United States Patent 11,001,841 (CCCTC-BINDING FACTOR (CTCF) RNA INTERACTOME) - sequence listing, part 45

SEQ ID NO: 106817 - DNA, 1151 bp, Homo sapiens
cctccctatgtacatttacatacataaacatgcatctgcaaccatttatttgtctacctgtgttaccaaaaatattgggtttatattgatacttccaatttcattcctaaatctcagggttctttctagcctcctacctttccatatttggaagttcctccaacagcaagaaacttgctctcatcctctatatattatttccttaatttactgttattaatcagtgtgatcagtttcccagctgttctgtctcttctgcccacaacccccgtgctctccaacatcttcagttttggggtgctgtcagatatgctactaccgtgtctttgtgaggaagctccccaacatccctcagtgcctgggtacttgatctccagtatgcatgctgccagtatcttcacaacacttcttctacccctcagcacttgtcctcacgtactaggggacctgtcactttttcactgaatatatggctacctggaataaattatttcccaacctcccttgtaactagttgtgggcgtgtgattttattatggctactggtagccagtatgaccatgaagtggaagccatatgttgacgaactgtgatcattatgaaattgcaactccagccctataactcaccttgggacttcatgtgagagaaacagaaacttctctctcttatgtaaagttttcaacgtattattttaattttttggtcccttaacagccaaaccgaattataactaatattgccccttctagacaagaaggaaatgaaaataattctgaattcagtcaggcagtaaagaaattcataaaggagtgtagcaccaaatttattgaggttacagtgaggggtttgaatttaaatctccctaaatcaagtgacacaatttatagaagtttgtaagaattacagctgagtgtaaagaattctattgcatgacatcaaggttctcaggcaattagaaagcaactgaaattcctaacaacaacaacaacactccaacaaaacaacattcacatggttaagtaaatgtaatagctttagccttacagagggtagctgacttctctctgccaaaatcagacagaatttggtaaaaacatgtagtagcacatcctgagggaaccccgggatgccatctttgagatcactct

SEQ ID NO: 106818 - DNA, 2057 bp, Homo sapiens
tggggattaggacttcaacaactgaattttcagaggtcctgagacacagttcaactcctaacatggacttagagtttttcttccttgtagccattatatagatatattttaaagatttaattttttagagaagttttaggttcataacaaaattgagaggaaggtacagagttcccatatacccctcccccgacaactgcacagcctcccccaataccaacatcccccaccagcatggtacattcattacgattgatgaacctacattgacacatcatcaggccaagttcataatttacattagggtttactcttggtgttgtacattctatgggtttggacaaatgtctaattatatatatttgtccttatagcattatacagagtagttttattgccctgaaaattctctgtgaaaaattctctgccattataatttttattggtaaaaattttgatgtcagtttcacaaagtttcacctctgataattttatttttttctttacagtaaacatatagatggtagtctggctctgtcctcaccaatatttcatcttgcattgaaatccgaattggagtcccctccctgtatggagggaggaatttggtgggaggtgattggatcatggcggtggtttcccctatgctgttctcatgatggtgagtgagttctcacaagatctgatggttttaaagtgtggcacttccttgtgctatctctctctcctgctaccttgtgaagaaggtatttgcttctccttcaccttctgccatgattgtaagtttcctgagacctccccagccatgcggaacagtgagtcagttaaacctctttcctttataaattacccagtctcaggtagtatatttatagcattgtgaaaacagactaatacaggtagttttcttactcgttcatactacaatcgaaaaagacctctgacctcttactctaccttctcatggttccttctgccacccttgtgcacgtatgttagctgtagaagggatttgtcataaaataaaaaataatgagatttagtcatgttttcagcaacgtagttaaggtattctttagagtaaatctattaatacattgtgatattatttgctcccacataaaaacttgatagttttaagagttgaaacctatatgaaagactaataaaatcaaggatttttattttttgtcacactgcttatcttgaatagggtcttgatatgtttcattttttattttttaacctcccagctgatgattttaataaaatagggcccttgggaattaacaaaattataccatatggtaagggtaaaaggatcattgatctggttaacaaaccagcctgagtttccaggggagcgaccctttctccagccctcctcagccttggacagttacattattgcttaacaatcatcatctgcttttagtggaactgcttatttttctccttggcttgggcagattgccccagtgtttcagatactgccttttggaaacggatcagtaggaaatttctattaccggaaatcatctgtttctgaaggagacaaactattcttttcaactcaactcactcttgtgaaacagaaagcccagcactttctcacagctgctctaagacagtccagcagggtaagaacagtgaggaatcaaatgtactacaagccaggtgggaccatagtccaccacggccaagcaagaaactggaatatccatgccacaaatgtggaaagtggggcatcttctttctagagagctaccgaggctgttcaaatttcaattttctctgtggcatgtaaaccgtatttttttttttttttttggtgtcaaagaatagaaaattagttttaattgtttcttatgaggcaccatatggctactctataattttggctttccatggagctgcatgtgcatatggaaaatgaaattaattggaaatcacaccctgaaatctattattaagttaatatagctaacagcttgtggggtgtcctcacactcagcatgatgtaattgcacataataataagtaactataaactcata

SEQ ID NO: 106819 - DNA, 1012 bp, Homo sapiens
ggttatacagttggggtaagactgaaataataaaataactacttttcacatagatatttccaaggcaccctgtagtgctacagtacattgatttaaaagaagactatattgtatttagtagagtttttattactaactctatataaatcaggaactatatagagtatatgtgactaaatcaaatagtttatgaaattatttgtgtggaatgacctttctcccctagacataatcctagtgaaatcaaggaacctgttttatttgcttccttatactcagcacctagtgcagtgaccagcacgtagcacatatttaatgtgtttccctgtcaaaatactatttaagttaagacttgattgagtctgttaggtaccagagtcactcactcattactttaatttcaaatgctacagtttgaaaacttaatgtatgcttggttgttaaaaaaaaaaaagcagtgggaagaatagaagttgtgttagaatacaaggtacattttattttcaccagaaaggaaaaatattgttctaagattataaatagcacgaaaggcttattttaattattttaaaaatatgatacctttccactgcagtacctggatttcaagctctgactcaggggtgtccagtcttttggcttccttgggccatagtggaagaagaattgtcttgggccacatataaaacacactaacaatagatagctcatgaactaaaaagaaaaaagtgcaaaaaaatctcataatgttttaagaaagttttcaaatttgtattgggccacatttaaagctgtcctgagctgcatgtggcctgtgggccacagattggacaagcttgctaactgttttgtatagaatctgaaacacagatgattaagacagggatgcatagtacctgcaggagaggattttatttagtaactcatgtccattttggtgaatgtagagtttatacctgtggcgttttgtttctaactagtttcactaatacagtttgccatgctgacatat

SEQ ID NO: 106820 - DNA, 1031 bp, Homo sapiens
catcctccaataagattccttatgccctttactgttaatcccattactcctgccagccccagcaaccattaatctgcattgtgtccctatagatttgtcttttctttaaatggaatgctacagcatgtggtctcttgtgtcgagcttccttcacttagtatcatatttttgaggttacttcatattgttgaatgtattaatagtttgttctttgtgttaccgaagagtattccattgtatagatacagcacattttgtccatttaccaattggtagatatttatgttgatttgaatttttggctatcacgattaatgctgctatgaacacttatgtccaagtctttatgtggaatgtatttttatttctcttgggtgctgtgatagacagaattctggccccaagacttttacccctagttttgtgcccttgaatatgtggtattacatggcaaaaaggactttgcagatgtagttgaggttactatgcagttgaccttaagatcaggagattatcctggattaactagatggacccagtatgatcacataagcccttaaaagcacaagaggaagtagaggaagtcagaagagaagtttagagaggtatagcagaaatcaaagacatttgaagcctgagaaggatttgatgtaccattgttggcttcaagatgagggccttgtgtcaaggaactggatacctcagtcttgtagctgcaaggaactgaattctgccactaactagtaaggtgggaagaagtctctaagctgcaaataagaatcatagttccagccagtagcttgattttagcttggtgagactctaaacagaaaatccagttacatcctgccagacttctgacctgcaaacactgtgagacaataaatgagcattgttttaagcctttacatttgtaataatctgccacgacagcaaaagtaaactaaaacaggtagatccccagcagtgaaattgctagatcttatggtaaattaagactttgagaaactgcagtggttttgagctcaagg

SEQ ID NO: 106821 - DNA, 1008 bp, Homo sapiens
agtgataatgccaggcaaacagagccgagtgtcaccagttctgtctcagcctctcagtcaccgagggaagctaggagacgtaatcatttttagctcagttccccattctgtaaaatgagttttatgacattttcttccctagttcactggaatagcattagaaaaatgaatggatgtggtgactgtttattggatgacatttgctgaatgtggctttttggtgttcaagactggatacattaataacagttttaattgttatctataacatggctgtctgatagtgatgatgatgatgaggaggagcaggaggaggatagtcgtggtggtgatgggtgaacagtaacagtaaatgggaggcagcttagggtactgactaagcccataggagtcagactatcttggttgagatccctttcatgtcaattactacttgtgtgaccttgaacaagttacttaaatctctgaacatagtaaatgtcacatttggaattggaacctccacctgtcccagtctgtgttcctaaccaccatactgtgctgctttaagccaaaagcaacgaactttggtctagagcatttcaaaaggtcatccaacagaacatataaaaatagaagaagccagcaacatccttaatcttctttatttagaatacttactttacttacttttaaaaaataccccataggatcatgaacatcagaccaattgggaagggtagattaattgactgcctaaggactgaaattggcacattagactctgctacaaaacttacctgtttctgatctctcgaaatcaatgaatctcattattattcatagctcttcctttaaaaaaaatgaaacacatcatttgcaaaaagaaaattttgtcccatgcagtctaggttgttccaggagcttactgagaaactacaacagccctctgaggttaactggtactattcactgaactctcaagtttctgccttgtgaatctggtggtgggaaatttggctgtagtaa

SEQ ID NO: 106822 - DNA, 1055 bp, Homo sapiens
ccatacaccatatgttcaaaatataaaatttcataaatgcatatataaatcaaggtaatgctgtatcaagtagactaaagtatatcccaaattgaataaaatgtcttgccctgacaaacataccttcagagtgacctgtaaggcctggcttccattttgcattcccggactttgtggagtttagtgcaggaacatgtagcacagggattagggattacctccccctagcctgtggttcctctttccgcccccagcttcactgtgcgttgtgaggtgcctcatgagtatgtgtgttcaggtccatccacctctcctgcacacagccaccccttgagcataggagtataattagaggacagcagatgcttcccttggaaggccccatcttgaaaagaggcccacaatgggccatttcggtagacttctggggaatgtgcatggcaggggatatataggctctggacaatcccttaggccttgaggacttatcacctcattccatggttaagtctaattatgaggccagtagtggggtatccaagatacaagttggattccattggattgtttggccacttcaatcacattattagtcagtttaatgaaaagcagtttgttccttcatttagcaggtattatgtacaggtacttggtgctggagatataactggagtaaggcatctcttgggagcggcttcgaattctagtgagagaagacagaaaaccatgtaaagacttacaatataatgttctcaagttagcaatgctatgaataatataaaagagggtagtgagatagtgatggaaaaataagggtgggaccaagggtcggagaagtcttccctgtggaaatgacattgtgatgcaagatgtgaatgctcaacagctgcaagaagatctaagggaagggcattccaagtgggtggatcacataggtgatggccaggtacttggtgacttcaagggacagaaagatgatcatggaggcatggcatcagggagtggaaggagatggggttagagggatgggcagggtcttagaggtcaccagagcc

SEQ ID NO: 106823 - DNA, 1126 bp, Homo sapiens
tgtaccacgtgcctctcatcctcctcggacttgtgggctaggtgtgggtatagttttcacaaggaagtggctggaatgcaagagagcaagcccaactgcaagtatgtttcaagctccttgttgcatcacatctgctaatatcccattgttggaatccaaagacaaggggtcagggcctctagtgggaagaactgcatagtcacttggaaaatggcatggatccagggagagatgaggaattggggctagtgatttctgcaatgacctgatcttatctatcttataaaaagttcaccatagtcgggggtgaccaactgctcttgattgctcaaaaatgaggagttccctgaacatgggactttcagtgctaaagctgagaaagcctaaggcaaaccaggatgagtcggtcaccctgtggactgtcctgtggtaaatagattaatggggctgcaggagaagtgagaaagagatcagctgtcattatggtcttccaagtgagagaagatggtggtgtgaatgagaggtttacacgggagatgtggtggagctgatgtctttgagatgtgttttggatggacagctcgggacttgttgatgtttgggatggggtagttgaagaaaggcattggggatgtgttagaccgattgaatatgctatttgctggatatacaattgaatgtgttatatgtgttagaccaattgaatatgcaaatattctatagggtaggataacaacttttagttgttaggcattggggatgtgttagaccaattaaatatgctatttgctggatacacaattgaatgtgctatatgtgttagaccaattgaatatgcaaatatcctatagggtagaataacaacttttagttattattgcgagaatataataacaagccactatttgcaaatacattatatattatagacatgtaatgtggtatctatctttaaaaccatgttaaagaaatcgatggaataaatgtggaggttgacgtatatccacctggacctatagtaatgtacacaaattgtatcagaagaatggttgtcactaacaaaggtcattttcctaatagccttcattggctacctaggctcaccatagtggtttgcttctatagt

SEQ ID NO: 106824 - DNA, 1068 bp, Homo sapiens
ggaagaggcaaaaactactttccctttctgactcattattaaatataatacatttaacaaacagagtttttttctgacccagaatagaaaccttgtccttaactttctttctttctcctggctctcatgaaaattatctttcaaaatgattggcaggaagttggcaattctagctttaaacagagaagtaataactgtgatcatcttactgtttgtatgtaaagctagttacttgtgttgaggggaagagagaggtgttttccgatggaagtgtagaaggctgctttctgagatagatcctatagacaacccgtcaagggatactactttaaataaaccaaaccactccttgccttttaggtcaggaaacttgtgggtacccacccagagttcatcaaactaaggaggttggatgttcatcaaccaagcctgtgagaatgatgtatacaccagaatgccaatggcacatttacaaaatggaatgattttctcatgactagaatgttcagatctgccatcctgatgtcttaggagacacattcatcttgttttacctttatgcaattcttttccttttcaagacaaagagcacatttcaacaaaaccttagactttcatttacttatgctctcatcaaatattgatctggtgtgtgtgctaggtggtagaaaatacaatggctgaaatgttttgaaaactcagtgtatctgtaataaacactgttaagtgtttatcctgctttatctcactgaatcctcatgtgcccttcctgagatatgccattgtcctaatccatagtttataaaataatcatctaagaggcccaggcacaatggagcttctcagagtgatagagaaacagtcagtggcctttgcttccaagcccaaagtccagggaccagggcctccagcgtccagagccatgttcatgaggttgcttaccttcgcttaggacgcagagccatctcttcacaccctctttctcccaaaggtcaattcaaaactccctatactgggcagactcccaccctggcactcctttcctgcttgaggcctggctgacgttct

SEQ ID NO: 106825 - DNA, 1046 bp, Homo sapiens
tatctcagctgtgtaattttttttctttcattcaacatcgaacaagctaagagatttgggagtctatttctctcaaattaaatgtgagccaagtattagagtttttttttttttttgtcttcaggcttttatttgagcaaatataccagtcacttcagcatggggcagaggaaacagatgggacgtggataacagggggaaaataacagtgctaaaggtatttgatgtgcaaaaatcaaattgttcccagaatcttcaggtgctagatgcagcactgaaaaacaactttacataaatatatattttctttataaatgatctgtccattagcatcataaacatgagaaaacctggatcccgttgagacactcttgctcagaatttcttactactgttccttgtttagtggattcagttttaactcactgtggcatacacagtcagctgtgcatgacgcagtcacaatttacctttcgctcattgtcctctctttatgcctgttacccagtgtgtggccacatcagtttccttcctgccttcgtccaaattctttctttcatagtgcaccttctaatatggtgaggatgactctggagttcgccttgaattcaaatcttgcatttgctccacgatagcttcacaaccctaggcaagttacttagcctctagaatcctcagtttcctcatctgtaaaatgggcttagtaataatgattcctaggagagccaggagagtgaaatgagatcatgctgtgtataaggtttagcagagttgtataccctaaagtttccaataatgggtagttaggatcattatcattgtcacgatctcccagtttttgtggctcatcttatcacctcttcagtgatgtctttgagaaggcactgtggtagtatttaagaaggtgggctctggaagagactgccttagtttgaagcatagtcccatcctttttagctgtgctgtaacttctcgaaggctccatttcctcatctgtaaaatgtgggatgtcagtagtgtctactcatgggtttggtgggaggaat

SEQ ID NO: 106826 - DNA, 1483 bp, Homo sapiens
cttttgctctgtcgccccggctggagttggggggtgcgatcttagctcactgcaatctctgcctcccaggttcaggcggttctcatgacttagcctcctgagtatctgggattacaggcgtgcaccaccatgcccagctaatttttatatttttaatagacacggggtttcgccatgttggccaggatggtctcgaactcctggcctcgagtgatcttcccactttgacctcccaaattgctggcctttgggaggccaagttgggaagattataggcctggccgacttgtttttttaaagctacctcattgagaatgggcaaagaagttatgttggcatgtggtctcattttccaggactttcccgtgaaatattttaccctgggggcctttgactcaccccattgtaaagtttggcagttttgaaagttcagagggtactttatgggctataaatgcagaaaaacagaaaaactttacctagggtaaatgacataggacctcactgctgtgatcgctctgtctgggtggattgccccttttaaagaaatcttaaacataattagacaaatcttttctgattatcaaaggaacatgctcattattttgatattggaaaatacagaaaattacaaaaaagtaaaaaataagtaaaaaatatcttctaatctcattacttagaggaagcctgtgctaatattaacatattttctttcatttttgttttgcacacatgcattcagcaatattaatttctgtgtacatatgtatatgacatcattgagagagaatgagcttgtttataaatttggtgaggtactaagtacagttttgtttataatttttgttttaaaattctatattataaaatgaacattgtctaaatattaaatttttttccaaaatattattttaaggttttatgataatctctagattgactgtgttatttcctcttgtggttatttttggattgtttttctctgtattggcatattaggtagtgctagcttctgaagcacatgagctgccccattctcagtagcctggtgcaagaagaagttatttcctattcacatacaaatctagcatgatgttcttggtctgccacaggaacccaggctccttttgtttttcactctgctgtcttccacacatggctcccaaagatgacctggaaagtatgcccattccagccactcaaaaggcaaaaaaaccatggaggattgcatgtagaaatttgcatggactgtgtcatttcagctaaaagtaattgcaagatctcaaccaacttcaagggtggctgggaaatacagtttcaatccatgcttaggaaaaagaagaaatgggtttggtgatcatgtagtggtctcttctgaaagtagtgtttagaatcttgaaaatctttgtctctttgcttcaaggcttagaagaaacacaggctatacagtcagaacagagctcccatcccagccctactttga

SEQ ID NO: 106827 - DNA, 1002 bp, Homo sapiens
attgactactgattgatatgtactattaatcccatagtcaattaaatacattgcaagcctccttgattgttgtggctttgtcctatgacatgtggttaggatcttgcaaaaagatcttaatatcctttttattgagatgacggtcatttttgtcttataatgacagacaaggataacattgatttttgtgaagtaagttttccttttaccaacatatcagctgcccattattttgactttggagtcaataatataaagctgctcctagggtaatggcatatgtggtccatgagaggttgaagcggtatctgctttctaggaataacagtggtgtcctcaccagacagatggttcctgtggtgtgatttgattgtgtgcctgcctgctgttggcctctttggttccttcccattttttaagtctgattgtcctgccttcttggtgattatgtgagcctcccaatttctttttcgtaatttagttcatgcttatttgagctagagttaatttctgttgcttgctgctaagaacctggtctcatgcagatagagtgcttctcataggtcctcagaggcagtaggtgctcacgaataaatattgttattcagaaaatgttcacttgctcatgctcgcttgcaaatgctccttaaaggagcacctgaatttaaattaatggttttccctaactgtatttataaagaggatatcccattcaacaagttgtagcttttaatgacattttctattgtatgtatttttgcaaagagatcccccttttataaaatgttcttttttcttcttcctaagtctgcaaatataaatggtcttctctggtcatctccttagaatttctctgtgctagaatatcttttccctaagtgtcttgtggtattcactgaataccactctgcaggagacctgcagagtgaagggcgagatcaaggcgggttgtgggcaggcaggctttatgggagtgtacatgtagcttcctttcagttttct

SEQ ID NO: 106828 - DNA, 1124 bp, Homo sapiens
gatattattggataaaatgtaaggaatttatttgttcatgttattgtgtcctttgactgtgtccttttaacacagataaacacgtagtgcatattggaaaaccacttctacttgaaacttaagcaaatttcctttaatacacaagttgcagtttaggaactagtttaattaatagtcagtctttcaggttattgcactcaaccttggtggatgaaagagataatctcgttaaacacacaatggccctacccagactctgttaaaaactgtggtaaagaaatgaattagtctgtggcccagtgacttcagagtgtttaaacaaatttcctgaaaaaccttacaatgattaacagtctatatacagttattaaaataatgctatgctctttatttatttggggtgagaaggggggagccatatccatgtaatagagtccttaacagtttttaaaataacttatgttgaaatacttgtagactcaaaggaagttgcaaaaatagtatagcagccccatgtactcttcatccagcttcccctaatgctgacacctcatgtagttgtggtacaatatcaaaagcaagacattgatatttgtgtattactgttaactagatcacagagctcactcagctttcagcatttttaaaaaacctgcattcatttgtgtgtgtgtagttgtccttaacagtttttgttaaaaaataattaggcatgaatttaagtgggttttttttttcttttgcttctctcaactctgggttgcagattgccagtcaacagtacctctaagactggccatgtaggttgacttttatttttcttgctattaatgaatgttcttacctctctccttcaatttctgtaggcagttcaattaacctccagaagatggctgaacctgcaggaataccagagcaagaaactgatgtctgacaacggagtgagagttcaaagattctttgtagcagacactgcaaatgaagctctcgaggctgctaagagactaagtaagctgattcataatgggtgaaatacacttgcccaaatcagtgaattcacaggtagtggcttcccactagttaattttttttgttgtggattaaactgacagggacagatacag

SEQ ID NO: 106829 - DNA, 1063 bp, Homo sapiens
gagtctcactctggcacccaagctggagtgcagtggcacaatcatagctcactgcagcctcagccttccaggctcaagttgtcctccagcctcagccacccaattagctggtactgtgggcatgcactaccacatccagctaatgttttcactttctgtagaggcagggtctcactatgttgcccaggctagtcttgaactactgggctcaagcaatcctcctgcctccgcctctcaagatgttgggattacaggtgtgaaccactgcgcctgcccacacccagctacaaattcttaataagtggagttgtcttgaagttttagagccagtcagggccctagttttccaagttttggattgacaaaaataggtgattattctgtaaaagaattcctttgtggagtgatagccgggtgtcatcagtggatttggaactgtgctcattgtcctggttttcaatttaagagcaacagacttcaagctggctttcatttgagtcagtgtggaaacagtcaatatatgttacatgtctgtgaagctggcctctggatcaattgcaattagtttccagcagattgcattaacatatctaaaattaatatggcgagtgttctgatgaaaaggaattgaccacaaccacattgtggctgtttttagtctccctcaaatgctcttttcaaactatattttttctttctttggttaatggctttaaattgttatgtcaacgtagacataatctattgattgttcctatttgccttttaagagtggtcctagataatagcacacagctaatgtttaatgttttctttcactaaggggctttttcgctaaatgccttaaactcgtatttttctttgtatgttatataacacgctattaagactataaagcctttgagtatgttcatttacagaattttgtgtttttcaaattactaatgtttcatcaagacttaaaaagtaagattaagaaataatgtgtagttaaaaaataatatacggtaaatgatgtgagcattgcttgtctgacaatttatttttatcccagtattattta

SEQ ID NO: 106830 - DNA, 1027 bp, Homo sapiens
gaaagaaagggtgctctctgcaatgttatatttttctttaaaagcatctaagatcaagttttccatagcagtagtattttattcatcaacaagaatgaaatgtctttctaaacacaaatagtggacttcagacctcacagacaccaattatcattctgcacagagaacattcaaaatgtcagatgatctcaggaatttccccagcgaaggtcgctcatttcctactctacaagtcatttctttggcaagccagtgtgacaggcaaacttgtgagattgagttagctaggtcactcaaaactgccgctataaagaagtgatgagaagtctcttgctatcaggtaaatcccattaaactcaaatgtatcctaaactattaagcactattagatccttagaaggagcaggagtgggttgattgaataaagtctgtcccttgcaagctttcatctggatttattggaaaggactgtggggagtaatttaaggagggctaacaaattgctaactgcagggtgtggagatggtagcagggccctgtgagacagtcaaatctgatgcattgagatgacatgtttgacccctggtaatggtgatggtgaatgtgcacgtaggttctttagggtttacaaagcaccttcacgtacattatcccagccaccctggaagctggtgttttgctaatatctctgctttacccgcttagtgtgcaagctcatttgaggtagagatcttgaaaaacactgctgttgttcctctcacactggtgatgtgtttgggccacatggttgaataaaaatatctagtactttcccttctctgagtattgtaaaggatctgctctgatggtgtagttgggcgggttttaatgaataatgaatagccccagaacaagattttttcccctttttgaaaatttaaagaatgatcccatggcctagtattgtactctttttaatgttttcttttctttcttattttttgtttcttaagatggagtctcactctgtcatccaggctggagtgca

SEQ ID NO: 106831 - DNA, 1075 bp, Homo sapiens
cagatctcatgagacttactatcatgaaaacagcatgggaaaaacccacccccatgattcagttacctcccattggtaattatggaggctacagttctaggtgagatttgagtggggacagagccaaaccatatcagttccatgtccactcaccaaaaagtcctgtggtcagctagacacccttctcttcgatggaagtttgctttctatctgtggttacttaaacataccctctgggtgtctcatccactcatcccaaatagtgtatcaaaatattccttacaattgcatataggggtaaatctacctttgaccatcttatacattcatactcgccttcattcaataaaaaactaaatcgaatgcctacaatgtctcatgcagtgttctgggcacggggcactcatcagtgaacaaaacaagtgattgccctgtggagctgctctagccatatacatatataaaattagtacacataagaaagtatgaaacagggaagtatttactaaatttctatgtatttatatatgtcttcctattcctgcttttatcatttggggtccagttagaaagatagagactatgcccattattttaacagataaaatttaacatagagaattgagtaaagaagtattggaggactagaagggcaaaaaactccaaaaaaaaccaccactaactaaaacagagattataacttgcaggaggcagtgtcccccacccccaacccaagataaaaggaagaggttgaagctctctaagaacttgggaacttggaacataggtcctgcagagctgggatctagagttttcggaaaggctgctgcttggctggtttcagtggctccaaggctggtcagggagtgctggtagcacctgtaaactggaaccagctagtcttgaaaccagctccttttgccaggatgaggagctgtggggccaggggctatggtgacaaaacattagaaaggagcagatatcatctctatctgccagccctttagtctccctatagtgtgccccatatgggcagaccctaataggaagccagatggcgaaagagaaagtaatt

SEQ ID NO: 106832 - DNA, 2180 bp, Homo sapiens
ttattgaacatagacattgacaggaagcattgttctttaactggcatttactacaactaggtattttcctggcatttcattatggaatttttatttaatttcatccaaacctggggagcaaatcactgtaattatgcctgttacattattttataggctatagaacatgaagaaatcaaatacagaatgaaggagtcagggtataataactctgacttttggtttagaacttggtgtttgaaaacatgcagaccttggtttgctttttctgtatttgaaaggtttgacctctgtgtaaatgactttactacagaaactgattgcagtgtactacattgtttatgaatattgatataataaatatttaatggatacattttgctagtaagtacttcatctagcataaaattagagaaattttacttgagacagtctgcaaaacagcccaaaaaaataatcatgtccttttgaataaccttaaaaacattttacttttcgttattaatttgttcttgattttgttttctggcttaagcacattaattaaaaaatgcactacctgtaccttcatcctcctacacttgtggattctagcgatgagaatggtgaaaagcaccgttggacaagctcagatttatatctcaatatgaaggattataaaatatctttgtacatgttagctaaatctgtgaaagatcaaatgagttctttgcttgacagtgtagatgattatggtgatgtgatagttataatgaaagcatttgttgagtgtgtactttgtgttaggtactgtaatgtatcctcaaaagcaggatctcattgattacacatgataacctggcagcaaagtgattaaggtcatagactctagaagttaggtttgtatccttgtgaccttggaaacatgtgttaatctttctgtgcctccgttttccatctgcaattggagatcaccctttacctaccttatgatttcaaaagcaatacgctgaaacagtgccccattccctggtcagcttgtattattaataagtggttgtggtcattatcatagtggggccagggctcaaacaagtccgtgatccagtgtccatgatcttaaccacatcactgtatgcttgagcatcactggtgctcaagcatgccacctgacacatagtagatgctcattaaaaaatgagctttgggccaggcactgtggctcacatctttaatctcagtactttgggagggcaaggcgggcagatcactcgaggtcacccattcaagaccagtctggccaacatgatgaaaccccgcttctactaaaaatacaaaaattagctgggtgtggtggtgcgtgcctgtagtcccagctacttgggagactgagacacgagaattgcttgaacccaagaaggggaggctacagtgagcagagatcgcaccagtgcactccagtctaggcgacagagtgaaactgtgtctaaaaaaaaatgaactctggattttccctgtagaatttgtgcttgaactggcttatttgtctatttatttgtacataatatatggctcaatgcagagagaaactttttagctttgaagtcttagagataaatgatgatgggcatatgggctgaaatctgtattattctggaaacacgattactgaactgttagccctgggaagtgcctgaccttgtctaataatttgttgtcacaggaaccattattatttgtctgctatgaaggcaagtcagtggccccagttttagatcgagggtcattgtgtccttgggctttgtatctaattaattaattatcattcaacaaatactaaagaagcaccaggtctgtcccaggcatgggaaatgcattggtgaatgcatgagacatggtttgtgcctttgagaccatcatagtctcatgggacgtggcagacactgacaaatcacccacatgtataattacacattgagaggtgttatgaggtaaaatgagaggtcagtaaactttttctgtagatgaccacgtagtaaatactttatttttttattttttttgaaacggagtctcactctgttgcctaggctggagtgtagtggtgtgatctcagctcactgcagcctctgcctcccaggttcaaacgattcctatgcctcagcctcccgagtagctgggattacaggcgtatccaccac

SEQ ID NO: 106833 - DNA, 1037 bp, Homo sapiens
cctcatctagggtaatacctcttcagggctttttgtgatgtttaagtatcaatatcattgacttcacatttttcttctaaatctattcactattaaaaatatttaaatccacatttgagcccctccataagtaatagtgtccatgaaagtatgggcttggtaaattactgatacatatacatttttttcgaatgtacattacaataaattacacagaagaaagccttgacagagctttctttaaaaacatgccaggaactattatccgttaactgaagccagctcttcttttctctggacacatggctgtactggatctcccagcttgccttgcagctggacaaggccacggaatagctctagatagttaatctagataatttttttttcttattttcttaaacttctatgagggaggaagttcttcctataaccttcccattagacttcctctaggttatcactgctggggattaggtcatatgctcattgctgagccagttattggcaaaaattggaaatctccattattggctaagctgctgaatagtttagaaaaagatactggcgagtcacttacaacatccgctacaattgggttactgcttagtgaccaagataggatttgaacacccacctgtcagactcccaagtctacgtgatttcttctgtgccttacagcctttctaaatctgtctgcttgctataaaggctttccattgaattgatttatttctggaattagactttgatgaccagtaattccaaattatgttcgattgtccacttgctggctttctttatccaccaaacttgcctgtctctcagctgtagggcatctcctgatccatggagctcctaggtaaggcaaaagaactgtgtttgcattcagctgtgtgctgccctatagcagtatgaacagcttcacactgtcaactaggaggtgaaatgccaagtgtagctacaatctggaaatgtgttgatgtatatcagcttggaaacaatgcagggggcaggttttgggcctttgcagtgga

SEQ ID NO: 106834 - DNA, 2914 bp, Homo sapiens
gaggtggatagcagaagttgagggacaatggcacttttgggtatacaaagaagtctaaatggggcttcagaaagcccagaattcagcagggaataaaattaacccccacaactgaaaaatcaaacaaatatcatttatgtagcaaatattttctgaatgcttattacagctcattctttatagaatgttgggcagataaatatgactgagtgaatgcagacaggaataagaaacacagctcctaccttcagagggcacagaggtacaactggcctataaacctgtagttatactaaaacatagtgggtactgcaattgagctgtgttcttagccttctaagatactgttggcctctgtcaaccacttaccctgtgtctgcagaactattccctctgatcattcattgcctgatctctgtcttcatcagctttctgattcaacgttgattcttcagataggctttttcctaattaccttacccagccctgcctttccagggattattctctgtacccttatctgctttgttctttataacacttgactgtacctggtagtgttatttgttcattggccgtcttccccgctctcctacaagtttaagaatgtaagctccacaaaggcaaagtgatacagcttaatgtaacagcgtgagtgattccccagctggccggagttggtattcagtaagcatttgtggtctcagtcaatgagtagggtgcacagagaagggagagggaggtaaggaacaggagaagttgagggatgatgtggctcatttcagcaaatgaggaagaaggaaggggctatagaaatcctagttgtgaaagggtcctcataatcatagaactgttccttgggcatgtagtatataacaaggctgcgtgaagtaatctccacacattatttctttaacccttacaacatcactgcaggggagatttcacagtctccatgttttatagaagcagtcagaggcatagagaggccctatagtcatttgcttaaaatcacagtgccagggagtcacccgcctcatgctgataaaggacttatgctgttaaattattaagctctgtcactgaaagatcctagttgggctgaactaggcagttaaactgattgcttacctttccccatctttttgcccttgagtgacactcgcctttggtcatttggacttgtgctgatgaaggtgtgctgatcaacttggcatggttgccctttctggactcttatccaccttcctctctctctggcttcagggtcttgtcaacagagtagtagggagattaaagacacgaagtctgggttcaaattcaacggagttcaaattcttatgggatctcccatgttctttctctgcaacctggagcaaattattgaacctgactgagcctcaatttactgttacttgaaaaggggatcatttgcacagatagttacaaagattaaataagatgatatttaagacatttggcatatgacccgatggtgggcccaggatgattatttctcttgcactgaatttgaagctaaattcgctggtctttttaaaaggctttattgagctagaataattttgctttcccagattcagtaagcatttatcatgtgctgccatctcaggattagtcactggcttggtgcttccatacattttatttcacttcatccttgcagtagccatgtgaaataggagttattgttcccagcttacttctggggaatctgaggctcagaggggtgaagatctgcctcccgggctctgattatcttcaggattccacagttgggatgaatgtctggtgaggcctgaggtggcagtggggaggagctcatggggagcttaattgtaccatcctggttattactcatttcacaaacatttacatgtctcagtgttgacttagtagtgacgactgctggacctcgtgcatcaaagatttgaggtgagggaacacttaaagaattggcagtagccacagcatgaaccaacggccaactggacatgactttcactgtgtgcttagcacaaactactgccctcagcgtttcaagaatgctggagaaattgtgaaatgtcattgcctttgcagagtgggctttgggggatggtgttggaggatggagtttcctggtattctgggttcagactttgaccagtgtactgagtatggtcagcttttaccctttctagaaatgattccaaaagaataggacttaggcagtagccataaatgcatagatttctaacatttacctttgaattttatttttattttaaaattcgagggatttgacataatatatgaattgttaatggagacatggcaaagcacaaggcatggtttgtgtaagtttgggtcctgtgggttggagtggggggactagcatcttttttctgctcccatccatttctccctgtgcttgctgtatttccatttgtgggctgtcttagtcccagagttgtgacttgagagccctaaggaggttcaggagggctgccttgtagagtttacggtgagaaatgaggccagagacaagagcaaggacaagatcgctgatcctggtaggcctggtaatgaagctaagcttgttcttgaggagggcaatagggagccattgaagggttttagacagtgaagtggcaagggcagtttaatgcgtagagtactctttctggatatagtgtggagagggttggagaaatgcaagaatggagatcatttgggcgactttggcatcgattcaatgctgtgagtcattatgccaggatactagacgtacaccgtgagtggaatcagactgcccgggtttaactcttgccttcagcactccatagctttgtgatcttgtgacaattacttatatttctttgtaagataccttttttttttctttttcacattt

SEQ ID NO: 106835 - DNA, 1141 bp, Homo sapiens
taaacacagacacaaataaactctaagtaaaaggatagaaaatgatacacactattcaaatagtaagcttaaaaagagggactggaaggaaggacatggtgagagaacaatttgaagagtgccgaagcgtggaagtgtcttctgcccaaaaggcatggtctgaaggtggaactaactatgcctggcagtctttaacctcgggatgctattggggtatccctgagtcctactgatacttcttctcttttcatgctttgagggtcaagaaaacaagaaaactcttacaccatcaacagcatcctcatgaagatccagccaaatttggtgcaaacagagcagaacctgaccctgtagtgcatcatagatgccagcaccaccttgtacatcaagcctcagcacctggtgcttttttagaaggatggcacaacatttttacttctccctaggcaacatagaagtatttttcatttctcaggcttgggtctatgactcagggaaatagaagtacattttggttcagaacaacaaggagaaaaccacgccagagtaccaggtgttagtgaaaggagtggtcagttccagagcaatgcaggacaagaaggaggtgatagaaggcaaagtcttgatggtgaattgttctattccagaggtaaagtcccaacatacttcacagctgaaaaacttgaactagaaacaaaaagagtcaagcaaaaaagagagaatacttctcagaaccagaattttgtgatgctggaattccccaaatgagaagcaagaccatgctttaatattccaatgttaagctatgatcgtttctgggatctgggtggtgaccttggaatccaccagaagtcacctggccaccacggggggtcagagtcctgctctccttttcaccatttttttttttttggtggtttccttgtttggtatgaggagaaagagcccaaaattggaaaggggctggggctttctggatggatttctgttctcaggacttaagacctgttattaatcactttaacaatttatatcggtatttttcaaattatttgactgtgaaatatatatatatatatatataaaatctatatgtcctaaacaaaagttttataaacaatacttgcctttaatgcacatg

SEQ ID NO: 106836 - DNA, 1130 bp, Homo sapiens
ggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagatcattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagataagactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgac

SEQ ID NO: 106837 - DNA, 1049 bp, Homo sapiens
gagttctgttaaacaataaacagaactagcaaggtcattttctacctgaccaaaggaaaacttcgcagcaaggagacatgaattaagaaacaggttaagtgtctcagggggaggaagggattcaagtttttcagagctgctcaagcagatatttgcaatgaaatgtgaatattatcaatgatttattgtcagtgatacataatttttccacagaaaatttgttcaaggcctgggttgaagcaaagctctcaaagtggtggctgataggtaatgtaggcccacagatatgttttgtttggctcagattatgtttaataactgttttttgaattggttgcattgtgtgaaaatcacaagatttgacataataatcctaaattggcacaacactgaaataataacagattatttcttttttttttgtagcagtcctctgcagctggcttctggctgccccccagctccccaccccaactcttgcagatgggacatttttcattctctatgtcaccctcaggcctgtctctgtcatttacattgaccccttgaaactgcaagtgaatttgagaactttgactcagatattccagaatgaagaaaaaaataattagattatatttcaaatttcaagtttctttgtcaccttagaacacagtggttaagagtttgggctctagggtcaaaatagccagggatcaagtgctggttctgcacagactagctgtgtgacgttacacaggttacttaacctctctgaacactagtttcctcagttaaaaggggacaacagtgtacctacatttttatgtgtagaattccacttgcatctatgtgaatgcatacgccttaaagacacacacacacacacacacacacacacacacacgtcacttggaatagtacctagtacatgctaacctgtcaaatatttttatattcggttgaaaaaaaattttcaattggtcaaaaaggaaaattggtaagtaaagtgatgatttctcttccttttcccatcaattgggaaaagcaagtaacattttgctttacat

SEQ ID NO: 106838 - DNA, 1052 bp, Homo sapiens
agaggtgtgtcttcttccccaaagtcaaacagttacagattttggaaaagtctcctttgctctggaaagtcttatttgttgtttagaaagcatttgcaagaaatagtgggaggcttgtctttcaagtggcactttcaaaggctggttggatttgagctagagaaatgaacatgtgaacatgttgctgttttctgccctccctgcaagtgtcctgtggtcattttacaggcttttcaagtaagtgttgccccgtggaggacagtgatttctaactatgcatagtctatatgtttgagctgttgccggctaaacatatccaataggaaataatacccaaattgaaagggagagagcagctattaatatgaattacttgtctagttagttgctttcaggataccatctagaaattggaaacattcacagaatggctaggtcagcatttttctggcccagggtgtgtgtgtgtgtgtgtgtgtgtgtgtgtgtgtgtgtgtatgtctgcgtgtgtctgtctgttgtgtgtgtgtctgtgtctgtttctatttgtcttctcctggaaaacaagtatgacgttgtttgatctctccaggtgagagcaaggttgttagcctctcctaccttatgttgtactgatctggaatttgttttctaatgagcctgatgcatgcctcataggtgtgtgacacatcagaacctggattgtttctataagtcactgagacctaagtttgaaccctactaattttagaatttgtaatggaatgtgtgatgaaagatcagccttgagatgatacggctgatatttacccatgctgtctatgaaaagggatttgctaagcaaataaatggtgtaaatatatttaccaaggagctgttcacgttatcttaaaaaatcgtcaagtgctttggaagcatttatttaacatgaagtcaaaatgcttgtgccttctctctgcaaagtcctacctatgtgaccctgggcaaagttatttaatctctctgagcctcagtttcttcttcctggaagtgagtattacaacatcccctac

SEQ ID NO: 106839 - DNA, 1049 bp, Homo sapiens
gatttgcccagggcatacttttaactcagtggttggtttatggagacatgaccttccctctcataataattctgctgttggcactgtgctccattttaggtcttgagacactaatagcagttactgttacctgtttccccccattatgtctaaatatctgggttctatggtttcattttaaaagtgatttgactctgtatttaaataggaggctatttaggaaaaaagttgtcatgaacttccaatgccctgcaaaacatttcaaaaatatatatgatatatgtagagaaatagccagataatggattctatctctgtcatttctcttatagagagagaaggaaggatggaagaaaggagagagaagggagagaaatgtaactgagaaaactcaagccttatagtctaatggacctgggttctacttttgcatccttcactatttagttatatgaccttggaagtgttacctatcccccttgcctctttcatacatttaaagacagaggtattataaggtcatgccaagtccataggcagcaggccctattgaataaggtcaattctctccattccatgaccctattttgttttttaaaagttaagttcatttagttcagagaatatttttacattctcttcctcagtcttgtttactgtcttcctcagtcttgtttacaaccttttgcaaggacatatttgggagctgcattttattttcgcagagttgttgatttggaaaaaaccttggacaaaagcctcatgttgtgacacccttgtgtccttaggtacaactgtgaagatgaacgctgttacttagacttggccaggctgagaggcgttcactacatcacttggcgacggcagaacaaagtctttcctcaggataaggtaaagttcaatcacaaaacttaccttgcttcatttttaattggtttaaagtatccaattattgatatgaaaaatggttattgaacttcagtgctgcaaagataaactgttctctggaatactgaattgttttattttatatttgcaaataggagaaa

SEQ ID NO: 106840 - DNA, 1014 bp, Homo sapiens
cctcggcctcccaaagtgctgggattacagctgtgagccaccgcacccagccagtgttaaaactttgaacccattttcttgctctgaaatttttttccaaagatttttcattcaccctgatggtttttgcacactgagcataagagtgtgtgtaaacggtggcatagtgtgtgttgtgtgtatctataatttggataagatgttcacaggaaaaagccctgaactacaaagatgtgagaataaaagaagttaaggtagaaaaatgaaacactattaatggctaagagtataattgtgataattatttctgatgatatttcatcaaattaggcatttgctctggcccaagatgaagatccattttgcttgtatggattttatgaacttgcgtaggattgttagtttttaacacaggcaaattcaggtattttgttgcatctttgaaaagtcatgttatatccttttattgccctaaaaccttgttttgtttctactttcagagttcttacggatatggtgacctattctccgacacatggaatgcatttactgattatgacgttatacatttgaaaacttatgattccaaaagggtactggaaattttcctgaaatgtctgtgaatatttcttgagtgcagatgactcactcataaaataaacatttattatgagttcctattagccattaccactgatttctgaatttctgaatttcttttataattagaatcctcagtgttgttaatcatgcagcctttgaaaagttttttctataatctttccaaaaatatgaattctgttctctttgaatgaaatagtgtgctattcaagcaatgcaaaatggagattaattaaaatctatttctcaaaattatacgtgctatttttggtgtgaagggtgcaaattacatcttcttttaatgtatctttgttcttaggtatgttttaaagaagctgttttttcattactcccccgcatgaggtatgggctgttctataatactcctctggt

SEQ ID NO: 106841 - DNA, 1026 bp, Homo sapiens
gcatggtggcacatgccaccatagcaagaccccacccctgattaaaaaaataaataaagtcagaagaaataatggtttgtcttcatggccctgtagttctactcagttttgagttaaatagacctaccttgtttttttctgggaacttaatgatcacttgttacttgggatatatgggaaaatgcattcctgattttaaataaccaattttagagtgacttttgaaacccaggcagtccataaattgaggactacctatgtatctagatcatttcatgtttggaaaaacaaaacagttatttttttccccatttatttaaactaaaattctcttaaactgtaaatagatgggatagaataaaacttgcttgatcatgtgctctttggtgttaattaatgtagtttcattttccaacactaggtgttaacatgtatcaccacttctgtgatttcatcaatctttatattactcagcacgttaataactcattcagtactgacgtgtacatcgtgatgtgggacaccgtaagtaagaatgtgctctccgcttcagtactgtctttcccttgtatcagtgtgtgactctgatgttgtgaaacagaattttcaaagacacatatatttcaacatgtacagccgcacataatgcggatgggtgcgaatgtatctgtacatatatgtgttgacatgtgcatatacgtataggcagataggtatgtatgtgtgtaccttcattctttgaattttagaatgaggcagtggggaaggtttctttctctttctgggtgggtggagctccaaaggccagagattcagtgactttggcttagtgttcctctgggacacacatatgaaagactgccattcagcagggcgtggtggctcacgcctataatcacagcactttgggaggccgaggcaggtggatcatttgaggccaggagttcgagactagcctggccaacatggtgaaatcttgtttctactaaaaatacaaaaattagccagatacggtggcagacacat

SEQ ID NO: 106842 - DNA, 1189 bp, Homo sapiens
aagaggtggtttggggtagtaaatacaagagcaggctctcaactacaattcagatcctgagtcttagacaaggtacttaggctttccttgtttcaatttcctctgccttaaagccatgcccattatgtagcatatggtaaggaagaaatgaggttctgcagataaaaatgctcagtgcagcagggcctggttcccggccaagggctcagcattattttttaaaggttgatgaagttgtaagcacttacgattaaggtacactgttcaatgatcctgaaccctgagtctctgacatctcaggggtctccgatctccaaccacactggagaactaaaaaaattttttaatttactcacattcaaaaactgagtatatactttatagagctattggagggtgtcacgtaatagagctttgagcattctagcaaggtgaatgaggcctcaggatgtgaggcatgccattaaactgcacggccgcagggtgtctttaacagagttctgttctgtcttgcacatttggctcaagtctagctgttcacatggaaagggcaagataataatgacaacccctatcttgcactcctctttcaaggtggcttgtagaatgttcttttgattaagatttaccttgatttgctttgtgctagcagagtatgatccttgtcttagttgtttgggctgttataacaaaataccatagactgggtagcttctaaacaatatcatcacattgggggttagaatttcaacatatgaatttggcagagacacggacattcagtccattgcaatattttaccaactacagactccaaaacaccatgcaggtcaagattgagactttgtgttcattgggagttttgggaaaaacaattaaaatggcatttaaatctataaataaaacccagagcagataaaagtttttgaagttctgagcataacccagattggttgaaatagaatcaggctctggtagctgactcttcgactcctttcttcaattatttagaaaatattgccctcatgttgctgttgagacagaggctcccacaagctttacggtttgcagaaagcacctcttattaaaactggcaaacttccctccctgcttttaatgtctcttacatgtgcatttttccttgtttcttttggcttttggaagctgctttttcatatagctgtggggg

SEQ ID NO: 106843 - DNA, 2968 bp, Homo sapiens
ttgtatagctggtatgctatacagggacctaattaatttctttggtagtgatgaaagcctctgtcgatacaacctacacaggtggggctacgttaaagtatatttttatttctctgggttcttgtagtaatttagaataactgaaatatatgtcatttccttagattagaaaaatatatggttgaatgttttcaaacaaataattggatttatctctgttgcacagtaaaccttataaacggtatacctctcaggaaagttgggaccgtttttctgccactgtttcctttacttaagaaagagctagctcaaggttatatgttgacatgtctatttcaaaaaaaaaaaaaaaaccacacacacattaaatatttttatattactgggagtattaaaaaagatatgttttgatttaaactattttgtggtaatgcttctcagctagaaattggcaatctagaaaaaactcgatcaataatggctgaagaactagttaaattaacaaatcaaaatgatgaacttgaagagaaggtgaaggagatacccaaacttagaactcagctaagagtaagtattcttcacctaaggatgagtctaagatattttagttcatttactttaaatctcatgtttttaatttatagtatgtgttagtgatttatttgaaaattaaagagtactaatatttgagcaaagaagtttaaaaatgaatcttttatcttgcttgtatctttacatattcaaagtaattttcacaatcatgtttagtcccagtataggaaaagaactagatttcatttggctacacttcatttataacattgaactttgtatgatcttagtaatattttgttgattgttgttatatgtatcatcacaattgtctcatctggatgttagaagacactgttaagccataagtgagaatatgttttcttttgatctttcctgtggtgtgggctaaatgccgggtaatacttataccaccatggaacaaagagactaaattttatatcaagtgtgcttacattaatgggagagaagtcatatatggggagaattgtagatttagtggagagatagggtaaaattgatagccatctagcttggtttttttctttaattcctttttttgctatttagttcaacatagactgaagtgtgagtttaatttttaaaagagatgagtatatacttttatttaaattgtagtgttttcattgttgactcctatggcaatataaatattaaagatgttctgtgtagttattttaaaaattgtaaacaaatacatttttcaggatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgggatttactgtagagtgtaaaaatttttttaaaattgttttacactatgtagtaatatttacagttaaattattttgtgcaatatttgaactttatttttgaaactattctttaaagatttattttttaaagcattcattttttttccttgaatagcacagagatttattactttatcctcatataaatatggctagagaagaagaatggtgttcatatatgtattgtagatatacaactagttgtatctataatttgtaagtgtttatatatatattaagaacatttgaagagtaatgttaacatactgaaactttgaaatctttcacatttaaaatttcaacatatcttaattactgctcatgaaaatgtacattaagtgttaaagtaaaaaattattaaatctgtggctattaaattttaaactaatttttttcctttaaaagtaagagtcacactgacactgtctgaaatttaaagagtgaatgatttaaacttaaaaaaaattttgatctgaaaatttatttcacccagctttcacaattaagtctgtataaaatgtggtaccttttggtacctatccagagaaacctgtacatattcaatgttatctagatgtgattggataatggagaaaatttatttataatgattttgcaatggcatcaataacatttaaatgattttgaagaagtattattttactaccctataaaatgaatcgaaaataataaagttcttaacataatttactctttaaaaattacctgttcatattttgtaaacccatatttttagcacattaaaaatgaatgtttgatattacagaatattcataacaaaatggaagaattataggaattaacttgaatttggcatttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaaccccatctctactaaaaatacaaaaattagcctggcgtggtggtgtgcgcctgtaatcctagctactcgggaggctgaggcaggagcattgcttgaacctgggaggtggaggttacaatgagccaagattgtgccactgcactccagcatgggtgacagagaaagactccgtctcaaaaaaaaaaaaacaaactcttatttaatttttagttaaaattaa

SEQ ID NO: 106844 - DNA, 1022 bp, Homo sapiens
gtgaaactcagatgggatctggaacacactgttggaaaatcactgatgtcaagctggtaataaaaatgatttctcaatatgtagctggagttaataaagtactgagtttttaatagtctatactagcatctttttcattttctgtttttttaaattctgccttgtttaataggtaccaggttgaattggaaaacctaaaagatgaatatgtaagaacacttgaagagacgaggaaagaaaaggtatttctcttcgtgaccactcagctcttagggcatacattagagaatggttggggatggcagcaaattaatgagataacaagatgaaatgggtgatgccactgcttttggaacttggtctttagtaggaaaacaaatatgagtttatactttatgcttctaactttgagattgacttatcatggcatgaattactatcacagaaattgtctaactttatttctctctattagacattgttgaatagtcagttagaaatggaaagaatgaaagttgaacaagaaaggaagaaagccatttttactcaagaaacaataaaagaaaaggtattgaattttgtttttgtttgtttgtggtgtaaccatttagtagatgctgtgattaatcattgctttttaattttagctatgctttataacaagcttgtccaacctgtggccctggttggcatgtggcccaggatgattttgaatgaagcccaacacaaatttgcaaactttcttaaatcatcatgagatttttttcatgatttttttttttttttttagttcatcagctattgttagtatattttatgtgtggcccaagacaattcttgttcttcaaatgaggcccagggaaccaaaagattggacatccctgctttataagtatcatttttttaatgtctaaaatcaacatagtgatgaattctagtattataatcagtgtcctgctcagagtggacccaaagtaattttgagtttatccaaagagatctatgatttctaggacttgaaa

SEQ ID NO: 106845 - DNA, 1053 bp, Homo sapiens
ggtttttttgcatatagctgtccagttgctccaggaccatttggtgttggtgatccactactcttttaatgcatgactccattttgaaattaaaatacttttggaaaagagtgataaagcaggtataagttaagattggttcatttgtctcagtagacagtcctgccttaggcaataaatagttatcagttttaagtgtggctacttgcatcattaaatgtttgaaatcagaattgacttggtattttggtctctgggctgtatgtgtatgtgatttttttttctgtcctgtaatcaggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtgagcatggtttctgagtgatatttttggtagttccgtgacatcctaaagcactttttaaaagtatgttgttgggccgggcgccgtggctcacgcctgtaatcccagcacattgggaggccaaggcgggcggatcacttgaggtcaggaggtggagaccagcctggccaacatggcgaaacctactctctcctaaaaataaaattagccaggtgtgatggtgtgcgcctgtaatcccagcagctcggaggctgaggcatgagaatcgcttacacccgggaggcggaagttgcagtgagccaagatcccaccactgcactccagcctgggtgacagagtgagactcggtctcaaaaaaaaaaaaataaattaaataagtaaataaacaaagtatgtcgttggcttttagcttcagggtaccaagaactaaatgtaatcacttttagcatttaaagttagggttattagtaataggatattatggccgggtgctgtggctcatgcctgttatccagcactttgggaggctgaggcaggtggatcacctgaggttaggagttca

SEQ ID NO: 106846 - DNA, 1104 bp, Homo sapiens
atacaatctactgattttattcagatttccaaagttttattggtactcatttgtgtatgtgtgtgtgtgtgtgtgtattaagttctaaacaactataccacatatccattaccatagtcaagatattgaacagttccaacactattgagtccttcctgttagctttttttctttttttcttagctgaaaataatcactcttaatgttacccttttggaaacacacctaccactctctcaacccttcctcccttgtcccaaatctctggcaatcactaatctgtcctctgtttctaaaattctgtcatttcaaaaatgttacataaataaaattatacagtgtatgacattttgggtttggcttttttcactcagtgtaattcccaggaagaggttcacacagttgtttttgtatcggtagtttagtctttttattgctgagtgttattccatagtatgtaccacgtatatttaaccattcactgcacaagggacgtccaggctgattccaagctctggctattacagataaagctactgtgaatattcatgtacaggttttagtgtgaacctaagttttcatttctctagataaatgcccaagtgtgcaattgccaggtcatgtttagtgtttttaagaaaatgccaaactgtttacaaagtggctgtgtaagagtaatgtggtttcttcacacccttgccaacattttatgtcgtccctgttttttcttttagttactcagacagcatgtagtgatatctcattatgattttaatttgtattttttccctaatggctaatgttattgaacatcattttatgtccttattttccatttgtacattctctatggtgaaatttctgtctatgtcgtttacccattttctaactagattgttatatattcctgatactaatcctagatatatggtttgcatttatttgctctcactctgtagtttgccttttcatcctcttcacatagatttaaaagttgaaaattttgaagcagtttgtcagtttttctttctatggctcttgctttttgtgtcaaatctgccttgttctagatcctgaagactttctcctctgttttttcctaaa

SEQ ID NO: 106847 - DNA, 1043 bp, Homo sapiens
ccagttttgtttttgctagcctatttaatactgtagggaatatccctgtgtatttacgtatctgctttcttagagtgaattcccaagactaggatggcccggtgaaaggatgtgagaagtttgatgattctttaaacatattataacgttttccaaaaaggctatggtagtttataatgtatgctcctgcatatgagtggagcccccagcttttataatccgtatagcacctatcactttctgtgtgatgtggcaaatatttatagacgcactgtcttttctccaatattgtatggtaatggctatgccttatacatatttgtttgcgtttctttgccttaacagaatgcttttctaagtaaacattgaatatacatacagttttagaattgcttgatgaatgagagatgtgataatcatatgtaaaagttcattggagagtatgaaatagtatacatgaacaatgttgacacaacacaaaatatgtagttagtgggaagttatagataatactgtaccattgtttgtgaatgtattgtttctcctcctacaggtgggggaccttaggcttgcattgcagcgtacagaacaagcggctgccagaaaggaggattatttacgccatgagatcggtgaacttcagcaggtactgtcacaggtttccaaaacacaaatccaagaagtatgtgtttttctagaaataaaagaattcctcagtgggatagtgttcatggaattgagaggattactgtcacacctagcatttgctgaatttttgtggcttgtgtgaataaatcagagtgggcaccttaaaaattatacaaggaaattccttattttgttttatagaaaataatgttatgatagatttgttatatgtattcagtattgcttttccatttgtaatcgcttattaatgattgtcagtctttgattactgtgggacaggtaatagttcccggtttctatgcctctgttaattttcagtcatttataacatgcagaggaaaagggagagaaaatacaatttaggttgatttttc

SEQ ID NO: 106848 - DNA, 1974 bp, Homo sapiens
gatgtcccacccatgttcgggaatttgttactttcttcatgatgagatttaaattagatttagttcatatttctagtaggaaatatctgggtgatattgaacaactatatcacatcagcagacacatattgtcaggctgtactacaattggtgatgccaaaactgaatgcttagttaaggagttgactgccagatttttctctttaaaattagtaggtgatatatgagagtgattctttaagaccgtgtcaatatccagttcccaacaaccttttacccaataattttaacattcattgatgattgctgtccaaattagttgtaacattgtgggttacaaaattgtaatttaaaaaaattctgttcttttatgttactattagataaaacattctattgagatttttagggaatagttatcatttgagtttatacttctttaccatcaccaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtgaatagcaatcataattctctacatatatattgttattacttcctgtatgaacagttggccatggttatggagcatttgaaaagatttaatggggtatatcatgtaagaaggatttttcaaacaatagataaatgataagattttttagccgagtggggtggctcacgcctgtaatcccaacactttcggaggctgcgacaggcagatcacttgaggccaggagtttgagatcagcccggtcaacaaggcgaaaccctgtctctgctaaaaatactgcaccaacctaatacaaaaattagccgggcgtggtggtgcacatctgtagtcccagctacttgggaggctaaggcacgaaaattgcctgaagctgggaggcagaggttgcagtgagccagaacattccaccctgggcaatagagcgagactttgtctcaaaaaaatatatatttttctccattattatagattcctggaatacagttatttaccatggtattatttcttgaaaaatacttttgtctgtttttataacatataggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaagtaagaaaatgaacaaatatgcaacccatttagaatgaattatcagagtaggatgttgaagaaatactttttctattatctgatcactggcaacatttataaactcaatctaattttttaagagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtaagcaatggatgatgaattagagtagttttaaaaatatttgtttatgcttctacaaattaaacaattagctggtttgaatcaaacaatgtagtgatacatgtgttagatttcagagtactggattctgctaaatttaaccagttgtgttttttaaaactgttaaagtaatgcttacgtgataccagtattgtttaatttttttgagttttagacccatttgagagtattataaaagctaggaaccctcttagaagagaagagcaaaaatgcacatacatattgcatataattttgagagaatccatttaactcctgagctcattcataacatctgtgggagtccaaggacctcagatgaagtaggaaaaacaaaatttgtgaggctttgt

SEQ ID NO: 106849 - DNA, 1096 bp, Homo sapiens
atgagataaagctgttttctttgttacagtgatacacctgcatgtaaaaatggtcttttttaaagctaagcgttctgacttttatgtattcgccttatccagacagttgaatttctgaatgaaaagctggaaaaaagggaggctcagttattatctcttagtaaggaaaaagcacttctagaagaagcttttgataacctgaaagagtaagtattctgcaaatgtgaataatgttacacattttctggaaacctgtatactttgtacatatttaagaatgtttttgaaattaaaatgttttgtaattttatcattattgaaagttgtatagctttcaattataaccctaaagattacttttctcttttgattgtctttaccctttgccattgaagagagtcattttgcaaaactggaaaactctttcctttcgtttttagtcttttagtattagagatttaaaacgtatttgaagaaaactgtgttaatcaataacacagttgtgctataaggagctgattgggaaaatgtgatacaagaagattcagaattgaaacattgtatttactcttctcttatttttacatgtcagatattggtgacattttctctttctaacagattttctttgaggtgttttaaaataaatttaacaagggaaatttcctttttttttcttaaaagttaataggcctaaaactgttctattttaataaggtatatgtcagagaaaagttatcttccttttgagaattgaactcatgtatacctttgggatatatagacaccatcctcattctcaaatattattttaaatttagtgaaatgttcagagtgaaagaagaaagcagtagcatttcttccttgaaagatgagtttactcaaagaattgcagaagcagaaaagaaagttcaactagcctgcaaagagagagatgctgctaaaaaggtaattgaaatttaaagtaatattaattaaactctatagagatatagatttttgaggagtgcattcatcgtattttgatattggaaaaaagagaagtaaggtgaaaaggatatcatctattaacatttaaattgtagatttttggcca

SEQ ID NO: 106850 - DNA, 3424 bp, Homo sapiens
attaagtggatgaaaatgaatttgttctctagaacttaccattcccatcagtttaatatgatcttcgggaaagaacatttgtcaccattatcttggtttgaggcttttgttgttttgtttgttttcgagacaggttctcgatctgtcacccaggctgaagtgcagtggtttgatcatggctcactgcagcttccacctcctgggctcagatgatcttcccacctcagcctcctgagtagctgggaccacatatgtgggccaccaggcccagctaattaaaaaaatttttttgtagggacaggggtctcactatgttgcccaggcttgtcttgaactcctggactcaaatgactcttctagtgttgggattataggtgtgaacctccatacccactgagttcagtttttgagtgttgccctttgtctagctcataactatattactgatattacaagtaaaaattaatatgaaactgactgaataggtagggtcatttttctgtgactgcacatggcccaacctattcagttagttccatattagtttatttcatattgataagtaaagcgtgttattatgagatgaatcataggtatcttggacttactgtgggttataaaacatatactgttacttccttaatttgttgtggggaggaataacatactcgcatctggtagtccaggccaggcccagtcttttgtctgtgctcctccttcctctcaggtggacccacaccagttttcttccgtaagtccctgtattaacttggaaactacttaatgatgtagtaagcaaggagtttagcaggtgcaaattacaggtatttcatagggtattttttctaaatttatatttatactgatttataatgatgattgaaatattaatgtaacatatatgtgttcttttttaatatttacttttttgttaaaggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttccacaccaataaatgaaggacagactgtgttagacaaggtggctgagcagtgtgaacctgctgaaagtcagccagaagcactttctgagaaggaagatgtttgcaaggtaactctagtaagtggaagggatttttagatgtgctttttggagattaaatcatttgttttaaaaaatactttcattgatgcataataatttatacagatttaaaaacatacgcattttgccatttctgtgtagcattaagtaccttgaagttgaacaattattaatataatttggaatttctccaaggcaattatggtagaataagttgatacttcaatacagttaagcatgaaagttttcatcttacatctttatttttgagtccttatcacttcaaaattctgttatgcttattagtatgtcaatttgaaaggaatattttcttacattaacatgtatcttcacctcctttgcagatagatgtgccaaaaaaactaaatgttatggtttttcttgtatcagaatttgtttttacatgtttacattatttgtagcaaatattaaatgataatttaagattttaattattggtgcttttctgttattagtattttcattcatatataaggagtatatatccttatattgcttcagtttgttttctgcttatgttatttttgagatctcctattgatagctatatttcacatgaacgagaaagagaaatgtctaaggaacaaaagcattgcttaggagggacagattgcttctacctaatacatgtgaaaggaaagtgatataaattctttgacattaagtcctagttttggtttttactgtgacttttagatatacaaatttagttggatctggtatctttaatagacttctgagatgtaggatgtcttgaagaaatgtcctgtaagtgccatgtattgaattacttaattttttaaaaaagtgccagattctgttaatcaggttaaatattcacaaacaaaatgctgtgcaataatatttcaattagtaatagctatatactgtaagatatataataggagtttgaattcttagaaaccagcactaattactatcagatatttttgaatttcagtgtatttaagaaggtaagtgatttctaagttcatctaaaccaaactcaggtaagactatttttttgagtccaaaaaggaacccttcctactccttttatactcaagtttatcaccatttgagtaggacctaaggaattagacattccaagcattactttttgtttagctttatactgatacattatggagatttaaaaattcttatgggttttctaaaattacttttagtgtggatggatgtatgtatgaatgagacagggtctctctctattgtccaggctagc

SEQ ID NO: 106851 - DNA, 1076 bp, Homo sapiens
atgaaatctggcttttagttaggattttgtctttaacttgggcccaaaccaaatatagctgcagactggattaggaaggccaccaatttaaggtattttcccatgtccaaatgttcgaagagaatgcacacagaaaaggttatgttttaagtaatatgcacagtgcacattgttaggataacagctttagtgcttcctaggtgtcttagtccatttggactgctgtaacaaattgccataaactgggtggcttataagcagtagcaatttgtttcttaacagttctagaggctgagaagtccaagataaggagccggcagatttggtgtctggtgagggctgctattctggcttagagttggtgccttcttgccgtgagctcccttgggcctctcttataagggcactaaccccatttatgagggctccatcatcatctaatcatctcctaaaggctccccttaatactgtcccattggagattaggtttcaacataggaatttgtgcaggggacaccgacagaccacagtattaggggtattttgactgcagcaatgagtttactactattttgagagagaggttgtgctttatgcaccatgtgttccacgagttggacacagtgttcatacgtgatcctgtcttttaggcaagcccaaacaagtgtttctccttacaataccaagttaatacagagcttattaaatatttgagacaaagggctaagagaagtgtgaggcccaatttccctttgcaattattgctggcaaggtgcaagcttttagcacgtgaactattttcctggaaagcacacacacgaaaacttgaatattccttccggggaaatcgacctctatcggtagccatagcttccccttcgctaagaactgctgtaagcacgaaatcgacatcaatagaaacccttccgcgttcctcggtaactaacggcaaccctgcgctcccggatgtgacgtcaacgttcttctgttcttccgtctgtcgaccgaactctgggctcgtagatttggttgctgtgtacgtggaagaagcaagcgcatgcgcacatgggccccct

SEQ ID NO: 106852 - DNA, 2636 bp, Homo sapiens
tggatgggttgtgtaactaagctgtcgaaaaagaaccagttattagactttgcatattttttgtcttacattatgtcttaagttacctgcagtaaagagacgttttagttccatatgaagcaggccatttattaatctgataaacaagaaaaacatgtagtgttactctattacatgaatcacacaaaacaatgtaaaatttgttactgtctcagtttttaaaaattggaatatgtattttttaatgaagagccaatgtaaatttatctgttctgatttataactgacttttaacatgcctaatttccattgagttaaagcacctgtattttctcctcccttcagctgtgtgtgccactgaggtttttaaaatagccacaaggtaataggtttcatttttaatatgcatgtaaatttatgttttgacttggtttaattatataaagatgaacattttttcattacagtgcatacattcccttgaataattacttggtgtttaatgatgtagatgggctgtatacatacacatttgaagcagaaagaaaggttagtagtattaagaacacatttttgatcatgcatattttgatttttaaatattattggttagaaatttgaacaaagtcacccatacattttctaacttccagaactctacttattatatatcttttgctttatagcctgaaataactctatagcgaagtaatttacaagaaatggtctattatgaaaagcaggctttaaagcataaaaatttttttataggaaatatgcatgattataaaacaacctgatttttattttattgttcataaaagagactaatattggtgcatgtgctgctgtaatttgttgtgtattatgtgtgtaggaaaactgcccagcttgtagccagcttcctcaaaatattcagttttctccatcagctaaactacaggaggttttggattatctaaccaatagtgcttctctgtaagtattgtagatttttgttatgttgtaaaaatcatttttgtgatttttgaaaccttaaaaaaattatcttttgataaaaattatgtttgatacttctctctcatcataatctttaggcaaatgaaatctccagccatcacagccaccctagagggaaaaaatagaacactttacttacaggttatcaatgtgtattttaaatttttttcagaaaattatatcaagttttattttactttaatgtgtcttacattaaagtaattttgttttctagtcggtaacctctattgaagaacgaacaaggccaaatctctccaaaacattgaaaggtattttacataagggtatttactaatcattttctttcttttctctctttttggtgaaagtaatcagtgcttgttctagatttcctcttaatgccttgtatatggtcaggtaataattacttacaactttagacatattaatagaattaattgctcttttagtagaatattttaaaatctctaagaaatcaaatattactttgattaaagaggattggattttgatgtttttctagaccgtaatactctgtagtttgtttacatgtgtattatcctttctgttgagttttttttgcttgtattaataatattttttctgttttagaattggggcttgttgatggacaagaactggcggttgctgatgtcaccaccccacagactgtactattcaaacttcattttacttcttaaggaaaatctccacataatagaaaactcatggaaataatatactttgtggatgctaagaagttgaatcgatgtcatttttagcaatagtgttgccacgatttgtctttttttatataatgaaccactcttttttaactttgtaaccttcccttgaagacagaattttggtgttggtgcttgtaagcattttcattaataatatgagaaatgatacctggagagagagattatgagcaaatgtattgcttcttttagaggaggaagcatacaacctcttttgtgtgaattttgttattatggtcaaagaatgcattcctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattgtgtacttctttcactgaagtttttaaaagtacattaagggtaatcagtagttccatggtaatataggaataatttttaaatgtgtagcagagttatatcaaatttttattgcacttaatacttttgctacagcaatttctatagtaaaaatttactggtttaatttaactttctgtatcaatataattttttttttttttttttttgcg

SEQ ID NO: 106853 - DNA, 2797 bp, Homo sapiens
aaggctatttcttcacttgctttcctctctcactgttggcttttcagtaatgttgctgatagactgaaaagagaatgctagttttagctgacatgaccagctacaagtttctatgcttacctgaatgagagttcactcaaggaattggagctctgagaacgtatgtgggattacagtaaaaagtgcttgtggtttttttgttggtttcttagaacgtgcaaattgttttctgcaagtgctttttttttttaattagtaaactttattttttagggcagttttatgttcacaacaaaattgaacagaaaatttttgaaaacttgggttctcatagagcttcctgttcccacaaacacactaccttcctaatcaacatcttgcaccagagtggtacatttgttgcagttgatgaatctacattgaaagatcatcatgcaactacatatttaaaaactaaagttgcttttttttttttttgtagaatttcatattattgtatgtggactggactctatcatcgccagaagatggataaatggcatgctggtaaagactttagtattgttatagttctctgaagttcttgctgctgtgcttcacatccccaaaattagaattgatatatttttgaaaaatcagagtttaatttttaattaagtatatttacttcattgtttattgccagtcattggttttcaggtgaagacacaaattgttattataatcccttgatttgatacattggtattcaatagcacaaccgactcataggattacttgaaagcatacttcttcttttgaattcttatccccttctcctttaaagcccttcaaattgttttcctagatatctcttctaaattatgaagatggtgtcttagatccaagctccattgtccctttgatagatggggggacagaaggttttaaaggaaatgcccgggtgattctgcctggaatgactgcttgtatcgaatgcacgctggaactttatccaccacaggtaatcaaaaaagcacctgcatttcttttatagtatcttggcatggaattagggattaattattaagtctagttaatatttaggattgttaattagaagtggccgtattttaaaaattacactaagaagaaagataaaatatgaaattctgctctatttgaggaaagatatgaaccgagtacattgttttgatactattctgctttcataatttatttgtattttttatttggggagtaggtatcaagtagaattacaaagttgtatattgatgtcaagctgtaatctatgtggttttcacctgtatttatttcagggaaataaagataccagggataagaatgatctttccaaggatggggctttttggtttacatatccactttaaagaacacttgaaattttgaataataaatgtaaacaattttatgagtattcacttgggattcacttaactctgaacttgcttttgttttggtttgctttatacttaaatattaggtaaaaataacaaggtgttcatatttgagaaaatctgttcagtatttttcttctcatagtctaacaaagcttaaattttataccttgtaaatgtagggcaaacctgtctttacaggcagtgcagcctaagtgaagtgactcagttaatctgtattatagtttgagaggcatttttaatggtatacaatattttgagttgaaacaaattgtatgaaattgttaagaactagatcataactggaagttgcattttaaaataattcgtttaaaattcactgaaaaggacaaactgtggttttaggttaattttcccatgtgcaccattgcatctatgcccaggctaccagaacactgtattgagtatgtaaggatgttgcagtggcctaaggagcagccttttggaggtaataaacctaatttaataatctagaattacataaaatacatattttttctatattattcctttggataatttcattaaaaacattgttttgtgattacgtattcctgtcttctctctctctctctctccctttttttttttaaacagaaggggttccattagatggagatgatcctgaacatatacaatggattttccaaaaatccctagagagagcatcacaatataatattaggggtgttacgtataggctcactcaaggtaagtcagcaaattgtcatgaattatgatgttgggatgacttagggctgggatgctttcaggagaataatcgataagtgagtttagacagtaccatccacttgaagttcagtaaaggtaccatgtaattcatactacttattagctagggggaatttaataaaattattgaatcttacttacttaggctataagtcatccaagtcaaactgtccattttatcttccactgaattcatcatctcttagagacagtctatttcacatttggacaggactgttagacaaatattctatatattgaacagaaattgtcttcaggtcagctgcggtggcttatacctgcaatcctagcacttcgggaggccgaggcaggcggatcacctgaggtcaggagttcgagagcagtctgaccaacatggcaacaccctgtctctactaaaaatacaaaattagctgggtgtggtggcacatgcctgtaatcccagctactcaggaagctgaggcaggagaatcacttgaacccaggaggctgaggttgcagtgagcctgagattgcgccactgctttccagcctgggcaacaagagcaaaacttcgtctcaaaatagaaatcgtcttcagtttg

SEQ ID NO: 106854 - DNA, 1050 bp, Homo sapiens
ttacaaatacagcctacccatgtgtgtgtttttataatatatgtcttataatagttaccatttctgaattgtggcatgcttaatattaagtaaactaaaataaagcttgtagaattgcttttaacaatattttgaaaaaataatagcaagcatagtaaaattaaagtatccatcaatagcagcaaagcaacaaattttacaaatgtgtttatggaattatatatatatgtaaaatagtttcaatccgtagaaattttgagttgttctcttttggttatagattatttgaaactgagtgattgtacacttttgacctgttcaagaactctgaattttatataccttgcaagagtctttcagccattgaatacaaattacacagaatttattactgagaatttgtagacttaagactacattgaaaacaaatgttacgtttttaaatgtgaggaaacttctgcttaattggattgtttttattcccacaggccttgtctggttttagacagattcatgttatagatatggacactatagatgtttccaatctaaataggcagtttttatttaggtaagttttaatatcttagcggttttctttttttaagctctgataatcatttgaacttgtacattgcagtttaataatttttaaaaatgacttgagaggataatactaattttattttaaaaaacaaaaactaccattcccattgtaggtaaagttttgtaagaaaattttgggcatcttggtgatagtagttatgtaaacaaatacatgtttttgttttttcgaagaagtctccttccaaaggtttatgtgatttttgggaatatcctcaggttaactgtgctctgaagaaaggaaagaacggtagctcttcctccagttgatgtcagaagagaatactcgctggagtattaggccctagtgagagattggcagggatttgtgagccaaggtttgaatggtgactggagcaataaagttgggaaagagtttgagcttttcctacaaggggaaagaaaatggaaagtcgaggagagaaa

SEQ ID NO: 106855 - DNA, 3754 bp, Homo sapiens
gagactctgtcacaaaaaaagaaaaagaaaaagaaaaaataaccttatttctgagaaaagtgtgtgaaaattcctctcatcaaagtgatttttagattacacctttggaaaggacacataaatattaaatttgcatcagacatataagcatcagaattctgaaagtgtgactttttttctctgttgtatctcatatttcctaatgcaagtgtgatgaaacaacagattgaggaagcttgcagtgttttttttgtaaataccaaatgtagagaagtcaatttctcacataatagaccaatatcctaagttgaaccttggattgctttaggaaaccaaaaacatgtagactgatttatttcatccattgggtgaaataaaaatagaaacgtgcagttcttaactttaaatgaattgtataataggcaagaaaaaatttcaaagcataaacataatcacattgaatattttcctttttatttgagcaggtctggtgtggttaccttttcatttggggataccataatagttgtaggtgtggtttttttcatactgatctttgcagctgaatttactgtgttctgtgcagaatggctgttgatggtgggtgtggggacactggagactgggaaggtcgctggaaccatgtaaagaagttcctcgagcgatctggacccttcacacaccctgatttcgaaccgagcactgaagtgagaaacgtttatttttaaataactgctctaatagttttatgtttcaaaactaatagaatgcttcttttttaatttgctcttacaatgaaaatactaataaaattgttttgtgaaactaaatttttcttaaaatatgagattgaatattcacaactgattttgtttgaatatttgagtcttaacatttctcatgtaatataagttgaaaatttttgtgagaaaaatctaacttcatgacctcatgtaaaaatttaaaatgctttctgaaacatactccccttttgtagtgctactgtgagaaattaattttgataggagtataggtgtgcttacttaaattttgaaatttagttggaatgaacatcttagctttgagtataattaattgcatgttaagaattatgtaagtactaaataatagaggcgtagaattttggactgatagtgtctatcttaaggcaagtgttcacttatatgtcacttttttttattacagggtagggaaaagtatagcacatctttatgtgcttttgtatttataaaaagatagtattttgaaatagaaatattgtgttactcccataaattaacgtgcaaactcttggtttggcccagtgtctcatgtgaataactttctcctttaatgctgggcagaactgaaagcattaaaaataaaaaaaaaaaaaagaaaaagaattgaaagtattaattctgtctttctttagataacacaccatattttcttgtgcttctaaatttttttttttgcctgataatttaagattgttacttctgttaaatgattgtatttctgctgataaggaattttctaagagttttatatgttttcgtgttatctcatgttttgtgagtttcgctcactttattcaaaaggagatgttggccaggtaaggtggctcacgcctgtaatcccagcactttgggaggtcaaggcgggaggatcacttgagcccaagagttccagaccaccctgggcaacatagagagaacccatctctaaaaaaaaaaagaaagaaaaaaagaaaagaaaaaaaaattagctgtgcatgatgatacatgtctttggtttcagctactcaggaggttgaggtgggaggattgcttgactgcacctggaggtggaggctgcagggagctctgatcatgccactgcactccagcctgggtgacacagtgagaccctgtctcaaaaaggaaaaaaaaaagcagctgttactctttccccttccatctgccgcagatggagttttgcttttgttgcccaggctggaatgcaatggtgtgatcttggctcatggtaacctctgcctcccaggatcaagtgattctcctgcctcagcctcccaagtagctgggatgacaggcgcccaccaccacacctggctaattttttatatttttagtagagacagggtttcaccatgttggtcaggctggtctttcctgacctcaggtgatccacccacctcagcctcccaaagtgctgggattacaggtgtgagccacagtgcccagccctgttactctttttaccttattgttttactcctttaaacactttgggcagtgcttgatcctctgttttttaaatttttaaacttttatatttttaggaagtcagttaactgaatttgatgttctctatccctttgcaaaaattaaaaaacaaattagagatagttttccttgttaaaaataccctttaactttcatacaataaaaggcaatttaaaaacattaatggccggacgcggcacctcatgcctgtaatccaagaaactttgggaggctgaggcgggcggatcacttgaggtcaggagttcaaggccagtctggcccacatggtgaaaccctgtatctactaaaaataaaaaattagccaggtgtggtagtgcacacctataatcccagctactcgagaagctgaggcaggagaatcacctgaatctgggaggcggaggttgcagtgagccgagatcccatcagtcactccagcctgtgtgacaagagcgagactccgtctcaaaaaaaagaaaaaaaaaagaaaaattaacattgaaacttcctgaaatcattagagttttagaattcctggttcaatagaattcacaaatttcaaataattgagcaaatacaaagtctcctctttatcctagtggcattttttcctggaaacatcagaaactattttaaagtttgttgctttatttatagtctttgcggttatcacccagcttttaatatgcctttccattctttacagtctctccagttcttgttagatacatgtaaagttctagtcattggagctggcggcttaggatgtgagctcctgaaaaatctggtaatatatatacatatatatataaatatttttttcttctttgtgataagtaaaccttacttatctgtcatactagggaatttctcgtgattcttaaccttttctcttgagcctttgttagataagtttagcatgccaaattccaaacagtaattaaaatggtagaactttggaactttttaaattctaaagctctcagctataaagttattgataaaatttcatacttcagttttcttctctgatctttaacaaacaacttttggtgcttcctctggcaaaacgctcctaacttcaatgaagtaaataacaaaactggcaattcatattttaatgtatagtttcaaataatttattatttcttttgcttccccaaataacccagctaggtgggtaaggcattaccccattttatatagagggagacattgaggtttagagatgttgactgagttgctgaagtttttgtggattatagcgatttgcctggaattgaatccaggtcatcagttcttagttaagtgttctttttcagtgaaccattaggtcattttatgacctaataagacgattgtggacacctaaggtttgggaaagctaaacctttactgaacttatttgcatatatttagaaataaattaagtatataatttgatttaattaattggtttccttgac

SEQ ID NO: 106856 - DNA, 1718 bp, Homo sapiens
cccccgccccgtcccctcgcccccctcccctcgcggcgcccagtgtgtagcgcgatgctgacccttcttttattctctcttttagggagaagaaaagaaggagaatagaggagctgctggctgagaagttagtgctgccgggaggccggggccctctccggggacccccgcctccccccaccccaggcctaggggaccagccgcagcgggcccggggggctgggagggggacacccggagcgcaggccgcgctgcctcatcccctgatccccgccccgcagccccgggggcctggcgggccgctcccggtatctgcccggtgcgggcgtcggggccaggctgtactgccccagctcctgcaggggccctccggggtgcttgacgtaaaggtcttgaggaaggacccttgtgcactcctcttcctccatcccaaattgtcagagcagtgaccctgtgaaaaggcaatctaccttaaacacacaggaaaaggacacaagaccgttttgtggccttttgcaaacactgagacagtagtactaattgcaaacttttaatgataactctacatgtcaggtattgtactaagcactccagtcattttggcagaataattggctcttaaaagatctggaaagaggttgttgacttcaaacagcctatttatcccttttactacacaccctatttcttatcagatgcttaattctatgctggtgagacagatttaatcgaagtgttttctaacctggccagcgccacataatttactcccctccctgcctgggcagggaaaaaatactcttgcattggttatggtgagtttgtaaatttccgtgccgattcccagtagcagtgctttgatctttatgtgtgtccctcagttgaatttcagctgcaagaggaccgggatgacaaacttaatttcacattctttcctgccttttatttccctcccacttttacatgaaatcacaattaaacattgcttaccatatcccacgtactgtactgagtcttctgtgtgattatctatatcctcatggctgaaagaagtagctatgaacggcctgcagatgaggtttatgtctattaagtaatctgctcaaggtcacagtgctgttaattgtggaacccaacacaactctgacatcaaaacgtatggtttttattgctaggcaatacttcttggtcccttttgtaaaaattggatattactaatatatttgacggtagaaactgtggagttataggaaattagaaaattaaaaataatcacaaccaaacgtgaatcttaactaagtataaaatagatgaattttgtagaggagtcccaccttattctgttgtatgttctaaaaggtttgtagatgtctatctgtggcgtaattgtaatctgaaactttgtgtttagtggcaagaaaagccgtcccacagcattaagagattctttaaaaaattaagacctctgccaggttcggtggctcatgcctgtaatcccagcactttgggaggccgaggtggacggattacttgagctcaggagtttcagaccagcctgtgcaacatggcgaaacccgtctctactaaaaatacaaaaattggctgggtatggtggcatgtacctgtaggcacagctacttgggaggctgaggcaggagaatcacttgagcccaggagggcaaggctgcagtgagctgcagtcacaccactgcactcca

SEQ ID NO: 106857 - DNA, 1050 bp, Homo sapiens
tttcatttcacttagattggcatctgcacagctgccaaaatttttctctaagtcagagaacacactcctaggtaaaccttcaaaaaaggtatttcgaaggaggcagcttctctgctgctagagaaggcattgccacctcccttcagacaggggatttccgctagttgctttctgtcatttcgtctctattctgcactcagtcccttgttctgtctggaggttcctgttttcctgtacccaaccaagagccaatgaagaagtaaagaggagcaaacacgcccgcccactcccaatttcctttgctctgctgtctgccaaccgcaaagccgaccgagacggagccgctgtcaactctccaactcagctcagctgatcggttgccgccgccgccgccgccagattctggaggcgaagaacgcaaagctgagaacatggacgttaatatcgccccactccgcgcctgggacgatttcttcccgggttccgatcgctttgcccggccggacttcagggacatttccaaatggaacaaccgcgtagtgagcaacctgctctattaccagaccaactacctggtggtggctgccatgatgatttccattgtggggtaagtggggtccccctacccgggacaccgatccggggcgagcacggaggggcctcggggtgcaagatcccgggatgtagagacgctctctgaccacgctcagcgcctgccctggcaattctgcaagcggccaagccagtggaaacttgtttgcagggcgaggccgcagtaacctggggccccattttctgcaccaagggctgagacttgaggggggccctaggggaaagaggacggggaaaatttgccagccgcagggaagaaaaatgagagttcccccacccccctgcccccgcccgcgtgccaggatcgggctcttgctggaaagatatttgtagcgccctcgtcttttaaaaataagaagaaaaaggaaagtggtgtaaccctaccctggagctggctggggcggcagggtgtggacccgggctagtgtaaaaagggca

SEQ ID NO: 106858 - DNA, 1091 bp, Homo sapiens
tgtgtgctgcccagaccaggcacaagctcagacagccttgctgcttttgatagaatccatttttcactgtgaaggccaggggccagccctttgactaaatatagctccgtcagtattgtgccttaggccactaactcaggtagtttaggggtgttggccctcctcattttcctttcaaataagagttgttggttgtcaatgaaaattttgaagtgaaaaagtgaaaagtagccatgaagtttttaaaacttatccttatttttaaaaacttacaaaagatacaggctagtagtaaaggttgatttgaaaattatgtggataaaatgtgaaatttccttcatacttcagtaaaagtttggtatataacccctaactgttttctatgcaactataagcacagtcagtagttttttccaccagttgttctcttttctttctttatcatttaataatataaatatttattgagtgctctgtgtgtcaggtaccttgcaaagtattttacctgcattatgtcatagaacccaattttaaaaaactgttactttttttttatcattaaacctgaggctcagagaggttaaatgatttactcaaagtcacaaacttaggcttgtgctcttaactactgttctgtcttactatgagtcacaaggaagaaaccaaacatcttcagagttagggagcgtccttgattccagaacacttctcattctaaagagaactatcctctttcggtgatgctagtagatgggtaggtcagagcagtgctggcagctgttcatctggatcctccacagacttctctctagtttctcagaatatcttggtagagtatatgtgaaaatgtgacctggataaaagagtgttcaacaatggttccatcccctgctggtgaggagagcctcaagggcattgtaggagtgctctagcctcagctctccaatgttggaaactggcttagatgaggatagagagggcctcctcttcaagatttcaggaagggtgagggaagaacatagcaaatactatctagatccagaaacactggaaaaaactgcccataccaagacggagattaagagggatta

SEQ ID NO: 106859 - DNA, 1041 bp, Homo sapiens
gtgcaatcaggagatggtgtgacaaacctggcaggtaggccagctgctagccctgagagttccctcatgctaattactaaggcacttcttcctctcctagcagttacagccaaagccaaattttggccttggcttgtggagtgtgtgacctggattccaggccccacttaccccctcagccaggcaccaactccacacctatatacagtggccctggctgcagaggcaggcaggggccagaccctgcgaagccttgtagaatgtttaaagaattctgtttttagtttaagaacaatgaaaagaaaatggttgggtgggttcatatttgcagtgatccctctggctgattaaggaccacagagaaacatcgccaatttagagaagtccaccgtgagtatattgttccccactttttcggtgagtcagccttcctcagaaaccacacttcaaaaatagctttttcggctagaaaattggaactcagtgcaaagctgcctgtactcctcaggaaatattttgctgcctctttggtggttctttttggccttgcagcctgacaggagtcaccaaatgtggccttgagttgatccgaggatttctgttatggcaaacttttattgccaactttgcaattggtggccttggacaaatttattaacttgtatattctttagcttgcttacgtgtaaaatgaggtgggttagcaagatccttcctagctctaaaattttgtgagatttttttttcccctttcagtaacttgtggtaaaactatagacatagctactgaatcacgttgggaagtttaggacctgtatccacacccactaatagccaccttgtttcagagagaaatgagagtgcagagggattttccaggatgatccttggttatagtaggttacttagagtgtgggggaaatccttaaagccggttaacatgacagaatgggttctactgtgagttgctgccacaactggcacccttgttttcttgtttctctcctggatccctttggatatgtttcttctctgggcctc

SEQ ID NO: 106860 - DNA, 1519 bp, Homo sapiens
tttactcacgtgctcctgcagggaacaagatacagataatcccgaatcgagcaagagttcttttctggaaagcctcgggtaagttgatttttaagtaggatggaatcccgttgattcactctgaatttcaggacatttaagtagcatctgcaaggtgatgatatcagtgtgtgaaggaaagggtgtggcttccagataatggtccttcctgttgaatacagcattttcctttaatgcagaaaaaaaactatgtatgacttgatggagagctttacataaagtccaaggagccatttgaaagcttgcatcaattcgagaagcagactggactgtggctaactaaggcagtttactaatagtgtgaagagagggagtgtaatattgatatggcaaaagagaattgttgctttggtgttaaccaggtgtcccttctctgcagtgatgtttatccatgcatcgttgagacttcggaacctcaagaacaaactggagaataaaatggaaggaataggtttgaagaggacaccgatgggcattgtcctggatgccctagaacagcaggaagaaggcatcaacagactcactgactatatcagcaaagtgaaggaataaacataacttacctgagctagggttgcagcagaaattgagttgcagcttgcccttgtccagacctatgttctgcttgcgtttttgaaacaggaggtgcacgtaccacccaattatctatggcagcatgcatgtataggccgaactattatcagctctgatgtttcagagagaagacctcagaaaccgaaagaaaaccaccaccctcctattgtgtctgaagtttcacgtgtgtttatgaaatctaatgggaaatggatcacacgatttctttaagggaattaaaaaaaataaaagaattacggcttttacagcaacaatacgattatcttataggaaaaaaaaaatcattgtaaagtatcaagacaatacgagtaaatgaaaaggctgttaaagtagatgacatcatgtgttagcctgttcctaatcccctagaattgtaatgtgtgggatataaattagtttttattattctcttaaaaatcaaagatgatctctatcactttgccacctgtttgatgtgcagtggaaactggttaagccagttgttcatacttcctttacaaatataaagatagctgtttaggatattttgttacatttttgtaaatttttgaaatgctagtaatgtgttttcaccagcaagtatttgttgcaaacttaatgtcattttccttaagatggttacagctatgtaacctgtattattctggacggacttattaaaatacaaacagacaaaaaataaaacaaaacttgagttctatttaccttgcacattttttgttgttacagtgaaaaaaatggtccaagaaaatgtttgccatttttgcattgtttcgtttttaactggaacatttagaaagaaggaaatgaatgtgcattttattaattccttaggggcacaagg

SEQ ID NO: 106861 - DNA, 1024 bp, Homo sapiens
aggatttcagtttcaagaagaacctttgggcaaagtggcttgtttgtgcaaacatggtatgctaactcttctctcatcaagtccatttgggtaatggcaattagtcagcatcagttttacttggaccggaagcaaagcaaagtaagtaactggcatcatttctatagggacagattccccttttgcattctgttcagaagataagccttctcacaaaagatgcaagcacatatatttttgctctctgagatttttttgcgtttaacttccaactatttcaggttttttatatgtttacatgatgggcaatatataagctgctttaaaagttgtaagactggccaactttttggcatgcacgtttgtatatactggtgacactgctggcggtgatgttgccggtgacacttcaaagttagtaactgaaccacaccatgagaaaatcacgtatagttattaaaacattttaactacttgtggggtttttgttttgttttgttttttggtctgaagaatgccacttgaatatgtgaaaattctaaattatcctctgtgttgctatttttattgtatgttaacttaattgtttcattaatttgaagtatgtttgagttaattctgtttcattgttgtatgcctcttaggcaaaaattccttcagccaggagtttagatgagattgcaatggatttgacagagacaggaacacaaagggcctccaagctggtgacactggagacgaaaagtcagttcatcatggcaagtaatggcagtttaatctcctcaggtaacatcttgggattagagaacgtgcaagccatctttatttcgtttgttttttcggtcataaaccacttcgaaattcatcttttaatccattattttgggaataaataagtatgtcaataagtatgtatgcgacagctttgaataaaattttaaggctaattttttaaagaatatgtagaaagtcaaattataaataggttgtgcatgtcatatgagatgcaaggatggtgagtacc

SEQ ID NO: 106862 - DNA, 1110 bp, Homo sapiens
tctgtttccatgctggtttaaaaagtaaagggaaaacaaatagtatgtgttggtttacctgtattgtggtttaaaaggtcttcctccagtctaaaaagtgtgccacttgaatgaaaagcatttatcatgtgatcttaaaaacgtacagtgagaaataattatctgtgctttttcacatacatatgtttcttttgttaagaataaggaatattcctaacaggacagtcagggttttcttatcaatgcctaattcttcttatgcctatagggagagcattcctgagaaacactcttcaaaacaaaactcaggaactttaagaggggaaagtaatcaagataaaactcatttagcttaacaaagatacatattgatcaactctgtttttgtttgttgtttttaggaagccaagggagattataccaggtaatgcttttcttttctgatattactatgcaaaataaccctaaagaatcattttatgtggttattttaaataacaatggatacaaaatcaaaggaaagtagatctgtaaggcaggagactgagatctcttcgctcttcaaatagagacctattctttttgtgaatgaatcagggaatgatgctttcttacagtttttgaagccagaatgacagcgatggaaccagaagctctccaaagttctgttttctgtcatctgttaattagtgagatgaagaaatctataaaaagctttgatagcttatgctgataaaaaaaaaccttacaataatcttgtgttcgaagagttataatgtatgcacaaaaagattaaatccatcagctgcttagttaagggattaataggggctttctttcacagctgccccgaaggggcctcacccttcatacacttgacctaacagttgtattgttgctgcggagacacttaatggttctaactgcctcactggccacatccacagagggtgtttatatttgaattcaccctctacctgctccattctgtccttttaatgcaatcgttggagttgtagagaaacagttaaagggtggaggcaatgcttccctttgtaggccaatgacccctttgaaagcctggcctctacgatgttaatgttcgactcc

SEQ ID NO: 106863 - DNA, 1106 bp, Homo sapiens
actacattgagggaattcagttaatcctgaaacctcattctagccaagtctgccagtataggctcccatcccaaccattcaaccaaagtgccctgaatgtaattgactttccttctttctttttcctagagctaaaattaccatgtaggcagcaccaaagaaagaatggaagaaaaattggaaaaatgaatccccaaaagtcaataatgagcttctgaataatcaaaatgtgactgtttctgagaagggttctcctaaaacttagaaagatattttcatacttttgtagagttctagctgcctgtttatggcaaagagacttttttaaagtacacattcatggaaagacccattactatccatatttataatgccttgagataagaggattagtctcagtgcaatttaactgaacagaacatgaagcatatctttctgtaactggtccattactgttagcatcacatttatggttcttgtcctggaattattccatgtagttcagcaaccaacaattttagtcgtaccaagaactaaaatacattcagaatatctgctaacctggctgagttttagcatttgggatttcagagtgtttgcatatgtgaatgtgtgtgtgtgtgtacacacatacgagtgtatgtgttttaatcctcaactcatttcaagatttagaaataatttaaaggattagtaacagaaatcgaatgttgtaagctgtaaattctgtattaagacttgtgaatgggctgggcgcagtggcttatgcctgtaatcccagcactttgggaggccgaggcaggcggatcacctgaggccaggagttcaagaccagcctggccaacatgctaaaacctagaaatacaaaatttaaccatctctactaaaaacaataaattaactgagcatggtggtgcacacctgtagttccaatactcaggaggctgagagacaggagaatcacttgaacccaggtggtagaggttgcagttagccaagatcataccactgcactccagcctgggcaacagagcgaaattctgtctcaaaataaataaataaataaaagacttgtgaatgtaccttcttgtgataactaatcatca

SEQ ID NO: 106864 - DNA, 1027 bp, Homo sapiens
ctctttttttgctgttatttttgggtttttgtgtgttttctttgctattttttacatttctggtgattagagatagcaaataaaaagagaagagacctatcaaaacattatcatgtgaaggagattctctactgtcttggtctgaggaccaagttaccatagataccgtagagctgttttctttgaagatgaaggatagagttgccttcctttattcctcaaagcctcttagaaatcaatttaaagctgaaaaacatgggtaatatattttaatacataagactgtttctcactcatcagattcttaagattctcattctttgaaatgtgacaaacatttgctattacattttacgtggcaataatgttttctacagacttaaaaataattgaattctgtacaatttgatgccttaatttgaatagaggataaaatgcaaacaaatgctcatggaaagaattaacagtacagggatctgagttgcattcacatgcagacagactgctgaaaataatgcagagtccttgacttgttctctgaggtttgcttgggcaagtcacttaactgtatcctgaaatggatgcattcagctaaatcagtaatttctcaaatccatctcatgatagaactattttttttagttcacattctaagataaataaaatgttataagatgtaataccggccaggcacagtggctcatgactgtaattccagcaccttgggaggctgaggcaggtggatcacttgaggttaggagtttgagaacagcctggccaacatggcaaaacctcatctctactaaaaatacacaaaaaaaattagctgaacttggtggtgtgtgcctgtaatgccagctactcatgaggctgaggcataaggatcgcttgaacccagaggcagaggttgcagtgagccaagatcgtaccactgcactccagcctggacaatagtgagactccatctcataaacaaaacaaaacaaaaaaaacaagaagtaatacctatatttctctacctagcttg

SEQ ID NO: 106865 - DNA, 1034 bp, Homo sapiens
gcccaccaggcagatggcaaaatggcaggtcccagcgcatgcttcctgccgtggccaccaaggggccagcttgtcctctgtctgtcccctggttcagcttggctaaacttgcatgttcctgtcttctgagtttgagctaaaaggacaggatgtttggaagtcagaatcatcaaggcagtaactgaggtgagtgggacaggcaagatagtcgcgtgacataacttgttactttgctccctgtgggttctcttgttttgtgttcattttctaagcctgatttaaacatccattctttgcttctttcatcctgagaggcctgatttggttcagggatcaatatcacccccttgcccatataacttgggtaaatactgattgattggtctctaacccagtgcttccctactttctctgatgtcatagaatacacagaaaatgatagtgtttgtgtggcacctggagtaaatggaagaagctgctcaggctggaggtgatcaccaaattgtctctggctgcctccagtcctgaaaagaccaatagctcagtacacctgttgcctcagtacactggttttgaagctgtggttgaagctagtcatgatgaccttattcctctgccagggattggttaagggtaaacataggacccagctctggtcaatggggagccatttcttaaaaagctgtctgttcttgaaaataggcatggctgggccaggtgcagtggctcacgcctgtaatcctagcactttgggaggccaaggcaggcggatcacgaggtcaggagattgagaccatcctggctaacatggtgaaattccgtctctactaaaaatacaaaaaattagccaggcgtggtggcaggcgcctgtagtcccagctactcgggaggctgaggcaggagaatggcgtgaacccaggaggcggagcttgcagtgagctgagattgtgccactgcaccccagcctgggcaacagagcaagactccgtctcaaaaaaaaaaaaaaaggcatggaggccaggtgcagaggctca

SEQ ID NO: 106866 - DNA, 1022 bp, Homo sapiens
gcaccttgggaggccgaggggggaggatcacgagttcaggagttcgagaccagctggccaacatgctgaaaccccatctctagtaaaaatacaaaaattagcctggcgtggtgttgtgcacttgtaattccagctactcgggaggctgaagcaggagaatcacttgaacccgggaggcggaggttgcagtgaactgagatggtgccactgcactccagcctgggcgacagagggagactacgtttcaaaaaaaaaaaaaaaaaaagtagactaagagacaatggagactggggagggtcagagggtgggaggggatgaaggatgagaaataacttaataggtacaatgtacactattcttgtgatggctacactcaaagcccagacttcgccacaatgcaatatatccatataacaacactgcacttatactcactaaatctatcattttaaaaacccacattttacttatactgttttatctgactacaaaaaactgaagcaattcttgattcggggggttatggtgattagttttctttggatgcttacccttcaccagacaccgtgctaaagaccttatacagaatattttacttaattttccccaaactttttgtagtgaatactgataatacattgtacacatgaggacattgagactttgttgacttaaggagcttatatggggtctcacgggtcctgaggagaggagatctgaagttgggtgggtctcttttagaagatttagctcctaatcaccatactatcactattgtagttctctaattttagcatgagtcggaatcctccagaggccaactgaaagctctgatcgctgatctcaccccccaacaatttctgattccagggctgcctgagagcttgcatctctagcaaattcccaggtgatgctaaagctgctggcccagtgaccacactttgagagcccctattatactacatcctatcttctaaaaaattgccctgactttggaaaccttgaatgaaaatgatggaatt

SEQ ID NO: 106867 - DNA, 1049 bp, Homo sapiens
ctgcaagccaaggagagaggccccagaggataccagctctgttgacaccttgatcttggactttaagccttcagaaatgtgagaacatacattttgttctgtaagccatgcagtctttggtattttgttacggcagccctagcaaactaatatagtgcgtgattgtaactcatctaccccaactcattgagatcttaacatttctttgctcattcccagatacccaatatcacaagtatcttgtaccaaattttataggtggagtcaagtgctttaattatatttgcatatttggtgtgttcgtagatcttaaaacatatccctcctgcatgttaatagttgtagaatagattcccatgatgctctaatctcagttttcctttgtttctctctttagtttccttccaaatactgtccactttgtttctattcctgggttctggggttttcaagtagatgcatatttctttggtttatagtgctgcttgttgccggcaggaatggaatctgagaactaaccagttgtgtgtaacctcagacaaggtatctatttccctgacttggtttccttgtattcctagtataatagcatccatattatctttggagtttctagaagcattagcagaatacaagtgatgtgcctggcatagcatatggcttatgttggacacttaacaaatagtagctattgaaggcaaccagaagatatctgtttatttctcttttttctgcctttgtgatccaagttgacagcagctgtgtagtctttgttaacacccactaaagaagcaagggatttaactagttctttgcacgtgacattagacactgcttggtatatcattgtttacagggcttaatccctcaaggagcttttgtcgccgggcagacacaagaaagatgtggagagatgacgtgataaggcagaaaatgtactgagtcattccagtgccagctctgccctgtgtaacattttacaagttgctttctctctctctttctgtacctcatttatcttatttgtaaagtgggggcttagactaaaa

SEQ ID NO: 106868 - DNA, 1036 bp, Homo sapiens
gctagggtgtctgcactctttgtctgctgttagagcagagaccgaattgctccgaagactggaatagcagtatttgtaaatatcctgtgacgtgaactctggttataaagactgcatcgtcccccttctgtgattctccagacatgctaataagtgggtgctggaaatgtcatgatcttctaatcacaaccttctttttatgagccttttcagcagacacccgttcagggcaagctccaaaccctttctggctgctgtcgtttctggcgggtatgtcacttgtatgcatcactctgaccgcagcgggagtgctcggaggagtttacttttgctttgcgagactttttggaaggttgtctatttttattaattgtggcataggaattactttgtcagaaattttggagcccaggagtctaaaaaattacagggtattattaaatatttaagaattgcttaatttctccacgtggtatgagattttggctgaaattggatccttgggctatttacatctagtttagcattacagagccagttttgcctattaaaacaagtttgaaaattgtttaaaacaatctggtggataagtgtgtgtagagattttgttgtttctttatgttcgtggagatgagtagtgaacatagcactgaaacagaagcaatcatcttagcttgtgaaaatcctgtttgagtaataatgggaaatgttatcttttaaaatgttttggttattttcttttccattacaaacatgatataagttcctcctagaaaatttggaaggtatggggtgagagtcaggcgtaacctaatcacacagaaatccatgagatgttgaagtctcataaaatgatagagctggaatgcacttttataactatgtggttgaaagaaaaaaacaactttatgtcaataatcacaacacttctgataccaaatgtgtggattttccacactaagcagtcagttctccaactcctcatacaccaactggatgtcctcaattcaattcagttcaattttgatttcacaaa

SEQ ID NO: 106869 - DNA, 1024 bp, Homo sapiens
tttgcttttggctggactgttgggtaacagcactatttgttgagggacttaatttggaaacactgggtatttcctccttttcgggacctccactcactcaccaagaagcagcaggtgcttggcaggtttgcgctccaccccggaagggctctgggtgttctcttcaaaggggaaccaggaaaggactcctcacctttgtctaagagtaaaacgttcaaatgtacatttatttgtccctgagttccctgtaatcctttttttcctgcattttcatctatttttagtgatgttgtattttacccagagatgaacttgtgaaaatctttacccccaaattaaaagtgtgtgtcacagctgaatgggggagagagagagacccatgccccaggacggaggacacaaatagcaaagggtgtgaatggcaccagaatgtgggaatctctgaggatcagaagccagatgtggtatctgcagagcacagtaggaaagaaagacctgggaatttgaagtttaaaatggtttcatgtatcaagtcaggaaatttaggccctgaagtggatatgggaggcgcagtggaaaagttttaagtagatttggaaccaggaagatatttgtgtttgaatccaagatctgtcacttaaccacctttttaaccttgtgcaagtcaggaaaccttcctgagtttcagtttccttatttgtaaaatggagacaggagggaagaaagctaactcctgttgagtgcctgttatgttctcgggacagtgttagggaaatcagaggaattgttttatttaaagctgtccagtcctgcaaggtaggtataattggcctcatttaatagaccagaaaatggaggcaccggagcctaacaattttctcggccccacacagctggtaagtgatgaagccggaattcaaatctgggtcattctgactgcagagccaatgcgatttttatggtgccagcctgttgcctccgtgtggggctcataacttactccacagcggtgtcttattcaagt

SEQ ID NO: 106870 - DNA, 1019 bp, Homo sapiens
ctgccaccggtgcctcataccctttattctaacagcactcaggtcctgggatgcctgaagccggtgaggcagaatcaagttccgcccagagcttggaggagtcggagggagcgatggagaggcgcgggctggtgaccccctctttcccctcctcctggcaggcaccgctccgcgcctcctggcaccggcgccctttctctgccggggaaggctagcccagcccgcagccccgtgcggcgggggccgagggcgccccctcccttcctccctctccccctccccttccttccctcccgatacaatgactgggccggaacagcgcatcagccgagcctcattggcagcggccgccccagcccccggagaggcggcgggcgggggctgctggggagagagggagccgaaagccccggctgacagcgagaggaggcaggcaggacggaaggacgcgagaaaggcggcccggggcacagctgtaagtgtggagcaaagcgaggacgcacggcgagcggcggtggcgggggcgacctgcagacccgggccgggggatgcggcaggcgctggctgcccagagagcccgggagtcgggctgcgtagctcacgtgctgagctggagcttggacagagaggaagaggaagaagaggaaggcagccgccgccggggaaggcacagcgcagagtggacttgcaggactggcgcagagccgggtccccaggtcccgcgcggtgcgcagccgagacaataaagtagccgtctacagccccggagcgccgcagggaggaggtggcggagcaggtaggtgggcgaccgccccgggctccccaagcgtgctgccagggcgaggccgcaagacgcggccacgggcgcgcccggtgcgccccgggcgcagcgcgcacgtttggagacccccagcggaggtgcgggtcccaggagtttgggagagcggaaaaccccgccctggggctcgaggtctagtgcagcctccgctggagtccctggggcacttggcacggcgctt

SEQ ID NO: 106871 - DNA, 1033 bp, Homo sapiens
atgtccacatgaccaaactgtttttcacaaaacttctgctgaataaaatttgaaatactactgtcagcctgttttcctgtcttaatgaattccagacagtttgtagagtgtgggagcttccaaaacagagaggtggaatggatgtgaccagccagcatctgttttgtcacaaatgaggatgtcctgacataatggaatcgttccccttgttctgaatctcaccaagctgttcacttctctgatcatgaagtacagactgtgagaaggaagggcaaggccaatgtcatgtaacacaagccaaaagaaaatttctggattccttatttaccaggaaattcagcctacccctgtgtttcatccacttagacccaagcattttgatttttttttttttttttttggcatgttgacattctttagagaaaaagcgctgatctgttcttgttgtaaactggttaagacttctaaccagtctaataagtctaaatttcagagtaagacagatttgaacttaaattccaatttggccacttactggctatatatgtgtctttgggcaagttattcttgtggcctctgtttcaacagaggctgatatggtttggatctgtgtctctaccatatctcatgtcaaattgtaatccccagtgttccaggtggggcctggtgggaggtgattgggtcatggaggcagtttctcatgaatggtttagcactatccccttggtcctgttctcataatagtgagtgagtcctcatgagatctggtcatttaaaagtgtgtagcacctcccctgtcattctctcgctgctgctcccaccacgtgagatgcctcactccccttttgccttctgccatgattgcaggtttcctgaggcctcccctgaagctgagcagatgccagcatcatgctttctgtggaaccgtgaagcaccgtgatttaatcagcccatggaaccatgagtgaattaaacctcttttctttataagttacccagcctccggtatttctttatagcaatgtggactaat

SEQ ID NO: 106872 - DNA, 1007 bp, Homo sapiens
agtttttgaggtaaccaggctcagcttactcagggcctagaggataaaggtgatgattttgacttttgcaagcattggaaattagcatattatagttatcagaatggtcattattgtaaacattaactgagtacttgttgggattgcttggaattcttttagaaagaaggagaaaaagaattggtttcagtaggttctgtactttcaagttacatagcagatagatcacacaatttagtgacaacagagcacaaagaacaataataataacagtagcatctagcatttttaaagccctctttacagatatgccttgtgttagtgctttagcctatcttttatatatttctatagtattcttacagattatactggagttaaggaaggtacctatgtaattaaaaaaaattctttctgtgttagaaaagtgaagaaacagaaacatcaggaattaataatttacatctaggtgaattataaacatagtaaggcacttactatctaccaggtacagtatttaagtgttttatataatataattctaatatgaggtagataggatcccattttataaatgaagaaacttgtgcttgtctgttttctgtcacttgtctatcttaagttactcaaataaggttgaaccgcgattcaaactgaggactgtctgacttcaaagctcactctcttattcaccatgctggcagtggtttccatgtattttggtgttcggaggtttggagggagaggcaggagtgatcaggagtgacaacttatgttgatttttgaatggaaaggagactaggtttcttatgaagtaaaggcagaagactcagggtgtggttgcacattcaaatccaaaacaaatagttatatctattaaaggtgctcacagcatgcctgtctgcatagtcctttgtttctaaagctgcttctgaaggaggaaaggaggtaggctgtgaatcctccaagaaaggtaggaaaagatgggatggtggatacttaatcat

SEQ ID NO: 106873 - DNA, 1054 bp, Homo sapiens
accaagaaaagtgtaaacatccaagttcccagtgattctaaccctgattcattaccttgcatgtgtctttaactaccacaagaaatgtttaagatttccattgagatattatcgacagggactcctgggctgcatcataagcctgattgaaagcctttagccttgtaatgatctctttttggaggacaatcagggaattctttgcacctttatcagagagtcagggctttcctgagcaaacaaactaggtctttacctatggagctgattttatgaagagttttggtcagcattagtcattgtgaaaccatgggcctcctgccctggtttatctcgacagtcatctccctacagcagaagattgaatcctcatctctccatgagtctgagcatctaaagatgttagaggtacattggtttgattcttgctggggaatgtgtagtgggtactggtcttctgggaatagtgtctagatgaatgtttaataatcagtttaataggttgatgggctgtcttatttcctggggttggaggtttaaaccaggacaccctgtgctaactctgctctttaccttgccagcaatcctcagtcgtcctggtaaacaacctctgagttaaataccttttcttttctggagaggttaccaacaaaggaaaaggctttgatgtcagaacagggggcataaacagtgtttatggctgctgttaaaaatttctcatctgggtattttcaaaagaattccaagtcaaaatatatcacttatgggaagtatcttcttttccaatatgatatcttatgaagttgataattattttcatggtttaagtagtaattgatgacattttgggggttggaagatttgtgggaaggaggacatagattttcatcagatgtccttgcgtcctttccttgcgaggattattgatctctagtcttcatatgtaaggtgttgaatttatttaatgttattaactgaatctatagataaagaggtagttttggagccaagtaacctgttgatgtaaagtctattttaccttttatgattacca

SEQ ID NO: 106874 - DNA, 1025 bp, Homo sapiens
gtgtttttgttttgcacatgcctcagagaacataaaaattaacacatttccttaacagagatgagaatagagtcctaaacatcaccagataatttcctactagtgataagaaaaattattctcatctaatttttactgctttcagtataatgtactgtaggatgagaggaacagaccagttcccttgataaacaccttttgaccttattccatcctttccaggaggtggaaattctgattttcccttggagtgatattccagttcatttaatgcatgtgaacagacaggttcttttccaggtgtgagaacaatactggtttggaagtagagacctaggtatcctctgacagattgtggggaagttgagatacctgaaattaccttttgcttggatgctccttgtctctcttgcccatctgtacagtattagatttctaacaatgtgatagactcttctaatattcctagttattcttgactgatagtttttgttgaacaaatagaaaagaaaggtaaggggctttatctgaatacagaatacttagtcaagtgtttgtatgtgtgtgtgtgcacgtattcaaaggagatatttatatatgatatgtaggatatatatatatatataatttatatatttaataaaggagattatttctcttttattaaatgccaagttgggttatgttgctttctgcaccacagataatgactaaggacctacttactctaatcgaatgatctgcccaaagactaatggtatactttattatacttatttgcaaggttctgatagaggatgttttaaattatccagaatatgtttttttttgttcgtgtatgtgtatttctaaaagtggtgtttcacaaagtgtagtttaagagttacctgtgtcagggtcacctggggatgtgttaaaaataggaattcctgggtctttggactccagctgtctctactgatttgaggttttcaggaatctgcatgtcgctcagcttctttgtgatttttgtcccactatagttt

SEQ ID NO: 106875 - DNA, 1063 bp, Homo sapiens
aataacaggattctgataaagattgagctgtttcacttgagactctgtgggcctatggacttgtaatgaaaaccacagttattgttagtttatttccatgtgtaattaaagacaggaaaaaaatacaagccagtaaaatgagtaatgcaaggaaattctgatgcacagcttccttttgaagatggttttacacattcattcctgtctagttccctgttgaagattcttatcttggctgcgtagattgttcagaattttcaccccataggaaaacaactaaactggtttgcctcttcttggctgggggagccctccaagcaggtattctggctgagctaggccatattctctcttaagttacatgatttcacctatcatgttggttggtggtcttattgcctgacttctcttttatttacaattcctgtggtacattatagctttctggagccaggttaagaatgagatagtctgcccccaaccccaggaatgcttggatgttattttctggtcttggcaacctaaggatctcttaacttctttaatctgattaatggggaattcagaactatagttacaaaatagtttgcctaagctattactgctttgatggaattaatgatcaaatattggctaatgcccaaagcagattcgtgaactgtgcttaattttacatttcccttctcaaaggcaattgtggaacaaagaccttttatgttggttgaacccaattaatgaatggaaatgtaatttcatttcttctacaactatggttgaatttgatgagtcttgcttgtctacaacaacatgcatacgaatatcactttgtttttactaagtgaagttattaaggcaaaacactttttgttgaacttctatggtggataagccactttgatacctttatttgggtcaaaatgttctttaaacagcctttgaggcattgacctcatcaaagcagttaattttccaatgacccattttggagtaacatggacacaatggcagcttctctagacttgatctaaagtgtagcatagttggtaactaagcttcgtgattg

SEQ ID NO: 106876 - DNA, 1038 bp, Homo sapiens
tttgtatttctattagacggtgctgcttttgagagaaactttaccagggatgttcatggaactctgtccaagttacactttgatgtgactctttactctggagtagatcagatatggaatccaaaccttggaatttctaagttagcttcttagtaacttacagtttaaatgtagcaatgaaaacaagagtaggatttttttttttcagttgtaaaagaaatttctagaaactaagagctttacagagcttaaaatttattctcattgttttatttttaaactctaagtttctgccaggacaaaaatgttcagttctttttggattctgatggcctggtaaaacttctttgtaaacctaggggatgtgatagaattggcacaggagaaaattaatttggttgggatccatgaatggaatggaggtgatgtgcaggccttgcagtctgttgtaatcaatcattatagaagttttgctgcgatgctggcctgcccaacactctgcactttgggcaacatcgtgaaaagatatcttcctgtagatccctgctctggtgcaatacaagtgtcaacatagaaatagaatgtgtgttattataggccacatatatacacattcaataaaatgtctcagcatttactcgtgtgtgtgtgtgtgtgtatgtgtctgtgtgtgtgttctggaaaaaagttaaatgagattttccacaactttttaaaaaaatttcagcctcgttgtaggatattttccaaacccacattttccagcaatttgagccccaaacttatagcaatgaggcactttcttgacaaaggtgagtcaaaaacaggaaccctttgattctgtttgtcacatgatgctggatgttataaaataataatagcaaggagttcatttctttccctttgatcgtcagacttttagctgcttcacttccattgctaaagccaggaattcagaagtgtaggtcagatgctgtgcgtagaaaatgcatttgggagcatacacattaaatgggttataaatagtatctgccctga

SEQ ID NO: 106877 - DNA, 1051 bp, Homo sapiens
taaagtcttcatttagaaaaggaaaaaaaaaaactaaaaaaaaaaaaaaaagcaaaagttcaaacgggattttctttttaattttaaaattttattttattatgctttttgagactgagtctcacttactctgttgcccagactggagtgcagcgacgtgatctcggctcactgcaacctctgtctcaggggttcttgtgcctcagcctcccgagtagctgggattacaggcacatgccactatgcctggctaatttctgtatttttagtagagatggggtttcgccatgttggccaggctggtctagaacgcctgggctcaagtgttccacccgccttggcctctcaaagtggtgggattacaggcatgagccaccatgcccagcccaaactggattttcttgatagtctctctctctcagaaatattttgctcttatcttctgagtttatagatgatattttacaacaaaggtctacaaactataaaccacacctggcctgtcagcatcttcatggatgcccctacaattaagaatgattttcacattgaatgtttttccccccagccgtttaatgttgaaaaaacaaacagagaaagaacatgtggtagacatcatacctggcccaccaaccctgcaatatttgctatctggccctttacctacaaagcttgctggcccctggtttagaatgtgcttgctgtgtcacccttgctattagatatgtaatcagataaaaagtttctttcttggattttgttaattcacccattgaatatttctggagtatttattccattcctggcactgtcataggcactggggaaatgaagtgtaaaaagtcacaccaaaacacagactaaagggcatatttcaaaagtgacagagcttgcattcctgtcgagagaaaaagaccaaacctaaccaacccgaacagaaacaagaaatgaaaaacttaattaccaggaaaataaaccagctgagtatgagatagataataacagcaatttctgtgcttccccccttgaactgcactatggaatggtgact

SEQ ID NO: 106878 - DNA, 1100 bp, Homo sapiens
tgattactggcatgggtgccagctaataagtaaatcagtcagtattgacaccatgtttagcctcaagcatgcttttctctggaatgcacatttggatgaactttgaggaaaattattaactcaccccaacttaaggagctttgaccgaccagagatttcaggattatgtgtacatagtttcaaacgttgtattttaagatgaagaataatttaagaagattagtgagcatccttcattaatctggagctattttagtaataataaaaaagggcaacttgttttcatcttagaagagtaataggtcagttttatttataggtgatatctaatcaattttttatttagcttgtataggatgattctcaagtagataatgttaactcacctagaataaaggaaaccacttgttacctaagtatacgacattttaatagcttttaaaaaattcaccatactagtttacacaataaaatgtttctataagtctgtgtatatgtatatataaatatagaaggtaaatatacagattatattatataaatagataaatataaaatcaccatggtattttgatatataaaatgagtctcattataatgattccactaaatgtacaacctgttataaaatgagtgataatctgaccctcatttctgtgttttaatcttgggatgatttgaagtaaggcataatcatgtatgaacatattcctggagtctgacatgagcatcatgaacttgctaattttattccttgatggtttatataagtgtctgacaaatttaataggaagcagagctttattttttttcattatcagctagagaacaaaaacattggcatctgaattgaatactggaatatcgtgtgagtgtgtgtgtgtgtgtgtgtgtgttttactaagattcatgccactcaaagtgtgacccatggactggactgcttcatgaactgtgtggtgctgtcctacaatatgctaagaatagaaatagagtgttctgaaattttagagcaatcggaaagagtagctttaggtctgttggacctaataatacaaatttgggcttgcatatttgtgtttgttttgtttttcatctca

SEQ ID NO: 106879 - DNA, 1024 bp, Homo sapiens
tcactgggcacagatactgcagcctgcaccattgacgtccccaatgtggaccactagaccacacagccaagcccctgacccttagggcttccagatgtagctgcatctttccttgccagtgtacatacagcttcacactatttgtcccagatatatctgattgagaacctgaaggcatatgtctccatgctagctacaagagagtctgggaaagtgaacctttggcttctaaagtcaaagctatctctgtctccctctacattcattagaaggggaatttttcaagcacaggaagtatcttaaaaggtgctgggcagcctaaaagataatacgtgtccacttgacactgcctttgagcttcagtagcgcaataccttttgattttttaaggcaggtattactttctaccttgtttgaaaacaggagttgtgtttgctttaattttttaatgtgcccacagagtactgagcctgtactctcaagaggcactcaatatatgaccgaataaaagctgaattatctgtctagtgggattttataggtgacttaaattctgttcgtgtgtatttaaaaaatttccaatcataaacatttgtaataaaaatagttaaagtttccaaaacttgatctaactgggagaaaaacaataggtctgaagtatcttatcttcaaatctgaaatccaaaattctctgaatgtcgaaggattttttttgtctgatacctcattggcagaattacctgacctgaagtgacacaaggctatttatagtcttcattgttccacttaattgaatattcatatgtttcccggcagaaatattaatgtacttgattacaaactgttgccctgatctcactggagtactatactgtatatgatctctattatctctataaaatctggaaaactctgatgttcaagactcatcagtccccaagggttttttgaagtgtgtatgcatgtgtgtatttgtgtatacacacttgcataatatgtacatagaacgttctggaagggtgca

SEQ ID NO: 106880 - DNA, 1015 bp, Homo sapiens
ttaaagggacttgggagaatgttagacattagaataagtggctgggttctaactccagagaactttggttcttgaaaaaaaaagtgaagattctccaagccgttacaaatgagctttgtagtgatctctgatgaaatgataaaaacactgcttttcccactggaagataaatgccccttttcattaactatagtatgaggaacaaaatcatgtgattttcttttttttttttttaagtttaaccttaattactttttaaaggcagttttcattttgtgattacttttttttttcttccggtgcctagcatagttgaggattttatcttcttgtctattttaggatactctaatgaataacggaattttgacgtgctctttcaaaggaagagtctagttgcatcctcccagccatcggctggttgagctgtcctacccacttcgtttcagctcatggaggccaccgtgaggggctggggcatgtcagtggcccacagctattctgaatggtagttatatctatgtgggggctcagaagggaaccgactttccattcattaatgttcagtacccacgaaagaaaccgatatttaaaaaaaaaaaagtaagggaatttcagttgattttttgaaaaacgaaaacgttcacattaggacctttaaaaatgaaagcatttatgttctcagtgctgtggatctcacatataaataattgcaccccatccccctccccccacacccctcctccccaagtctgaaaccctgttgcaagggctgtgtgaagtgggaggttaatgtggcctctctttctgggacatcagtaattcttgaatattttgggtaagggtagaaaagtatcccatttcagctgatcagtaatttaggagcttttaaatgctgatgtaagcaagggtatattatggaatagaatctgagatgatactataaagagacatctctgttgctaagggtcagtccagaccacactcctagaccttacttctggtcctccttgca

SEQ ID NO: 106881 - DNA, 1005 bp, Homo sapiens
aaaaatcatcaggctactccaaaatcatgcagtagacaacacacgatgtataggaaaaatggggctaggagcacaatgctaaaaaatttcatcagtgacatctgaaaaaagaaaagataggaagctaataaacacagtagacagatttataccctttaatttaagcgatacattaatacaacaacaaacttgttactttgctttgaataacacctggattttgcttgtagaagtggcttcagaagagttgcagctggtgagttattatgcagtggtagaaggaagcttatctgaaactggatcaaaaattatagcatcagaagtgaatgagtgtgatgcataacactcttagtaaacggaggtagccggtagatgtttgaagtgtgtgcttggtgcagctgggtgcagttttcagggtgttcacctactgtttcttgaagacagaatcacgcacaagcaaaccaaaattcttgggggatatgctcaagttgtttactgtgtaacaaatttgcatttccaaaatcaacgtgatggcagaactgactgagatggatgaaaaaaagctgcactagctctaggtatgtcaggagcccagtgtggaacccaacctccccatcaccaccccaggggttccacagagcactgctgtgtggtgtaaactttattttgtttgtttgtttgtttgtgacctggaacagacacagaaagttatttttcttgtggagagtttcggtcctacctacatatccttccctggctggagtctggaggtgtgccaagggctttggcattgacaactttcagttccactgccagatgggctgtccagtaaagcaaatggccttgaactgaaaaccctatagaatacctcgctccaggtccttgccagggactataaccttgagtactcaatgagtactccgtaagtactcaatacttatgaaatgctgctatgaaaaaccaatatctatggattacagtgtgaagaacagatgttcatttgtt

SEQ ID NO: 106882 - DNA, 1036 bp, Homo sapiens
ccaagactttgccatgtttcatttcttgagactttatatcagattttctaaaagccattggggaagcccttcataacaggaattcttattttgattcagataacacatgggtatttcctaactaccatgttcccaatcccacatgcttcatagcctaagagctctttccacatttaatgatgtgctggccacattatttcccatcagcttcaactccttcttttctatttcatgaaaaaattcttgttcatgaacgattaggttttcttctgcttattttccgtgtagatagaatgaactcagttgttacgatgctcttgcagaagaacaaatttaaagctggaagaaagctttgcgaatttataacagcagtctgttgggttcagagagaattgttggaatcctatgctttcctttcatttgtgtgcttttcaagtgaggggaacattgtgatttttgtagatggtgtcagcatagatggcagagataagcagatatcctggccagcgttctggggaagatgaaaatgcttgtgttttctcatgactttatttttccagagctgactctatggcaatatcactctgacaaatattggctggccatggaatattttaaagagcaagggttttgtgaatgttctgtctattaccatggctgaggaatcaaaacacaatattctccacacatttcctcgagcactcatggatggattccagtatgatactttcatgttagctcttagaccacaggaagaatttaaaataaatgattactgaaaacacaatgaagaagaatcgagtagaatgttttgtaccatttttctctttctgcacggtaatatcatgctcagagtggtgacaaagactaactgagtgcaaaagggctttgcaaaaatttatgttttcagatgcttgttgtgaacatgatggcaatgacaatcatgtcacatctgcttcgctcgtgatctctatccttatgtaaggaaagagcagacactgatgatgttcaaaaacaaacccaccacagacatccc

SEQ ID NO: 106883 - DNA, 1064 bp, Homo sapiens
gtctgtagttttcatatgaatctcagaaaagtatttgaccaaaaagatcaaggtgtttattgtttataggatcccccaccctcccataagtaataagctcccagaggaaaggagcatatcatatttatgtttatttccctagatggatataataggataatatttttggagtgttcagatgaatgaatgtagttactagttagacaatgaggtgatatagcctgtggcttaagaacataggatctagattccaactgtgccttgggttgaattccttctttgcaaaccgtttggcaagtgatacagtctcttaaagtctcattctccttattggtaaaagggatactaaaataatattaaaggtagaaggttgttattgaagattaaaataaggtaatgcatataaaatgcttagcttgggaatacatagcataccttccataattagctgctattattattacttaagaaccttttgaaaggggccaaacaatgaggttctcatgattttcctagtgactattgcagagaaacaaaaacctgcaaaggaaagattgtttgcatgctgcttttgagtcttaaagacttagaaccgatgtgctgtcattaactatggtgccaggtgcaaggcagctacctccttaaaatgtttttcttgggcatttccattccctgtggccttgaccctggatagacagtggctcaggctccccagacaggcacccagaatgccagctaatggaaattttgtgatagtctgcccctgaggatttggacatatgttgttttgtgtctaaatcaacagaaataagtgcagctgtagttaccccctctgcataatcatctaagtagcctgtttctttgcatgctcatggagcccccaagtgctgggcccatcacttgccacccactctgtgcattgcaaatgagtacagtaggtcagataaaaggcagaggctggttgggcatcattgctgacttacacagcaatgatgaatagttacacatagatcaagacataaaagttatttataatagtctggtcaccagggtcacattggcaa

SEQ ID NO: 106884 - DNA, 1026 bp, Homo sapiens
taatattcccacagaaaagtatacacatcttacatgcactgcctgaggaattttcaccagatagctagcacccaatctctaagatagagcatcactagcacccttgtgcctcctcctagtcaacccctcttctaagtataatcactatcctgacttctaacaccatggattaatcatgtctgggttttatttaacttcatacaaatgaaatcatacagcatgtactctcatatctggattctttcgcttaacattatgtatgtgagatttatcccttgtttgtatgtagcagtagttcattctcataggatattccattgtatgattacatcaccatttatccattccactgttgatgggaatttggtttgcctagagttctgcactattatgagcagtgttgcaatgaacattattgctatatgctttttggtgaacacacatataaatttatctggtttgggttaagaaatggaattactaggttatgaggcatgcacatgttcagcttttggtagatactgcaaaccattttccaaaagtctttctgtgaatttacaccttcaggagcagcatctgagtgtgccatttgctctgttcttcaccaacatttggtaatacatctccctttcattttactgaagaatacgtagtgtttttttgatagggatggtgagtgcatgaagagtagtactccaggcaagagaacaccccaagcaagagtgtacagctagagttagagaataagttgtttatattggtttgaatcattacaatagataagtccagaaggataagttggtgcttgattgctagtctaaataaaacattaaaaaaaaattcattcattgtatagtgatgaaccattaattttgtgaccatagttgcctgaaaacagcaaaatcgtgctttaggaagtgttatctagtagtaggtgtataatattttgggggaagttgtcagaacaacctagtagtccaggccagagtttcaccatgtcagaatatctgtgagaacagagatggt

SEQ ID NO: 106885 - DNA, 1050 bp, Homo sapiens
gagtctcacaggcttaacagaaagatacatgagcttaagcatttgaattagtaaggggcttccctattgaatagttaaaatatcctcatgagtctccacaatatgccagatgaaagaactggatgtgtttttattatataaaaaagacttcctggccacattgacccccgtggtaatttatgctttattgatagtcatcattatgggttaaaaagcactacagtgaaagtttctataacaacatccaaaaatcataactcaagtcacttatattctaaagatcttgatggtccatgctattacaattcatatgctttatagttctgagtatttactaatatatttgcattgttttagatgatttttgaaataattcagtagactcacacacttttgatatcaattttcttctgaaattatgtttgcatttttggtttttcctttcccatgcaccttgcaatattagagctcttgccatattttagcacttaacaactggaacttcatttctggtggtttttctatttgcttttaagtaaatgtcagtggtaataaatcttctattactatattgaaaaagtcatgagtctccttcacaaatattacctatttaatcccaacaattaaagaaaggacttagctttgaaagaccacttaatttgaaagactcttcagttagcacgcttttgaacagagattgtgaacatgtgtaagcaaaatctaattttaactttgctctactaaaatcggtgggtgtgatctgtgttaaaaatatgtaaatcagtacagtggcttcactcaaggttataactgcaatcagtactagaatattggctcttgccctgaatgtgtctccttttattgacttctttgaggatcagcttgaacttaaaaaaacatttagctccagataatataccagttattcagatcttatttataaatttagatgttttttgtttagtaatttataactttatgaaaaggaaatgaatccgaattggagcatatgaatcaggtaaagcagggggctgttaaaggagagaatgg

SEQ ID NO: 106886 - DNA, 1048 bp, Homo sapiens
tgaagcagccagtaggacagagggggagaacttatgaagcaatgtaaaaacacaggaacaaagcttggagaaccaggatggtaaaggttttgaaatggaaggttatggcatgcatgtctaggattgaaaagtgtctattgggttggtcttttgtgtgatcactgtgaccttggaaagaacaggtttgggagagtggaggggaatggctggagctggtaatttgttgaatgaatgggaagaggaaatggaaacaagcatttattcattcatttacccaacaagtagttattgaacatctttgtattagggatctaatggtgagtgaaaacacataagatccttgttctcctggggcttactgttaagtagagaggtgggtacttagtcaaacaatctccctaccaccacccaaaaagatgtatgaacactaaaggctacagtaattgctgtaaaggaaagaaagaaagttttgtaggaatatgtagcagagaacgggggaagtgtttgggccgggaagagttctccaactaagtgatcttggagctgaaggaagcataggtgtgagctttgtgaaagctgtggtgagagaaaatttcagcaggtggagaaaagcagatgctgagaccctgcagtgtcagagagctagaagctccaggaaataagaagtgaggtccagagtggttatgtgtgaagagcagtgatgagaattgtgcactacaaggctaaaaggtgggcaggggccaggggcctagggtttaagctcccaggacttaatccttaagaccatctaaaggattattgtctttattttaagagcaatgggaagccatggaaaggcatgggaagccatggaaaggtataggctaggggagccacacctgggttttaaggagtgtagtctgctctttgcagagacagcgtaaacctgttagacctttctgaaccaacatgggtacatggcacggagaaggattctcatctcagggggttatcattccctcttctgagtgtggagtcatctaagctcttcagaaaacctccagctcag

SEQ ID NO: 106887 - DNA, 1041 bp, Homo sapiens
tgtgatttttcaaaaaaaaaaaaaaaaaagataaattttaagtcaactttgctactatcagtgttaaaattagttgtatttagcttcatttagagcccttttcctaaatatagtgtgttgttaataatgcaagtgttttggctttaaaaattaccttttataacaatttttactatttccattttgccaagatttagataattttcatgggtttaagcataatcctttaaacttaacccaagtttttagccctgtcaccctgactctatccttctgttcatctcctatccctcccccaatccccacacttcaattttctttaagattttgttagagtgcacttagagtgactagagtctgagcccatggaagtttcctattgcttatttttctcccagtggcacatggtctaatcacctattagagcgagaatagttggtcctcccctccgagtctctccacagttctgcatagattgcaaccagatgatgacattaattaatatggcgaattctgaaagcaagcatttaaaataaccctccctgtctaattcagagatcacagaaagacttgggcagtactttgagccttgacgacatagcgtgtgctgagcatggcctcccttccctatgtcatcaagagtccatgtagtgtaggcaattaagggacccatttctcccagcatgtgtcacccttgcaattggaaagtgtccactattctgggcctacatggggatagtagagggagctggcttagtcaggcaaagttggggcaatgggtagtagtaatgtgatttgctttataactgtttgctttgcattggcaactgagctgtggccacactccaactggcagtggagatggaaccttaattttagattgtgtccctaatgtttggtgaaaataaaaatggagaggtgaccatgagttgacttgagactttttatatgtgagtcatagtatctattaggaagaattgcattcatattatgtaattatcctttgtttagtttttctttttttttccagtaatgaataat

SEQ ID NO: 106888 - DNA, 1116 bp, Homo sapiens
agatggtaagcacagcctagtttagaacattagatcaatgagctcaagtcatgggtatgatttttcagttggcctattggttgtcctctgttctgtgacctgagaccttcttctgagcctgactaactatcttgcagatggatgttcttgctgtggtgtaggtaagagagtgtggacaggggaggcattgagcctagatccagtttaattaccatacaaatatcttaggtcatgaggtagctagggtcatcttctctaagggcagctaatttctttgcttatgccaagcaacagccttgtcactgggggcttttttcttaatttggcctttttaaaaaaaaatatcagcaagaggagtgttgttaaattgccaaccaattcagactcactagtcttttccagtatctactggagctaaaattcacaaacccaactcacttctagaaatcatagcttctgactctgcgtcagcatggtgggtgtttgggcagcaagtgagcagaaggtgctgggatcagattgcctgggttctgactctgctgctcccatgcactggatgtgcgacttggaagcaaaattacttaacctctgagagcctttgtttttcccgttggcaaaaaggcaataacattaatactaatatagggttgtcggaggattatatgagataatgctcatgcatcaaaaatggtaagcactcaacacatgtcagtggctggtattattactataatttttaccacaaattctgaataaacacgtctagaaacaaggtattgccatgattagcttgaaccagtatcacccataatttttttattaattattgcctccctttgcactctctgggatttccattcatttatttcacaaatacttatttagtacttactatccaagcagggtactaggcactggggatacactagtgaacaaaagagacaaaacataaatgatagtttaaaaattgatgcttcactacattttaacagccttaccatttaaccgtactgaagactgagagaactgaaatgtttgatcatatttagattttgtgaatttgcccataccaggtactgactagcatgaaaaatagtgacagaaatgctacataat

SEQ ID NO: 106889 - DNA, 1833 bp, Homo sapiens
ctatgtaccaggcattgttataggtgccagggatattgcagcagaacaagcaaatgaacaaacaactctttcttcatgaaagttatattctactggaggagagactcatgatggacaactttgagatcatgtagatgaaatcacttcataagcaggaggtagtattctcctcagatcctggtctaatggcctgtattatggtgccaaaatttgtatttgaaatcacccttgatttcaggcaggaggcctgacctgtctatccctggtaattttgagcactgttaagtctgggtagaccatctgctttacctaagcttagatcattggctctctttttcagtagtctgaggctttcctcagaccagtcacctcttcacggacattttaagtgtatgagggctaagctccaaaacacagtaattgctcttgagaataagcagttttctctgtgaacacaagaaaatcatattctgctgggctcaaagagagtttcttaaagttgactcagaagaggcttaaaaacagtaagtgttacaaatggttttttgaaaggaagaggaaattatttatttattattttaagagtttcatttcaagaatgagggaagtaaaccaaaatatccagctttttttgttgttgtttgttttgttttatttttccctaaaactcttttgcaggaaaccttatggggcttttgccttttgatcttgctatagaatctagatggatacatgagacagaaggatacagaaatgttctcaaagtggttgggccacccaattaactctaggggtgtgattcagttttgtaccactttacatagtgagaaaacattccagaaggagctgtgctccccttgggtgtaggaatgtctctcctggtctgcaatgcagttgaaaagtgaagaataatttccattttctgctttgtctattgaaataaaaagacaaagcaaaaacaataaaaaaaaaactcttctacatcatttatcgctcctttatttggcaggagttttcaaactaatattttctttttgtacaccagccccattttttaaaaagtactgagtagaagttttttaaatttggcaattcaaaaaatagttttacttcaacaaacttaatgaaatcattattctttaaatatcatatggaaataatagtaagtttttttttgtttctttaccacattgatatttgtggtttgtttaccacactgccattcaacctttgatgaacatgtgggatgaatgagcactactggtaataatgaaattaggtacaactttcccataagaaaatttggcaaaatgcatcagaagcttcagtggtttttatatccttttatctggtaattcttccacttaggatttttgttcttgttagaagaaaggaataagtgacaatctgagaatatttgtccctacgtgagctaacacagtcttttaagatttgtattaaggttagttcctttgcacctatcagttttgcttttaagttgagattatttatgtttgttttatttatgtgaaataagtccttagaaaatatctttgatgcttatagttataggatatagtgatttcctttaccagctgctaagttctattaggtttttttgtttgtttgttttttaaagacatggtgatacggcttggctgtgtccccaaccaaatctcaacttgaattgtgtctcccagaattcccacatgttgtgggaaggacccggggggttggtaattgaatcatgagggctggtctttcccatgtggttctcatgatagtgaatggataagtctcacgagatctgatgggtttatcaggggtttctgt

SEQ ID NO: 106890 - DNA, 1982 bp, Homo sapiens
aatcatgctattagaatggaacttttttgtttgtttgttttttgagttggagtctcactttgtcacccaggctggagtacaatggtgtgatcttggctcactgcaacctctgcctcccgggttcaagagattctcctgcctcagccttttgagtagctggaattacaggcacatgccaccacaactggctaatttttgtatttttagtagagacagggtttcaccatgttggccaggctggtcttgaactcttgacctcaggtgatccgcctccctcggcctcccaaagtgctgggattacaggcatgagccaccacacccagcctgaacaactctgtttttgaggaacggttttatatttcagaagaggatatttcaattgggtcatgctgggaaaactccccaggagatgaacctgccacttcatcgtgcagttattgtctgtacttgcacaaattattgcttcttctggcttgggatacttcatctacttgtgagttggcagtagtgacacctacctgtccccccctggagcactgggctgatgtcatcattgtgcggtgttggatgagtaagtactcgagaaagggtgattgccaagggctgggtagttcttcagggggatgggctgtgttagttgcctggttgttaaaataggagattaagaagaggaatcctgagcctgacttcttcctttgcaacccatgacctcattttgtctgacttttttcctttagcagttaaggccattatactctacagatatattccagaggaagtggagggctccacctttaaaaataataagcaattcaggacagttcatataaagtcaggatttgaatagatatttattaaatgtctgccatgagtaatgtattccactaagcacaagggggagatataaaacgtagtttagtaggttcttcataggttctaatgaaatgtaaacaccttacgagaagtgtattcctttatgtcacaaggaacccttgtgttctgtaggtcaatcactgtgcaatactacgtagattcagagatagttattaagcataataaatcaatcacacttttctctaaagctcagtagagatactacctgtctccacatattacatttgattgtaagatacagcctagagaaaaatgttagaatctcattgcagtgatttccaatgggaagaaatctaagagaatccattcatttgagattttctgtattataaaattattttctaaaccagagtctataatagatttcctttaaacacaagaatatatatcataagcataataaaaatgaatcataccacacaattcttgtttgtataaagaaatcctaatacatgaaaattaatgaatgatattgccacttcatatatatatttgtatgtacaaatatttatatatatttaaatatgtacctatttaaaatatatatatttataacctaatgcctgtatttacaggattaataaaaccataaccctatgtcagagtttttaatagctagcaacaataagcaacttttgttaattttgaaagaaaatgaatttattgacagggtattgggttacctgctgagttgctaggcagtaagaagaccaggcttggaaccgggagcagtacctctaacacactgcagaattggtctggagagcaatggaagcctgcttctctgtttctattgcaccaataattcagtcttcccacagccttgcccactccctgtggtccctgttccttttccttatcctttatctctaacacctgagtccagtgcagaacacctgattggtggatcctcagtcacatgttcattccctagctgcaagggaggctggcaaaggaacacctgcattttctcatttctagagtaggaggatgattctgcagccaaagcaattgccaaattgttattacaataattatgctagaaagtttgaaaggcagaaaacatgaaaacatcatcatattccatt

SEQ ID NO: 106891 - DNA, 1051 bp, Homo sapiens
agttagggtttcaccatgttggccaggatggtctcgatctcttgacgttgtgatccacctgccttggcctcccaaagtgctgggattacaggagtgagccaccacacccggccgccattgctttttagtttttgtttttatccaagccacataatatagtgggtttttaacaaaagggcagtcttgacatttctcttcttcccgtttttgttactgcttcacaactgagtacgtaacaactggtacttcagtgatacagtggcctattttctttcttataaaagacattactatatcatacagtattttaacctttcctttacaaatctcatgatactgagatgcctttggttaacaaaaattgccattgagtctggaagattgtttgtttgctgactgaccagccccctcatctcatccttctcacaaagaaagaaagaaagaaacaaaccctcaacccttaaattagtcaaagtcctaaggcagttttcccagaacaaatgtccatattgactttctccgttgttaggtcctgtccttgttgacccgttgctggcttgaggggctgattctgttcactttggaattgggtagcgttttggtttaacaacagtgtccacccagcgggggaccaaattctcaggagaagccttatttataataaagcacaaaaacaaatactcagaagaaatagtgattacataggccctctgaacagtttcaaaagcagaaataattccgttgaaaatatgaatcctgtaaataactcatagtttggtagtgtttcataaagtgattaggagtaagcctcaatttcctcatgctgaaaatggggataataacatctgctacttcgtaggattgtaatgaggattaaataagtgaatccattgaaaactttcagaaaaactacctgtaacatagcactcagtaattgctttattttctttcttttggagatggagtcttgctctgtcacctaggctggaatgcattgatgcgatcttggctcattgcaacctctgcctcccgggttcaatcaattctcctg

SEQ ID NO: 106892 - DNA, 1054 bp, Homo sapiens
ggagttgccaactgtgaaaatgcagaagaccgtgggaggagccaatttggaagagtggatgaacatgctgagcttgagagtctgcagtcctccaaacggtgccgtctcgtaggccagtggagatgagtctggttctcagagacctctgttctggggtgcttaaatccatgtgactgggttcgatcaccagggctgggagtgtagatagatgaaatcaagctcggatccttgaggcactctgacatttagaggggagaagaggagaaaactagctaaggagagtgagaagaaatgaagaacgtgagagaaaaaccaggcaagtgtggtaaatcgaaagccaagtaaataacatgtattaagagcctccttgctgttctttgagcaaccaaggcttgttcacacctgagggctgtatgcttggctggaatgccgttcctgccaatctgcctggctcatctcaccaacttcaggtctgggcgtcaatgtcatactctgtgaggcccttacctaaacacactgtgtaagatttgcacagttgcctggcatctagttggtgctcaagcaatatttgttgattgaatggtgaacatataacttttgatgaaggcagcagtccaggtgagaacatatgaaagccttgctgctcgggatgtagtgtgttccctggaccggctgggtcagcatcccctggcaacttgttagaaatgcagaaatcttgggctctagcccagacttgtggcatcacactctgcatttaacaagatcctccagtgatttgtgtacacattaacatttgctcccagtcctgtatttaattttctatgaatgtcaagaggacaattgagtatactctctcagatgggaacaactcaaagtaagaagttaaaacaatcaaaatcaaatatcttcagtggttgtttctgtattcaatcagaaagctatgatacagtttaaaagcaaaagaaaactgtgtcgagactttcaagaatattttatgtgattatccccctatcttttttacttttattttatgtggttattccacatatctttc

SEQ ID NO: 106893 - DNA, 1023 bp, Homo sapiens
gcacctggaatatgcacctggaatacacccctggatttacacagttttatcttcccttcttattcagttaaagtcctagatcagaactgacccacagaagagggagcttctctagttcgcctctgcggacagaataatggagacatggctatggtttctaaccctggcaagttgtttaggtttcctcttagtttctgttttctttagctttaaaaagggtggggggtaattaagcatatcctgtattcttacaaagatgcttgtccagttaagacagtagttggaaaaacaactgtaaaattacgtatacatatactatttctctttattaaaatcaccccattctttccttcaaatcctgctaaaacttctgttgagtaggaaagttcaattctagtttggtgaaactttcctagagagcaggggtcagcattttctataaaaagccacaatgtagataattttaggccttgggggccctgcagactctgttgctactcttcaaatctgctattgcagcaagggagccgccctggacaacatgtcaactaatgggtgtggctgtgttctgataaaactttatttatccacattgaaatctgaattttatataattttcatgtgtcatgaaatattcttcttttcattttttttcaactatttaaaaatgtaaaatccattcttactttatagaccatacaggcagcagaccgagttgggctgatgggtggacagactcctgttgtagagaaaaagcactgggtttgtcaaccatagccatttcgaacctttctttatttaagactctttggtttgctttgtatttgcatctgattttgattcttctcccttaggccaggattcatacccttgttgtttttactttttgttaaggacagctttgtacagattgtacagtaaacaagattatatgtccaaggatatatgttctgggcttttgttttcttttgtggtaatgtaattgtgggactgaaaagaacctcgacacttaatcagatgtga

SEQ ID NO: 106894 - DNA, 1014 bp, Homo sapiens
ctgccagatctggactatttcagaataacactaagatattgttttcctttttcactctcatttcaccagtaaacaatagagttttccgaaggctacatgtcgtgttgagatgtcattgttctgacatcctgtgagatatctactaatgtataatcgtgtgttttcaaaaattctcaattttaatttctaatatgctaaatattgatagatataatccatgtaaacacaataaatttaaagagtgtaaaaggatcctaagacaaaaatgtttgagaattgctgttttagatattgtgctaaggccgttagaaacatgatctcatttaatgcagaaaacacacatatgaggcaagctctactgtcattcccattcaatatgctaggagatgagggcctggagaagttaatgaattgcagaaggtacacgggttgttaagttgcaaagatagaatctgaacccaggtttcaagttaagaactccactgtctgtgttgtcaggcacattgtctttcaaagaagcaccaggaaatgcctggatttggactaatttctcagaagagaaacttcttcccataacctaggctatctccaagggaatgtaaatatgaagattatccttatagacagtgtaaaatagagattattttctagtagtttgtgggccgaggcttgtactctgtgaaacacaaaacagttgagcatcggatctttaaacctggaggattttacttaaaaaagaagtttggattgccagctacccttgaaaaatttggagattttgagctaggctggactcatattcccacatggccacaatcagctgcagtttttatctgctgttcctgctagatagatgtgtgtcctctggtttgccacagacctcactactccttattaccttcctcgtagctcatgttcctcatttatgttgcctgtttgaggtatttgggttagaaacagctggagatgttctgtctactgcatagtgtttataggccatctgctttcaactta

SEQ ID NO: 106895 - DNA, 1054 bp, Homo sapiens
tgtgtgccactacacctggcctgaccttctcttgcatctcgttagtattctccacaaaaaaatcaaggcatccagcttcttggaagcctccaaaaaaggatctgtactagctcactagggaaatagcaaagcacaatggttagaatttagaggtttctgaccagatctggggtcaaaccctgaatcttccatttcctctgtgaccttgcatgttatttagcttcctgaaaccctacatttccccatctgtaaaatggggctgttatatatacctatattatgtggtcaactcacttggtaaagcatctgtagtatttagcattggaaacataagttgtattcaataatgttatctaaattattaagtataacttattaattataatatcaaataatattgatagtatttgtttattcagctgatcttcactgagcccctataatgtatcaagctctatgttagctatctgtgagacatatctatctcacaatatccctcacagtaaataactctgtaaattgcagcatgggtcccagtttgcttcatggagaacttttccacataccaccccttctgaagacagttgtcatgaccccatatatgcttctgtcctttagaatgaatacttggctgggtccatggttcacgcctgtaatcctagtactttgggaggctgaggcaggaggatcacttgagaccaggagttggagatcagcctaggcaacttagagagaatccgtctctgtaaaaatgtaaaaaattagctgggtggggtagtagtacatacctatagtcctagctactcaggaggctgagatgggaggatcacttgagaccaagagttcaaggatgcaatgaatcatgatcgtgccactgtcctttagcctgggcaacagagcaagaccctgtttttagaaaacacatttaaaaataaaaaagtagaatgaatcctcatacctcttcattccatctacattagcgttgaggccttgttccttcattatctcgttgttccgaaagtatattaaagattaatttagcatttatggatat

SEQ ID NO: 106896 - DNA, 1053 bp, Homo sapiens
gttttccaagtatctgatttttaaaaatagactttatttttcaggacagtttttggttcacagtaaaattgaaatgaagctgcagatatttcccatacacctcattcccccaagcacgcacagccttccccattatcaacattccctaccagagtggcacatttattagaatcaatgaacccgcagtgacatttcattatcctccaaagtctatactttacattccctctggtattgtacattttgtgggtttggccaaatgtctaatgacgcgcatctaccattatagtatcatatagagtggtttcacaggcttaaaagtcctctgtgctctgcctatttcagtgttttatctttactcttattataggaacttgaaatgcaggctcgagctcatggactttcccttattccatccacgggtctctgctctccagatttggtgaatcggatcatcaagcaagaacccgttcttgagaactgcagccaagacctccttcagcatcatgcagacctaacctgtacaacaactctcgatctcacggatggcaccatcaccttcaacaacaacctcggaactgggactgaggccaaccaagcctatagtgtccccacaaaaatgggatccaaactggaagacatcctgatggacgacaccctttctcccgtcggtgtcactgatccactcctttcctcagtgtcccccggagcttccaaaacaagcagccggaggagcagtatgagcatggaagagacggagcacacttgttagcgaatcctccctgcactgcattcgcacaaactgcttcctttcttgattcgtagatttaataacttacctgaaggggttttcttgataattttcctttaatatgaaattttttttcatgctttatcaatagcccaggatatattttatttttagaattttgtgaaacagacttgtatattctattttacaactacaaatgcctccaaagtattgtacaaataagtgtgcagtatctgtgaactgaattcaccacagactttagctttctgagcaagaggatt

SEQ ID NO: 106897 - DNA, 1018 bp, Homo sapiens
tctttatactgcaaactatttaaagaaatatgtattctgtaaaagaaaaaaaaaatgcggccttttcatgaggatcgtctggttagaaaacataactgataccaaccgaaactgaagggagttagaccaaggctctgaaatataaagtctaatcttgctctcttttattctgtgctgttacagttttcttcatcaatgagtgtgatccagtttttcataagatattttattttgaaatggaaattaatgtcctctcaaagtaaaatattgaggagcactgaaagtatgttttactttttttttattttatttttgcttttgataagaaaaccgaactgggcatatttctaattggctttactatttttatttttaaattatgttttactgttcatttgatttgtacagattctttattatcattgttcttttcaatatatttgtattaatttgtaagaatatgcatcttaaaatggcaagttttccatatttttacaactcactggtggttttccgcattctttgtacacccatgaaagaaaacttttatgcaaggtcttgcatttaaaagacagctttgcgaatattttgtaaattacagtctcactcagaactgtttttggacacatttaaggtgtagtattaataggttaaaaccaggctttctagaaagaataaacttacatatttatttttaggacatgaaaatagcaatattcttggagattgataaccatagcattaatacgcccattatggtcatttaaattggggtttatttcagcaaacttgttgaatttatttttaagaaagaaatactgtattgggaagttactgttacttgataacaatgttttaacaagaagcaatgttataaagttagtttcagtgcattatctacttgtgtagtcctatgcaataacagtagtgttacatgtatcaagcctagatgttttatacagatgccatatagtgttatgagccaggctgttgaatggaatttctcagtagcagccta

SEQ ID NO: 106898 - DNA, 3394 bp, Homo sapiens
aggaccaccggcatcacttgggggcttgttagagatgcagagtctcaggccccaccccagacctgaatcacacactgcatttcaacaaggcccacaggtgactgcagcgtgtgttaaagtatgagaaatgccaccagggaggagaggcccacaccagtccagagactagtgattcagagcatcactacccaagagaactttacgcagtgatgcaaatgttccgtctgtctctgtgctggccagaattaaccgctagtcacatggggcctttgaacataaatgtggctagcacaactcagaaactgaatattaaatgtagtaagatttcgttcatttcaatttaaagagccacgtgtggctaatggtaacaatactggacagagttctagttctagagtgcggcttttctgttgccccaaacttttcagtgcacctgagctgcaatgggctgggaagtaccctcactgaacctctgcatattttttccaggcatcctgtacacgtcaaagaagagcccctcgatccagaggaagctgaagggcccctgtccttagtgacaacagccaaccacagtccagattttgaccatgacagagattacgaagatgaaccagtaaacgaggacatggagtgactatcggggcgggccaaccccgagaatgaagattggaaaaaggaaaaaaaaaaaaacacgtcaaaagttagcagtgaaattgttctccatttgttgtacagtctggaggattttcactacgttttgacaactctgaaatgtgttaactcttagtgccatcaagaaccccatttgggagtatttttgatttttctactttttgttgaaaaaaggaatttgtactctgtgcattggatggacttgtttggtacttgggattttcctctcttaaccgtcaacatcagtgttgtaaatttgctaaactgattcacttttagcagcagactttgaactgcagtcctgccaacgttggacactgaggacgcccgacagagcttgtgcacctaagctgcagaccaagcctttgcccagaatttaaggattccaatggacgacctatttgcacagtactgcatgttgattatcactgcctttactccttttttttttttttttttttttttttttttgcttccagttgggatggggaaggcctttgtgtgtgtattggggggaggggttaaaaaataattatcccaaactttttaatgtattgctttttttttttttttttttccttctactataccattttaagttctgacctcaggcctccatttgggccgatggcctcttggaggcttaaagttttctgtaccttgtgatgaatgttaataggtgtttttattatacaaagctgaatgtcatttctcgtttgtagctttctgtcactcattccatcttccttcagacatcaccacgtttctctaaagtcagaaaacattccgttttggtctttttcaaaaaggtcccaaatgctgcactctacacatgaaggccctctcacacagacgtgacgtcctgccagaaagagaatgaatgacagaaaaaaaaaagagagacaaactctaggaacaatgccgattcattccacgcagcagtattgggggtggttcgggggaggggtgtttcggattttctttttttcttttcttttctttttttttttttgcagcaaccattaataaatgccaccacattctaccagcacaaggaaacataggcagcactgaaaaaaaaaaaaaagctcatattaattagactgacaatatggccttggaaggctctcccttgtggaaccaagttgccatgggccttgggtgctctgcgataacgggtgtgggttggttttgtttgcaaaatggccaaaaaaaaaaaccggcttccccgagcagctgccctgaaagtaggggtggcggcggcggcgctgagtttatacattagttcagacctacttggtggcattaaactgtttgaatgcaaattcgatttcagattgaacttgttaagggagttaacgagggctgagttcagcaaatgctaaagtgttaatttcaaatatgcaaatttggtactgcagtttgttatgcaatattatatcaccaacccagtatcacaaaaactcatagaagatatcatgtaggccctgggctttgggggggtcccaaacatggtatgcagaaatgtgatggttacaggtcagtacaacctcagtccttagaacccctccacacttcagctctgcacccactttcctgtcatttatttatataggactgtagttttttttagttcgagagcctttcgaagcttaatttatattctttctttgtaccttttttctaaaattaccaaagatattacacaaaggtaaattatgttctctgttttatgctttatctgatgaagccaaatatcctcttattgttgatcaaaggaggcaaaagaatttagaggcaaatgacaagcgataggctattgcaacctgagaaagagaactgctccttcatcgtaaatttagaagaccaagtagataatggaaccaaagttgttacttttttctagtagttatttttcctttttctttttgtgtacctctacagagaccaaaactcattctcttaaagagattttatggggctactgcagataaaaataggacacaatattaaaggagctacagaaggaagggagtcccatctcaaaaaaaaaatgaatgtatgccactgcaattagagtatccaataaaggagacagtttagagtcaggacagaaaagcttccataattgaactagattacataatagtatttctagaaaaagagatatttttagattgtatgccacttttgtttaagaactgtgctgtgatcactgtattaattttggtttatcttggcatatatccttcagtttgtttttatttttaatttttcctttttttccgattaggctttggtcagcatttttcatttaaagaaaagtaacactcccatccactcataagcttggtacaaaaacttctctggcagttacttttgaagcttcactctgctttctgtataaagggcagtctgtggtcacgcaagactttaaaaaaaaaaaaaaaaaaaaaaaaaaaaaaaaaaaaaaaaacttttccaggcagcttcatgatgtgcaggcagtagccagacagggtcatgggaagggggccctgtgcttctaaactgagtggttgctggttagtttggtattcaaaagaggataaaaatctggtagattagttcattctcagcatgtgtagctagacatgagtaaagataacagcatgagaaactgttagtacgcatacctcagttcaaacctttagggaatgattaaaatttaaaaaaaaaacat

SEQ ID NO: 106899 - DNA, 1082 bp, Homo sapiens
ctctgaataagaagaaaattttaagtaaatgacctgaatctctttagaatgtcttcatgtccagcgttgagtctggatccgtaagtttaaccaggcgggactaaagaaatgaagccttgcttgttactgtacccagtaagggttggggattcttctgaaacccaaaggaaagatgagatattaaaagctcttcacccttgagttgagatcctcctttttgataaattatcgatgttaagggtctcagcttaggaatggccagaaaggacttttaaccataagcaagatatgtctgcagaaaccatcaactgtaggaatatagtcattttgccattgagagttccactcgtgttcctttggcatttactcagttaaaatacttgccgatagttagggccaactctcatattctggaaggtgagacataacatgatagctactgatctcttgaccggggcggggcggggcgggggcggggggtccgttcaccaccccccgatcctttgactatacaaggcgatactctcaacggtaaaatccactttagaattcttcataggacctctggaagttttaaaagccagaagccatcaagaacaaaactgtatttagcagtattaaccaagtgttcctctttcgtggtttgaaaaaaataccccctttttatgggaggtaggtgggcttaaaaagggcagtttcatactttgcatgtgttgttttgaagtcacagtaacattttcagatttgtactctggaacctattttgggcttgtatgcatattaaaaaatatttctgctggtcagttattaccagagactagacgaaaatgccaaagtacgattaatttataattttggtttatttttgcttttggaaaagacatccttaaccatgagaaggtcctccacgggggtggtagctacagctcttggggatggttttacaaatgtggactgttaggctgaatttactgctgtttttggagtcttttcttatagaaaatgtaaatgttctctcttttatacttgctgcagaatgcagtgcgtcataatcttagtcttcacaagtgttttgtgcgagt

SEQ ID NO: 106900 - DNA, 1616 bp, Homo sapiens
ttctgtcagaaggtatatgtgtacatggatatatattgatgaagtagatttaaaaaccgtttagtatgcaagcatgctgaaaccttttctataaggttttttaaaactgcaatatataacataattgcttttgattaagtattacaatacgatgtgattattaggaaattcatttcacacaacagtgaaaatgagcctgtttaaagatggcaagtcaattatcacaagctacagtaatctctgatccctagaattaatctgagctctaaataattactgagctttaatcagctagtgaaatgttttgcatttctctttgattctgctttatgaatgactaataaattaatatttctgtacggaaacagaaataaaaactcaaaacaattagataattccattttgaattttgctattgaactgttaaatacaaccattaatcttagatcattttgtaaaacctttctcaggatttagctctgaatcacagtgattttatattttcgagaaactgtggaatgacgactctgctgatttggtcataaattatcttctgttacattctgcttcacaggccattctcgaatctccagaaaagcagctaacactaaatgagatctataactggttcacacgaatgtttgcttacttccgacgcaacgcggccacgtggaaggtaagctttctcaggcctgtttattcttggatcttgacgttcatagaacagtttgttgttgataaaatgcagttgtgctataaggaagctacatttatattgttttgatactcttaaagtgtccaatctctaggtgtatttgattgggaaaatagtgccattgtggttgaaatgctctgatggaagactcccattataccagcatcagcagtgtggaggggccagccagtaaagtgatctctctctggttggaatatgtagagaaaaggagacaacaccgtcgcccagaagtggaggttgccatattacttgcacaaacctcatgccgttaggtcttcagccacagccgatatttgcagagatgtatctccagcgatctatctccagagatggaacctggagaaatgaccaaacttgacacagccttcaatggttggataaatagctcattaacccaattagtagagaaagctgtgcaatccaagcactagcactgtttgtaggagttattaatggagaacacaatgtattattaaggggcaggggtttttgtttttctttttttggttttaagtcaagagattgtcggccaggcacagtggctcatgcctataatcccagcactttgggaggctaaggcaagaggatcacttgagctcaggagttagagaccagcctgggcaacgtagcgagaccctgtctctacaaaaaaaattcaatgaattagccaggcatggtggcatgcacctgtggtcaacagctactccagaggcagaggtgggacgattgcttgaggcaaggaggttgaggctgcagtgagccctgttcatgccactgcactccagcctgggcaacagagcaagaccctgtctcaaaaaaaaaaaaaaaaaaggagattgtccctcatagatatactaaggaagaaaagtagatttcgaac

SEQ ID NO: 106901 - DNA, 1803 bp, Homo sapiens
gggatttgtctattcttcgtagctgtgaacacccaaaaagatgggcttgcacttgctgaatgagttttgatttctgacaatgaaactggaactcagttaacttggtgatcttcctcccaaaactgaaagggagcaggcatgaaggacatttgtgtttgtaattttcattgcatctttcagaaagccacagtgtttagggaaaagttcttaaactgaaaagagaagccgagaagtatagtcagtcctcagaactgctttgtggttactgtgtacctttgccctttgactgacgtatgtgtttgatggtaagcgcttcaagggcagcaattagctgttttcttcctgtttttgtcattgtaggagtaactgccttatatttgctcagttacacgtgttgattgtcatgcataagcagggataaaatgctctgcacggaatcttttccaaaaatgagcatacagaaaaatgaaactggttagtgttcatttttgctattaactaggcataagatgattatacaaaggatctagaatcatacaagtgtgtggtttgaccttgggtctgggttgggaatatgggcaaattatttaatctctccaagcctcagtttgcttatctgtaaagtatgagtaataacatctcagatattagtggtggtatgagaattgaaggagaccacacagtggcaggtggttttaaaacatgatttttacaaatgttacccatgactttccaaagcgctctgagattcttaggcttagcagcgtctgaattataaaagctgtatatttatgagcattagcctttcatgcactaatttccttgaccctttgcttgggctgatgcttatacatactgttcctggacttggtcagtgattaaggcccgaggtgaagaagaggtcagccccaactcttccccccttggcttctcagctctgccccatcctgcggctgctactctgaactgttcacacttagtttgcaaatgtgtgtcagaaagccaggtttccaacattatagagaaaaacccgctcatggcatctgctcagcttgctggggcatttgtaagggcagtgccatctccagagcttgctcttcgcaggcattgtctcttgctcaccgagacaacattctacgctgaaaataaaaaggaaagcacaactcaaagctcacaacattctgtttccagcgccatgtttacatttttccattagtatttcttcatgatatttgatctttcttttcttcaggttcattgcttttttatgaaactctcctgaaacatattagagaggattctcaggcccccctccctttttttttttttttaactagagtgtgagtaaaggtcgagtcttcccaacatattggaactctcttttaataagttctttgattatgatctcagaggaatctcatttttaataccttccacaaatactgccttgtacttaagactgactatagcaatggtgaattagacttggtgaaatagacttactatggtaagtgatttgaaatctggtttgagaaaatattaccaagtaagcctactttgctgaagtttattggattttagggtgggtctgtgtatctgagacagcacataaacagtaatacatacgctgaaaacaaccaaattcttcagcattgccagacgtaaaataatatttctgttgcaacaaattttggggaagggttatgccttttagtatttgtaagaacagtactttaaggtgaagataagaaagataaattgaaacagtgctcattaatttatttttttctttttttttttttt

SEQ ID NO: 106902 - DNA, 1036 bp, Homo sapiens
tcaaacctttgacagctagagcagcgctacaagccaatataaagaactccaagatgtaaaccaacaataggccgtctgtgtgaggtttgccattgtcaaatacatagattgtttggattagtttatgtaaatgtactgttgtattaccctttgaaaaaaaaaaagatcacatttgtgtatgaaaagtggttcccttcacaggcagcattataaattccttatcctttaacttacatgtaagaagtaaaaattggtgcctgacaagcagatattgtgtgacactctgttgtcggagtgaacctgccttcttttcatttattggaaaatagaaaattttattaaagataccatcttataaatcaggaattattaaaatatgtataggtgaggcattgggaaattaattataaaaggtagacgtgtaatgttttgcataaattttcacttctttgccaaaaagaaaaaaaaaagggcacacacatacagcaaacccttgatgctttcaactttaagggcccagagctatctggtgactgattctcatgtgcaaaatattccctgcagtctgtaattaatttattccgccctaaataatagaatgcatggcgtttgtttgaatgagtatccttctagaatctttaatttgaaacaggcagtcaccaggattcaaatctaaccatagatggggactttcatgttacaaccttgccagtaagttcatgaagctttttcttttttccatttctgtgtagaagaaacctcgtgtttattttaaaattcttagtcactaagtgatagaatgctttgctgtaaatgttgcttttcactaaatgccatttgggtgttaagtgtcatttgctgtatccaatcatccaaccagtcctcatttcattgcatcaaagaaactgctaaaacgttcttagattgtttttacatcagctcatagacgcattttctggatcttattgtgggactcatcagatttggatagttagaggatacgctcatctcgggaaggtgcccaagtttttggaca

SEQ ID NO: 106903 - DNA, 1009 bp, Homo sapiens
gccaggattgtaaggaaacacttgaagcttccgcgatattgggcccccactgtccaccggccgtgggcctagggatttaaattcatatgaatccagattacttgggtcctcttaggtgggacattcatatgaactcttccagcctctaagctaaagaagagatgtcacaaaaagttgcagtggtggttggattttaattccgtttggggaaaaggggaaaccatctgatttcacagacagaaaaaaaaaaaatacaaaaaacatctgacagaattgacttcacttaggaagctgagacagtggtacagatacatatttctgatcacatgtagtggttttaatttgttctgtgatcatgtgacattgctaaactgctgtatattttttctgatggatgaagatgtcctgatgttttcatcatgtgtcatcggggcaggttcaggacaggctccctacaacccctcagcctctaggccctttaaaatgaatattgaaagcaggcaagggaaaaaggaatcaaccaaaccaaggttgatctgcctggcaggcgacgggggtggaggtgtgtgtaccttgtattctttaatgattttattccattcagtcactacttaccaagcacctattatatagggagcactggatacagatagtaaggtggtgtggcctcttcccgtaatacacaacctagtagggtaagaccaggatgcctttaacttccctgccaggcagagtttctaaaagcaaggggtgagggattggggaaggtgacagtggaaagggttgttggcaaggacattccaggccaagggagccatggaagacgttgcctagattgtaggataaggaagaaaggatagtggaaggatatattgctcttaaaattaatctgtctgtttaacacgaaatagggtgaccaactgtcccagtttactttcttggactgaagggattcctgggagttgggattttcagtttcaaaactggaagagtcctgggcaagctggga

SEQ ID NO: 106904 - DNA, 1051 bp, Homo sapiens
ggcagatttttcagctttgatagacatcaaagatgatctggccagaagttagtacaatgtggtcgttacctgtgatgttcctcgtaatgtttttgtcggggagtttgccgtaatggaagaagggacaggctaattctgacgtgttccatttctgcaaagcttgagggaattatcagagtgatgacatagacctcgttgagagcaggggttagcaacccacagaccccaggccaaatctcacaagctaaggaatgtttttatattttaaatggttgagggaaaaatctgaagaacattatttcgtgactggtgaaaagtctaggaaattccaatttcagtgtccatgcgtaaaattatatgagaacacagccatactcatgcccattcatctactgattacctattgctgcttttgcactacagtaggagagtcaagtaattgaaactgaaatctacatggcctgcaaagctgaaaatatttatgatctggctcttacagaagtttgccaggcacccctggtcaagaggatcagaaaaacaatttatattatagtattagcaacttgtccccttaggttctggctgcctaagctctgctcacccgcttttatctctttcttcttagccagggtgtataaaaccagtctagtctccacatgggtcaattttccctactagctcttcacatggcaagtgcctgccagttttggaggtcatggaaagctggacgagggatagtaattcattctttcatccatgcatccatccatccattcatccacccagacatccattcatccatccacttatttagcaagcatatttcgaacctatcagatagcaggaatcttgctggagctactgcagagtacaatgattaaaacagataaagctgccctccaagttcttacactctagaaggaagaatagactacaaaataatttgctagtgcgactgtccattcattgggcagtgctagctgacattaacaggttcttgagaacaccagaaatttattcaaaagagagtttcagtgctagaaaggggcca

SEQ ID NO: 106905 - DNA, 1032 bp, Homo sapiens
tttaattgtacctagtcaagtaccagaggtgaacatttgttttacttagttgtttcaaagggttacagacctgggttttaaatctctgattcaaaccacatttggaacaaaaacctgaaatagggtagcacccagaagccttaaaaatcagctgtccctgttgttgttgttgttattgaagtattcaactatttttatcttacatccaaattgtaatgtggcctaaatatcatgacagtcttgttcatagaatttgaggcaaatatcccattacagaatcaggtctgctgtatcactagtaagaaaggactgagtaatgtagagacatgaatttttattttcaagactttaggctttgattcagccctctgattaccagagctcctgcgtatgctaaaactgattgaaatttcaatttgttagccttttccctgttggaaagtctaataaatagtaaaaggaccacaagacaggcatactcagcatgtggcctgaatcatccgtaaactggatatctagaccatcaacaatcaagaacccaggcagagttttccttttaaataattgtctgcatttctctcccccaccccccaccattggtacataatttgcatgtgtaggctcatgtttcaggtttcatatgtttaaagttgcttttctaccctttgccatttctgacattcacgtgaatgcatttcagtatatggatgtatcatcagttatatgaagtcagttttcctgtggtcagacgatcctgttccaacccatacaaattagactcttccgaaatacctagcaggccctgtctctgattgctgcccattaaggtggtcttgaaatgccaccctggctgaatttcttacttatttatgtgtaaatggttatctccagacgccctgcagaacttctccctggaaggcttttctttgggtgataacagtgtgtgccacattatacataatgacagcattaaagggtggggatggaaaggacaggccaccccctggactactatctcctgggagctagacc

SEQ ID NO: 106906 - DNA, 1448 bp, Homo sapiens
tagaaaatccataattttgattgctggtacttcataaacgtataactggtactttttagctgtctctttagggaaaaatgagttttatcacctgcggtacctgggttaatgaaattgtgtgttggaatttagccaggatgaaagatgagatcattccaagacactaatattggcaacaggtctcataaaaagctctgactcttgagtgaagtatcattagatttttttattattattattttatttaaattgagagattaagttagttgtcattttcaaagcttctgtactagcgagattctcatttggcattacgttcaaaacccagtgacctaaaaacctgtacggagccaagagaaacagagaagtgtccatcagtgcctagtacaagaatttccttgcttcaaatttcaactccagttcctgttcagccctttacaaatcacgactctcagctcaaatttgaaataatgctgcctttttcccccgtgttcctcctgtgtttgattgtttgtggatattagctgtccaggaaatcccatacttacagatataaatccagaatgatcttgtttttccgcagccagcccaggatgtattagacagttatgatgatttgttaatttttgtgacctgtatttattttatgtgtgctgtatacttcgaggctggaatcagctgttgaaatgctctccgtctctcacaggcagaaaggaagcgctctacttttccttttctgctttggattttcttgctttatttttggaaggttttttaaatctcttcacgtctgctttttatgcgcttcttccatatggtgataaacaagaggtacattgtgtttgatagacttaaactcaatcctatcaagggtgggtctttggagatgcatgaacagggtcacattctttccaaatgtgttttccatccatgatgtgtcttgactgtgtaattctattctcgtttttatggtgatatacatttcccccaaataatatattaatcctcagatttaatatgtgtttcagtagaattctgcctattacagataagaaaattatattatagtcttgaagaagaataaaaatcaactgaagttagcattattttttttctcttatacccgtcttcataaagggcactccttatgattctggtttttttttttttttttttttttttttaaatcaggtatttgtttctctccacctctgattcagtttctattcacagagacccactactgctcctgagtctcagtgtcagctcactggctaagagatgctgccagtttttgatgtctcaacttaggatggttatagaataatggaaactagggcagtctaccaaaaaattaaagaaaaagtaataaaaattcaatcctaccaaacaatctatatttatagtagcctgttgtttttatagctgtattttagcaagattttata

SEQ ID NO: 106907 - DNA, 1017 bp, Homo sapiens
cagagagaggggttcagaaaaaagagaggtgggggggactcacaggtctaaaactgaagcatatttttttttccctcctgaggaagaaatatcataactgttggtaaatcaaaaccagagatttgacacttttctgtgatcattctgcagcatttgttcccaaggtgaggtataccacagggcccttgatttcaaagataaatactgtacaaataaccatcctgttgtctttccctcaccgccaacagagggacgctttatcagaatcagcagatacccagtctattgtatgcatttatttccctgtttcttctgaaaacaacttgcagttttagtgttgatttttttttaatctatcaaccatgagttatcatgtgactgttgcatttgttagtgctaactgatagcagcaggtgctcctgctaactctaatgaaatcgtccagccctgcattgcttggcatcctccgataacagaaaaacaaaaacaagtcccgtatcatccagagtggtgtgaagctcatcggcgttcttccatcttctccccacttgagtcctttcttttttcttcttttcaaaccaggtgaaagacacaatcttcactagtaaaaacgtggatttgtaattcttccctttcctccccctccctttttttaatgctcatgtaatgcattggcaaaatgaggagtagatttgaaggttaaatcctgaccacatttccctgtttttaacttagaaggtaaaatcaaatgcaggcccatagtttcacaaacaccaggtactcttatgtgcttgggggaaaatgtttccatttctcctagtttttcttttaagtgaccacttgtataacgtctactaaaagtatcatttgtatccttgcttagtatcctatttgaaaagaattttttttcttttggtgatttctcagggagaaaaacttcatgcagaacaaaacaaaaattcccttgcttgttagatgtatgtaatttatgaaagccaaaataaactgtatatgtgc

SEQ ID NO: 106908 - DNA, 1017 bp, Homo sapiens
ttagaagggatttcttatggtttaggcaaattgatagcagtgttgcttgaattctccttggtattcttacttaataaaggtaacattgctttgaccttgatttaagtgttacttcatagattattttcacctattttctgttcccttgattttacactcccctagtaatagtttataattaaatagtactgaaccttaaaacaggcatagtcccgaaatgcttcacatatattaactcatttaatcctcacaaacagtttatgctagtattgtagtagtattcccagcatagagttaaggaaactaatgcccagagaggttaaatgatttacccaaggtcacacagctaataagaggtggagtcaaggtccaaacccaggcagtctggcttcagaagacttattcttaactgctgcattatacagcctggttagaggcagcacttcttattgacagtttgctttctgcttggcagtggatgtaaagaaagttttggagaaagcctgactgggtagtgaggacattattaatatgttctttgaactagccacatgtcatctgagcctcagtatcagcacatgtgatttgggatgttaaccactttttacggttgttagaattaaaaggtacaccaggcaagacacaggtggtttacccctgtaatcccaatgcatttggaggctaaggtggaaggatttcttgaggccaagagtttgagaccagccaggtcaacatagcaagaccctatctctgccaaaaaaaaaaaaaaaaaaattcagctgggtgtcgtggcatgtgcccatagtcttagttaattgggaagctaaggtgggaggctcacttgagcccagaagttcgaggccgcagtgagctatgataatgccactgtactgtagcctaggtagcaaagcaaaaccttgtctctaaaaattaaataaatgaatgagtaaataaaaagtacatcatataaactgcctagcccatactaggcactctttaaaagcgttagaacttctt

SEQ ID NO: 106909 - DNA, 1013 bp, Homo sapiens
ctaaatgattaggctcactgctttatttaccatcagatgcccaaatcatccttttcccaccatgtttcatcctgtaaatgtagctctaaattaattcaagataaaaacattattctcctcatttttatttcccttcttgtcttttttggcacgacccaaaaggcagtaagaatataaatgcttgttccacttttttgagaaaacagaaaagctcccattcagaggtgcagctggtgttgtccaatgatgcttcatacagaacgactgcaaagctagaagcgagtcccagccacacatgcagcgggtgtgtggtattcattgtgccactgttagagcactcagcagactggaaatcaagtcctgcatagcacttgattctttttctactacatacatatatgcaaacacacatatgtgtgcaaaaaaattaacaattgcacagcaacagttcctacaatgtgcaaaattaaaacttcaaaagatgtaagaagtatggtgaaaactgagtttccctgctactcctgactccctgtacccctccccagaggcaacagttgttccagtttcttaggtatctttccaaaaagatgctatcgaggcacctctgccagcttgttctctctccttccaaagccaaacactttatttcagacaattgtgtatttaaaagtatccagttatatattaaatatgaaaagcaaatgacaacagtgtgtacaggatgtttccatgttttaaaataataatgtgttagaaatgcaatataaacccgaatggtaaatgatgcctaggttggggtgtgggggtgcacttccttcgggaaccactgcagtttaatatgtgaacttgtgaaaacaagagcatgtaattttttcataataaagaaatttttttaactaagagacaaattcacaagcggtcttctgaatgtgtaattgtacccgtgtgtgacgagtatgagtttctttagacttcaggtataactgattgcgttctaaggccctagtgtgtcg

SEQ ID NO: 106910 - DNA, 1054 bp, Homo sapiens
gaccttttcctccgatgctacagtatggaatgtgaagaaactttacctgtcgttctgttttctgcaagagattgtgatttcttttccagctgatttccagctgatttcgaggggatatacaacagtatgaaaaacgccagaagaatacactgtaaagtggaaagtggtgctaagtatttaaggaatcatctctttgagattgtgaatctaccttgctcttcttagaaaaggtcgttgcgatcaagtttcaaggccagctcgtctagtttggtatcattttgtgtgactgagcatatttcattcgagctaatgatcaaatatttcacaaatatttgatagcaattagtttttgtaaatttagtaatttcaaatcagaagtctgattatattttcagataggacctcatcactagaatattctcggatcaaattcgtattcccatcttcaaacctaagaagtacatgatatggttcggtacaatctcattgaaagtaagctatgataacagagtcacaggcagggaaatgtgataagaactaaaaagtgaagagagaaaagggaaagtaggatcattttgtataagctgtcattgaagaatcagcaaataaatctgaaagctttaaaatagtagtggcttccatcgatgcctgccattgtagcgtaagtgtagcttaagacactctttattagtagatagggctaaaattgtatatgaagagaacagctttctagaaacccaaggtgtctgatttaatgtaatgttttggctgggaataagcagtctcttaccgtgcagacaaaaatcacaggctgggatggacctgaaaaaggaggattctgtggcttacagtgttgttaggttgacataaagttgtgcacatggacatgagaccaaataatttggaaggataacagacaaagagagacatggaagtcttttgtcaacaaagcagccttactgatgagtatgctcggtgcctgtctcagggtcggagttcataaatgttggctggacggatgaaagtcctaaatggtgggaatgaagaaggtggc

SEQ ID NO: 106911 - DNA, 1601 bp, Homo sapiens
gcacaccaaccagcctccagtactacagctctgattctctgctccgttctcctgctatgccacataaatactcctggcatctgggaatcaagatggcacattttgcccagtgtggctggaaaggggggagataggggagattggtgacatggttagtgatgaaaataactgccagacttactacctttcgtggcacctagcctcaggttcttaccattggtaaagcagccagttgctggtcacatagatagcttacaaatgagatgcccttaaatctggaggaagaagctctagtcctaaaagcatcagacacactacactgtgctgttggggcctttgtgggtctttgacccctaagtccagaacgaccgtgaggctctgccatcccctgtgaaaattcaaattaaagtacgtcttcagagacttgctactttgtcagtgtcaacctgcgaagttaacccagctacagactggatcctcaaggactactttatgagcttttacttttccaaacttgagtcgtttgaatatgcgccccattgttgtgaggtttgccctgtctgcttatgtgattatttgtattattttctttaaatcaagtcatttcttaaataaaatgagcctcattctaagaaatgatatctgtgaaatcagaagttggagacactagatatattttagtccattacaaattaagatacatctgcaaatcttcaaagtatgctttcttgctccatttgacattgtgtggaccccactgagtgtgtgcatattatgagttggtatgttttcataggtttttctcatttttcagagggaagggaccttgactgaatatggtactgtgccaagtgcatggaaaccctgccttcctagtataccctaatttcttagaaaaattcaagactgtcacttaaccttcctaaaaagttgattgtgactctgcttttcctcacatacatcctcagggatatgaaccaggcttagaagatacttaaagcagacctagagtttggggactgtgaagttttcaaactcattgattcagtagtttactctgggataatcttgatcagtgtaatatctggtaaacattaatcactgaccatatcacccaacagatctgtgctgatgtaaaattggtgtttgttaaacagaaacagaaagtgaccttttccctgtgctaacttccttcagccttacctgttttgttacgtttaaaaaacaaaaaagaaatacagccttgcattaatttttaaataattttgagccagcaagcatttctgtgagtttgcaacaattacttggggaggttgcccagtgccacccccttacatatttatctatgtccatccatcttgttataaagagggcatccttgtgactgtttctttaagcatagacatttttaggtcagatacagatcagggaacacccaagatccttggtactcatgttatggtccatggcccagcagctctgggggcttactccacatgcatagtcgtgcgccaccccaccacccagaaccaccgaatcggatttatatctgtaataaagttcgagaagcactactctaggaatagcaatgggaaaggaag

SEQ ID NO: 106912 - DNA, 1074 bp, Homo sapiens
ctacgttagggtgagttgtaaaattatttcattatatgttacaatgtaataataatagaaataaatgcatgataaatattatgtgcttgaatcatcccgaaactattccctgccccccagttcctggaaaaattgtcttccatgaaaccagtccctggtgccaaaaaggttggcgagcacttctgtaagagaacctggttagctgttgtcgatacctgtagctgctccaaaccatgagaaaacttaagtttctgctacaagtacatctcaatctttagcttgcctcagaatccccctggaggaatggctaaaatacaggctactgggccccacccttagtgtttctgattcagtaaattggggtggggcccccacatttgcatcttttacaagttccagacccgtactctgagaaccactgccttacaacgtccccacctggtatccttatggtgtggcattctaccgaagttcaaagtgacggataagtgatctggattaccattacttaggaaaatacaggtttcagagccaagactcaacatttcagagagaaaaattctcaagactgtggcccaatataagctattttatggagcaaaatttaaaaaaaaaatttcaattttggccttaatttcattcatcagggctctggttttgtcttcctagattttttgtgtgtgtgcttcggttctctgctctcactctattcctttcatcacctgagctcctactgatacgttaaggcccagatcaaatgttacagtactttatgttccagccatctgttcagttatcactgtctccccaactagagaattgggtagaactctttccgaggatgagaacttacttaaagttgcagtcaatgccagtgaccaccaaacttgattttttacccatcagtataaaagtgttgaatgtgtacccctactaagtatgtttattaattatatacatgtttctaatatatattccttatgttataaaaattggtggctaagagggtgagaaatgtatatatacattttcaagttctaatattaatatgtgtatacagaaatcttaatattg

SEQ ID NO: 106913 - DNA, 1028 bp, Homo sapiens
taatatttgtggtttctaagtcttaaaatgaaagaagagaaagaaaaaagaaaatcattatccgcctcagaaatctgagagtaaaacattggctggaggtgtgagaagtgcaaagaatcaagaaaacagagatttcccagtgcacagggtgaaaaatagggactttttaaaaagacactttggaaaattcaccaggaggcaaaaagccttctccatttatatacccaaggcttgttctgcttttgtgtaactatttgtgttcttgtttggtaaacaaacagaccccatagcaactgtagctgatgatatttatactacctgtaagacttccctaaacaaatagacagacttttatgaccttcaaatttcattccttttatagtcttcaaggaaatcagtctaatggcaagccgatctctctctttctctccattgctttttttacagtactttgagatatgtctttgaaggagcttttgtgtattgtgtattttacatcttggctgtgaatgttgagtgtttgaagatgtactatggcagaaggaaagaggaaacctgaagtgtttgtgcaaatgatgtgatatttgctttcaaaggagtcattttagtaatcagtggaattctgggtcatacatccaaaaagcgaacactccaccgaaatcatgaccatagacctgagaatcaggcggatatctatgtctgtgactctactttcatgtctgaaatattgatagaaacattgtggtacatatgagcccctatattcaacttaaatttttccatatgagtcagatttatgacaagaacaagatgtctcgtgttaaagatcagtgtgagagaaaaatggcagtttactttaattagaaaaaaattgacaccaagagctggaataatccagtggcgtttgaataaattagaggactgtacagacagaaataaaaagaaactcaacaaggataaatgggaagttgtccaaagtgcaagaaaaaatgtgttcctcagtgggacagaagtcacaggacacttcc

SEQ ID NO: 106914 - DNA, 1055 bp, Homo sapiens
acccctgaccttcaccattagcctggtgtttctcagattccctgatgatattttcatagggtatttgttaaacacacagcttcctaggcctttcttctgaaacctggactttcttggtctgagatggggtgcaggaatttgcatttgccctacataccctggagtcttgctactcagaggctgcagaccagcagctctgctgtgacctggaagcttgttagaaactcagtctctggccctgccccagacctgcatcaggatctgcattgtaacaagagcctcaggggtttggaatacatgttcaagtttgagaagcaatggaagctgtgtgtttatcactgaggttttgacacttggaaagaacaggacttttctccagacacttgattcacatcccagacaggttctcatcaaaagtcagggctgtagttaaggtggtctggggagcagcccactggggagccaccagacaggttcagtcctcaaaactagtgacttgccattcttacgtgagccaacagagtagaaatcatatgactgaagggaccagaccccatttgcttcctttccttaggagctaccacgagaccttgacttgagacccactccttggctctgtgatcacaggcaagagacacaaatttaaggttctgttttgctcttgtcaaggatgaaaggacctgacatgtgatggtggtgatgagaatgcagctaacatttatgtaactcttactgtgtgccagacacaatgctcaacagacttgacatagggcttgatactatactgattttcctatttttaattttttttattttttatttttattttttgattttcctatttaatcctcatagtaaccttatggggtattctcccctttgtacagagggtgcagctggggcccagaatgatgttatcgcttgcacacgtcacatagctagttagtgaccatacagggactagacctgagatttccctgaccctcagggacttgcagtgactgccagattctggtggctcccagtgggctgctccccagaccaccttcactaca

SEQ ID NO: 106915 - DNA, 1308 bp, Homo sapiens
gatctgggggtgctcgatgggaaaatttgctggaaaaaggtagtgttgtgagagttactgttgttttcaaagtagtgagatggctaatgatctcaactgagttgcatatgtatttccatgccatttggaaaactccttctcccccactcttgcccccgtgcattttgctggctcctgtgagcagccactgcagtagcagcagctctggggtttggtgagctgcaatctgttaaggagataaataatgtgcttggcacgacactcctactctcctctttaatttgtcttacacaaggaaaattataattaaatcattcagggtaaacccttgagtgtagagaagggaaaaaacacactttggtaaagattgccaatagaaacccacttccctgttgcgcagggtagagacatttatcaatattcagcactattacgggaggagcggcccatgtgatttgtgaggcggatgccagcgttcaaatcaaggcttgttaagatcctgtccctgtgtaatcatggacattcagcatcattagaattcagtactggcaccatgcttcgtgctttgattttctccgacaatttaataatgtttattgtgctgattgtatataaattcattggtgcaataaacatgcctgtgttgtcagtgcctgagaaaagtgtggtggggatcaagttcaatggcgcagctaagggggagcagcaagaggaagcaggtgcattcaagcctcttgctgtcattttattccatagggacagagagtctcgacttcttagggaaacagacaaaactcaggcctgggataccggtacatatgaagatactgtcttgtttccctgtctaattgtcttgctttagaaaattccaggttttggtgtgggtaaacagaatcaacagaatgcaaatgaaacatctattaaaatgctaaatttagtaaagccctttgagcttcttggatcaaagcagctatgtaaatactaatagcaattactacttaagtaattgcctaaattaaaatttgaaatatcacattacattatggtgcactagggaaagggacaagaactcacatttaatcagttccttctctgtgccaagcactggctagacttttgcatatggagtgatgtctcattttatccacctgaccactcaggaagcagtaaggatgattatacccattttacagatgaggaaatcgaataatagaaattaaataactaacccagggtcatagaactggtggttagtggcatatccaagatccaaattcagatctgtgttttagtctgcaaaatagtact

SEQ ID NO: 106916 - DNA, 1075 bp, Homo sapiens
cgaagaactaaaagatgcattaagcatgttggtttggaagagtttgaagaatagatagaggaatagaatggtggacactgacaatctttggagccattgagggaaatgtggcttctgttgtttctggcaaggatagatatgtatgtctggaagccaatcttagctcttgctttacaatctcttatgatgtcttcttttttttttttttttcaagaaagaaaaccttagagagcattaaagaaaaggttctaggctgttgtcctttgctatacttggttttgatgccctaaggttgatgcgtccatttgctgcagagcgattgaattacatctttatccataggcagagcaggaggccatacactgaaaaacgccgactgatgcacttaaggtatttgtggcaatctcatcggctgttgtggagcctgcacagatttcctgtgacatagaaaactcttcttgtttagatgcgctgtgctcagtttcattttctaaaaggttatgtatctgcagtcaggtgatagattagcaaggaggcaagtgggagaagaatagcccttttcatgtcttaaggcacatttgaaagtaagtggatctgagagacagtctaattctgggagactaagtttgtttgaatttttttttatggtccttatttgtctgcacaaaagttgtgcttaatcttcatcatactacacaccagaattagaatatggatcagaaaagaattcagattccaatgagccttaatctggatgtaaaagcaggctgagttttccaattgtacatgcaaaaaagaagcaactatgaaattatatgccactacttaatctcttgaatctctcagtttgtattatctagtaggttcctaaacgtggctggattaaaagaaaattccagtcagcacattttaactgaatgtagccatcaagacaaatgagcaccttcagttaaagatagttcagtttaagcttgtggaattgataattaaaaaatcaattaggcctggtacagtggttcatgcctgtaatctcagcactttgtgaggccgaggcaggaggattgcttgaggccag

SEQ ID NO: 106917 - DNA, 1601 bp, Homo sapiens
cgaaaaacccccctaacactaggctttgtttactgactctttgatttaattgctgtttgaagaggacggaattagctgttaattgatttaattatccaatttgtttgtttcaggcatgattccaacagaactgcagcagctctggaaagaagtgacaagtgctcatactgcagaagaaaccacaggcaacaatcacagcagtttggatctgaccacgacatgtgtctcctcctctgcaccttccaagacctccttaataatgaacccacatgcctctaccaatggacagctctcagtccacactcccaaaagggaaaggtaggaaccagccactgagatgggtccaaaactgcctttaacatgagaggggtgggtggccctgcctcgtcatatctcagtgatccctaattggatccatgtgacttgaatgtgcatataattactgaggaatgtattcagtatggtttgggtgtgaagcatctaattattttcaccttttcaacatggaattagcacttatgtagatctactctcagcttaggaacccgggcagaagtcgtgtagtttctcattggatgggttggatttccaggcttccaggcctactccttctgccaagtgctcactccgtacaagctgaattccttggctggaagtgccttctaagggaatagtagtgtctgctgtgggcaattttgaattatggtttgagaaaacatagaacttatgttactctacattgctccccttgaaggctgggcgcccatgtttttcatcattgtgccctggagcacatggtctttcccgtatgtattctgagtgaaggtttggaggatggagagacagaagaggtagtggtggtggtggctggtggaggtgggggatctgttgtatatactcacataaacagacacagcacactttctcttcattgtgggatatagtgtagtattgtctcagcagctgtattcctatttagaagttaagacattttatttttgaattgccctgggctttacatgaatgttacttgaagctgagcttgttttagagatccagaatatgccatgttagcatgcagttctaagaaaataaagctgttaattcatgttatggtattcttagtacccagaagcattaataccactgttgaagtgcttttcaagaatagaaaatacaatgcccctaaaattgaaaactttttgtttgctattcctaaactgttttctatatatttcataggcagagcttccacacacagaggtaaagaaaccgtaaaagtagtatgtgacagtaaatgccatttctctcaggagaaagcaaattctgtattgtgttttttaataaaaatggctcagtgaaaaaacatttaattatatatttcagttatgcaattacaaatgtaatttcatatatttctcaaaatattgagtatttaagaagcctactgtttaattagatgtgtatctttataccagaaaaatattatctgaacacacacacacacacagatacacacacacacacagagatacatacatacacacacacacacacacacacaccatgttcaagtgtaaaaccatgagtggttaccagag

SEQ ID NO: 106918 - DNA, 1071 bp, Homo sapiens
tgaaatgtcatggaaagcgggttttaatggtattgcacataatatgaaagaattgagacatctgtgtgctgggtgaataaggaagagtaaaaggcatcatgcgaagggtctgtgtttaagttcggaaggtgtgtccaaggttcccttcccagcaagtataagcattgattggttgttcttaaaatcactgtccacagagcaagtgtgctcatatgggctccacctgcaaaggtgctggttaccatttgtcttctctcaaacaaaattcaagtctgggttaacttcccacagatggttttgaccaaaaactcactctcaataagcaattgagaactgtcgtatcttaactccagttagcatttattaagtttgtcctttttgtgtgcttgcaaggctgcctggaacccccatcagtactgcaagattttacttttctttctttaaaataaactccatgatagattaaataggatctgttgctgcatcccctctggataaatacatgttgcatgggaaattggtcaactctttaagcaggctgatggcagtcagctgctgaacctgggaggctgcgtgcttctgatttcctggcttcctatttatccttcattaacattctaggttcccgtgtcagtggctatgatgacacctcaagttatcactccccagcaaatgcagcagatcctccagcaacaagtgctgagccctcagcagctccaggttctcctccagcagcagcaggccctcatgcttcaacaggtaattgtccttcctccacctccagcctgtctcccccagaacccaggggcccccatcactccattcgcaatctcccctccaccagagcagctcctttgctcagtgaagagtaaagcagcgtgggtggggcaggacacagaccactccctgaataatcgatgtgcttttgcatgcccaaaagagaggagccctgccatggtgactagtgtttgggcctggagagtacccgatggactgagatcagggctgtaattggacttggtagcagtaagatcttttaggtttacatggctcctaaatggtgtgaatcaa

SEQ ID NO: 106919 - DNA, 1024 bp, Homo sapiens
ttaagggacaatgttgtttctcctttaagaagatgcttctagttttacctgagttaaggggaaaaagtattttaggagacatatgtaacttttaaaatcagttttattgagggatgatttacgtgcgctcaaatatactgattttcagtgtctagttggaagagttttgacgattgtatacacgtgtgtgagcaccacctcactcgagatatggacatttccatcgcccccaaaagttcacctgtgcccctttctagtataaggtttctatagctcttttaaaaacgatgaccaggaggttatttctatcatgatttctgctctaactctgttaagttcatgttcatcaccagtttagattttacaccaccctattcctgtctgttttcctgttcatcaccatcagaatttggctcaagaatatttatattgtacatcatccaagaaacgcagaggaaaaaagaaaccttaaacatggttcttttgtttgcttaatcaaacctccccgtatgatgatgcaactctcaaggaaaagtaaacttctattgtgatacgctggctttagcagctcaaaggataccgattggcacccaaaagatacttaaaaatccgaaaagtttcttctgtatgaagacaaagtagactaactggaattaatttgtagatggttagatgttttgataatgtcttcctggtgtttgccctaaactgaatgcgagttcactgttccaatcgttggtgatatttcgtgctacaaattatctttttaaaagggtaatttatccattcatatacatctgtcccattttgcatatgaaaatattcagacatgcccatctgttttaaattacagtgtatctacatctacacttaaaaggccactggaataggaagaattcatggatgaccttccagagctgggttaatgaaatttttcgaatgttctaactagtgttttccaaacacacgacactggcacatcaacatccccacacatgaaacaagcccacaacaacagtggaga

SEQ ID NO: 106920 - DNA, 1049 bp, Homo sapiens
atgcttaaaaatcgagggtttgcctgtgggtgggccaaaaatactgtcactcttcgggagggaaataacaaattacacttggtggtggtggtggcagtgatgttttccccccgatatctgaagggtacagcactttgggacatgctctactgccccaaaacatgtaccttttcaagaactttgcacacttcagtgtaatctgttctaaccccatggcagaagcagtccattaacaaattttacattatgttaaaacaggggattatagtttcatcataaatgagagagggtaatttattactgtcaaatgcagagttaggaaaggatgttgtcatttttcttttctgtcatgattttgtttacctctgatgcttatgaatgcttttagagtaagggatttgtttttaggttgatgttttccatagctcatcatacttacaagtcacctgaatgttgacatgtcacactgtgtatatacaaattaaccagaagcaatggctttataaaatgttgcattacatgaaaatgcaaatggcaatttggaagatgcattaaggggaatttaaactcctatggaacagtgagaactcagtgttttcccttggccaaacttgcaggcacagaagaaaaacaacataattagcttcattgtcaacatatgcataacagtgacataaacaatatcaatatggagctaactgccttagctccctgtagatggatgatgtattaatttatatttttaagtaaaagcactgcttaaatcaagacagaatggtggttccttggagacaaatccccagatctcaggaatggggcattgctgttgcaatttagtaactctaattggctgccccattgccattctttggagaaatacttaaagcagtcctccttctggggaggcgcgctttcctgagtaggccatcaggcatgttactgggcttacattttgtattcctgttgctttagctttctctctccggaattggaatcagttggttgaatctctttaagttctgtcatttcagaatatgtcctggatactc

SEQ ID NO: 106921 - DNA, 1026 bp, Homo sapiens
atcataccatgtctccatcctgctgccttcatctagttaattagcattccagctttgcattaaattagatgtcccgagaagaagtttatagccttctgactggggagaggggagagagtcatgaattcagagtcatcattcctttgtaaggagctggataaaagtgcagtccatttgataacagttcagagtccccaaaatccagaattgcagatactgtgtactgtgttgcctgctgtttagagagaagacctttggtgattaaattgtgtgtgagtttaatttcaggagattatctttgtctgctttcttcagaaagaaactaaaaaccacatgatgtgaagggctgtcccgttcctaagttctccaccatgtgactgcctgcttcttttccattggtatctaccactgccccctagaaggtttcttctgatctcctctgactataagaccttaaggcgagacactcccttgtctgcacatgggagagccgctttgtcagacttaatgaaattgcttttaataagacatcagtgaaattatgtctggtttgttgtttgtttgagagcgtaaagggattgttatttattctagaaacagaataagagtctgaaccacatagaattacacaccgaagaggttttgttgtgactaccaactttgttgaggatatgaagtggctctacctagagtgctgtttgaaggactgtgggtctgagatgggctctgaagagtgccacgattgattaggtatgtctgccatgggcactggagatgggagaagtgctatgtgcaccttctgtttgccaagcttgccatagacctatctgaccatagtctatgctgatccatgtcagagtggagaggtctttttctctgggaagtctaatagactctgtggtaactattgaagtattatctaaacttaaacatatgctttgtgtttttccctgtaaccttaaatgagactgggcaaattgcattcttatcctaaaaccatgtctcttcttgatcagctctgaaatg

SEQ ID NO: 106922 - DNA, 1049 bp, Homo sapiens
agctactgtggaggcaaacctccctgaggttgcctacaaagggcaatgttccagtgtgttttctcttcgagtgtgcttcagccgcacagtacttcctgtttattcaaacatcttttttaccactcggcaacccccgcttcgcagaaacagccagaacccatctacagcaagaagacggaaatccaaaggcagacagtacgggctcccttcgccaaactcttcattttctctgtaagtgtccagagaaaaagaaacatttttttgctgggttaaacttttaaactagggatccgttcttgtgcagacattctctgaagggcgaaataaggtgatccaacttgtttactgctttttttcctcccccttccctcctctctccatcagaggcttttttctttttagagatttgagaggaccgtttccttctaactccttgtttaattcactcttgttttcaaatatgtctttggatataatcagctaagtaagcagccgggtggtgtcaggatagttttataggctaaacgtagattggaacctctctctgcttactgtgacattgtttcgtgttgccttctttttcttcctgttatcacaagtagtaagagaatgtggggatggtgcctttgtaattctgcatctacagaattgtcccctgatgtttgcatcacgacaccgtcatcatttgtgaatcggtcttggtaatatttgtaccaatttcatgccaataaaagtcagactgctgaaacacgcacggtcattatctcattcatattcctattgtttcaacggagtgggctgcagagggaaagggaaagcctgcctcactttccgtgatggttgttaactttgatgttggaaggctcttttcaaaattttccttgtggataatcagtatagcaggaaaagcccttggacttgggctgcctcctggctctgagtagaagagcaatctaacggctctcttagtcctttctgttgaaatgactttttaaacacatgatttgacatttttgaaaaaggttccaccttttcctgtctgtagtcac

SEQ ID NO: 106923 - DNA, 1085 bp, Homo sapiens
atggcaaaatccatcccttcattagtttttgttagtgaaattgctggtggacattgagtagaagaagaaagctgtctcacaaacatttccagctttttaactgcctctgtgagaaacaatgcctgcaagaaatagctgttggtgtctgtactggcagcaaccaccactggatgaaggtgcttattgcatctcattctttggatctcatttttacccataggcctctggggcaccatattaaaattccagaggccattcctggccttgtttcataccttatgggaaatgacgcaggttatatggtatggatctataggtgtaaagactgggtagcaatggctggattggccgtaccattctaccacttttttctttgaaaaaggtggcttatgaactttgttagaaatgccctcaattggcctttcccgttgtagctgctggagactgactgtgtctgaaaggagggtctcttgatgctgacagggaaaagctgatcagcacctctgtgtcctagaaggggaacttccagaaagggggcatagaagaaggtattattagtatttattgaatgctttcatggggccaggtactgtgctgggggctagcaccttcccttgctagtaggtaaaaacccagctgtaattttaaaggaattgctatgctgagatacacttttattgaagaccttgcatagttcaaataacgtgaaaagtattgatggtcaaaaatattttgtgtaggaatcaatgccaccaaaatgttagtgataaccgtacaaacaaattgaaacaaaactgagacaggattcagataattctgacaaataaagaaaaagcagccacaacactgaccccccaacatgttcttaattccctttggggctgtttctagaaaaggcatatttcaccctgaatgctaaatttagttctctactctgttagtttagacctgccttccatcaaaatattgttgtcaaagatttatgtaacttgtgatttgagccttgtatgaaattctttcaagttttgattactaaacagttatgtgtcattaatctctccattgaaaattaaaatggcacaaga

SEQ ID NO: 106924 - DNA, 1038 bp, Homo sapiens
agtgttgctctctaagctgtcattagaagaaatgttgactttattgatgttatagtcctcatatagccaggagacagcagcaaaacacatttttttctttaagttgaactgagaattcagtgttagttcacgttcattttatgatggggagaagagtatttgcacttgagaattttccagtggcctcccaaagggctgggttttatgagctagtaataatcactgtgatttattgagcacctactacatacaagacactttacatacattattcctctgtgctctcagaacactgtgcatttttcatggtagcacttatcacaattctaatctccacttatttatgtgtctaattgattaatctgtgtcttcttgattagacaatcaccttcatgttgatggaactgtattgatttttgttccatgttggcaccctaacactcagtacagggcctggcatattttgtattaactatagaataaatattgcttagaaggacgagtgaaatcagatgcagaacagcatgattttatagatgaggaaatgagaatagggagtggtgggatatcttgttgaaaacttaaaaattggctgagctagaaatcaagcccaagtatgtctgcctgttttccaccagacctgccttcttaaactttaatatgcatgtgaatcaccttggggatattttaaaatgcaggttctcatttagtaggtctgagatgggctcaggaatttgcatatctaacaagctcccaggtgatgcctttgcggctgtccacagaaccatgctttgtgtagtcatagcctgcaacacagttgcagtgcacaggttgatcactttctcatctgttggaggtatatgtggttctattggaaacccttgtcatgagacagatcccttgtactagtctcctctggaaggtgccacaggggtctactcttggataaatgcactggctcttctcatcaattggttgtgcctaggttatgatcctctctcccccgctcctctctctcttttgggggagaacgtgatc

SEQ ID NO: 106925 - DNA, 1049 bp, Homo sapiens
ttcaaacgatcctcctgcctcagcctccagagtagctgggactagaggcacatcacacctagcttatgtttttattattattagtagtagtagtagtagtagtcgtggtggtggtggtggtggtagtagtattgtagagaaccactgcacctggtccccatttttcttgctttttttttttttttttttgagacagagttttgctctgtggcacgatctcagctcgttataacttccattgccagggctcaagagatcttccctcttcatcccaagtagctgggactacaagtgtgcatcactgcaattggctaaattttttgtatttttggtagacacagggttttaccgtgttgcccagactggtctcgaactcctgaactcaagggatcctcccacctccacctcccaaagtgttgggattacaggcatgagccaccacacccagccctgaccctatcttctttttgttttttttgtcggagtttctattctctgtttcattttttgagatctatggatgtgaataagcttcctgccgtaaagaagacatcattatttatttctgtagcttttgtgtactaccatggagatgacatggagcatcagttgaggggtcctgtagagtgacagctagcagatgggtagaataactattattagtgctgcttctcctctctgtcagttctcatagcagacattgctaattgatcacagtactttttctcagcaagcctgactgtggcctatgaatcttcctctcaaggagtgccagccactgataatcgatagcacttgactgaaatgtatttcccctcccttctctaattgttgtgatttactacatgtgaaattggctgatgagatattattaataaatagtggcacatcttttattttgatactatcagattctttttatattatctcagtttgctaagccacctagccccttccaaatgagctttttaaacacatgctctttcttcagatgtgacctgacaagagagacagacaacccccagaaatccctttcaggtgacgatgct

SEQ ID NO: 106926 - DNA, 1053 bp, Homo sapiens
taatttctaaaggatgatttgacaacagtattttatgctttttgtttatttgtgggtggggggggtggtgattggaggaggtgggaaagagctttatcatgtaaaagtaaccatcctagaaatttcaggtaataaattttcaggtgcatgaatggttaagactcttcactcagtgacacagtatgtgaatgaggaatttttatgaaggtaacggtcttgttctttaaaaatctgatttatttagcaggtacttctaaatgaccaagtaattttaaccttcagagaaagatggggagggggtgggtgggtagagaaggcttgtatctctgcaagggattgaaaattcacatcccttttaatgattaaactggcacggtctttatttggatgttaaaagccttttcttacattgcaaacattcttagcaaatttacagtcagatatttggaaacagctaacacttgaaaaaaaaaaggaggaggagggcctgtttgaactaggaaacaaaattagtaggaatggctgaaaagacaggactgaccccaacaccattagctggagaaaaaaaaattccatttcattgcaactatgttattgtttactttaccatacacatcctaatatggttacctccccgtcagaggaggccaagccaggggttgagaggccccctccgggagaaagctcctaactgcttctcagacaataagaaacaaacggtacaactccacaaaaggcttcccggaaaataagtgtcaaataaatcctacggaactctcgcttctgccactgagctctgtatatgcaaacctgtttttatgccatcgcttccccaggctgagctgcgtttgtttggaaatgtaagccactgccttttctttttttcttttttccttttttttttttcccccctcacttcatctgagggctctggattaattccttgagacatatctttgcatacatatctcatgagttatgtttcctggagccttttactaggaacattaaggtaagaatgttgatttagcctgggacctttgtcactcaaac

SEQ ID NO: 106927 - DNA, 1067 bp, Homo sapiens
tttttccagggagattttatcagacttacaagtcaaattagttgaatgcatttcttttgctaataaacagagaacctttaccctggaagcatctccccactgaattccaataatttagtgtttccttgccttaagagctcaaccagtaaatgacctaggcatcaaaagaaatttattagcctaaaagaagattgttaagatgggagaacttaagagtatgaaagcgaggaaacataataaaatcaaaatgtaaatattgaatacatatatgttaggtatttttttaaaacttcattttagagggttaggcttaactctcccccaccccaagcaaaacatttcggggtacagatttttctgtctctatagttgcatttacttctatgttgcacatggggacagtgtaaggctaacgggctattatattctgacctaaacaattcctgtgtttctaatttagaagataattgcagtcaaggtaggacaagaccattttggatggtggctagtctgattgctgcctctgtcttgagttgccttatgatctataggtccgaggttaattgtgggaagattttggccatgaaactacagcaagcctttacaggaatggaaaaagggtgtagtttctttcaagtgcatttattagggtaggtgtgatcaccgactcactgcttggcgttaagtgggcccattggttattgctgtgaggtggttctaaatcctccttttaaaaagctccgttcaagttgctgtgaccttctcatgctgcttgctcccaagtatttcaaatgttgcaatgctgggcattttgtcaagctcataactgaaatgctttctccatataagatatggagtttgaccctatagtagagatatgaatgtggatttgcttttaccctgtagataagatcagctacagtgaaagacacaggtaaatagaatgcttaggcagaaactgttggaatccagtgtacatgtgaaaagagtgaaatttttcagggctaacagtaaagccctcttcagtgtgtaactggaattcaccttctctagtatttttgcacaag

SEQ ID NO: 106928 - DNA, 1040 bp, Homo sapiens
taaatgaaaaaaaaaaaaaacaaaaaaaaccccactctgagtagctgtgagtccaggaagggcctgcatgggtagtggtgccactgcagagtgaagtttctatctgtctacgttcatttaccttcccagatttttgtcttccttctgcacagatgaaccacgaggctacatgttgggtaataaaagaagtaatgatacaggctggtgatagggagaccctggaatttgattccaggctggctcagtgggcacaggaagctctctcttaatatctcagtgatagagatattaaatcatcctggtggacaggtggacacctgtggaacatcacttgttagacatccccaggttgacagcacaccagcgataaccgccctttgggtgtggtatgcctgcttgcatcttcccagcccactgatgagaatgtcacaagggacagaatcaggggactaacagaagtctgtaagattacatctctcatttcccctttatctacctgtcttatcacttggtcagaggggctggcatgatgtgtctccaagcaaaccatgttggttgtttttctcaaagtgatggtaaaaagattatttcccctcagtatcgcccctggtgtggaagagaagaagatcggttttaattacttggctcatcagtttttgaagcttcttcattatatcccactacccccccaactttcccagtcttctggggcttttcctgccccttggaatctcggaaatacatttgtcagttctcaagcattttggaatactttatccttgtgatgtgactgtatctgatttttagaattattttccgcctccttcatctagctgatggcaatttagaagctgaaataaattagccgggcgaggtggcgggcgcctatagtcccagctactcgggagtctgaggcaggagaatggcgtgaacccgggaggcggagtttgcagtgagccgagatcgtgccactgcactccagcctgggcgacagagcgagactctgtctcaaaaaaaaaaaaaaaaaagaaaagaaaaga

SEQ ID NO: 106929 - DNA, 1038 bp, Homo sapiens
agaagtctttgttaattttttgtcttttctctctccctacatttgtatttgtttaccacagatctttagatatgtttctgttggaaggaagtattctctttttttgagacagagtctcgatcttgtcacccagactggagtgcagtggcattatctgggctcagtgcaacctccacctcccaggttcaagcagttctcctgcctcagcctgccaagtagctgagattacaggtgtgcgccagtacacccggctaattttgtatttttagcagagtcggggtttcaccatattggccaagctggtcttgaactcctgacctgaggtgatctgcccaccttggcctcccaaagtgctggaattacaggcgtgagccaccacacccagctagaagtattctttaaacagatgggtgcagtagcatttacttcatatcttgcaccttgggagggagaatataacttgcctaatggcataataattgatttccccccttgtcactttagaataagactttataacgcccccagaaagagtcgaagatgaaacatgacaaaccagaaaaatttattggccaaggtgtccactccacttggtaactttttgagggcctgatctggggttatctgtcctgtaagaagattaagatcaacccagttaaaacacggtgggccccatccctgctaagaccaggttacaggataaaactctcatccctcttggttgttaagacgaaattttcattcacttaaagcataaatcctttgcataatatttttatgcttgttcttctcctgtgtgtaaacctttatttggcgccttctctcttctgtgggattgactttttagggcaaatgagaattttgaagataattactctcctcctccattcctgtatctttaacaactgccaggtcccagtgacactttgataaaatgtttttagagccagtcacttgtgttgctgtggtctgccttgtcgtagaggcacatcatttttgcacatcagtattaacagttcaaacaccctgaaatgctaa

SEQ ID NO: 106930 - DNA, 1048 bp, Homo sapiens
cataggtgtgatcagagcttactgcagccccgaactcctgggcttgagggatcttcctgcctcagcctcctgaatagcttggactataggctcacaccactgaactactgtatccatgtattttttaaatgatgtttttgctgtcctatctgccaaaggcacaaatattccaactgctcaccttgagcattttaggaacacaaacctcatgttaggtggcaacttaacgacgtaccacagatgtaggaaatagagcctttccttggcaattcaaaagcctctgaaagaaatctgaagcttaactgtacaaaaacaaaatattataaaaggtagcacatctgtgttaaccttgtgggcctaccccctcagtatctagtaacaccaaggacctcaaagaaacaaatagtgtactgatgacagaatccttattttatgagcccatttaaaagttgaagctgtagtgacagttactaagcagtgctgagtttggatttgaagtttgtggtatcttttaaaaacactattggtgaatgggactttgtgaatttgaaatgaagatgaatcgtttcagtttgttcctctctgccactgatctggctttgcatggggtcgggaagaaaaaggaaaaacatgaagtctttctgcccttgtcaaattcactctttttaaagggtgaaaatcatgcagatctttcctgaattttgtatattggcatatatgtggtatgtaattaaaggtaattagatgttttgttaattatctgagagtgtgaccagttatttaaaattaccttttaggccgggcatggtggctcacacctgtaatcccagcactctgggaggccaaggcaggtggatcacttgaggttgggagtttgagaccagcctggtcaacatggcgaaacctggtatctgctaaaaatacaaaaattagctgggcatggtggtgcacacctgtagtcccagctacctgggaagctgaggtgagagaattgcttgaacttgggaggcagaggttacagtgatctgagatcatgccactgctctac

SEQ ID NO: 106931 - DNA, 1029 bp, Homo sapiens
aggtggttgctacttctcttgacattcagattttgatgttctcttttgttttcagggtaagacgtgaccttttgaggtgactataactgaagattgctttacagaagccaaaaaaggtaaatgcaaatgtgattagtgaagttatatccagggctgtgtcttttgccttccaggcattttaattcagttgctttttggtctgtatttgtcaaataaacatgtatttatttgcgtgtaaggacatatgtggtgtatttttggaggtcctaagaaaaatggttgcccttaagaaatggtctacaggttcacatttcccccccaaatattatcaaactcttctctgtttgttgaagctgaacttatttttattttttaaatttatttgtttcttgttgacttggtaggtttaaagttagaaaggaatattcacatcacaaaagtggtgattcataaaattaacttgctgcaaacaagagtaacgcatgtcagtattgtgtgctgaagtggtgtcatccaattgatgttcatctggcggctttataatcaccttctttcagaaattaacagtcaggcaccatagcaacacgccacattgatgtaactgctgagcagtgtggggcatatccctgtaatgtcagcgctaggctgccttgttctcttgaccttgcttgaaaatcaaatgagtacttgattttaaaattagaagttttcagagagactaaagtagcttaatgaattaaagccaaatttaattttctcaaattcgcttttgggagggggagtgaaaaagtactccggttaaaatggttatggatgctacatatttacttgatttcaaaagtacctctctgataaaggcaatgatcatcttacagaagatgatcctgccggtcgttttaacatctgatatttctcaagcagtagcatctttgtttcatttagaatttttggcctttaatagttccatttgatttagtagatttgtgtctgtctaaaaacaggttacctgccagcatggttgaacaaagc

SEQ ID NO: 106932 - DNA, 1054 bp, Homo sapiens
gggacatacatcagcagtaaagcacacgattttcattttcaatttgaattgttttgtgtaaaaacaaaaaggttttggtcaggctgcaaaatagtaattttaagtcccagagctagggttttcccccacccaaatggtgaaaatttatggtgaaaacctccaatttcctcttacagtaaacatgaaaattatgatttcactcagagcctgcgtctttttccaatcttaatggcaagaatctgcatacacttgcttgtggaaatgtcataaattggcctcggatcaattcctcaaagatagtacacaccaaagtgccactttcaaatttttagccctcgtgaaataagattttactcttctcaatgatgtttgcctttccacattcagggctgacagcagagggatgagcagggatatattcctataaaattaaaccacttcattacatgctattctgaagagtgagcaaaaagatattaacattttggtaaaatgatgatatgatttcgccaccttaaaaattatatgagcatttggtcaatggatatggaatgaatcctgtaccctcttagtaacttgatctaaattaataaacaaatgtttttcttttcactcgtgccatatgttgatcccagttacatgggcagaaagaggcagcttgtaatgtttcttaaaggattaaacactgttttgcatacgggagtatgcagatgcaggagtaggatgtggggtaaaatgtgttccatggtttctttgtgttttaggaagcttgatttcaattgtttgtttcatgtgacatgaaccctttttaatttaacttagtagctccggtagatacatggtaagagaaaaacattctgtgaacagctttcgccagcaattaactccctgcccctccccaaagtgaaaatggtgctgctttcattcattttgaaaggtccgaagtggcagaaagcatcttgtctacaagacctaactctcttccaaaaggggaaaaaaataagtctttgctttaatgaaataagagatgttgtggatattaaccaaacagaga

SEQ ID NO: 106933 - DNA, 1050 bp, Homo sapiens
gagtatatatgcacatatatatatgtgtgtgtatatatttttatatgtacactttatatgcatatatcaaacagatctttgtaggtacagagtcacaagtatcaacttacaatgtgacaaagcagagaaacgagacgtatatctgacaattgtgactaaacaaaccgattgtttaaaattcgttgaatgttaaagattgaaatgcaacccatagtagaactccagggatgggtatactacaagttctttttggagtagctggagatacaacaatagcactcccccccgccccacgagtgagttcttaattactaatgaatacaattcattttaattgttattatagcaacataacatttaactgactcctgtttagtggtgtcccctggaataggcagtgtctcctgtcagagtgaggacaggtagaaggcacagcgggcgtctgattgagccagttattcatttgctgagtgtttgtgtttatgcaaaggggcctcttcctgcatatttaatctagagtaaggcagtggcttttgttgtgtttagcccacataccttcagtccttcctcacactgccgccagcctgggagccctgagagccagcaggcttccaagcgcctgtagtttctcccttacaaactctcaactttcttccgttgtgtgaaaattgcctctcccgccccaaagctttgcctcctcaccatgaacgggtaagtgtgtgcgaagccaaggctgacacttttgtttcattttactaatgttgagagggtactttgctgcccttctgagcgcctcctgaaagcagtcctggttcctgggccgttgtcagcttctggctgcattgaaatagacaagtacaggtgcctcttaggaaatgtggctgaattttggactcgcagagaaaggctcgtgaggactagggggaattaaaaagaaaagagagagagagagcagctttattattctttgtcctaacaaatcctgttttgtaactatcctgcagataatgctgccattgtttgctaaaagccttcaaacagtgtctaaga

SEQ ID NO: 106934 - DNA, 1037 bp, Homo sapiens
tccctcataattatccactttctataacactgacccttgtcctgctaataaccgaagaggattagtggacacccctgcctttgtacctatttgttctctgagattctttgttttgacctctaagtaatttctttttaggccctctgctctttatgtaacacatgtttttgcagatctcactttgatctgtgtgaacatatagcctcccatttctcttatgtcatttatcctgcttagaaacattttatgagagcataagccatgctttcattttttcctttcgtacacctctttcgaatctcttcagaggaaattcctccttaatacttactatgagctcagcagcagtacagaggtatgatgactgtgacctaaggatgtccagccctgtgaaacgagcgcttcctcgtcctccttgtgtataacggaggtacatatcttgagtcccttgtttggagtgtctgtctggcatggatgctgctgctccactctgccatagccttctctgttcccaatgtctaataaatgtttaatgataattgaaatgattagttatcaatccataatggagaagagcttattaaccttttctgatcacagctacattatccttgagatgaaagtttttgctaccatgtaccagcaactggaagtcagatccattggactgattggggtccctgctgtgtcatggcataaaatggtttcatatcattgatcaatcttctggaaggtatatgccctttgttattacttcaaagaatagccaatatttctatatttgagataatatatgtatagctatgtaatgtatttgggggcctgcactttcaatatttttataaagtagaacagttatagaaaactacccacccactcccaactatacacatgctcgcgcacagatcagttctgaaccagatgtcctatttccatactgtataaaaggtagccattgtctactgagcactgcagatgtggctagtataactgagggactaaattttacctaattttaaatttccgttttaatagcc

SEQ ID NO: 106935 - DNA, 1049 bp, Homo sapiens
acttatggagtaactagggttatctaggaaattaaaatagccatttcttttattaattcataacttgtactcttgcaacttaacaataaaaggacatgattaaaatatagtttaaggcatcaaacgtggttactaatatccttttaggaaaggaaaagatgaaatccagtaagtttcagtcaaagtaagtgaataaatcagaaaaaaaaacattggttagactcatgataaccctcagagtggctaacacccagattttttgcatctctaaaaatatataacacccctgtctccaaatatcacttcagaaactaaaataataattcgtgaaaggggaaacagatccgtgtaatatgagacttgatcaggcagtttacgcgggatgcttgagggcctagatcagcccttgtgctgccctcttctcaataccctggtgcctgaggagcagcggggaagattaggagctttctgagggtttttactttaatgctttgaaattttgctgcatcgtctgagtccaatttggttcagcagtctctcagtgccaggtgactctggctaagatgctctagggctgaattttttaatgccagctttcccaggggatcagtaaaggttttgccctgggtattccaaccaggagagcctgtgtcctgtctttgtccacatctgtccccagtcattaatggtgacacaaaatagtctcccactcctgactcacttcctaaacctggcagtttctttgggattctactcctagaataattggtgcttagaccttcttaggtttatctgtatgtatgtacctagaagaacttgcatttcgtgctgtcaccaatattctgcatgcttaaaaagtagggagaggtggaagtagaattttctaaactcatgaaaaatctaaccctaaaaaatctcaataaacagcagttttttaagagaaacattctagcttttgaaaggtctaccctataatagctacctttactgtctgtatgccagacatgattctaagcctttgatatttattaactcatagtaactctgtg

SEQ ID NO: 106936 - DNA, 1070 bp, Homo sapiens
cttggcctcccaaagtaatgggattacaggcatgagccaccgcacagggcgtgattctattattatgcgtagttaacagagatgagaagactgagtcttggaaaagtcatgtgatcttaccctgggcacgcaatggtcagatggagccaagatttcaaattagactctgtggcttaagaatcagccttttgaggactgactctattgccagtgggcacaaccagggatttttgagcagaggagtctctggtcagaactgtgctctgggataattcatctgtcatatttcaaagcaatgtagtgaggagcccagataggaggaaattgtgatgttctgaagagcggcaactacagtctgcagttgagtgtttgatgagattggaaaggcagtgatggagaggtcccaaaatccttaacgttttgggcggtacttggtgtgaaagacagatgattgggagaatggagttggtattcttatcccttgctaatggaagaggagagagggcaggctgggaagggatgagctgaggtttggatgtggcttgaggtgcagacgttaatttcaggcagagtcttttggaaggtgatgaaatacacattgaactagaggttacgaagatagtcagggctggagatgtggatctgaagccacagaagccagtagaaagagtgagactggtacatttagagaggtgcggggaaaagaaagtggctggagaaggagaccacgatataaatcagtcttaggagataaagaaaaatctttctgcacattggagatgacagatttgtaggccatgcttcagacacatacctatacatattcatgtttgtatacatattcatgtacatatttatatatgtattcctatatacattcatatgtattactgtgtgtgtttgtatatgtatcttattcatgagcatgcgctgttctcttatgctcacatatgtattcttgggagcctttcccacctcagcaagtggggagaggaagagtggggtaggcgtcagtctctccccagagcagctgattggggcaggttctgctccctgctgctgcagtttga

SEQ ID NO: 106937 - DNA, 1046 bp, Homo sapiens
attgagtgatgtgaaatgggagcaaaatcactctgcacccccagcccgtggttcttggtgtgagtgacatagttgcttctggaagcatgacaaatgagccacatgttttattgttgtgtacaaattttatgttggaatttaaacagggtgaaaagggttcacattagcttataccagcaaagtaggtgtttaaaggaagctaatgagactaaagggctggcgatgttttcagcgtgcttagtgcttcatagcaagaactgaaatatcttatgtttctgtcaagtttcaaagagggaaaatcccagcactgttttaaaaaaatgagagtggttaatatgagaattcaaagaaatcagaagcaagtggagacaagatattacttaagcactgttgacatacatattgcacacatcgacttgacatatatacaatcagattagatagatgcttctaaggaaagaggcacaatttctggttttagcattatttgcacacacaaagctctgttaaaataatgttaagacattggagtgttagaagctatgagtggtacgaagagtgttttcaagcttttggaggaggataaaaaaagaaaatggttgtatcttaaaagctattctgtggacagaaggtagtgatctttctggttttccttccttcctctccccttctctctctttccccactctctctgcttcttccttctttccctgtctctaccttctccctccttcccttgcatccctgtaaaatgttatacggagaacagttaaactgtaggattaggtctgtctgtacagcttgggacctggaattatactagacataggaactttcctgccttttccagtgtagatggagaaattattctaaatggtataagttgaagacttcaaaggtttctagattaactctgtgaaatcagtgagagctttggtggggttttccttccttgtcctctcagctgaaaatatggggtcctcctattgttttctcccatagtactgcagacttgatagctcttgtagacttgaccatacattgta

SEQ ID NO: 106938 - DNA, 1051 bp, Homo sapiens
ttcaaagggatgttttattgattctgtaattgcacagtagaatggacgagctgaacgggacctcagggccaggaaagccccggcttcagcagtgcctcctggccgagccaggttgtggggagagctcactgagcagttgcagcccaaggtgaagtgtgtgcttaaccccttctttccaatgttccccttcaagtttcttttgtgtgtatgtgtgtccaggccacatctcattgtagggatcacaaatgtttaatttcctttgaatctcatgacctgcctaactattattgttttatgactctgcttcttgaagggctcttttcaaaccttgggcatgaaagacatttcataggggggcctctttagaacaatggactctcaatagggacttctcatgacattaaaaaccagaaggcaggcctctgaacaagacttgttaagatacagtagcccattctctgctaataagctgattgctttccaaacccgaaggggtggaccaagctgttttgccaaaacaattggaaattagctctgtcaacttctactgctgccatattttgcactggcatgcatatctgtactgttcccattaatttggttacagcaggaaacatttggaacaagggcgtttttaaaaccaaaaagggattgcagaggacttgacagagtgtcccacttggaggttaggcgggcaggagacacagtttccagaattgcttcataatatcttcctgatcttcatggtcctgttgggcagaatgatgttcagtcttttcttcctgaatgccttgttctgagggtatgagggctttgaatgtagatgggacagtctcaccctcctacgggaggaaaagggctcttcccttatcacacagtatttatcaacttgattaaaagctatgatagcagtgcctgaagatgggacttgtttctgacttaatttaccctcctctctcccagttccactctttacctcagtatagaggactctgagatagccctgttttgagctgatctttttcttggaattcattttcaggttcctgga

SEQ ID NO: 106939 - DNA, 1183 bp, Homo sapiens
tccctgtgccatcaggggatggcagacaatgcaggtaagtgtagacacgcctttgcttgcctgccgaccagggcattcacattcatccaggtaaccagtcagggaagagaaaactcacgtgggggattggatgggcttggagctgctctcccgagtaacagaaaaacaggctagcagggttccagaatacattgcaagctggggagaacttatctcaccagggaggaaaatagagcccccgtgaacctgttttatattctgtttgtatagcatgcacgtttttaatgtggatttttattttagtttacagacccttcccccttgcacaatctgagattattcaaagtctcccctgcctgccctctctctgatgtgtgatgtcagatactgaatgtattggaagcctttgcatgtttttatttctcatggttgaacccgtaaagttgtttccctgatcaattgcacgtgcatttcaggaacacacatgaaacccttgctctgttctgatagacacgtagagtgtttatacatttagagacaaagggacacagcaaaagtctggcacctacagtctgattttatagttttaaaaacaatgcctaaagtggttgggggtagttcaggctgacttgctgtgttttcttcagggtccttgtatgtcaatagttcatgacatgatttttaccatttgatggctgaagtcttacatatgctaacatatatgagttacatataagaacatgtatagagttacatgtaataactctaccatcatcactaatttgcccatcgctgagaagagggtaaaaggacaaaatgagttactcaagtcactattttttttttaacaccaaaagatccaagaagaccaagcaggtacaaaatgatcagggtgttctaaccattagaatcattcaaattattttgtctgtcttaaagctcagactctggtatatccttggaaacattgcaaagaatagttcctcagccaaatcatggggcttttttttttaattttttttttttttttttttaacatgttcacatttcctgtcagtgttaagtgtcgaactgctttgaaggcttgacttaggagctccacacttaagcctgaaaatgaatgtaaatgctgtaaatgctgagttctgcttctttggatgggggggatagggtgcttggggat

SEQ ID NO: 106940 - DNA, 1058 bp, Homo sapiens
tttaaaggacttatgtttataaagccccttttcctttttaatgctcaattcgtagacatgttgggaaagaaatttcatgccttatgactgaagtcacctctctgagattttttaaacttttatttacctcgtatttcatagacctatgtgagattgtatttagttatactttgttatggtttagcttttctaaaaataaactttgtgaatatttatctaatgaaacaatgattcatttataaacagccccttaaaaaagaattcctcaattcgagtggtcagattgcatgatcagtaagtgacccctattcattttacattgcacccctttcttccatagggtttacatgggcaaaaattatatctgagaataggattttctgctgcttgtagaattaatccctgtttgtatgggagaggacaagaaaaggttgttgagggctgatgaaaggaaaccctcacaaagttgcaaagagctgcctttgaacttggtaaggttctaggaaatagtcctttgcctgggctgctcccagccatgaaattctgggttttaaaggaaagatgtgttgtaatgttgcccatcagtgtacatcttggagcctccttgcaggttactgccacacacacacaaatgcatgaaaattacatttcacttcttttaacaccggattaaggggagccacagagggtgtttagggtggaaaatttaaggaggcatttgctgtcaatgctgatcttgaacttggacgatcctgagagctagtgcctccctaaattttgcaccctaggcaccttgcttgcctcctataatttgggccctgctctatttttgcaattaagaaaaaccttgacccaagtaaaacacatcaattttttgctctttctatatttctaccctgtttttattaccaaaatttaataatgacaatgaatatgatcatataatattgtttgattactgtttctatgtagtttccccgaattggcaggcattctgtttctgaaccaaaaaccagtttggggttaggtctggtcataacacgcattttgttctttga

SEQ ID NO: 106941 - DNA, 1048 bp, Homo sapiens
tgcaaatcagagtaaaaaggcagaatatttcaccttgtcaagcacagggatattacactttcccaaaattaaaaaaatgtatatttcgtttgatctgatgcttgtttggggtttttgaaaatggggttgcaccttgagaaattgacagtatgtaaagttctgatcctgggtgatttctttatagcttgacatgtgtctatgtaatgtgtgtatgtggacatgtatacattggaaggatttttgcctgcatgctgctttcatggttaaactcttttttgagatttgcattgcattaaacaaaaatgttggcattctgctcacataagcacatgaaaataatctgggctgcatctttcttgaggggcaatgtttttgattgttggagtattatatagcttgatgtggtccagaagtgaagtaatcttgtatcaatgagatagcattgtaatagcaagccctttagtaaaggtttagtgtaaatatctgactggtaggggagctggtttctggaacagttgtgcctctgtgagattacgaaaatggagagaaagaaagggctgaactctaattttcctgaaattggtgcgtggtgctggagttgtagccaatactggttgagatgtgctgcaaggaagcctggagcacaatagtccctgtcctgtgcccccatgttgggcactgggaagcggagtgtgttttgctaaaaggaagaaagtaaagagaagaaatggctaaggcttgtagtaaacaaacttacccataaatatcaataaaatcctatttcccaggcatatctcttcgagtgctttgattgtgcatgtcagagcaactgcaaattttgacccagtggttaagccctttcccctagtatttttgtgtacaggagttctcagttgctgcagtgtgagacatagtatactaaaatatgctttagagggatttgcactaaatgcgaatctgcaaaagcactgtaattcataattaatgctttcttgtttcacactcctgagtccttttggtcttctactttgataaagttgttgcttta

SEQ ID NO: 106942 - DNA, 1053 bp, Homo sapiens
tttatctgcaatattttgaaatcaggaggcagttggaaagcgagaggagagagagatcaccagggctgtgagtttttagagttcatagattaccccacatgaggccatttctgtcctacagacaggatgctgcctataggtgttgctttgaattttatctataggcataagaccaaagaacttgcagggatgtggagagctactgcacatcatctgtgtgcaaaattcactgggggggaactgatatttgagaaagttccagtgaaaaatcgggctttcagttgagggtggtctgcagcttttacggtttttagctccctggctttccattttggcttttgcttcttttcctccctcattacattcagcaaggaaatggacactctaatatgatcatcaaagcccagctaagatttcataattaccagttggtaatccatgtgaatttctgtgtgggctaagtcacttagtagatgttattttcttcatcatactcccatttggatcccaggaatgactcaagaaatttgcttctttcctcaattaaaatggaaacaattttgcaactgtttgtttgagggaagactggctttacaagaaggtgacttagaaggggtggttttctgggaaagagattaaactatagaatggtcctgtgtgttttaaataatgctgacatattttgttgatgctggctattttatttgattgctatccgttctgaagtcttcccctcctttttccttctttgaaatctgttggttactatggaaacagtgttgttttgggtttgggtggagctgtatccacaaatgcagtataaagtcatttataaaatgggttaatatttattctggctgggcatatatggaacttgatgtaatgataatcatgatcacacatgcagaataaatttgcacttttattgttattttcttagtcagtctaaatgtgtgccattttgcttggaatgcactgtcatttcctctctgatttggatattgccatttacaaggcaacacccagcgccggtggaattgctctgagttggaa

SEQ ID NO: 106943 - DNA, 1077 bp, Homo sapiens
ataatgaatactttacataaatcagatggtggtattacggatccatggcttatgtagggggctgaaggttgtattctatcagaggacttttctagaggtccaagataggtggtattttaacatattttaatttttgagtgattcagcgagtgattaaaaaagaagatgtggaatctggaagacattaaagagatgtcaaggacagacgggttttgatttgtagcctaatgaatgttttgccaacttttaaagatttttttgagagtagaactttaaccatttgcttgtgtttctggcatggtaaggttattcctgtttctgttataatgaatccaaagtgaaaatgggataatttttaattagcaaaattataaaacgatttgcagccaaatgtttcttgtcttgtataaactgtgaggtttcacattttactttaatcattttaggaaatttcattctgaagatctatttcagttggtacttcatgtatgcatacaaatcttcaatattagaaattaccttgtaatattcttttccattgtcacttgaataatctgacaggatttcagtcatgtgcattgcttgtgtgtattttgtaggtgtcatggttaccttagttggatgtagcactaatattcaatctagcattatgaatgcaaggctcaacatcataagagaaatagaaatcaagggttagaaatgtttgctaactctatgttgtatggttttatacagttcagaattgcttttgtcgagcttacctatgtaattatttgaatcaaaaattttatatttttactttttgctataaataatagagagctatttaaaaatatattttattaaggaaatgagaacaatgagttaagtcatggcaacctacacataattcccagacttttcattttatgatgcttcaattgcatttgattacgagagttttacagtttctggaggctcattggagccctacatggagatgaaagaattctatggaaatgcaaagggatttaagtgttcagaatttgagcatctgcctagaatgggacacttccagcaccttgaacttttctactt

SEQ ID NO: 106944 - DNA, 1025 bp, Homo sapiens
atatatgctgcttgtaactgtatttgaacctttttgagactttgccaatttcctgataaaaccaagaatattgaggatgtagcaatgaatgctccaggtggcactatttggtgggtgaaatttaaaccttacatatccttgaagtatgctttttgtgattattaaaagcattttaaaaataagtattagagtttttacttagatgtttgaaaaagaattctgtcatcaaagtgtatgagagttgacaagtgtaaatatgcagttagacagtttcaagggacgtgtattatttactgatcaatgtactgtctcctttggagccattacactcagtcatttcctgtcaatctctccacgctgttataatcagactatggatatgcatattaaaatataagaaagttattgtgtatgtgtggtggcagctttttaattgttaataatgttgctgctttaaaaaggtatcagggtagtttactcttaggatggttaatattctgcagaattgcatgagaaattaggggaaccaaaattcgagctggtggataatgaggccaataggtgggtgtctgtgcttctagtcgttgccccggttacaaaaaaatgagcttttaatggtggtcctaatatggaggtaggttccttctgttcttttttcaaatttttatttatttttatttttttttactactgtgtttttaggaaaacttttgtaattaaaaaaaagttcgtgtatgtgtgtgatggtgggaggctcagtctaatttctgcctgtaacagggatcagcgaatcttttctgtaaagagccagatagtaaacattttaggctttgcaagccacctggtctgttacaactatttacctttgtcccctctaagcagccatggatggtatgtaaatgaaggggtgtggctgtgttccagtacaatttatttacagacgccgaaattagaatttcacatgattttcatgtgtcactaagtagtagtaggattttcattttcccccagccctttaagagtaa

SEQ ID NO: 106945 - DNA, 1048 bp, Homo sapiens
gcttctctctccatggctagactgtggcatttggagtagccacaggacttggaaagcgttggaaaggacttagtagccactgccagaacgcatgcatttttaaatatgtaaattgaaaagggagaaagcttcattctttctaatgacccccaagatggtaatctggcttttcaaatctctaggaaaacagattgaatatggcacaattaatgtttcagcacttctcggcttttctctaaaatatttcaatgggcttttaatttattgcagctcttgattagcagggttgaggcagggttactgctgacctcctgggccaaggtacttctggggctgtagtgaagtggaaaagaacaaaggtttgatagtgttctcagctggagcctcccagggatgagcccctgggggttcactgaataattccttcccctaaagtagtcagagagcaatgcagtgttcttcagatctttatcagagttacctggggtatctgttgggtagaacagcagattcctggaacttgtttaagaatctctggactatggagggtgggaacttgggcttcaagctggtgcctccctgcacactcacatttgcagtccatggccttggtgattgatattgctacagtgtaaataccgtgagctggggtagaaagcaagtgggggtactgctacattttaaaaaaatgtttgagacttgcacattgtttgttagtgcatttacttttcacttactctacttcacaagttggctgttccctaccttcttaaatcaaaaaactttctcctggaaattgtttctttttggtctgaagtaagtcttttagaatgtccttatagagaggtgataaacttctgtttgtttgaaaaagcttctatttcaccctcagctttaagagatagtttttctagttatacaattctacgtaggcgggtgggggtttctgtcatttttttcttttcttttttgtttttgcctctgtactgtggaaaggataatttatttgggtatctatcttctggtatttttaaaaatttcagttgct

SEQ ID NO: 106946 - DNA, 1054 bp, Homo sapiens
attcaataaaagagagtgttttctcttctctctggtatgaatattatactgaagataaaggagaaagaagtgataccagttcagtgttcctggaatgctggccatttctgggaaggattggatgaaaaatctcgagttgattggtcaagttgctgtgttggtagtaaaataaacatcattccactgacaattattataatagacatttccctgacagttaataaagtggtatagaatactactgataatataatccctgttgccagtttggctgctaaatccaagaaacccctgggcaatggttagacaaatacattcttgcattgttacttatttaagtcatgtcacacatgactagacagcatttccatcatttgaaagcctttcgttattgccttctcttcaatgctgtgaatctgtatggacttggacttgcagatgtgttgtcattatcatctgtgttttgcatagccacatgtatttttttttttgatagatcaccttcagtgtaggttaatatttttagcaaaagtaagacataatattttgatcctcttttctgactatttgaaactttgtattaaagtatgggttgttttctcaggaccaactaatgtggctgacatcatttccaaattggaaagccatgtttttctcctaccaatgatgtagctatttaaaattcacagggggtgaaagagaaagcacacacacagtcagctctgacaggcgagacacacacgtggccctggatgggtgcttcatatatggcgtatgtgtcgattggctaagtgaatgaatgaacagaagaatgagtcttttcttttcttttcttttttgagacagagtcttgctctgtcacccaggctagagtgcagtgatgtgatctcagctcactgcaacctctgcctcccgagttcaagcgattctcctgcctcagcctcccaagtagctgggattgcaggtgcccgccacaacacccagctgatttttgtatttttagtagagatggggtttcaccatgttggccaggtgggtcttgaactcctgacct

SEQ ID NO: 106947 - DNA, 1021 bp, Homo sapiens
gtaccttttctgtcttttaagaaagaagacgctgagaatcaggaaagtcaattccctggcttaggtcacatagctaattcaagattgaaactcaagcctttctgaatccagagcctgttttccttctgtctctctggctctgacttattaagtgccccaatttcctatcttctcttggaaaacaccatcacaggaaaaggaatctggtggtatttcctgtctttgggtctgtctgtctgtctctttttaagcagagtagagtttaccctgagaaataggaatattatgaaaaaataagtttctctagattggatgtcccagcgtggacagatgagcccagggacccttgcctctgtcattgggcagctgcccacagggagctcagtgtttttggtgccagtgtctctctcggaactcttggcaggcccaagggtgtacttgcaattgctggtgcgtggtatttgggatgtttgtatgtggctgttttttattttggttttgttatctaccctttgtaatagtaactggcaccatttcttgctgttcagatgttctgttgctttcaaacaaagagatctgaaaatgtaccaaatcagcgggcttcataaaaagtttggtgcattggagccaaggccgaggtttcttgggccatcagtgatgtgcttaaaagtccaatgcgcctttccatgagcagttccccctgcctaggaggatacagatgccagagccgacaggagcaagcagatggcctcaccctgttgttgctgtgggagaaacattagtttcatgtggccagatctcctctcctcatatcttccaaagaaaccagaaaactcaaattaacaaatgcttaatcttgattattaagtgttggaaatagaataaaaataaagtctgtctagtctggcccaagcgaaacaaatctttggaccacatttggctctcaggtcattgatttacaattttaggcttagaacagagcccctgtccttcacccaggtcccccccctccccctgccct

SEQ ID NO: 106948 - DNA, 1068 bp, Homo sapiens
ttttaacagggactgagaattataattgaccagtgagtttggtaaaggtgtaaataggtgtgcgatgaaagttgattacctaataattgaaagcttggaaaaagcatgaattggtagaatcctagacttggcaatggccttataaattagggcagtgcagtttgctaaaagaagggacttgtccaaagttacataccacggttgagacagattcaggactcaaagccagcattgcctcagtggctgcaggaaacaatggaatctcaggcttcatggtttgtggggttttaatggcaagatatttgtaacctttttgttaatgttctcctacctctttaacttgtggtcctaaaaaccttgtttccttctaatctttcattggtgtttggattcacattagtaactaaacatattcaccaccatattagggcactggatatttgctacacttgtaagtgtacacaatatgcgtgtatgtctgtattcatacatattcagcatagtgcacacatttggagtcaggagacctgggtttaaatgccaacggtggcagtttggagaagcgaggccttaggtgaattaccctgacatctccaggtctctgttgtccctgctctagaatcgtgatgataataatacttgccttaaggttgtcccaagaagttaatgagattatgtacatgagacacttagcatggtgcccctgcagcacatacagtattcttgtccttaacgaaagtttattattttaattgattatctgttacccttgacaacaaaggaaagtagtgataaatgccatatttagccttgagtttcaacatttttctcctgtagattggtttgtgtttctcacccttcttgtccccccttcactctttcttttctagcaccttctgcagcatttcttgttttacctttgggtgtcattagacgttgtttacatcattgtctggcggaccagtgctgtttgcaaaaagctcaggtgcttcctctcctgcttactcttattctcttccttgtctagtgacattgtcttgaactttctagctgggaaagactaaaggg

SEQ ID NO: 106949 - DNA, 1027 bp, Homo sapiens
ggctgagctttggtgaaaaccagtccttctctccctcagaccagtggtatttccatgacagcatgctgatttttttcagggagcatatgcgcgcatgtacatgtgtaaataaaatggttatttttaataaaaaaaaaattgttttaccacccatggtcctggttaaaatcgctattttgcttccttttaacagactgcaagcgtggtgacttggaaatatcattttctttctcatcctttcaagaagcaaattcagcgtattgctttacagtcttaacatttttttatgtctctagatacagaattgactttgtcttttctttgccttctaagctgtttagagcaaggtgagattacaatcataagctgaatctggaaaaaaaaagccctattatctttcttgactaccctcattgcctggaaaagaactattatccaagtttcacttaatcatatggtaacttacaacagttgtgatttgtaaaatacatgacgatttggtcttgtctcctttgtctctcttacctctttgtgatcatattctgcttattttaatgcatgaccagccaactgtgttatttttcagaaagaccaccccacatataaaatggagtggtctttaaatgtcttgggctttgaaagattgtttagccattccttcccaagtgcttcaggtttggattttggaaacgtatgtttttgccattggtgtcactgcaaatgttctcatcttccttttttctttgaatttgatcaaactttgttcacttgtagtacttccacgatcagcagagtctgtctagtctttcctgctttttccttttttttgttccaaattttcctttttttttttttccatttctttactttcctttgatacatctttttaaaaagtcaaagtggaaatatatgtaattgaccaatgctatagcagtttatagatgatataaattattaaaagaaataaatacatattttataactggatttatatcataaaatatttctaacctttatagaaggattt

SEQ ID NO: 106950 - DNA, 1058 bp, Homo sapiens
ggcaattttatgaaaataataaaaataataaagactgacatttttcctgacattcttctagaaacttactggtgatgtggtaagagacaagtacagccaagaaactgattgaagtacaggtgtatgtactaagaagattattctgcttatattattgttggtgttcaaataccaatttcaaaagaatctaatagtctatcttaggatgataaattatttggtaactgtaaatacaaagcacctggcatttaagtaactacgcaaatacttgctgtcattataataccatcaatattattattatattttgcctagttctttgccagttccatactgtctgaattattgtactttataatatgtttaatatcaaatatttcatagtccctatttgactttaaaactttttatttgcttttattttttagtttttctaaatgacctttggaattttttgttaaaaataatttccttttttattttgattgtaatactaaatatttaattacctcagaaaaatttatcttttctgtattacatctgctcatccaggaaactaatataattatttattcaagtattcctttttatttctcatgaaaattttgtagttatgtgtctgaacctagaaaataaagaaatatttatattttcttactggttatttttaatatgtacatagttctgttttttgtacattttatatttgattatctttttgaaatttcattagggctgtgtttttgttatatttccaaaaactaagaaatttgacatctgataggtagcaatatcagcaccttttcccatatttctttctcctgctttattgcattggttctgccttacagaataatgttcagtaatactggtagcagttagttctttatacagttctctttcaagctagacttaattctgttgaaggtggattttgttttgttatctgtgtgtctttgtggaatctttgcacaaagacaggcacttagtaaaggatgaatggcatgcttggttgaatattgttgcagaaaattaggataaaataaaggcactaaatg

SEQ ID NO: 106951 - DNA, 1021 bp, Homo sapiens
cttttttaaaactttttgtggagacagggtcttgctatgttacccaggttgattttgaactcttggtctcaagtaatcttcctgtctgagactcccaaaaggttgggattataggtgtgagccgctgtatccagcctaaatttgaattttggtggagaacatattgtggtaaaaactggttttactagattcagaaacccatggagcaaatatgtaccatacttggaagtgattatagtgaccatatattttataattgcatccaaactgcaatatatatcacttgaatagaaactgtagctaactaccaacatttataaataattttatatatacgtagataaccaaactacaaagtttctgttttgagactaatgttgaatacaaataagtacttgagctatcagttaggttttagaaatgtttgagactttgagaaactattttgtaaatcagtgtaagtgttccattgatgttattaaacttttgtaaatgtgcactctaaattgtagttacatgttgttcagactctgttggaaattttaataactcaaagaatgaacatacatatgtacacaatttcttttgagactgttagcaaatttcagttgttggtaaaaaaaagattgcaaacaggacaatattaccatttttatccctgaaaaaaccagtgaagaaccgaacaagttaaatgtgagctcaaaaagtgaacattttttaattctgaaattctgtaactgtatttggaagcctctcaccagtgggaagaagcttttgatggaactcctattttaaatcagataatgtgaattccgtatagaaatgaaattgatgaggcctacaattttgcagcatccaaatttggccaaacatttcaagcaattataaagcaagtttatttatttgatgaatttcatcttgtaaaaatatttgtcaaagatattcagaatagagtttaaatgatgacctataaaatatttgggctgttatatttagggacttcaataccacatagtagaat

SEQ ID NO: 106952 - DNA, 1383 bp, Homo sapiens
ccaggatcaaatgggccatctttatgcatagttaccatttctgcaacaaatacggcttttagttacattttgactaccgaaaatatactaggtactataccaagtataagctgccgctttttctttctagcctgagcacttaattaagacctgacagattgatttttccattaggccagaaggcaggtgtcgtcttgagtaattcttgatttgaatttcttattaagagtctgtttagctccccccccatcactgccaccaaatatgtgtatttagcagagactctctcttacccaacgagttttacacaacgaattggtaacaaccaaaataaaatatcctaacaataaagtactgtttcaaaggtaccaataaggaatgttgccttcctgctgcagtgtgcctggtatccctatagaaggcctgcccgtgggttaatgtggtctggtagtctgaagcccgtgaagccatcatttctcatcctttttttaacccctaacactccactatggacaaattgacagaagacattggtatctgtatagcccctaactcctcagtggatgatttgacttctttcatttttcttttttctttgagacaaagtcttgctctgtcgcccaggctggagtgcagtggtgcgatctcggctccctgcaacctcgcctcccgggttcaagagattctcctgcctctgagactacaggcgtgtaccaccacgccctgctaatttttgtatttttaatagagacggaatttcagcatgttggcctggctggtcttgaactcctgacctcaggtgatccacccacctcagcctcccaaagtgctgagattacaggcctgagccactgcctgtaatgatttgatttattttctttctcttttcaatttccatcctccaaaaatgttatggaaataacttccccaaaatgattgtctgcccgtccactgaaatataaattcccacttacaaataatttttaagaaaactctgtaattgacatttaactccagggataaagagtgttgctaatctcagcctgcatcactggccaagggtgtaaccaaatcctcatccaatgtggtcatgtgtgtcagtcacactgcaacgtggtagttacgggcagcgactcaaggtcggccaaccagagacttttaacacttgttgggtgactcaaagcttattaacctttctgatttaccttgatcttccataaatgtgtgtgtatgtttgtgtgggtttaaaaggacagaataaagaacttacctcatcaatttgttcggtggattaaatgagataatccatgtggaatgtgacacagggtgcctggcaaatacaggagctttatatatgttagcttttctgattattactattgt

SEQ ID NO: 106953 - DNA, 1025 bp, Homo sapiens
cacctaatttttaatttccattttggctttaggtgtggctttattttaatagctgccaaaaagttggcaattgtttttacgtttagaacttcacagtttgcttttctgtaggtttaggtagcattggggatattcgtctaataaaaacttttaaaatttctgttctgaccctgaggcacttaaaaaaaactcttatgggccaaattttaaaagtagagtgtctctactactgcataaagaatttctataaaagatgaaacatggagctgattgaaagaatagacggcgcaatggtagaggacacatagttaccactgtcactggtaatctacagcttgatgcgaagtcattccgccttgtttgttgaaatgttaatcatttcattaagaaaggttaagtaattaactgatatttcattagggaatcaatgacagacctttttttagtgatgtatggtagatattttctaatagaaagtttgccccatttaattatttggaaagaagctagttgattgagccttgggaaggaggggtggggcatcttcagataacatctatgtccataagcaactttaaataattttggagaaaatggtctattagaatagaaaatcgttcagtccccagttttcttttatgggctccatcaggcatgttgttgcagacctgctgttgttttgcatgccttctctgggtttaagaagggttcagctgcttaaatgtgttcatcttattttctaaataatggcttttgttgcagtgtgatgcatgttgacagtaaacgcgcagccgtaactttggtaagcttacaacaaattcttatacttgtagaagcaagttatcctccttgctgctgactgggggtgcttctcccttttgtctggctatccttatggcaactgcagcaaaaggtttaagtattctgggatgaggatggggtgggggtggggacggagggactctccacctggcgaaagttcaccttttctgatacctttttgtcctgaaatcacacacaaagta

SEQ ID NO: 106954 - DNA, 1026 bp, Homo sapiens
aggaggccgaggcataagaatcacttgaacctaggaggcagaggttgcagtcagctgggattatgccactgcactccagcctgggcgacacagcgaggcgctgtctcaaaaaaaaaaaaaaaaaaaaaaaaaaaaaaaaaagtacagttgatgaaaatgttttagaggctgaacaaattctcactgaagcataagtctcctattgtccatcttggattgcagacactcaaacttgtcactgaggggacaattgtgagaagctcccaagagttccctgtatgatgtgcatattatgttttttatatatatatatatatatataattattatattattattttaatcctggctaccttaaaggaaagttaataggccttagtattgctgagatatagaccatatacaatattgactcattaattcaacaaatatttcttgaacagctatgatgtgttaggcactggggatacaaaaacaagacatgacatcattcctatttcatggagctgacaatttagtggattggtaaatattaaaactgaactactagactataagaaatgcaggaagtgtatcttagacatttttgagttgcacatacctggcatgtaagtatgaatgcaatgcatgtttgaatgaaggaatgtttgaatgttgtcataagcggtgtttttttttttaagtcaaaaaccccttagatttctaaagctgagtgtttttttactaatctcattattgttttcaaattctccaataataataatagcttagacactgaattcagtaaccacagaggctgtttataatttgttggtgctttttaaacatctttgaaagccaaacaagcccttgactcctggccaataattcactgtgtcttcatgtatatacctgaggggtagcagtcatcaaaaggcctgtgcaccagcatgtgaaatatggggatccttatactgtggaatgtataaagattgcttactctgtaatttttaaaagccctgtaactctttataaagcatatatagc

SEQ ID NO: 106955 - DNA, 1045 bp, Homo sapiens
ccgtgtccggccgctgctgccgtggactcctcttccagttcttcctcatccactgggcaggtatttcctgaacacctacagtggagccacacacctgctatgcgctggagattcaataatgagcagcagctgaccttgtcaggaagggggtgaattatggctttctcaagggacaacccaggtgccatcttttcagaaagaccccctgactaccgtatctaaaatagaaaccttgctccctcgttttgtattctcctgccctgccttctttttcttcctaatgcttaatgcagctggattttattatatatgaatttgtttactttcagtctgtctccccagctcctcaacacctcccctcagttaaggataaaagagcagtggatttttgtttttggacattttggacctagaactgtgcctggtccctagtaagaacaccagaaattgttatgaatgaatagatggatgaatgcaaagccccttcttagtgtctgccctgcagtgggtgcccaatgatgacacctcaaggttgtcccaagagcatttggaaattttgatgaaaccgtgtctattctggctaagtgttaggaagaaatgtgtgacagtgttctgagaagtttgcttggtacacacaaatctggttttaaaaggctttgcataaaatgactgcaagattttgttttaaaaaagtgatattcattttttttttggttaagacaagctcatttcttttttccttttgggttcttatagcacccgtctataagaattgtcacttgctgccattttctttgccggagacccaaaaaagttgggggtgggggagatggagtgagtttcgttctttcaaaacattttcactttcattatgggatgctaagagagcattatactgtcataacaagcgtgcttttggcagaccttagcagaatgaaatcgtgtctgttttcataggtgtgctgcaactgtgctattgttacctggtatctgttttcaaggtgttaaacctggacctgtggtctaaattgtgaatactgctgac

SEQ ID NO: 106956 - DNA, 1055 bp, Homo sapiens
atattgacacatcattatcaaccaaagtccatagtttacattagggctcactctcggatttgtatattctatgggttttgatgagtgtccaatgacatgtatccaccattatagtatcattcagaatagttttattttcataaaaatctttgctccgcctattcattccttcctctcctacacctgaacccctgacaacccctgatcctttaactgtctccatagttttgccttttctgcaatgttatgttagttggaatcatacagtatgtggcttttcagattggcttcttcacttagtaatatgcattaaagtttccccaatgtattttcatggtgtaatagctcattgctttttagcagtgaatgatattccattgtctggatgtaccatagtttactgatctactgactgctaaaggacatcttgtctcctttcaagttatggcatttatgaatgtagctgccataaccatctctgtgtgggtttttgtgtggacgtaaattttcagctcaattgggtaaataccaaggagtataattgctggatcatatggtaagagtatgtttagttttgtaataaactgccaaactgtctttcaaagtggctgtaccattttgcattcttactagcattgagcgagagttcctgttgctccacatcctcaccagcatttggtgttaccaacgtttcgggatttagacattctaataggtgtatagtggtatctcattgttttaatttgcagtctccagtgacatatgatattaagcatcttttcttggtacctatttgccatctgtatatcatcagcaagatgtttgctcaggtcttttgtccaattttaaaatcatggtgttcattttcttattgttgaattaaaaaatttctttgtagattttggagctattggtatttttatttgaattactattatcttaagtgcttggacaagagtttcattaagacctcagcattttaaccagtaaaacatgaaaatgttttcttctcattttttggagggaggtggataaatgatcttcacttgaaaaaa

SEQ ID NO: 106957 - DNA, 1012 bp, Homo sapiens
gcccgcgcttgtgggcatccggcccgcagggccgggccgcggcgcgcgccgcctcctcgtgctggaagaattcaagacggagaagaggctgtgcaagatgttctacgccgtcacgctgctcttcctgctcctctgggggccctacgtcgtggccagctacctgcgggtcctggtgcggcccggcgccgtcccccaggcctacctgacggcctccgtgtggctgaccttcgcgcaggccggcatcaaccccgtcgtgtgcttcctcttcaacagggagctgagggactgcttcagggcccagttcccctgctgccagagcccccggaccacccaggcgacccatccctgcgacctgaaaggcattggtttatgagggaggccccgccacatagacccccaacccagcctttccctttggctcggacggtgacgttgtatcttttccttctggcccctgtttaattttctaagctgccttcaaaatgactcgaagtggacagacacttggattgtactgactcctttgggggtggggtgggtgaggagtaggatgctcagcccactccagctccgcacattcgtcctcctaactcgactttcttcctgacaataggccctgcagtctttttgtagcggtactgacgtcttttattccatgtgtggttcctttttttctttttctataaaggctgtactaattttcttcatgcaacgtttcctaaagaccatggccagttttctacagaagctatttttgacaacctcaagtggcattacattttgcagtgaagtagaggaacctagggggacttcttcacaagttagatttcttgaggatcttctgttggaagcaggagaaagtggggggtggggggaagttgtccgaaatgccctctgaattgccggctgcagggtccttgtgctgcgctggttctttgaaagtctcagtgttgatattgaacttaaagagcagagatggagatcagtagcaaggcagtcatttttttaaagc

SEQ ID NO: 106958 - DNA, 1086 bp, Homo sapiens
ttgtgttggcttgggttggtctctgtttcatcctcctgtgaggtagtcccaacagctcaggcaccctctctgttcctcatttattggaagtagggctctaactcctctccccttcttccaaccggttcagcagaaatccaaggattgagtctctgtggaccattttgggttaggtgttcattcggaatgaatcactctggccacggggatggaatatgctgattggatgggcttgcaatgtggaggtgtctgctgatgctatacatatgggggtagctccactctgaccacctgaattgagggtaagtgggggtggttctcctaaggaaaataaaggttaacaaaggaagaggggatggatgctgcagcggcaaaggcaagagccgtgtatcccacttctgagcaaagcagggttactctgtacacacccatcagtgaccgacgtgccctttgtatctctccaggactgaagaagcaacataactgcccgtaagagggacttctcaacctcttaggaaaacacatagtgtcttaaacatgaactgttctctttcccaaggaaaacattgctgaggactttatctttgggttttcatttttttataccatcctctttgactctataaatgtactttatatgttgaaattggatagttatgtatctaacttcctacttgatgactacatatattctctatataccagaacgagataaaaaagaaattagtaggtgctatttcagagacttgtggcacagagatcagcagaaaaaaagccagaaacaaacaaaaagcaacccatgattactcataataaagatcaccactgaacaatgagattttatggaactaaaattatgatatatttatagatcagtttatttcgtttgccacagcaaactagtttttatttttcacatttttctctgtgcttctattagaagccatggaaacaacgctctcctttttttttcttatgcaaattgattcacctcagcatttactgaccttttcttggcatattctctttgactctggtcatgtcagttgtaaaagcatgcaaagaagctgataatgaatgctttca

SEQ ID NO: 106959 - DNA, 1033 bp, Homo sapiens
ccctaggtctcattggctgcctccaggtctctccttcggcctcttgaaccttgtgtcatccctgttggagttattacgggtcccacatgcgagtgacaagacactaagaccctggaggttggagtggggtgcagggtggggaaatccaaaattgtgtttgggtatatccattaactatttcagtggagaggtggagtaactgcagttagtgtcccttgcttcgtgcttactggtttaggcactttccatagattaagtcatttaatcctcacaacgaccctatgaggttagtacttacacctttttccatttaggaaactgaggagattaagtaattgttcaagggaacataacaaaaaaggcaagtagtcatttggttacacgattttggagaggtgtgtgtggtgggagtgagaacaaagctggaaatacagattcggaagtcaacagctgataagatgatatttagagctattgatcccatcagtcttcctgggaaagcacctagactgggaaaaggagagtgtctggaccaagccctaagcactcccaaatttagagatgagaatatagaggggtaggagccactactgggaactggagaaaggtcagtgaggtaagaagaaatcaacgacagtgaggtattccggaagccaagaaagggaagcattccaaagaccaggaagtggccagttgtgtctggagctgctggatggccaagtaagataaagtctgagaagtgcttttgcagggaggaagacattgtgcttttgacaggagcagctgctttggaggagaggggacaaagtccaattgtggtagagtgggaggcgagaaagtaatgttggggaggtgctacctttcaagaaaaatccagggactgagctgcaagggcccatggtccctggcattctctccagctctctccacacagcaacttcatttttttccccatatatgctgtagagcattttctataggtcacaaagaaggtcttgtcccattcggtcaataattgtaccaaggaggtgaa

SEQ ID NO: 106960 - DNA, 1006 bp, Homo sapiens
tgtgtttgggatcagtcacaaaaaggaatgccgccttctggtgtgggactttggtggcattcactccctgtgctgcaagcgttgctgagaagttacatctaagataaaacaggagcaaaggatccagctttcagttttcataagactcaagagcagcatcagcatcactcaaggaacggagatggacacagtggggtattaaaaatactggtgactagcgctagggaggctgaggcaggagaatcgcttgaacccaagaggcaaaggttgcagtgagccaagatcacaccactgcactccagcctgggtgacagagcaagactccatctcagaaaaaaaaaaaaaaaaaaaaaaattgctgatgactgcatcagtcgagttcctgccaggacacagatggtgctctcagcatgagtaatttgaggtgtgtttagtaaaggcactatctacaaaggggtgggcagagtatgggacaccatagtggacttgcaaaaacgcagggctggtaacagagagctattatcaccctgatgccttgaagggacaggaagggacaattatggggacctggaggtggcatgggcttcccgggaggagctgtgatctttgagggatgctgccactcccaggcaattccagagggaaagaatgaattggtagaacccaaccagaagccacaggaaaggtgcctcctgggccacagagcagggtggagaatggccaagaatagattgtgacaatggaaaatacccagcacggtgacagtaaaatggaatatcagcaatcactaccaagcaggaactcactacattccagacctggtgctgagcattttacaggcattcactgatcgaatcatcgcaaatttatcagcacagtttctattcatattgcccacatcacaatttactaaattgtccagcactgcacagctaggaagtggtacgactggggtctgtccttttcattgtctttaatgagctctttcaaaactctgttgtaggaa

SEQ ID NO: 106961 - DNA, 1049 bp, Homo sapiens
ctaattcttcccaatgcaccaggctgactgggactcctaccctgctgtgtaggacagtgtcatggtgtggaagtgagggcttaagtcaagcccaaacatgacttccagacagtcagatctgctttttctttctagggattctattatatgcatgttgggtctcatggacatcatttttttttcttctttgattctcacctctttaatcttttccacagagctcttgaagaagctcttaagcctatctctctcttctgtgatcttggttttcttcagtgactcaggaaaggcactgcttctattgtgtttttaatatgacacctataattttcatctgcagtctttatagactggattatggatcttggattatgtttattcttcatgacaacctgctgtcatttaatagatatgatgggtctttaagttatcttgaaaatactaatgatgacttacctagtttcacatgtttttctttcaagataaatttgctgttttcacattggcccctttccattgccacaaacagtaaattcttttttgttttcttatttattcagagaatagcctatatttgcaaattactgagatgggctaagtttctttcagagactgtattcatccatgtctgaatcactgatactcagatgaaggagaaagaccatgcaagatagtaatgttaatgggcagggccctgaaactagactgcctgggttcaagtcccagttccaccactttctagctatgtgatttggggtaagttacttgactgggctgaacctcagtttcttcctccataaaatggagatattaataatgctgacctcctgggtttatgtcgtgaggattctatgagcctagatatagggtgcatagaagagtgcccagcatatggtaagctcagagaaagtgttagctgtgaagatgatgatgacaatgataacagtaataattttactccattcatgcagactcctctgtttgctttccgaattcattgtttctgtgaagtcaggtcaagccagtctttaatcttgtcttgaaccgtc

SEQ ID NO: 106962 - DNA, 1071 bp, Homo sapiens
gtatttgtctgtgtaatccagtcatttctcaggctcatgtaatggtgttttgggtggagtaggaaccagaatttgaacgaccagatgaacagaattagatgagaatcctttttctggttgtctatttgcagcctctaagaagtgaagtctcctgactcatccacatttgagtttggacatatgctactgggactaatgaatttagatagcttggatggtggtccagtttcggggacccccatgatgggggatggtgtctttcgtggtaaacaagatatctgacagcataaacagcacagggaggagctctgggtactgtataatgaatacaagaaactaccctacctcacagtggcatatgtgttttctggaaagtcacagctgtcaactgaaggggagacatctctaaactcaaatgcttcaggggcttaagcagctttgctgtgtgacccctctaagtgagtgtgatgcggagagcatgtcattcatttcttccagttgatgataggacttgctggccaccgggagctggtgccaggagagatttgggtttctggaggatggtggattttcatctccagcagcaccagcaaggaaacagcagtttcagtgcaaagagctgcgaaatcccagccttcctagcctcatggcacctgggtctctttcacagatacacgcaagcagtgttggagccggaactggcctctagaaatgtcgaccagttgtcatcctcaccagcagactaccggagtgtttatttctcttctgctttcgccagctctggacattctcactaaaaaataaaacaacaaatcctgcatggctttaagaagtctctttatacatatgcatacatagaagccgaagggtcccgaagccattctgattgggcaacaatttggaagacaaatgatgacagccacattatggggcatggccaaccgactgccatcctgcttgagagggtccagcaagctgcacacatttgaatgttcactcgggagagcgctcctctcttcctcttcaattacccagcatggttacatggtgcttttcactcaccaagccctg

SEQ ID NO: 106963 - DNA, 1028 bp, Homo sapiens
acttcagaacctgaatctcagctgtgaacacaatacaaagaaagtgccccttgattctgaacaggaggaagaaaaattgagaaactagttgagcgtgcagatcagaggaacttgcaaagagggcaggagggttctccagcagcacaagcggcatcatttgcagggcccagtgcaaagtgagaatgcagggacccctgttaaaaaatcattgagaatttcaagtcggtgacagctgagcattaactaagcatagggtccttctaagtgtggggtcctgtttgactgcttgggtcacatgctgctgatgctcgtcctgtgcctctgttttgaacagtgagtgggtacagatggggtttcctgcagcaggatgggtaaagggcaaactcctgggtcagatggcttgggtttgagccctaggaattcccagcttcttagctaatgactttgagcaacttctttaactcctctgggcctcagttttctcgtctgcaaaatggaatgttgttggctcttcttttctaggagtattgtggggcagatgcagtaaagtattgtgcatagcgcttggcccatagtactgaccagcagtaccgggtattagagttaatagtccctactgccccagctccccagggcacggtgcccgtggaaataccaggtccctgctgtctttacctctgtgctgctcagcctgggttggaatcttggaggctgtagcctccccactctggcagcccttctttccctccccatcccccaggcttttaatgagtttagtattttcatcaaatcattcttcctacaacacagggctggggaggctaaaaatagctccccgagtcacgtgacagctccaaatgcggaggctcccagcaaaggtgcaagtgcgactccctgtttcctaggaaatgagagtcattgtgatgcctgaagccaggccgctgccaatgcagccgggccctcgcaggggcacattgtttcctgtgacatcctccagtgtgacagacggagggcgggggggcagagag

SEQ ID NO: 106964 - DNA, 1128 bp, Homo sapiens
ccaatgtgatcacaaggctagtaagtggtggagtccaggtgccagaaagaggtccagagagcacctctgcctagagtgtggcccgctcgagcagaaagcagccccagtcagcctgagatgaacagctctcccctcgggcttagaactcccagctgcttctctgagctggactcctgccagtgttcacccaggtaacggaattgcctggggagccctgcttgactccagggaagccggcggggggggcccccaggcagagaaatgaagtgagcaagacacctcccgtccccagccttcccccgctcatccctctcctccagaggagctggaaggaggagttcctgcagaaagagtccacacccaggaggacactgtgctcgggcttatgccaggaggccgccccctaccccagcaagggcggcgacaggaggcggaaaccctgggagcagagggggaggggccggcccaaggagtgtctgagcgccttctcccaggctgcctggaacaggatgttccaaaacgaggaggctagccaagaagcagggcgtgtgtgcgtgtctgtgtagcgtatgtgtgtgtgtgcgtggtgtgcatacgtgcatgtggtatatgcatgtgtgcatgtgtggtgtgtgtgccctgtgttgtaagtgcacgtgcacgtgggagggtgtggtgtgcgagggctatgtgtgagtgtggtgtctgtgtgtgacgtgtggcatatgtgatgtatgtggtgtgtgtgggtgtgtatatgcatgtggtatgtgcacatgcacacggtgtctggtgtgtggcggggagtgtttgtgtatgtgtggtgtgtgtgtatgtgtggtgggtgtgggtctgtatgtgtgtgatgtgtgtgggtgtgtatgtgtgtatatgtggtgtgtgggtgtacgtgtgtggtgtgtgggtatgtgtgtggtatgtgtggtggtttgtgactggtgtgtgtatgtgtgtggtgggagtgtttgtgattgtgtggtgtgtgtgtgggggggagggactggcactgtggaacaccaggacaggatctgagtgtgggtgggttaggttcacctatgtagagcaaggcggaagtgacgaggaagtggaggagcaagaggagaggga

SEQ ID NO: 106965 - DNA, 1537 bp, Homo sapiens
tgttgacaaggttagatgattgattgactgactgactgactgactgactgactgactgatggtcactgtgggtttcactgtagctggctggctgtgatctggactgaccaggccatggactgtgggagcttgtgactatgactgggccaactgcaactgggctgatggattcagtggattgaacatgactggtgaggagacaggttgacaaggagaccaactcattgaccacatgcatgatggactgactggccagttgatgacaatgggtttggtgtatggttgactggttggttgtttaattcaaactgactggataactaggcagcttactatgactgactattgtgactgcctgcctggctgactgagggaataactgagtcagtgtgactggcaggctgattcagactgactggatgtctggatgactatgatctcctaactgatagccgtcagtgatgatcttgactgactgactagccggctctgggattggctgtctcttccagactgacttggtaaccgtgggtctgactgtgacccctgcgtcttgactgaccgccttgattgcatgcctgacattttgagatcaactgactggctggttgcctggtgtttcattgtggctgtggcacagcctacggctacctgtgactaaccatgaaactgactacacccaactcacaggacagaccgggtggactgaccacctgccttagtcatggaaaactgactctggctgactcaactgccagagactgactgagatgaacaggccagccaagagacagctgggtgactcgtggtgagtggctttgtctgactggatggctgtgacaatgtaactgagtctggctgtgagacaataacctgtggattgactgacttgaatgtgttgactgggtggctgaatctgattggctatgtgggtgactgatgactcctggctgactggctaaccctgccttgactgactgattgatgggctgacagatcgagtttgaccaggcagcaggagacctgctgaccacggctgtgactcactgtgtgagcggccatgtctgactgtgtaacacaatctgaccaagagacaatgactaattgactgaccaactgactgagattggctgggtgtctgactgaccagctgtgactgcaactcctgatgtgagtgggcgttgactgggtggccctgactcgtataggcaagtctggctgtgagacaacagctaactccctgactggcccagtgtgccaactggctgactgcttgaggctggccaacagaccagctgaccgtgcctgggactcacggtgtgcgtggccatgcctcactgtgtggccctggctgtgtctcggagtctgactgtgagacaagggcagactgactgactttcctggccaactgcctccaggtagcctgtcaacacagtccctacccttcccaaaaccattaaagtgctgcagtgggagctggcccagcctgaggggacagagcagcttctgtggagcagcagggacaggaagagggaag

SEQ ID NO: 106966 - DNA, 1063 bp, Homo sapiens
gctgggtgggggtggggcgggccacgggcagccatttatggggcttggattggggccaaacgctgccctagaaaatccaggtcttggaatgcagggctggagaagtcttaggaaggagcaatgtgtctgtcagtcacacctctgttaccgccaccattttatagctggggaaacagaggcccacagccctcaagagcccagggcatttcccacacccggccccccctggggctgtcccccagagcccgggcaggtggtgagcctcagccctcccttactctcccgcaagatgctgggcagcagaatttggggggcagggtcgatgaccttgggcaagttactccatctctctgagcctcagttgcttcatcagttaaacagctgtttctgatagaagccacttggcagaactcggattgggtgcccagatgcctctgccaccacctgtgtggtctccagcagggagctttgcattttgcgcctcggtgtccccattcacaaatgggaacgggctcaagaaaggcacttacttcataagcttgtcatgaggaggaaaaacacaatccacatgaagacttcagctcggtgcctggcacctagtaaacaacccagaaatgtgaacctgcacaatgattaatcctcatctcttgggaggcattaggattaatcaagatctttgacgcgcatgtacttgggaagccatgacgttcagccccaaagtgttgggaggcacaggggcacagcctggtaatggtgccaccgatgagcccagctgggccctccgcagccaccctgaaatgccacctgcttccccaaaggatcttacagaccctctgggaggcaccagctgctcctgataccacagccactggggcctggtccccagggacagggaggtgaaaacaggaggaaattttctggggttcccccaggtaagagccaagggcccaggtgtcacacataggccttggtggggacaggagcctcttccaggaacgcccagagtctcaggccctccagaagctgaagaaaaagccagactcttctctgaagctgagaagag

SEQ ID NO: 106967 - DNA, 1053 bp, Homo sapiens
gggactttacagggataatcaagttaacgtgaggtcattacagtgggccccgatccagtgtgactaatgtccttataaaaaagggaaattcaagcacagacgtgtacagaaggaagacagtgtgaagatacagggagaagatggccatctacaagccaaggagagaggcacagaatagatccatcccctacagccctcagaagaaaccaagtctgcccatgccttgatctcagacttccagcctccagaagcacgagacaatttcagttgtttactccacccagtttgtggtactttgttacggcagccccagggaacaaatacagcatccaaaggcatccacgttcaaaagcgtttttcaaccctggctaggccaaataagatttgtctggaggccacgttctgcccgagagggcgcaggtggcaacccctgcagcctggagagttctcagagcacaccctgtccaccagggaattggcactgtgggaggctgaggtcaaacagatcaaatgggaattcaattatggtttggagacgagtccgtgaggtcacagattaaatgagggcagggactgcagcctgggcctcgctgtggtgttcatgctccgggctccagaagctgcactcctgcctgtcacagagccggacgaggcccagcctgcttgtcacatagagaagaaaccgaaatttaaaagatagataggtcagatcagtttatatgtggctgtggactaatacccccagcatatggcaaccaatactctgcgaggcacattggaactcctgtaatcaagtatctgttaattattaaaattgaatctatttttctaccctttatttagttgagaaatctcacattacacagaaaggttaattacaaaccgacttcaagaaccctttgttggaagcttctgtttcagtttctccaagatgagtccttgaactccatatttgggaatgcagacacaggctggcttagcaaaatcgcttcctcatgctagcagaccccagatatagcaaacctctcagatggctccatggagctgggatta

SEQ ID NO: 106968 - DNA, 1010 bp, Homo sapiens
gacggaaagggaggcaaaaaggttttctctaatcctcagccaaactctagtgttaacaccaagtgtccagatccccattgagaaatcccatggctagagtgtgacaggatcatggaagcagctcttgctcaattattcttgatcaagggtggaatgacgacttcagccagcaagggcccaggcttgtgctctctgatttcatagccctacggcgtggaaatggaaaccagccagactccaccttgggcagtgaagagaacataagggacgtccaggaggcccttggtctagcacgcccctgacctcccagcggttctggaaggccactcctaacccttcaaaccatagcaaggaaggttagagctatctttgtgttaggatcaaaactcgagaaggttctgtttgctaaccactgaaggaagcccacggcctgtctttagggcttctgtcaggagaggacaatggacatagacaactagatactgcaggagggctctggttttctcagacaggatcctaggatgtgtctggaagcctgcggagtgaaggtagacatgcaggtgtgatgttctgcctgatagtgcctctctccaggcattaactacaaggctgggtgggggcttactgtaaggcatcgagtccctaagcatttatacagtcccaattgtgcatcagtgcagtgctggttataacagggaagaatttgtggaggggagggcacaggctgaaattggcccattcctacacatgctcttgacctagacctagagtaagtgacattgaccccaaccgtccccctacccacctccagcttgtgccagacatcactaatcagtcacagcgcttctttccagctgaatccagactcagaatcctcattagagctcattgttagcacgtcttcctgaagtgcaacccatttgccattccttccctggacgaaacccaccccaaataactgggaaacccttcaaggcagtttttaatcaacacttcaattgtggaactgc

SEQ ID NO: 106969 - DNA, 1047 bp, Homo sapiens
aacagacccattttcaactcaacatcctgcgctatttacactctcttccttccagtgctagttcaggtgcagacccaggacaaaataatcggggatggatcttgacatgttttaagtggtttcttaattctttggaaggttatagactggtatgcctcagcacctgcagcagcaggcaggagtctccctcgcatggggcaataagtgagcttgtgtggcttttaggttagtaacacactttattcacatctctgagacatagttgacctaaatccagttggccagaaacaggggttgtcttttgaggattttcagtcctcaattagcatattttagcatcatctccattttctttccttaaatcccatttccttcctttacatcattgcaatctatctcaaaggttacacttaggagacagttcattttctttcaaattttggtgattcttttgccccattatgtctccttttgcatctttgaggtatgtacttaagatacccagctatttcagcttctgataaacaagttctaaaatacaaagtgagcttcctattcacattggaaatattccacagattaaaaattaactattattctaaaggctaaaatctatacacacaaaaataaagatttccaatgtaaattttactattttatttgtgaaaaaactacaagcagaattcataaatagacatttctatttaaagcaggaaaatgataaagtggcttctaataacatagtcgtgcacatgccagtaacaggaatatattaacatcttttatttgctagacaaagagcagtgtccaatataaatttcccccaaaacatttaagacctgtgaatttttgaccagttcacaaaaccaccaactgacactttagcatgaagaaaaaaacaaacctaacagactgtcagctctaaagacattacagagcagaaacttccaaaagcgttatacaagctgtctttctgggcaaatgaaaaatatagctcgtataatacattaacaaaaattcacaagataagattgttttgacatactt

SEQ ID NO: 106970 - DNA, 2048 bp, Homo sapiens
gtcatgcattgtgaaagtgtttggcatctcttagaatttgtgaacaatagtgctaagagccagtgtcagttggagattggcacagacataatggtttatggcacaatgaatgtgtcacttgtgtatgatttttttacagtgactttcagtcttcactcccttgggagctagtatgagccatagttacctttgttgctctctatgtgttgtctgtgccaatcacagagctgcaggggaacagaacaagttggaataattagattgaggagtgaatgtcacacttctaatttcattctcttttcaagggattaccagtgtccatttaataaaatgagattaaccctctgcagcaggagtacttgaaagctgtcagtcagtataatcttgacggcttgaaagaagtagtgttctcagcactcttagaaacactgtcatgttttattggctcaaaaactattttactgcacagggatgtgtatgttagtgttatcacatgtgaatgtatcatttcctttgaaaaaggaaaagtttagtatccatactaaataatccatacaaaataatgcagaaataacatgaaccttataatttagttttgagttggcagatatcagtaataaaatacccaaggaatgtgagaccagataaaaatgtttaaaaactttataaagcaaatagtgatatatattttttgaacatttcagaaaacctcggatcaattctcagctggtggcacaacaagtggcacaacagtatgccaccccaccaccccctaaaaaggagaagaaggagaaagttgaaaagcaggacaaagagaaacctgagaaagacaaggaaattagtcctagtgttaccaagaaaaataccaacaagaaaaccaagtaagtttctggttaactaagtacaggatattactttgcaagtgaattcaagatatcttctaaatgcctgttttttttgtttgtttgtttgttttgtatctccctcatttagaccaaagtctgacattctgaaagatcctcctagtgaagcaaacagcatacagtctgcaaatgctacaacaaagaccagcgaaacaaatcacacctcaaggtacttggaaactagaatgacatactaaatcactgctctgatttacttaatcgtaatcatgaatccagggtggttttgtgccttgggtttgtaggctaagaaggtgaagagctaagtatgggtggggctggtgactttttctcttttttaaatactgtggccagaacaggaaacagataatagtaattttacattggtcccaagctttgctatccgtgcttgttggattattgctaaaactgagtagcacactctgtagtcggctttggcatgtgtggtaggcagttcggattcattgccacagtgtcatgaagtcttgtgcgtattgatgatattctgccagaagctgtttttgatccataacttacttaattggctcttcccctgtggtgttgcttctaggccccggctgaaaaacgtggacaggagcactgcacagcagttggcagtaactgtgggcaacgtcaccgtcattatcacagactttaaggaaaagactcgctcctcatcgacatcctcatccacagtgacctccagtgcagggtcagaacagcagaaccagagcagctcggggtcagagagcacagacaagggctcctcccgttcctccacgccaaagggcgacatgtcagcagtcaatgatgaatctttctgaaattgcacatggaattgtgaaaactatgaatcagggtatgaaattcaaaacctccacctgcccatgctgcttgcatccctggagaatcttctgtggacatcgacctcttagtgatgctgccaggataatttctgcttgccatgggcatctggccaccaaggaatttcgcaccctgacgattactcttgacacttttatgtattccattgttttatatgattttcctaacaatcatttataattggatgtgctcctgaatctactttttataaaaaaaaaaaaatctgctgtgcacaatttt

SEQ ID NO: 106971 - DNA, 1652 bp, Homo sapiens
aaggagaacatttcagaatctgctgtttattaaggtaaagatacctgttagtcgtgtggagccagttatttctaaccaagcagtatctggtgagagtttgtgtaacaccatgtgtggatattttacaattgaagttcagtggccttccctaaaggcatcctcttttaaaagggatttctgcaaaaccaaaattctctccgaaatacgcagaaaaactggcagctatgttagtgaggctccttagtgctgctgttgctgttagacagcataattaactttaggatgctaacatatgcgaaggatttatgtctctagaaccatttcccagggcgcagacttaccagctcctttcacttgtaaatctttccatttgccttccagtatctgaagaagggtggcagacacatctacggctggaaaagtagtgctttggaatgtatgtattacttgtacagggaattgtcttgtggaatatctctctacatgtcctgttgcaagagctaagtgaatggtacctaattttgtcctcatttcatcctgacctcagccctgtgaaaataggtgtggcctcattctcatttcaggtaatttaccttagctcagtagcaggtgtggataaagtccaaaggctgtcttaactccaaagtctatactcttcctttatactactccgtttccctattacctgtgaagatgacagaaggaaagatcagggagaaaggggatgacttgagttttgaaattctgataggatcaaatttgagggaagttttagttctctaatacagagcagagtgattctcttgagtcaaggatgtgtgtgggaaagagtaacctagaatgggactaagacccccttcaggtcacctagtagctccttgtagatgggtcgaaggatttgagaaattgaagaaaagtgtttacatgaaagaggaaagtactatttaagaaaaaaaagaactacaaaaaaacaatactgtttgggaagcagagggaaattaataatgtcctgcaatgtatgatcctggtaaagtgacagttgagtttttaattatccatattataatgatggttggcttcagtcaagtcatgaggtcatataggttccttggtatataaaaaatacaatggaacagactgtatgggttaagtgaacagaaaacaaattttattaatcatcaaagccagagaccaatactgtttactggacagtgctgttgggataaaacaactcaggtgctttcacactttaacactgctttccttagaagtaaatacatatgttgcccaacttaaaaatggattgtattccacaaacatatttgcaatttggttatttacaacttggaatacattatcgtagacaagtccagacaaagatttagcctcagtatgtctttaacaaggtacttttgcaaagaaaaaaaaagttgtgttcagtttataaagcattttcacacatgtggcccacctagtttcctgcagttggattttactaccattcctattttgtttttagaatgttttagtcagcaggtgttaaagaataacagccgagttgtatacttcggtaggttccaacctgggatatatgcattttgggacatcagtaatataaaaattcagtcattattggatggggtaaaatctgt

SEQ ID NO: 106972 - DNA, 1755 bp, Homo sapiens
agccagggctaaaattccattttcttaacatctgttactcttttcactggcgttacattcagattaagaaatgcaagggctgatcacgtgtctcatcctgggggtcccagcaccttgggaggccaaggctggcggattgcttaaagccaggagtttgagaccagcctgagcaacaaagcaagattctgactataaaaaacaaaacaaaacaaaactggaaacggtggtacgcacctgtactctcagctactctggagactgagggaggattgcttgagcccaggagttcagggctacggtgagctatgatcacaccactgcacttcagtctgggtgacagagcaagagcctgtcttaaaaaaaaaaaaaagcgagcagatgagctctataaatattactatgctgtgaaatcttgtctgatctcagaatctattattccagttctctgaaccccttcagattttggttgtctcatccaaagtgcagcatatccatcctgctctcctttccagtagacgtcgcttgtctactgtgtttacttccaattcaccgattctacaaacctttatgcagtgcatacactcttactcatctaggtcagtgcttcatttttaagagatggttgattgtaccttcttataaagctgtttagcttagagtaaaaaatgctttactctattactctgctccaaaattagacaagtagctgtctttactttcattctcttctgagttcttgtacctcaattaagacattctttggccatgaaactgcgtgggcttctagtttatttttaacttttaaaaatggatataactgaaacacaagaatagaaataatctccctgttcatcacccagcatcaacagtttgtatattggcaggcctcttgatcttcataaatactgtacggacttattgtttttgttaagccatcagcttaacagtgcacttgtataaaagtgcattctgggcaaaaaactggctcaacaccattagtcattggggaattacaaattaaaatcacattgggatgctactatacacccacgttaatggctcagattaaaaagactgacagaacgaagtgttgttgaggatatggagcaattggaatgctcatactttgctggagggaatgtaaaatagtacaatccctttgaaaaagagtttggcagtttattatataattgaatatatatcttgccataaagttaaacatatacttgccataggcattttagccaagataaatgaaaacatatgtctgcacaaagacttgttaatgaatgttcatctcagctttatttataatagtggcaagctggaaaaagcccaaatatccatcagcaggagcctggataaacaaaacacataacaacatggatgattctcagaaatactctgcaatgaaagtagccttacacataaagaagagtatatagtgtataattccatttatgtgaaattccaggaaagacaaatggaatccgtagttacagaaaacatcagtggcctcctggagctgggaatggggattgtctagaagcggcaccgaagaggatgaggggtgatgattaatagctgtatacatttgtcaaaacttcttaaaactgtacactttattgtatatagattgtacctcattaaaatttaccctgtgcaagcattggccatgtcagtaaactgcagcacctgttcttcttcacgttttttgtttttatttttgtttggatggcaggtaatcattcacct

SEQ ID NO: 106973 - DNA, 1986 bp, Homo sapiens
cctgtgtatataaccagtattgggggcagagtcctattggtacagataattaacactggctatcaattttcctatataacaaagcacaggctttttatccaaggtgtctctatttgtatttaggcaattttaatagctaaggagttgacctatacgtgacttgcatttgaattcttaactgtaatatgccagtaactttagtagttttgaatgcagctcctctcttcgagcctcttgggacactgcgtctgtccttgtctgtcagattctcaaaaactttacctgggacacacacaagtaaacctgggttcagtagtttccctttccttttttcctttcttgagagtggggagaagcttctttgttggacagaaatcactcatctcattttttttctggcactttatggattttacaccatctcctacagaatagagttttgattagagtattcaagaccaaattgcttactttcagggtagctttattattccagcccaatactgcactccctactgcatttttgatacaaacttgctcatttgaaagggtgtgaaaagaatgatgtggttcctgagatttagctactcagggagtaggaggagacagcaggagttgggttaaatctaggaggaatgaggtgggggaatgtctagtgttttgaggaagggctgtgagaaacaaaatgctattttctgagaagcttgttaagagagttgtccctaaggcaagtagttctctactgggatttcacatttctagaatctcctcgggggatctatttaaaatacctttgtttaggtgggcccatctcctacccattaagtcagtgtctctgttaagtaaacagcatttcacctgtttgaacttaggagttttagaggctgaaggcatttactaagcagactttgattttcttttaattaattcattcaaaggctccatatgacacttgtgtcagggtgacaagtctccatttgtgacatagtttaggctggaccagagcatcattgttctttaaaggctccccagctgatctaatgtgcagtcagatttttgagccactgatctccaggacaagcatggttgagaatcagtgatgtgatctggtggctttgtctcccaagctgcttattttttagtagtgtgtgtgtattttgtttaatcttcaagtgaattttaagtttccagttagatagtacaatagtatggtataggggttcatagtagctgagtacatacgtgatccctaagtaacagtgctgatctggctccttgccttcagttcctgccttgtgttgtcagcccggtcttgtcagcccagtctcttcagcttagccaccctagtcttcttttagtgttaactaacgtatgatttttcttcctaccacagggtcgttttccatgtttttcctggctgagaccacccatgcgtggccacccccttaccccaccgctggcccagacgtggccacaatttttgaaaaagtccttgatgttcctgtcctttggaacacttccctcatttgcaattttctatccatgtgtgtgattatttgcttgtttggctcccttattagaccaagctttttggatctgcctattcttatccacttttatttctagcatctcctcagtgcctgagatacagcagatgttgaatgaatgaataaatgaaaagtgcaaggtaactagacagaaattcaattagttgtatgtgtctgtagaacagaataggagagcagtgcaataatgtaaaagcttctggggctggagaaattgtaatggacaggaatagtcagggaaagctgtaaattggaggtagaaatagggaagagggtaatggttgtcaggtttgggggtgagaaatggtgggaaaataggtaaggtaaccagacctatttgtttagggtatagggatgttgcttgggaaaggcaaacattaaattggtatcaaattgaggggtttaggttttagttgaaaga

SEQ ID NO: 106974 - DNA, 1051 bp, Homo sapiens
tccaggctggtcttgaactcctggcctcaaatgatcctcccactttggccttccagagtgctgggattacaggcatgagccattgctgggccttgatttttgtcttttgtgatcattgaagcactttgtgatatacttaccgtaccacacaatcatgttgtactggaatttcgtgttcacatttgctgctccatatccgccccgtatgaggctctcagggatagagactgtaacctgttgaatctttagaggcaaggtcttactatgctgcttttgtgttcttcaaatgtatttagagggcagtctgttcttctgatttcttatttaaaatgtttactttttaaaataattgtgtgatatattggctaaccccctctgcaaataggtttattcatttaaaacctttgggaaatgccttggaaatactgctacactactttcctttttcacttcagtttctagttttactctgtgcatcatctcttttgttactcttaagatgattcccttgattgtctgtctctctttgaagttcatgcctgcttttctgttcataacaggtacaacagttgattgctaaataggattcttctgaagcactgtctgttttaaaacggtgatccctcttagtagagctcccatagaatgccttccgaagttctcttctgctctgtactctctggctgaaagtttcagaaacagagcgactagagtggtctagagtcagaatacagtgtaaggaagcaaaggggatgaaaattgagaaaatcgtgaagtctgtattcttcatgagattttgcagctgaataggactcagaatagttgtagttctcttgggctagataattgtttgaactgataaataatttagataccggaattttctctctcctttttcaggagccacctcctagataatcttcctcttcagctggtactgttttataaatgaagcctctgaattgttcattagtattttcagacctcttttatctagtaagttttatgagagaagacatttttcctgatgaattggaatgttttgattaaa

SEQ ID NO: 106975 - DNA, 2936 bp, Homo sapiens
ttttttttcaattaatactcaaagcaatcctgagagatagttgttactctaactttcacaattgaagacgctgagtttcagaaaagtaacttacttggtgtcatacccagttaatagaatagaagacaggtgatttaattaaatggacaaatttaatgtgatgtttaaagtgtttcagctacactcctttgattatttcccttccaactttgccatcttttccaggaccatttaaattagaggaggacaataagatgtcacttgaggagttaccttgctccgaattatcctgaggttattagcctattcagataagctataatgtaaaaagttaacataagcctgtatagattagatgatttattttgcttgttgcagtgtttctctttataaagttgagtattcttcatcctgtcttttggatacatatacctataaaaacgggccaagaatatgcattctgtgctgactgccttaaaatcggattctttgaagtgtagtttgtcgcttcacttattcagaaaattacacaattcttttaaggaactgcgtgccaccattaaaatcactagtgaaaggcagtgagtttgtgaatgattgactttcccagggcagtggtgcagtggaaggcactcgttacctgggcagagttagatggagcatatttcattagtcgttcaggctctgtgttctaatgtgtagattttgttttcactgtatgcgttgctggctttatttccagtttcttctctagttaaaatatggaggaagtcacaggacatccagtttgttcttgggtactatgggacaaaatatatgacagtaaactatcagctcatcttggcaagtacttttggtgtggaccactgaagcatatttgtaggaagggagttacattttggtgctcaggatgggagtgatgatagtttcaaagatttctattttggaagagggatctcaaatgcctagggtttctgaaaaatttcactgtatacagtttctgctactgcaattacgttataaataaatgctttaattataagatacaactttatatgtgtaaagatgtgtatactaggttaagatttaaaaccgtgggttgcaattaaaataaaagattccctgaaattcatggaactggacgatgtctttcctttccttctttatgtttttttaaagacagggtctcgctctgttgcccaggctagagggcaggagcatgctcataggccactgcagccttgaacttctgggcttaaacaatcttcccatttcagcgtctcaagtagctaggactacaggcttgtgccaccaggcacaatttaatttggttaaatttttttttttttttgtaaagatgaagtcttgatatgttgcacaggctggtcttgaactcctggcctcaagtgatccttctgtcttgacctcccaaagtgttgggattacaggcatgaaccactgagcctggccagaactagatgatgtctatgtcttttccagttctaaaatactgtgttatgtcagtttgggcaatttgtcatacagtaagatgactcttaaaattttacagtgccaagttacttgtctacaaatatatagagaagataatttgtcatttattctcccccaatgtgttgtatagatattcatgcgttttgtgacgacttttctttctttctttctttctttctttctttctttctttctttctttctttctttctttctttctttctttcctttctttcctttctttctttctctctttctctctttctctctttctctctttctctctttctctctttctttctttctttctttctttctttctttctttctttctttctttctctttctttctttctttctttctttctttctttctttctttctttctttctttctttctttctttctttctttctttctttccttgtttttgatggagtctcgctctgttgcccaagctggagtgcagtggtgcgatctcggctcactgcaacctccacctcccgggtttaagtgattctcctccttcagcctcctgagtagctgggactacaggcgcctgccgccatgcccagctgattttgtatttttaatagagacggggttttgccatgttggccaggctggtctcaaactcctgacctcaggtgatccacctacctcggcctcccaaagtgctgggattacaggcatgagccaccgtgcctggccgcattttgtgacttctaaagaggaaagctttatcttaaaaatttttggtagtgttatttatgtgtagctgaacggttttcttatttaagttataattaaggttttaatttggaaatcttcattcaggggttaacaaatctttgccccattctaagaaattaaactcaatgcagactgaccaaagacaagattcagtcagtctccttttcaggatctctgagatgagggcttcaggacagaacacctggtatggaaggctagtgttttcaagtataaacaggtgtactgcagccctaaggctgttcttacttagaccttggttatattaattaaaagaatgacactgatacatctttttttttgaaaagtgtttttattactgaaatggttaatactgaatcatgctccatagcaaagcttggttctaatagaacaggtgtacattgggtgtttttcctgcttaacattttttgatacccatccctagcattcagtctgacaccaaattctgctgactttatttgtccagtatccctgctgcgactaccttaatttaggttctcattatatttcattttttatttcaattcttaattacaagcctgtattgcccagacctgtaccattgcagtagccttgaaactgttctgccaagtctagtctgttgtgctgcctagagatatctctagaaagcacatagatcatgtagtgtgc

SEQ ID NO: 106976 - DNA, 1019 bp, Homo sapiens
accttaccttcatatgcttttcctttgtgtcttcttctgaaatgcttcttccttttgtccaggctgactcctgtttgtctgagacttgtgtctcaggaagcctttccgttcccctccagtcattcatacctctgtcataacacatagactgtatttttaatttgatttccaatctgtctcttttaggttgtcaccttttttgagggcaagacctttttgtttcatggctttagtttgctgtgtttgttacagtgcctggcatttggtaggggttgagtaaatgtatacagaataaatgaagcctgggagaaggagttccagttaagagttctaataaataactgttttttcaaaatcttggggctttcatcttgtgtgttgaatgttactggattaggggaaagttgtctttatgaagtgggccctttaaactagtattcctgtttttctgttatagttccctactccccgccccacaccccctctaaaaaaaaagtactagaagttacacacagaactgtagccttggaggctgtaggcagtgcatttaaagtacttctggagtggttttgagcttcagagcattgacacacttccctaaataactgtgacaattctttctatttgctgttgcccatcggtgatttcagtggccagtagtcatactggaaagtctgataataaagcaggggatcagtcatgtggtaccaaaccagttgtggggaatgttagatgtgttaagatgtgattagcaacgacattcctgtttgtaaactggcatctatggcggtttaaaaatggtggcaaaaccattttgagtattgttggaaatgttatctgttctgccgtgttaatatacctataagttggtagttgcatcttgtacccttgatagtcatactttgtacattgtgtatgccactcttctgttgagtaatttggattaattactttggagattgaagtcttgactcattcacttcactcatttatttagctgtattttcagttccatgcaa

SEQ ID NO: 106977 - DNA, 2188 bp, Homo sapiens
tggcctcccaaagtgctgggatttgcccagcccctaactgttgttttgttaagttgcatttctcaagattgggcagagtagcttcctagacttggtgatttaattttacttttcttgtcttgttatttctctgcattcaatgttaccttaattgtaaaataaaaattaccaagacattgctgaatatagttgttgattagtgttcccttgatagtagtcctgcatttttactttcagctactgcttaatcacattcatttgcaaaattggaaaatttttactttggctaattaccataggtttagaactttctggtcttcagctccagaaatgtatcgctgtgttgagatcatgttttatttcatccatgtttatttgaatactgcccctctgaaaagctgactgtttttggagcttttatacacaagtatgagtgaggaaattactttaggtgtagaataaaattgtgtagaaataattatctttgaaaaaatttggtattcaggatattgaattggaagtgttgaagaagcagctgttttgtgtgtaatacgtttctcttgtttgagaatttaccagttttttgcagttgtagctttgaactatccattccccccttaaatttagataccctgacaaccaaaaatctcttgaattgtcatgaagtactttagtagaagttttatggaaaaacacaacatagctatgatctttgctggaagcttcaaaaaggcatcatcgtgtgatgctttttaggtagaaaaactcccagaaataagataaggtacctacactgggcaaagcccaagcctcttactcatgtttcctggtaatccacagcagtggttttgctcctttcatgacattgtttttgttgtagtgtttgtctttcataaaaattctccataaaaatatataaaaattacctgtcttccaaatcaaacttttatcaaaccttccaagctgaaagctggtacaatttaagatcattttacccaggaacagagtaataatttattttgtgtttactgtttcattggacttactgatttattggtggtgacttgatcttatgtgtacttggtgaccttaaagtaaattacctgggtagttgtggtcatttgacaagtttttattgagcacacagccatttgcgctcttggtgtacagtggtataaagacagaccaggtccctgttcttacggagcttaaaatactatggaaaggaagagaaaataaactaacagaaaaataacaatttcagctggcgacaagtgctacgaagaatttagagaagggtaaggaactacagagtgatgagaactgggtggagtgactgctttatagacaatgttgagataatgcatttaattttttaggaaaaagtaatgctacttccttttggagccggggataattcttatgtaggtttacctgtgccatttagctcatttggttgggggacagacagcttttagatttggagcccttgtgcataggctgctaaacttataaacttagttccatgttgtagactaaacctaggccagctaatttactagtattgttagtcattagggtgggagattatgaatggattcacttacatattatttattcatgtggcatatatttgttgtgtatttcagtaggtgctgaagaaaattccaggattaagaaaaactttctcaagtagctgtagtttaccaaaatagttatcagaactaatttggttcattaggactttgagtaaatagtaggtctctcgtgtcctaaatgacttgagctaacacattctgcagtctttctggcacttcttttctcttttgcctcatcacccatgctttttctctttgtggcatcttctgtgttacttttcataactagtactcccacttccctttttacctatagatacaaactttttcaacggtcgcatacatagaagtgcacaaatcgtaagtataaggatttgataaagttttgcagaatgagcatatctttgccactagcacccagattgattttttttttttttttgagacaggtatctggctctgttgcccaggctagagtgtggtggtgtaatcacagctcactgtagcccctactttgaggcccaggtgatactctcacctcagcctcctgagtagttgggaccatagacatgtgccatcatgcctggcac

SEQ ID NO: 106978 - DNA, 3419 bp, Homo sapiens
cgtctgtgttttgctgtctctcccccgttttcctgctccctgcctcttccctcccttttcccccactctccactcctcggaaggccaaaaagacaagcgaaacctgccgcagacgaagggttttgggattgtagcgtctgcaccttcagaaacagtgctgaagcctttaaatgcagcatctgcgatgtgaggaaaggcacctccaccaggtacttgaagatctgtgttaccttttgttaaaggactttttttttttttttttaagtgagagggtagtgagccttactttctgccctttttccaacttgttgattacggctttttttgtatttgcgggtgggttgtgtgtgtttttgggttgagtgtattaagtgttgggtgaaaagccttgtgttcgctaaatgatttatgggagggaatttttccaggttttcattttatttcaaacggacactggatttatttgacacttgtgtctattggcttattggtattggctggggaagagaggaagcagtactatcgctatggattgtaggacatagatgttttatatttttgccatgtgtagaatggttttaatttgcctgtcccgagttacttttctcttgtctgagaaatttagtgggggtagtaaggctggctgtgcttttcctgtcttgagctgcaaatgtctgttactttcttgcacttgaaaataaatgtcggtatttgataaagtaagtgcattttgtgggagactgagctgtcagttttttttttctttgactagcttatgtggggtggtgatgggggacgattttgtaaaatggtgaaatgagcagtgactgtggaagtttgtgtttaaagctctgtgatgatgaaaagaatgttgaaagaattccttttcattttgatgaaggtcgtaaactgcatgtgatgttaaaacgagttaactactttagatttaacattcataaatacttggataaaatgtcaagactcatgtagtcttttggtcatcttttaatttatgtctgaatttgtttcattggcgttagagtttgaagttaaactgttcttggtgtcatttaatgaacaggcattgggtgtgtgtgtgagacaagaatgagtttttggtggatcctttagaacattacagttgattgccaaaagtctcattttatcaggtacttatttttgaattggtgacatttcagtgtgactgtgtagtagtacttcacagttccaactggatattgttctttgattagatgaatatgtcatgttaaggtttcattggtttatttatacttgggattaaataggattattgggcaacctaaaataatctaactctgagattaattggcctaattattgtttctgtgaattgcactctttaaatgatgatacctttgaataaaaataatcaaaaactaaaaatattactccatacgttgttttaagaaatttttgtcggtgttttgtattatcatggaatatatctaaagtaaaaaacacgcatcagtagtttcatagattttgttttgctgtctaaaatagggaattccatcaaatggcatgaaagtttttagaaatgtatttgttatttaaagcagtagtgattgtatattatttatgagtaatgttttttacatgtagaagccctcagaggccaaacctctttattgtggttttgctttgagtgttaccgtagatggtgttcaagtaaatgattaggaaactcctaagaacttgagaacattactggtgaagagaaacgtaaaccaaattcaaaagtttatgtctgatttatcgctgggaatgattatctcataatgaagtgcatttcagcttttaacatgtattttaaaaaaccttactcatcaatttttcggaagcacatggaaggtgttgacttttaaaaaaggtatgtatgtatgtttaaagttttttcagagccgcagatgactgttgaaacttagttaaaactactgaattatttacagtgaaaatattttagagtctattcaggaacagggaaaggcgtctactttaagggtcttcgagtaattttctgatgtcatttaatagaatttgaatacagatttaacaggtgtgaggactgaaaactgtgtgcattcatgacactcttagctggccacagttggtttcattttggttattgtcaatattttggtgttttagatctattcagaagtcatcgttggttggaatgcaaataacgttttggttttcctacattatgaacaggttttatgtggagaagtgagtttgacaggttttcatcctatcctgtcttgtgtgttaactgttggttaatccctttgtgatactggttactgccatgtttttttcttggccctcttgtattttttttgtacctcaaaagtttgagtatgaacttgacattttctatcttgtgtagttttaatcagacttggtatagattgatggcagtagaaaacttgtgttttggatgctgggtaataggcaatatttgtgatttttagaataatttgtttcgtggcacagaaattgtattttattgctctgagctggtgttatgtattttaacaattctagctagttggctagccggtggttattttgcagtttttgatcattctcatcactgtcaccttcatctaccagtcaaccaaggaaaccacctatgacttagtggtaggccagtatgatagagaactatatttgccctttgagggtagaattgatattgctgatgtgattgggaaaatactgccattcgtctgaagaacacttattaaattcgtaggatatgaaagatgctgctgaagggattggagagaggagaggggagtgttaaaatgttgataagccgtgtatgggaatgaccataattccaattataaaggctgtacggaagcaggggtctggcttagggaatcagttagaaggattccttcttctccacttcttttggacaaggagaattaaaaaatcacctgtcaccttttcactattaccatgtacgtcagatatttttagttctgcaggtggaattgttaaggtgattgagaatgaggtcttttttttctttttggagcagcaatagagcagaatgaaaggtgagatggtcttaaggaatctgttaagggaagaaggtggcctaggctgtgtggaggttcaggggcagcaggagagatctatattttagatgtattatcagtatgtgttgggtgtctttggttttttgataaacttgtttttctaactagactgtccactctttgtgccttttctggttatatatatatccttttgtttggagacagggtctttctctgtcacccaggctggagtgcagtggcatgctcatggctcactacagcctcaacctccgtggctcaagcgattcttccacctgaacctcc

SEQ ID NO: 106979 - DNA, 1080 bp, Homo sapiens
agcactgcctcatcttctaggcttgcattatcattgacctatttttctatgttctgtctctcttgtcccattatccttgaagaataatcggaggccttgctgtgggcatggccaggttttaggtgccggtaactaagctggtatcacctttcactggcacaagattaatctgcaaatgagacaagagtgctccctaccacattctaaattggttgacagctggggagcggttttcacacctgctaatgaaaaatccactttggttacgtggatcaaattctattattaataccaagaattgggaggagtagagagagggccatatttaagactttataaaattatttaaaaaaaaaaaccagactcctggatatctactttgttacaaagggatttttattactttatatgttataactggaaattgacttatatagtcaatgatgacaaaacagatatctctaaaataaatggaaatgagtttaaaacttagtataggaataaaattataaatatacatcagatcctaagagtgtattaattataaaatccttaaagatgcagaaaccaccccccccccccaatgtatcaaatgacctgtcatggaatgtcattgcatgtcaggtaaattcaaatgaagcttcataaacgcaaatctctgattgtttggtcaggggtctccattagagcaaatgaaagattgcaaatgtttctctaacatcattccatctaaatccctgatggaatttttgtgatctgctgcttttctctcctgttttctgagtgtgttatatatagtttcaatccataccaaatgaaggaagcattgattagacttgatttaaggcagcaagtgataaatgcagctggaaattgattcatgtctctcaagtgactggggcacagccatccacagttgacacaactcttgtctcaaggctggagaaaacaaacaggcaaacacatgtcaaacagataaatgactttgctgttttgagctctccggggaggccatttgtttcttagataaggaagactgctttccaaagtcatgaaaagataagttagaggaaaaggatg

SEQ ID NO: 106980 - DNA, 1103 bp, Homo sapiens
aactgctttgttggaatgtgttcacaagacttctctcagcttccctggagagcttccaaatccttatgaccattgaaaatgcatttcttctcactagtacattatctgaagccagtttgaaaaagtattatctgtaactcccctcatttacttccactgaagtcaagccagttaagcaaatcctctcgtctaaaaatttaacgccatggaagttttcttccttccatcaatttttgttcttaggaatcttgacaggatctacttcagtgagacttgtcttgggtagaaaaacctgttattcccttcctcaaagaatgagcaaacatgatccttcccggacatcctcaaagccaggcagctcattaaacaaccctcatgagtattaaagacaacgtgagtgagctccttaatttcagagtccgtgtcggcagtgtttctcctaccctttctttgttcatggaggttgaagctttgttatatcacgttactctgtctttgtttaagatgggctgagaacactatactacactagctcagtaacccaaaacacctccagaggtgctgcctttcatttatttttttaaactagacaacctgccaggcaactttagggatctcctataaccatatgggtttcccaaaactcctagatgatgggagaaaaaaataagttggggcaagaatagggaagagacccagtgactgcctagtcgcagctcagtgggaaaaaccaagactttgcagttgacaagaggcagcctccaattcaacccagctccactgtagctggctcacgagggggggactccaaacgacacctttcccttcatcttagaaacggggctgggcgcgatggctcatgtctgtaatctcagcactttgggaggccgaggcagacagatcacttgaggtcaggagttcgagaccagcctggccaacatggtgaaaccctgtgtctactaaaaatacaaacaacttacctgggggtggtggcgggcccgtgtaatcccagctactcgaggctgaggcaggagaatcacttgaacctgggaggcggagattgcagtgagccgagattgtgccactgcactccagcctgggcg

SEQ ID NO: 106981 - DNA, 1010 bp, Homo sapiens
gattactattgtatcccttctcagtcttcccgatcaacctcttctgccttaaattattcttataggtccaaatttccaacctttgtccatcttggtctctttttgggcagactactttgtcagtgtccctcaacccctccctttattttttggtccagacccttttaaagtatcctccagtttaaataaaatgcttcaggtttgaccagagagaagcaattgcttttggtttttgtgaatattactttgtcagtcatctgcttatcactggaaaccttaactcactatattcttagtttatgactagctgaaattcttcatattcgtctttaagtataattcctcttctttgctagctagttcacaatctttgcatttgtccctgtttagtttcaccttgttagatttggcatatcccatccacctgttactaactttttggaactggaatctgtcacctaggttatttcctgatctttgtcacctttgtaacactgtttataaacttgactcttgaaatctaatgagcagtcattttttggagcaagcacaaggttaggcgctgtggaactaaagaagaattagatacggcttctggccttaaggaattagagtgagcattctctgttttcacctaagacagtgagtagaatgtaaaatgaggaaggctgaggtcagaactttgtactcttccactagataccttccttcaggttgaaatcagtctgacctctaaggtcaaatatgagtctagacaactgtataatcatacactcatactctgtattttgcccataaagagactacaggagattgttatatgttttgttaaaatccagacacaatctttgcacagggttcccaggtgcgggctagtccaagggatggcatcagtttgtgaatccatagtaacttctggggatcacctacttcgtctcttatctgcctatatgcagttcacatattttgagttcatggtctatggtttcatcactttcctccttcttttc

SEQ ID NO: 106982 - DNA, 1110 bp, Homo sapiens
aatattcatgtaactaccactgatttcttttttttcttttcttttcttttcttttctttttttaaagagacagggtttctgtcacccaggctggagtgcagtgatatgatcataggtcactgcagcctcaaactcctgagctcaagtgatcctgccatctcatcctcccgagtagttaggactacaggcatgcccagctaattttttattttttgtagagatagagtcttgctttgttaccccaggctggttgaacaactgggctcaaatgatcctcccatttcaacctctcaaaagtgctcaaagtggatcgattataggtgtgagccaccatgcctggcctccaatcttaagaaatagaatatcaccaatttcctagagattccctatgggaccattcccaattgtattaacttctggtaaccacaactctaaattttatgtcaatcattactttacttttccatatagttttaccatttgtgcatatatctcaagtttagtttttagctttgctttcttttggactttatgtaatggaatcatgctatatgtatggttcttctattacttgtttcttttgattttaaaaagatttatccatgatgatgcatagagttgtagatggttcttttctgtcctgcagtgtactatcccattgtctgaatatagtgctgtttgtctgtctgttattctgtggaaccactaataaatggtttccagtttgggctattcagaaaatgctgctgcagatatcactatacgtgtttcatggtgtacttgtgcaactttttggttaagccctatacctaggaatggaatttctgggattagggacaatgatatgttagcctttaatgggcagtgtcaaactgttttccaaagtggccataccagtttatttcaacttatactttaaccagcaatgtataataattttcctgattccaccttcatgccaacacttacatggttcagattttacgatttgacaatctgaaggggtatgaaatagtttctgttgtaattttaatttgcattttcctaattactagtgaagctgagcatcttttcatgtgtttatgagccattggtgtttcctctactatg

SEQ ID NO: 106983 - DNA, 1201 bp, Homo sapiens
cccaaagatgttctttgtggatgtcacttttgacaccttaagaacccaaagacacattcttttggcaaagaataaaacaccttctcgcatatggtattaagtacctttgtgccattccaaataagcttgccagccaatttagattttatttctatccttagattatcctaatgcttcagaaaaataagggtttagttcttactagaagaaattgacttcactttcaacttgatatttaaaattacagttgtcagcatttgtcctgtctgcttgtttaagggacataacagttaaaaggacttcacttaatgctgtataagttagtgatctgaataaaactattggcaaaggatctccactctgtattaaatactggattaatcatacaggtcaagctttcacaattctagttgtgaagcttgtgttctgaatgtggcagcactacatatccttatgtttcagaagctttattgtgatccatggtttcagatgcatatttcaaatccagaaattttgcctggtaagtaaggcttatcataccttttttaaaaaattaaatattttttaaatagtagaggcagggtcttgctgtgttgctcaggctggtctcgaactcctggcctcaagcagtcctcctgccttggcctcccaaaagtgctaggattataggcatgagccacctcgcctggccttgtacctttttatcagaaagatccaaccttgctccaggtttgtgtgaaaacagttttgctttgtttttaaaccagagccacatagatctttccatcttctgtataggtcagtgttacttgtttctgttaatcatactatttcaaagtcccctgccattttaaggtgggctctcctcttgaggcttgggcatgagagttaagccagatactgacttcgttttctatcttttggggtcttgttatcctaggtggaaatggtggttgtttaattgtgactgctttagacttgagtatctgttcatcagtccattcattcaacaaatagtttatgagttcctactgtgtgcagggttctctgccaggggcctgccaatggtaaacaaaacttgacttggcttctgcccttctagaatttgtggtctgatgaggagagaagtattaatcaaatacttgcatacacaaaaagtaaaattaaaaccttggaaagtggtgcaaaagaaaagattcat

SEQ ID NO: 106984 - DNA, 1129 bp, Homo sapiens
ttttcaaccagtagttattgagctctattatgtgccaggtggtgagataggtgctgggaatactgtggtgaacaagagagacacgtcgttgtgaagttggtcttctagtgggaaatgcagatgtaatgtattatacccaatagcggctacagtgggcaagtatgggagctgtggaagcatctaagaggacacagggctgtaggaaaaggcttccagaggaagagtttaagctgagagctgaaaggtttgtaagaattggtcagatgcaggtggggaagtggggatgaagagtatttcagacagtagacaaaagaatatggcccatttgaacagcctgaaaacccaggatgcataggttatagtacagaagggataggaaagaagtgaggctagaggttcatgtagaggcttggccacctaaagatgcttggcctttgtcctgggagaatatggagcatctgaagagttttaagcgatgaactgcctgtgtgagtgagggtatgagactgacattctgggaagatccatcaggtgattgtggggaatgaattgtggtggggcagagctcagagctccagacttaaaggccagttaagaagcagggtaatccaggaaaaatagcctgagccaggtgagtgagaatggggaaggagactagtcatcagatttgagaggcaggtgagacagacttagtaattgattggatgctgctgggagagagagaaggggaggagccaagatgagatgtgggttttgacttgggcatctaactgggctgttaaaggtggcatatgccaagattaaatagtaatgaagaaggtgtagtttgggagagaaggtgaggagttcagttttggaaatgttgatttaatgcctctaaggaatatcagtaaagagggagccaggaacatttggagcacagctgggacagatgtataaagaagagtttagacaagaagggaaatgaattaagtcacaaaacataaaaaatgttctctggttacatggtactgtgttacctataagtataataataatcggagtggatgcatttcaagctgggaaaataacatcatgcagatgagtagacaaggagaacatgtatgcaacatggtgaacaaattttctt

SEQ ID NO: 106985 - DNA, 1020 bp, Homo sapiens
ccagcctgggcaacattgagcactgagtgagcgagactccgtctgcaatcccggcacctcgggaggctgaggctggcagatcactcgcggtcaggagctggagaccagcccggccagcacggcgaaaccccgtctgcaccaaaaaatatgaaaaccagtcaggcgtggcggcgcacgcctgcaatcccaggcacttggcaggctgaggcaggagaatcaggcagggaggttgcagtgagtcgagatggcggcagtacagtccagcctccgctcggcatcagagggagaccgtgcaaagggagaggggagagggagggggagggggagagggagagccccaatgcatttttaaaccagtggaagcaatactgcacataccattctgtagcctgttttatactcatgataataccttataaaccatttccctttataacataatatccattacagagttttttttaagtaactaatttattcctcattataaaaagagtacatatatgctcactgagaaaatttcacattaaaactgtatggttttaatacatagcacattttgaaatgacaagggatcaagaacggtgttcttttgtttttgctacatggaaaaattttattgtttttaaatgaaactaaaatctaaaatcctgactcttatcagtacaaatgtgaacctgtaattaagatgttaaatcacacttttcctctctagtatagtttttttaagtaggtagttctggggaaaaagaaaaaaagtgtttttgaaattctaaaccctctttgcattaaactgattaatggttaattaactctaatagtgcaattaactttttttgctgaaatcttctgaccttttggacactaatgtgggaagtttgtagagggaaacagctatatcacaagatagttatctgtcatttcataagtcatgaaccttaatttcctcagttgtaagtaaacctaagtcatttcagcactgaagttctaaaattttagaaagcttaagaccttatgatt

SEQ ID NO: 106986 - DNA, 1034 bp, Homo sapiens
gccattatatgggatttattttttatttctcttcatgggggagcaattatattgcagaatgaaatatgaaaaaacttgaggctatacctgttgtacagaaaatgcttagggattgctcaagataatgcctaataacatacagcaggtggtgtcagcatttgtgttggaaatctagatttcgccagatggaaaattgaatgtttaacccctgaggtcataatggcatgtcatcacttcatttgatcctcctgctaattgagcttatcaaataccctgctgccatttcctgttgttactttcattttcataataaaattaaatggggatagtctatttgtgtgggttttggtttttcttttttttaggaatgatgattttgtaaacatgtaatgaatattgaggtatgtaccaggatctcatttctgtgagtgcctgtttctctctttgtgatattctttattagctagagagaagtttatttttcattaaagaagaaagatataggctgccaagtagatgtagggattatcagaccttccctgaaaaaactttttctcttggttttatgttgtgggaaatgaagtgaaattcttaggttctttgtaattgttgtgctaatagtacttttaaaaaatgggataatgtattggggagtgaggtaggagagagaaaccagcaggaactcttcaaattactttgcaaaagttgttttttcaactttaccaatttgaacataactttcttttccctaaacaggcgtgttgctttcagtttgtatgttaaattttaactgtagcccagctatttttttctctcttttgaaataaaacatttgtttatctaatttttataaaaatttctagttttattcttaattttacaagcacaacatgattgagctttctagtattttctttactgtgaacttcttaggtctaaataattctactgcagtgtagatccatgattttcgtaaggaattttttcctcacttttaccttctggtttatttcttctacatatagtttatcagt

SEQ ID NO: 106987 - DNA, 1044 bp, Homo sapiens
ttaattgggctcaataaacaaattttcagaaattactgctttactaacctcttccatagataaaataacacaatcaatgagaaaggaaagaagagctatggtaccaagcacagggcttgtgactgatcaattttttaaaagaataatggatgtttaaaacattgaggtttggcaagtgtattgtatgagctccaagtttggaggagactttaaaggtgaatttctttttaatatttacattttatttattccagagtcagtttagcaaatgacttttaaaaaaattgaattgtagaggagatattgcaaactcgaaaactaaaagatgaaatcactgccattttccagtgttgacatttatctatatttaacttctgtaagttcccagttctggacattttaaagaattgttaggccttttaatttttactctttaaatacattgtatgaaactattttgagatttattcaacaagtatttgttgagaacctgccatgtgaggctgctgagctggatcctgaagatataatagttctaatgggggcacagggcacagaattacacaactaccagggtttttgaaaaattgcatttgtaataagtagctcaaaagagaaatatggagagtgaaaatataagccagggaaactgacctacatttaagtcactgaagacatgtaacttcctactgtgggagcctctgccttatttgacctctaattctcagctcctactagtttcctaacaccctcaagtacttgttaattgcttgatgagttcatttattcattgatttgttcaacacatattttgaatgtatgcctactcaggagccagtccatacaaagcaccctgtaaatataaagagcactagaaaaataatttagatgtgtgggctgtatttggggacgtgttcactagccggggagcgtgttcactacctagggagctaagatgtccatcagtaacataaaatatatagtcagccgtggtaagtgccttacaagaaatgtggattaagtagttcaaaaaagagagagacg

SEQ ID NO: 106988 - DNA, 1045 bp, Homo sapiens
ttttaaagtagacagtaattgtaaaaatgaatcatggttagatgaaagatgcctttttattcatccagttggtttagactagctgtattttattttgaaggattgttgattataggatgaaagagctatcattgagaaatctatcttctttaacttaacagtgggaaacaaactgctttgttttttcatgtgttatttcttcttgccttccatctaagatattttttgaattgctaaaagtaccttggaaaatcaatctactataaatgactgtgtgagcctcagttacacgtcacaattcatttcttttttaagtcatgctagattatctgggcattattcatggacttaaaccagtgagaatgcagtttgcgattatcctgttatatcatggcttccagatggagaattggcaaaacctccacatgcctgtttgcacacacactcacacactctcactctcactcacatatacagactattgcttgttactttttattctgggaagtaatctagttcttttgactttcattggaaaagtaatcagtactatgattgcataaccaaaaataaattcgattgccttgacttacacaggaatcaattacccagttttagtaggtcagaattgaaattgagacttaatttttattcattatcactctgacaagaaatagttttatcagctgtgttatgatagtaacataaaacttgaagtaacacactggaggcctctgctaaaaatgaacctgaaccctctatgtaccatgtacagtgtgttctgtgactaatttgggttgtggctagttagtgctaaaactgagggctgggttgtctagaatttgtgccagaagctgtagagatgacatgttctggatgagaatcgtcacctgtctttgtacaggtggatggcacggggatgccattattgccgctgaagaggctcatttgtttgaacaccccataatttaaataaaggtagctctggtttggcatttagtgttttccaagaatgaattcatgcctacttataattcaaaatgca

SEQ ID NO: 106989 - DNA, 1141 bp, Homo sapiens
cacacctggctaatttttgtatttttagtagagacggggttttgccatgttggccagggaggtctcgaactcctgacctcaggtgatccacccgcctggagtcccaaagtgctttacaggcatgagccaccactcccggtgagttctacatttttgatctgtgccatcttgaatagccttagctgacaaaaacatgaaatgtaaattatattaaaatgtcctttatgtgcatctgtattttgttaatgccatgtgttttagattcttatttgtaatctttaggactttatttaaaagctttcttgtgacatttgtgatgtattgatagtgtgagaaattacaaaaactaagattctgttttattgtaaagtatacaaaaagaatcttatttcatggttttatgtttctcttctacttggcttcacaatgatccgaacttgcagcttttaaatgagaaaagcttcctatttcattgtgtacttttgtttgtgtaacattttgtggaaatgactgcttattaaaatgacacttcacagacttggactaacgttcatgatatcatggtgtcttttggaagaagggtgttgtgttacccactctatcgccatttcaagctggtgatgaaggcctacagggacactataaagatattgcaactgggtaagatattactgtacttgcaaatttgggagggaaaaagttgtaagtttttagtctgtgaagatataataatgatttttgcttttttactgtatataaataagtaatgaaaaatgaatccaaccacttttaaagtatagaattcctgtgtataagacatatgtagataagtaattgcatagaggcataataaagactcttttccgagaggagtaaggaaggtaaacagagaaggcacacatagtattgcaaaccgttttacattataatagctgcatcattcagtatttcttggctgcctataatcttctaggctctatggtgggactgtgggtctaataataaagaaggcagaaaagttccctgctctgttgaagtttacagttttgtcagacagatgatgggtaagttagcaattccaaagagagtgaaaagtactctgctgggagaagtccagggatcgtttaggaggggacatgta

SEQ ID NO: 106990 - DNA, 1006 bp, Homo sapiens
tgaaaatactttttgttttcactcgtcttttaaagatactgtaattggagaaaatgttttctttgaccaaaaaatgcttcatattaaatcttgaaaagatgagtgtttaggtatatttgaaaaaatttaccattttttattcttgtatttgtgtatttgaaatcatgaagtcttacaacttgagaccttctctagcatttacttattctcaccagcattctctgaaagatcaaattttctagcagcttcttaagtgccacaggtaatacttcaacattatctttgattcctttgatagattatttatggattgtttgggaggcatgtaacttagtggaaaaaggacagaaattgagcagggattactttgctttaacttttagtttcaaaacccctggttgtttgctcttgtgttctggtactcttatcagtagaaaagttttattttcgaaaatcccaaggagagtaaacagaaacttcccactggtagtctctgtatcagcaaaataattatttttctatagtcgtgaacacttcttagttctcatatgtcagtgatcctcagacactggttgaataaatggatttgtttggtctatttaaatgacttcacctctaatgtgatggtattcttttctccaaaacaaataaaggttgaatctgcatggaatatcaggaaactgagtccaacactatgctggtttgaggtatgatttccagttgcaattgtttagaatttgttgttcaggaagttatttttgttgtttttacatcatttggggtaattcaagcaattccttgaatttttaaaagtagaagctctattgtacaagtatgttttccatctttttaataaaattctgataatgaaccaggtagagtactttggaagctgggggagggaaacacactttggagagaggatggagacatggtttgttgggaaagaatgtgggggcagagtgagaggtgtgtttgtaagttggcatgtattggagcttgaaac

SEQ ID NO: 106991 - DNA, 1020 bp, Homo sapiens
acaaagtcagtagagatatggtagctttggaaagatgattagggtttatatctataatatacaggattcttaatttgacaagacaagccatccaatagaaaaaaactggacaaaacacattcgaatgggtcactcataagagtgcaaatccagattgcctacaaaccaaggaactagtgcttaaagttgagcaattggagaaatactaagtgaaataacaatgataagtcactgttttagttttctcttgctgcataacaaattatcacaagcttcacacagtgtacattcatgatctcagtttccatgagtcagaagttgggccaggcttagctgggtccactgtgtaaggtcttgcaaggctgtagccaaagatatccatcttatttttttaaaaaacagatgttggaggctgtgttctttcctggagctcaaggtcttcttccaatctcacatgattgttggcagaatttagttccttgcagatatagaactgaggcccctactttgttgctggctgttagctgggggccactcttagatcttagaggcctctacaggtccctgccacatagccttctcacaggctctctcacttcaccatgtgacatcttatttcttcaaaactagcaggcgagtccctggctttggtctgctaataatggaatataatcatggaaatgactgtcccattgccttggtcgtattctgttggacagaagcaggtcacaagctccatccccacataatgatatgactcattggaagtcatcttagaattctgcctactatactcaatttattaacctggaaatgattgtaaaaaagctattacatttcttgccagggggaggtgggaggtatgtgtaggaagaggaacttctattcatgactgtgagaaaggagagttattgtagcctttaagtaaagtgtctttctaaaacagatacttttttaacccagtcaatacagtctcgagagtctactttatggaaataaagcctctaataatcaaggaca

SEQ ID NO: 106992 - DNA, 1047 bp, Homo sapiens
tagtgatttcctggtttgttgttattgttatttatcatctctgatttctttgcttgaatttcagaatttaaatgcatttgtgtgttattaatgaagtaggccacagtggaacttataaatgctcagtaaaaggtggaagtgttttagggaaagtctagcagctcctagtatccaagaattcagaagaataattcaagtaggtttttcttctgtgcacagttattgaaaatgactaatgtagaaatacttacatgtggataatgtaacgtcagaacctacattgcctaggtcaacttttataaatggataaacgtcgataggtatgattacttaaaaatgaaggcataaatatgtagagagttgacatgttgctaaatagtttctgggcatgcttactttgtgattgagaattatgtgggagcaggggtctattagtcaactaggatataaagacttttctctagtcagagatcatgaacacctggcattttcccattagctaaattaatgaacatctcaaaaaccatacctaagggaatactgtctctaaccttcttgctaaatacaaggagtcataaaatattttgtcaggtatgctttcttcctgcagtgagtatatgccttcatgccatttccttaaatcaaattgcttaaaatgaactgagagcttttatttaaattaaggaacttcagatgcgtcctccaatgaggcagtcaacactcagtttatctgtcttattaattaaatccagtaaattttaaattaaatacagttgacccttgaacaaaacatgtttgaaatgcataggtctgcttatatggggattttcttttgcctctgccacccctgagatagcaaaaccaacccttcctcttcctcttattcctcagcctactcaatatgaagaccaggatgaggacctttgtttatgatgctgtacctccacttaatggataataaatttaatcttaaagagacttcatgtacaattcaaggattggggaaaccttaactaaagctataaatccagaatcttgtcttaaaaa

SEQ ID NO: 106993 - DNA, 1116 bp, Homo sapiens
ttgcataaagaacttatctaattaacagataggtacatgatgacttgagagattgtgatacctcccactggccaggatagcagcatttcttccaaggattgtcgcttgacctctcttggacatgtggctctgctaggatgcgtggagaatgagggttttatgttgatgtagaccttaattattaattctgggtcaagattttccaaactgttacatatatagctataatcatcatatctccttatattggtatagtacctgcagcttataaagtgcactcatgtgattattcagttttcacaacagatgaggagaggagtttaagggacttgctcaaggtcacactactactaagtggcttggccaagacttgaaaagagtctctccatttgtcattttgtatatccttttcatgtacactatttcagtttaactgctgtagctctcgtgattaacattctatctcctgtgacacagtaggatactaattggaatggcagggatatatcttgtgatgtgcaaatggaatgagtgatgtgtaatgataaatggttgaactgttcaacatcctaagggaaactgggtaagagcagggtatgttacattttggaggacatctgagagattcaactccatttacactgctatttctaattacctttatctctccaattgtggttttaaaggtccactgaagagcaatttgaagaaacccatttaaaatcatgctgaatatttaaagtggaaatttcattgtcagcaaatttctcaggctagcataaaaacagaatgaactttacaagactgaaatttcaagtgggagggagcttaattagaagaactgcctatctcctctcttctaaaactagaagaataactatggcctgagagaattaggaaattggaatttatagttagcagtgtgatattataagcagcccttatttttctccatcttctgtgtgtctttatccagaagctcattttctttaatactatgcatgaaatattctttccacttctcaaagaactgttcttacaagaatggtttaaatttagttatgggctaagtgaggagagtgggagtcatgaggtaaagattctttgtgacttttc

SEQ ID NO: 106994 - DNA, 1040 bp, Homo sapiens
cttatacatatagccagaagatagttttatgtaattttttaatacttttgtgtatgcagccaagttttgactgctttttgactgtgactcatcacatgaggtcaagtgtggagttttccactttgtggtgtcatgttggtgctcaaaaagtttcagattttggagcatttcagattttcagattagggatactcaacttgtgttataacaatagtgataactactatttattatggcttttctttttcagtatctattttgttggtgactaggggtattcaaatagaaagatgagtcatctctaatttctactttcttggttggggaaagaatctaacttagtttattaaaatgtgaaagaaatactgaggaacttcttaaaaaatgattgatatattttgatggttaaatgtttgcaagtattgatggccacttatgttacgttataatttaaggacttcatgagacctgtgttaaatctgcagattaacccttcctggaagaattgtagaaaatggaagtgagcaagggtcctatgatgcagataaaggtattgtctttggaatttttgttagtttatttcttgggatttttcacattatttacataataatcttacaagataccatggggaccttttgatgtctttcaaatacaatctgttcctatcactctttcttgtttcttagtgtccagtgcctgttattgatgttccccacccctcacaagtcttttaaagtatttcacaatgttcttcaaagtaaagttaactgctccggttctatttcctagagtacttcccctacatttagtagacatttaaaagtaaaaattagaacatgtgaaatgattgatcataaaaaatgtagatgacttatgagcttatgaatggaatctttctggtataattttcaaacttgaactttaataacaggtaggtgagagagaaactatgcatgggtggcatttaaaggctaattgaattttctcctcatgattgataagcccttcatttcagctagccatgaacccatttattt

SEQ ID NO: 106995 - DNA, 1059 bp, Homo sapiens
ggttttgtaactttcccaaggtcttacagctgagaagttgtggccaggaagggattcaaacgcacgtctgtttacctgtcaagccagtgctgttaaaatcatctctaagaacctcgaaaaaggctcggttgctagtcatcccgccggttcaacgccggctcccaggcaccactcgccacgccctttctccgcccgggggttttgaaagttccgcctcttctcgaacggcgtcccgtctccatggagattggcgtggggagagacttcctgccttacgcgcgagcacttccgcctcgagccggaagctccgtccctcacaccgagagttcctgcgcgtggggagttggagagtttgcgtggcgggaacgcggcggcagtgagagcgagcggcgccggcccttgcgtccggtgcggcgatgctgaccccggcgttcgacctcagccaggatccggacttcctgactatcgccatccgcgtgccctacgcccgggtctccgagttcgacgtctacttcgaggggtctgacttcaagttctacgccaagccatactttctcaggcgagttcggggtgcctggccgcaggaaaggcgcattcgttagatagctgctttagagggagaatgcaaggtcgagagagcagtgctcgattgcgcgaatgccttttcccgacgtttccgcagcttctcttggtgccagggaactgccctcttccaggggtgcgttttagatgctgcggaagcccttttccttcttgagctttcttaaatcccatatcaaaggattgcggaatcacttgaaaaagtgacgtttggaccgtgtcactttcccgtttctgccctgtcgccctagttctcgtcccgttctgacttgttctgttctttcctttcactccgcgtttgctctcccagtctctcccttcctgggaacggcgcgcgctgacatctccgtgacttcccaacccgtcggtccttttaactttgcccaggccgccttctgttgatctatctcttgtctgtccgctccctacttaccgaaattcttaccttttttggacctc

SEQ ID NO: 106996 - DNA, 1050 bp, Homo sapiens
ctactgtatgtttgataccctgctaatcattttacatgtatgtttaaagtttaatcatcaaaataagatagaggttgtattattcccatttacagatgagaaaacagaagtacaggaagttaagtgactagacatggatttcagtggttttgagtgagagagttgagatttggacccaggctgcctcgtgcctgtgtttgctttcttatttaagatgcaacactctcttctttttttggatgaaacctacatcatcactgtgtgccccttcaattcttgatctcagaattttgacaaatggggcaaaatttgatctatgagtaaaaaatcacactcctgtactttgaaattacatgctgtgtacagttagtggaaacagtttaatcgtgccacatgtgcatgagagctggcactaaccgtggacatatatgtctttctctttttaccaccagagtgtctctatgtattcccctgccagtggaactaccgtcccgatcactgcatgtacggaagcaactgcagagaggctgagcatgaaggtgtgtctgttctgcatggaaaccgaggcgtctaccatgacgataagcaaccaacgttcagagcactctatgaagcaatacgggatgtaagtgtgcccttgctgctgttagcagatgtgcttatcagcatgaagcaatattggcgctttagtcacctgtccctttgaaggccaaatattcccaaagcatagagttataccagttattcccgacctcagtcacgctctgtcactatatcctcttgccaccttgtactatgtcatatctacttgacttatttccacgtacaccattcattatcttttacttaaccaaatttactttaggaggaaatttctgttttttgtttttgttttctgagatggagtcttgctctgttacccaggctggagtgcagtggtgggatcttggcttactgcaacctccacctcctgggttcaagtgattttcctgcctcagcctcccaagtagctgggactacagacacgcgccgccatgcctggcaaatttt

SEQ ID NO: 106997 - DNA, 1095 bp, Homo sapiens
gggaaaaaggaagtttgtcctgtcctggatcagtttctttgtcatgtagccaagactggagaaacaatgtgagttgaaaacatgcatttgtcgttatagaccagtgcattattaagaattgctcaggaaagggaaaaaagtatattttgggataattaaataattcattctaaattgtagaagtcctggtcatttaaataatttatatatttacatttaaagaacgtatacgcttacttactttatacatggtctgtaacggattttaaaaacctgtgtatgttaaaattttctttatagctaggctttggcacgcttagagaatgtattagtcttaacgagccagagaaaggaagaatgcctattccattatgaccctttttggccataacaaataggcttattcctagaattttgtggctttgattctgtttcagagtcttggtggtattttctcatattgtcgtgtgtccagcctttttttggtcatatttgcatatgtaggtgtttaaagtgtcacttctatttatcgtctggaggactctgttattatctgacaaattccagatgctacagttttgacttgtagactttctaagatagctgacttgttacatatgctcagcattttattcagctcgtttccaaatgttctgaatctgaaacttacgctataaagttagggctgtgttcagaaggaacattccaggtcattgttttgcagtttgtgtggtagacacaatctggctaagtttatttgtagacaacagtgcatctttgatgacttctttttgtagtctttgggtgggggctggggcagcaggaaaggggtaggtttctatggtttcaatgttaataagtgggttatctgcccagtatgagtgtagctttcagcaagaattgtataatttctctggctttattattagcaagtgttcatttctcacaagatttgcttatttgtagtctagccttttaacaactagcctaattttagaaagaaaaaaacctttgctgcctcagtgcttgatttaatggtcatgcctgcaagctgagtctccttagtattctattaaaatacaccagtcattttga

SEQ ID NO: 106998 - DNA, 1019 bp, Homo sapiens
ctttgatatgcagcataatttttttaatacctgtttctcattttgttacacagaatatgtaaaagatgtattcaagggttgggatttaatgaaattagtaatttttatatcttttacactttaagtggaacagatttttaaaattacgagtttgtgaaaattctggcttctgctacagctagtaatacagtttggtgctgctgtcctgactcttgctacatggattatcagttttatccaccttgcttttataccatcagtgcacacattaacagtgaactagtcagcccttattcttttgacaatagctttgacctcttggaccacaatttgaaaactgctaccctagtttatagggttgctgcatgggatggaaggtgattacagatgggctcccgttaatttgtgtaaatttgtttaagtagtcaacctgtgtaaagagattgatctgctgtcactaatggtagtactgtctgcctgaggaaatggttagcattcctgactcccgtgtctcctggaatttacactattcaggcaggtatcctcacaaaatttccttttatattactggtgaaatgtgaggaaagagggataaaaaggtgtttatgttaatttgataaatgaatagatgtgaaaagtacctaagcaaattatgtatttttattgtgcaagtactggttggatagaacctgtgattatgtgccttaatcataggtacatgccttttgtctcttaagtgacaaaagagcctgaagatattaactgaaaggggaaaaaaaaggagaaagtaaagtttattttgttatttagtagataatagacaaattttactagtccatgcaaacattgtaacttggatgattaaggtatggattcattctgacttaataggatagtgtaactaatgcccacctggttaggtttgttatgagtgaaagagtcaaaatattattttaaacatactaagaataggacctaacacaccatagactttcaggcagaggtagttcatttaaaag

SEQ ID NO: 106999 - DNA, 1003 bp, Homo sapiens
atcacatcagggtaaatgggttatccatcacctcaagcgtttctttatgctttgtgttacaaacagtacacttatactcttagttattttaaaatgtacgataaattattgtagtcaacctgttgtgctatcaaatactagatcttattcattctaactatatttttgtacccgttaaccattcccccctccctccccccccacctttattgctttttaaaggaagggagaatggtttttttgttaaatagaaaggtatgcttattttattgtctttttttaaatgactcatccatttatttccctattatagcattttcttttgtagcttaatacatgggtgactagatacagctttacctagcaaaagaaataatgttcctcgttttcttgattatcagtgatctcacactgtaaaattatatttttttgcagtatcccttttactattcagcgactatgtgaattgttaacagatccaaggagaaactatacaggaacagacaaatttctcagaggagtagaaaaggtatttattttattattggaattatattatgctgtggtgtaatagcttttattttagaaaagaacattgagtaagatctgtttcgggtaccacttcttgaaatatgtttttcagcctaccttgagtttcccaaattgttttccaaattgcattctgttttacagagagatttaataggaccgggtagaggagggtttgtgtgttggtcattgaagtttggtgaaagcagcttattatttcttggaaattcatagtgtatatcaacttattaaaggttctgtgaagttataattgctattttaactttatagagtgttttataaacttacacatggaattcattttctcaattctggagttcaaaggtacataactttggaaacttactggtgccaagcatgtaaatgaggtattgagtagaaagatgcaggtcagatttagagataaacattagtgtttgtgtgtggagggggt

SEQ ID NO: 107000 - DNA, 1021 bp, Homo sapiens
aaattagaatcaatgggaatttaacccaccagagtgattttagaaacaaaaatgatgaaactttatgttgtagtacttttcttcatactaaatcactgatttttgttattgcagaatgtgatggttgttagctgtgtttatccttcttcagagtaagtatattttttctatttctagtatattatttactatatttaatcattttattgcttctaatatattattcttaaaatagactgaatttatttaatatgtaattaagtgtgataacatacttgtgaacctaccattcagtccccaaagtagaatattactaataacattatctatatgttttttccattaaagagatttggattaaagagattggtgatttactgtaattttaatattgttggatttacatactgtggtggcactcattgccctgagatgccattctagatgcctttccagggtgtctctagggcataattcccatgtttggaataactacttgatggcttttctctttatgatggaaaatatttccagttgtcaagatttagatatagcaaagtaagaattaaatttggatacaatttctcaaccttggaactatggacattttgtaccagataattctgttgtgagtgggtgtcctggggattataagaggtttagcactgtccttgacctctacccacttatgccagtagtgttcccctctccaaatatctttagacattgccaaatgtctcttggagatgtgaaaggcagggaggggaggttgtcccctgctgagaaccattggtttaaggttaatctggctctgctttcatagactactctgttacccaggctggagtgcggtgatgagtgatcatagctcactgcagccttaaactctagtgatcctcccgccttggccttccaaagtgctgagattacagatgtgaaccaccacacccagcccagtcaatttgtttttagaatgttcccaagaatatagttatgttgctaaataagatactaaaataat

SEQ ID NO: 107001 - DNA, 2159 bp, Homo sapiens
gggccgatcacttgaggtcatgagtttgaggctagcctggccaacatggcaaaaccccgtctctactaaaaataaaaaaaatagctgcgcatggcatcacacgtctgtcatcccagctacttgggaggctgaggcataagaattgcttgaacctgggaagtggaggttgcagtgagctgagattgcaccactgcactccattccaccttgggtgacagagccagactccatctaaaaaaaaattaagtcatccacaagtgtattttcttttcttataggaaaaacaattccaatagtttaaatcgaatgaatggtgttatgtttcctggaaattcaccaagctatactgagaggtgagattctagatttttaatacctacagagtttgcattgtcctgattttgagtagcaggcttagtgtactttttaaaaattgggcattttatggacaccataggatgaactacatagaattagttaatttggtaaggcatgggcctgaaaacaaagttgcagcaaatacttctgtgatgtattcacatcaacataccttaagagggatgactttttataaaaataggaaatgatgttcatttatcttattataggtctaatataaatgggcctgggacacccaggccacttaatcgaccaaaggtttctttgtcagcccccatgacaacaaatgggttgcctgagagcacagacagcaaagaggcaaatttgcagcaaaatgaggagaaaaatcacaggtttgtatgttttatatttaaaaacagtgtttttattaaaagttaaagttaacatttaatcagtacttatcacttactatttataagttctgagggacagaacaaggttttcatgcggtttataggagcactggcttctctttgcagctgtagcaaatgttgaaggtggacatagacaagacttaaaactgctaatttgtggagactgtttatgtagggtctaaaagtaacgtagatatgatgatccatttcatttgttgtttctgaaagttacttgaaaagaaatgatctttataaataagttgatttttgtgagtcgtttctcattgtagttcataaaaggacaccttttgtttatatcttcaaattttctgtatcacattaagggaaggaagactaaatgagggagaggacttaagagagtatgtccgtatggaagacttgcgggtttattgtaggagaatatttaacttactggagaattgcacagaaaggtcatatagcttttctgagtcctactgggaattattcatcaaacagtttagtttaccttgaaattattctcttgtgtttttctttgttcaggtgttataatttaactttgacactgaaatacaatttaaaacattatttaaccttaaaaatggggatgtagaagatggggaaaataatcttattaatgacactttaaaaaaacatttacagtgactcttcgacctctgaatcagaagtttcctcagtgagccctttgaaaaataaacatccagatgaagatgctgtggaagctgaggggcatgaggtaaaaagactcaggtttgacaaagaaggtgaagtcagagaaacagccagtcaaacgacttccagcgaaatttcttcagttatggtaggagaaacagaagcatcatcttcatctcaggataaagacaaagatagccgttgtacccggcagcactgtacagaagaggatgaagaagaggatgaagaggaagaagaaggtatttagagaccatctgtaaaagggtggagtaaggagatcctcaaattcttgtacttcatttttttcgtgaaagaattttacgtaatggaactccttataatgctgatgttgggcttttctcccacctgtatgtagttgctgctgaatttcaggggatgtgatttgaactatagaatatcagaattcatgaaacttaactgtggaggtattttgaaaatacaatttaactacaacaacatttgcttatttttagagtcttttatgacatcaagagaaatgatcccagaaagaaaaaatcaagaaaaagaatctgatgatgccttaactgtgaatgaagagacttctgaggaaaataatcaaatggaggaatctgatgtgtctcaagctgagaaagatttgctacattctga

SEQ ID NO: 107002 - DNA, 1942 bp, Homo sapiens
tcatccatggaaaatgatgacgaagccacagaagtcaccgatgaaccaatggaacaagactaactatttagaaacatttagatgcagtattttacatacagttctggttttaacactgtataaaacttttgtgtaataaaatggacctttagttttacaagagaagcaggttgtaaaataaagtactttatggataattcctgaaagagttgtacatgtaagaactgtgaatatcagctcctctgggtcctgcttaccttaccgctgacttttctttctttctttttttggtctgggcaaatcagtggtttgtgtatagatttttttttttttttaatttaggattgaagtttttaaactggaaagtaattacaattttgaaaagttttttgagattatcacatttagtttatacatatgcaagaagctttttgtcttgtctctttctgatagctctagcagttttcatattttggtcatagtttcaacattttaacatgtgaattatagggtttcatgctggtttccagattttattgtttggctacgtacaatggaactttaagtcatatatacatacatatatatatatatatatatataattctaaggggggaaatgttatatttttctgtttctataagagatgaatacagtggatactttttctattggtaatgattgagttcacctctttcagaagacattttctttctcttctgagtaattgaaataaaatctggcccttgtgaaaccctggaaatcttaagtctgttgaaataccaggttaaacacattccaagagatctgttcaaactcaaattcttttgtatacttctgaggtgcctgagaaaaagacttcattatttatgagaaaatatgctttatcttggaaattgtgttcaaatgttagcttactattttgtagaatgaatgtttatgaagctgatatgagaccatctcagaagaaccaagtaggttccttgaccttttgcttgcttttctgaacattgtgaatattacacatgtctttctaaattattctagggtatgcaaatgtcaatggtatgaaacaccactgtactggaagaattaatatattactttagtatgtacctgagctaaatgactgaagctttaggggtgcatagaaaccaccataatttgtatgacattttgaagtgaattaaatatttttgaacatgcttcttcgacagccagtgttatatttttcagatcaacacaaagcacaatgattactcgaaattcagtattttcaaatttacatatttaaagtcatgcaagctgtaacttccctgtcaaaattactggctgccaaatttatacctgtttcttcagctgtaccttttgatatttaaagtttttaaatttctgtaaagtagattttgtagaatgtaatgtgttcactgcctttgtgaagcggtatataattgtataatttctgtgtgtaaactgaatgcttgggctttcaatacagtattcatataaagcaataaatattaatgttatgaaatatttgactacatttttatcaaaatatgaaagaatccccccttttttagtttcagatacctgaactacacagatgagcttctaaaactgatgcaaacagtttctgacactgtataatatgcttttgggtgatttggggggcaaccacaagttttgcgttttgactacttaaatcatcatggctataaataccaaaacgatttggatccatttatgtttgtaggataatatactactgactgacttgactgtcaggttcacaacagctagatgatatatttatgactatgtctaatagttgaaataaaatctgaatattgatttactatacccaagaggggagaaaaattaaccattgtaaatttttaaaaaatttttcaaaaatgttaaaatgaggcaaatttaagtt

SEQ ID NO: 107003 - DNA, 1100 bp, Homo sapiens
caactgccagtatgtatttttaatggaaccctattttataatggtacgttactgaatgtgtttcatatgcgtgaccgttaagatattatcatttaggtgaaggtttcaactcaaaaccacccaacccggtggttaacgatttaatacatataaccaaaccggcagcgtttagagttgggatatacatttaaacattttcctggttaaggttcccaagagagtgtaaaggttttagcagaaagcaaaatatcttgcatctttatggaagtttaaagcatgtttgcaaatattgcagcccattgaaagaatttgcatgtacaggaaagttgtggatggagacggtttgtggaattttaagtgctcattgtagtaaacttttgctttgtagatttgaaggtacagacttatacaggcaagttcacaaaatcatgattagttacaaacagtaaaatgaagttaaaataaattattattttctatttgatatgttttgatgtgattcctcattttgcagtggtgcctataaaataaaagccttttgcagtgtttgctttttttcccttggttgtggttgtattacatgctactttggaaggatttaagtattttagaccatctgatgtcttcacattcagcctcaaacctaatgatggatataaagcgaaggtctagcagtgaagaatacagggtcaaatttacaatacaaccctgcattctcactgcctgtctcacaggaagtttcagcctggcccaatatcctataaacaagaatagctatgagcaactttatcaatcaatcagggtcatgtttacagtgaaatctctttcgtttattgcaaccattactgcctatcagtaataacaactccgggtggctaggtccagctttccatttctaagatgcatctgcaaatcaggcaatattttcatagaaaaacaggggtcaccaaactgggtgggcttcaaatctggtatctttctgactactgcaaccaccaggatcctaaataatgaatttgctacaaataattgtttcctgattgattgtaatgtttacaccaatttcagctgtaatacttactgaaaaaaagtaagataaa

SEQ ID NO: 107004 - DNA, 1057 bp, Homo sapiens
agaacagtttcattctcagccttttgaactgatctcagaggccagcacatatcttagactgttgcctgggctcgagcctagttctctgcagagataaaatctaacaatgaagcaataagcagtaaaatattgtcctgtttcctgcgtagagatggagttagaaatcagtcacgctgaatcacgtgactggcaggctccgggatgggctctgcaaacaacaaagcccatcaggcttgcactttgcatcttaagtccttcaggaggaaatgtactaaaggcaaatggtaaaattaggatgatggaggtcctgaccgtgctgagagccccatccagagggaagtgagtcatgaaagggcccacaccctgggaattgctactgtgccactggcctgacaatgggtgtaagaaaaacagatactgacaacggaagaagggctgtaaagatgttgcatctcttttcaggcatccctcagcccatgaatactacgatccaaatgactacattggagacatccatcaggagatggacagggaggagctggagctggaggtatgaagaacatccttgtctcattttaggagtcattattaagaacacagaatgcctaataagttctctataagcataaattagtttacggatgccgatggaaagtaacaaaagcagaaccacttttactgatgccctttgaaaggcacaactgagattcttcttccttccttggaaacagagcttaataatcaagtcccaaaagcagaaatgtaaactttttttaatttgaatcacttaaaagttaggacagtaaatcctgttgtcaacctttgaatccacataatccatacattcttgtaactaacataagcctcctcaccttcctcccttttatgtcatcaccactctttactcaaaggcagatggctcaagagtaggtggataaattacttgagtgaatgctagcccgccctaacaaaagggtttgttcactgcttcacttgcttcaagtttgctaacattgatacagaagaaattaaacaagtctgcaactcttcttaagtg

SEQ ID NO: 107005 - DNA, 1017 bp, Homo sapiens
tagcaaattctacccatgtctaataaatcatcttacaaaatgctgcaggtttttctccgtcatagggatctagtccacacgctaattgctgtgcccctgtgaagttttattctcctacctctcactaaaagcaacccctttagcttcattgttaaaactctaacaattcgacaacaaagaaaagatttcagaactgtgctttggccaggccaagtccccagagtcatttcaagcttgctgagctggaatatacccagggttattctgtcatctaaacaaactttctccaggtgaacgcaggcaaggcatctgtctcttctgtgtcccctgttggacctgggagtcagggagatgaatgatccattgtcctgaggcaacactaccatgtaactaacctgagaacaagaaaatgaagtcaggaagttttaactgcatagccatagggtggggaaggacgggggcccagttcctgcttccaggatgtgataggattattggggctggagattgtggagttgtagctacaaaggctgtaaagcattcatagaagaccagatggggagtgatctgaaataattcagaagggtgtaagtaccagtctagtgaggttcctcttatattaaaaatcaacattatctaatttcccagtttctacaggtaaggaaattgaggtccagaaatgatcagtagtttcttcagatgcaagtatactattttgtttactttatcatttgattcccagcatgtatcaatggactcacctatacatgaatcttgcagtgtttttagcccagttcatactttccacaaacatgtttatttctgttcagttctccaaaggtattgtgggcctcctatgtataagtcaggtgttctgtgcggctaagataaggtattaacccaccattcttatttttaaaaatgtaatcacaaaaagcaaggatcaattattataatatggccatattttaaagcccttctgtgcctgtgaagtcgagagggtgagtcattttattt

SEQ ID NO: 107006 - DNA, 1048 bp, Homo sapiens
agtcccagctactcaggaggctgaggtgagaggatcacttgagcttaggagttggaggctgtagtgaactatgctggtgccactgcattccagcctgggtgacagtgacagagcaagaccccttctctgggggaaaaaaaaaacaagcccatcttctcctcccaccttgacaaacagggccctttattgaatatggagccagcatatggctgagaaagtcactttttaatacatggccgttatttgtcactaactgttgttttcttgttaattaacaatggattataaaccacttttatgttgattctgaaaagaaacgacctagggtgggaccagagattacctctcttctttcagtttgtctcctcttaagacacaaagctttagaggaccataaaggagttttccttcctttcccttaggactagggcttgatacccaccgtcctagcttaggtgtccttctgaagtattccaaggtgccctgcacttccttccaccttgtttccatatatatgttaatttggcctcccatgttacactgtaaactaggaagtctcatcaccactgttactctcagcacatggttggttgaataagttggattttgtagtgtttgttaggaagagtgaggagcaagaaaagaagaatacaaatcaggaatttagaaagagaactaggtgttgaatgaaatgaccatggtttggaccaaggaggtgaggatgtggaacagaggggacacaagacattcatttttcattcattcagccaacacgttcacccgacccaccaagtgctgagaaccgaggtgctcacccacttgctcactggctccccagtgcccttggaattcagtgaattaactgtggctcacagagccctgtgagatccagcctcttctgacctctcccataaacctcctgccctgctcatctgccctggtcctgcaggcctcctttcaagacccagaacccaccttattccttccttctcaagactttgcagctggctgttcctttctgcctgtaagttagttcaccaattcatct

SEQ ID NO: 107007 - DNA, 1138 bp, Homo sapiens
catctttgtcaaatgttttatttttaaatattcaagtcctactcttaactaggaggtttaatactgctgttggtaacctaccttggcaggtaaggattttctcctaaaatcattcttcaaatgtgtcttggcagtaataaaaaaaaaataatccagctaaggttttctttttagataagcactttaaaagaaggttgttacagcaagtgagaaacaaagggtgtgtgtttcttgatttataacaatcaatggcatattaatatattttttaaagagccagagtttttaaaaaagaatttgatttgagtgtcattttttgcttaggccaccagggggtgatatgcttaaagagacacagggagacgcggcaaaaggtgggttggctgcctctctggacaaaacctaaagataaaatgaccctgggtgaacaaaaagtatctctctgtctgtctgccttccccactgagacagagagagggtcaaaacaaaccttttgaggcttgctactctccttaggcaaggggtacatatcttacaaaaaacaagcatcttaaataagtcttgtgaataaatacatttccgacctgtgacttcacactcaggacttcactggacttaagtccttttcaaagcatttgggagacatgttggagatctcgggcaaaagcgctttcaccactggcgatctggcccccatcccttgtgtgatcatgtggtgaggtgtagtcctcagtttgccaagttatcccactcagtgagctggggagttctcagtgagtccagcacgcaggcaggaaacaagtggaacagcagacgctgccatttgggcaaggtggttctgttacagacttttgacgctatatttgaaatagctcaacatagtaagtcaaaaggtagtttttaaaatttgccttttaaaaatgttttgctttttaccatcaatgcacataaaatatcattcagcagtcacagttgtggatgtattaattacactggcaccctccaaaaagtaactctactacatctctggcaaatctaagtgaacctgtcttttattcttctgtatcatttgtgctcagtccccccagccccacccccaaacacacacacacgactgcccccaaaagagggagcctgg

SEQ ID NO: 107008 - DNA, 1085 bp, Homo sapiens
cagcctgagcaacaaagtgagacccaccccatctctacaaaaaaataaataaaaaaatagccaggcatagtggtgcccatctgtagtcccagctactcaggaggctgaggcaggaggatagcttgagcccgagagttcagtgctgcagtgagctatgatcgtaccactgaactccagcctgggcgacaaagcaagcgctgtcccccccccaaaaaaaaaaaaaaaaaaagaaaaaggaaaataaatcaagttaatagtagtagaggctgtaagtcaaaaatcatggtagttccctgcagccggaggtttggaatgcacaaatatggaagtgggaagactccatgtggaaagtcacccaggccaatgactccaaagacttggggatggttggagtttggcaactgggaagccatctgcgaacttagagcagctgttgtcctggggtggctgcaagtcagatgcacacagcagcttcaggagggtagggggggttttgtgtgttttgtttaccactaaacaacagtgtctggctcatagtaggcaatcaatacggaggcgtgaatgaataggtggaaggtatgaggtgaggtttttatttccacccatgacactgacacccactgggccggtggtggggcgcggctgggagcagccggattcccacgcccccacttgaagtgagctcataggagacacagcctcccttcaggtgaaggaggaagaaagggagggagggaggtaggctgcagtctctgcctctgatcttataccaaggctcttctgttttatattgtcctttataaacaacaccacagggacctaggcaccttagtgtactccagctgaaagtggccagtgaagaggcctgggaggagctgtggcatggggggaccacataccccatctcaagggacagctttaccctgcttctgctcatttttgtcacatgggaatgcaaggtcatatgtgccacacactaggaattttcaaaagatgtaaaaaaaaaaaaaatccacacattttcagacgactgctgctgatttttttaattagtgcctaagttaaaatgttaaagacaccacaac

SEQ ID NO: 107009 - DNA, 1019 bp, Homo sapiens
cacagtgggcaggtgtgctggggcaggaaatatattttacctaatcaaatagcatttagccaggtagttggcagctcagcctctctctaaaaccaactttgctttggtatttttctcccatttatttactctctttagtgaccctgtttggcacatctttgcaccatgaccaaagtgacagactttggtctctgttggactaatcagtgtgttctctgatccatgacatatgttccctgtagacatttaaagtcaacatattcagcacttgtggtctggcaggtcagagttattaactgagctgatagactggtttggatatttgcatccaaaagactttcctcctcatcctctaacacatagagccacacatccactcccaacaacacaaatattgactgtaccaatcatttattagcagtaaaaatttgagagcaattatttttttactgcgcttgccctgaaagacaccattaattactatattgcctgtggatgtgagccagtttcggtgtcccaggggcctgctccccacccggaagaagtatttgcagctccgaggaacacagcataggatgtcatctggcaagcagtgcactgacattgtcttctgaagtgagatgtcaagactgtttctgccatcctattggattcctcctgacttgcagtttacaggtcaggattggcggtgacggtaggtttccccaatggcctgaaaactccaaatagaggtgggtgtgggtgaaatttgagatgtgccagcttttttttttttaaagagcatgagaaatattccaaatcatcctagaataattatcagcggaagaacttttttgattgttgattctgcaggtctcatccagagggtgaaaagaattaaggcttctgatgggcagcaccagccagtctgccttttcagttctgatctttcaaaggcaggtgtgatgcagagatagtaatggtgctgttggatggttttcctcctcttcctactctagttagcagaaatgcaaaaatgc

SEQ ID NO: 107010 - DNA, 1051 bp, Homo sapiens
ttatgcctgtggtatgattatagctacctttaacatttggcctagtcttgaacgttggtccaggaaacaaaacttttcagccctacgtatcttgcttaacctatcaatggttgaataaatggatgccttttatcttaattcctatttatacatgacgatgttattgtgatgggaggcatatatctgtgtactgtcctatcagtcattttattcttcaggggaaaaactgtgaacatcatctggcttcaaatttggaaatggtgactatttaaaatgttaagcaggacttaaggcagatagttttttaaaaagaataattttattttttctttctttgtagcaatagacattattttgtttcacttctgtcaaatctttattcaaccataaatgtaaatcttgattgcctttagaagaataagattggctcacttgggactttgtttaggatgagcaaggctaaaatgaaagctcctgtgatatcagggtcagatacaacaagtatttgccaactctaggaaagtttcaccatctgaccttaattattccacagaagggagggtttcaccatgataacaaggagaagcgcacgcgcgcacacacacacacacacacacacacacacacatttttcttctcttcagtacctaagacgtcaacatttatacgtagaccatatgaacaatgtattaggtttctgccctaacaccattccaagaaagcaaagcccattttctgatactaacaatttagtttttgaatctgtttcttccttccaccattaccactattttataagatacccagaagaaatggttattatttatgcagggtttgtgctccctctgctggttctgtaattaactaataagtctaattcccataactatgctgatgtcatcaattatttttgtgcatggacatggaattacccaaatcagcatgttctgctcaaacatcatcaggaaaattagcagggggtcagaggaggacagttggcctagcgaagaaagtgtaccttttgatttgtccaagtctgtatttgaaaaac

SEQ ID NO: 107011 - DNA, 1033 bp, Homo sapiens
tggtagtgtttactttgatttaatgactccaacagatgaggggccactgggcttgctgattgggtctgtactgacttttagccatcatgatggagagtaaagctcatgtccatgaaagacacaaatcataatgcagggaggaaggatcaatggagagaatgttagcataggtagtgatttgccctgtcatcgcactctcacctattgatatattttttcagtgacaggattctttcgctcagacttttttcttttgctattataatagttctcaaaatcaacaaacttttagttgcttagaacaaccaccacagaaaagaatgtgaatgtttattaccactgaactgtacacttgaaaatggtaaagatgatacattatatatgtatattttacctcaaatcattttaaaagcccccataatgtatatatgagaattctaacaataacagattctgtcatcttccacaaacattgtcatctacatttttcacttggaaggggaagtgcagtgagctctagtgaaaaggcatgcatggacttccacaggcagacatctggatgtgactcctgcctgccacgtattagctgggtgacctgggcaagttctttactgttctgagtctcaggctccccatctgttaggcagatataaaagaagagtgcttctattcacaatagcaaagacatggaatcaaccaaaatgcccatcaatgacagattcgataaagaaaatgtggtacatatacaccatgaaatactatgcagccgtaaaaagaagaagaccatgtcttttgcaggagcatggatcgagttggggggcattatccttagcaaactaatgcaggaacaaaaaaaccaaataccacacattctcacttgtaagtgcgaactaagtgatgagaactcatggacacaaagaagggaacaacagatactggagcctacttgagggtgaagggtagaaggaaggagaagagcagaaaaaaaataactattgggtactgggcttagtacctgagtgatgaaataatg

SEQ ID NO: 107012 - DNA, 1272 bp, Homo sapiens
gctttaattgactcaaagaaaaaaaaaaagagtaagcgactgtatttggggcatggagaggggggaaaaggtgcttaaaacaacacaaatttgtaagccctggaagccagaatcaaaatgtgtaaccaaactataatcaaggtgtgaacatggctgcattcttttctggaggctctaagggaaaatctgtttccttgacttttccagcttctagaggctgcccacatttcttggctcatggtcgcttcccatttccaaagccaacagtgtgccatctctctgatgatgcttccatagcacagcttcctctgatcctcctctctgcctccctcttcagctttttttttaattattattattatggtacaatatacataacataaaatttgccatcttaaccatatttaggtgtgcagtgcaatggtgttaaatatatttgcattgttgtgtgaccaatctccaggattttctcatcttgcaaataatgaaactctttatccaataaatgacagctcctaattccctccttcctctaaccctggcagcctccattcgacttcctgtctatgaatttgactaccccaggcacctcatataagtggaattatatagtacttgtccttttgtaactggcttatttcacttagcatgagtaactatattttccatgaaaacattctctgacttctagaaatggaaaatcagtaatgcttgtcataaatagagggaatagccataaaaatgaacagaatgaaagcagcccattattagatgctagctgagttctactgtgtgacactctgaggttcttatctcccactgagattagcaaatattagcaaggcgcaaaagatgtagcagcaccgaactgagactctttcataatctggaagatggtaagacatttgataaagccaaaccctcttgctatgggactcagtgttaactcaaggcctgcctttccttccactacttcaaaacagttcaggtgttactgggaatcgctgtgtagaacatctaggcaggaaagaagaaatgaacaggaacactgagtgagcaactaatctaattggagaaacaaatatttgtccttttgtatttgagcgtgtgtgtcattgagtatactgaaacaaaaaaattggctttgccatcctgctgcttccttcacctgggtagattccagttgattgtcaattatatgtcaccaggtggtatcaaaaggcagtttaattccccatgaaaattaggacttaacctgactctgtggcttta

SEQ ID NO: 107013 - DNA, 1028 bp, Homo sapiens
acaccgtggttagtcaattaaaaggaacacccagcaacgtgtccctgagcctcttgccacagaatggtcagtggtgagatcccaaaggcctatttaaaagagtctgaagattctgtaagtaaatgtctactctcggcctcaggctatttagccctgacaaatgacgtgggtgagcccctatgggcagatttgaaggaaaggacacctataaacaaatccagcctggcagctctaacaaagccagaattgaaataattagataacagcactggcctcgctcaccaaagagaggagctgtgtgttgttttctgcattgctttgctaacaccagatgtgaactttttaactttcacctagatttctctccacaacagtatcttaaaaatagtaaatcagcatggcacttcagcttaagacattttgagaaaaggctttgttggtcttttccccgtagcccactaacttatccctgtctacccgcatttcaggtgagtgtgaacattaatgccgcttgtgtttcagtgattactaaatagtcttcctttttgtcctggacccatttatatagctgtcacatggtaaatttttaatctaagatgtgatattttacaaatccattagaattcttgtgaataaacattctaaacggaaggggctaaagccaggaggccattttgcctgggaactagaaaagacaagccttcaggatgtggactgagaggccaagaagcagggagaagccagtgacagacagcaagggagtcccagccctccttgagggcaaaaccagtagggaaggctgactgggcccagctgctagttggcatgggtgaggacccctcagaggacatggcccggctccaagacatgcatatggcaggcaccacttggatgacaagccacctcaaaacacttggtttgctttacagtcataaaggtaaagttctctagaagcccctagattaatttattacatagatactatatgagttttttagggctgcatttacaaagtactgtaaactagg

SEQ ID NO: 107014 - DNA, 1021 bp, Homo sapiens
tttagaaatactgcataggtaaagtaaacttcctaagctgatcaaagcaaggagaagggcgcacctgccaagcactgggaattttcccatctgtctgtaccatgaaccatgttacctttgatctttttctttggtgattgacaggctggtgaaaaccatagcaacttctgaaagtgcctatcaacgtggcagtgggagcaaaattaatgtgtgttttcccccaaagaagatactaggtgtgtaaaggaatggtttagaagcatcagggagacagggtagcactgtggttaagaacatggaccctagagccagataagcttaggtttgagtccaggctctaccgcttagtagatgtgtgacaagtatattagttatctgttactgtgtaataaattactccaacacctagtgacttaaacagcaaccatttattatgtcacacagttgctgaatgtcagacacccaggagtggctcacccgagtggttctgtttcagggtctctcacaaagctgtgttaggatgttgactggggcagcagtcatctgaggcttgactggggccagaggatccacctcgaggttcactcccatggctcttggcaagaggcctcagttcctcaccacgtgggtctgctcctggcattttactcagagtgagtgcctaacttctctgagcctctgtttcttcatatatcatataaggaaaagagtagtacttcaaaggattatagtgaagattgaatttcaatgaaagtgcttagcatgtcatctgattcatgattaaattctcccttactcttcttaccatttttatcatcattgtgatcgtcacctaccccataattcctataatgtttaaatgggcctatgtatctccaatttctgtttttttttttcctctttgccaccaacaatcttcccattcctctgaatttcaaattctttcttgactgcctacaattagaacccatcaaaatgtcaatacccaaagacagatggagccctcctggggtctcagttg

SEQ ID NO: 107015 - DNA, 1074 bp, Homo sapiens
tgtcaggcatgttgttaattacttgatagagatgctatatggactgccttttggttgtaattagaggtttttatcatctttgccttgcctgtaagcttttccaaatttctttatgaacattacaagtggagatggataggctaacacatatcagattacctgccagtttccctgaaattgtcttatttaattgtcactctttgcatgccacttgcatttctttgggtgcttggattagaaaaatgatttttcatcgtcttatagtttaaaattagcatttcctgccaccagtaagtttggacttgaccaagatctcattcagaaagttgttggaagattaaaatactctcacctatgctaaaataagagcttaattctttgcaatgctttgtagtatttgactttgaagctgccagaagttttagtagccaagtagtagtaggaaaactacttcaaccacgaagaatctgaattaggagcaagctctaaaccactgaaaaatatttcaaaatttgtttgaatctgtaagggtcttcttttgtaaagaagtaaaaagagtttgaggaaagtatttcttattccacgatgatgctattaaaatattaatattataaatattaatattataaaataatataaattattttgatattaccaattataagttaattggtaattttcctgagtgctgaatctgtatgtcagatttttttctggggctatgtgtgtctatcatgtaatattaggttggtgaaaaagtaattgccactcagtggcaaaaccgcaattatttttgcaccgacctaatatttcatgctcagaacagtcttgagacaggtatcttcattcttcttgttttacaagtcagagaactgagactaataaaaagcttgtttttgtcgcttacttggggcaaaggaagaaaggttagaatagatgaatgctccttctggtttcattttaaagttaaatttactctattttaatctcatctcacttcctctaggagaaggttggctcgccctggtttcgggtgcctcccagtctgctcaaaaagaaagcccaggcctcctt

SEQ ID NO: 107016 - DNA, 1036 bp, Homo sapiens
cctcatagcccattccataggcacatgagcacagccagcaccagaccaagaccataaatggatctgtagaaggtttgggcaggtgtccaggactccgtgtcctgtaacaagtgtaaacgttttctggagtgtttgttttaaatgtcagaacttgaggataattttggccagggttgtttttacatttttcatggatgcctatttataggtctgaatctaaatctattttttatccagcctacccagaaaccataaagaaaaagattggtcatttgactatataaaaatttaaaacttatgtatggcaaaaaacataacaaactagcaagaggagatgaagggctaattttctcctttcttaacgtgtttctacatgtcaaggaaaaagacacactacccaatagaaaagcaagataagaatataatcaatagacatgtgaaaaggtactcaacttcattcataattaagaaaatacacaaccaaatgatgttggcagagatgtaacagttggataataggcaacattgatgggtgtgttgacataagcactcataaactgttggtgagagtttacattggtgcagcttttggcaatatctattaaaattaaaatgttcattctgtctggcttataaattccataatctatactgtggatgtaatcacaaaagagtgtgccaagatatgtatgtatacaggcacacatacatgcacacaagaatgctacttgtaacattatgcaatggaaacccaccacaacaatatatcccttcctcccaaattagaaacaagataaatgttaaataacaatacatctatacggcaggaagccctattaaaaagaatgaagtagagctccaaacgctcagttagacagatctacaaactttgtggcaagcatttatagaagttatttcttaaaatgagatctctatactggtatatgcttttatctgaaaggatacattaaaaatgagcagtagttaaactttggggactgttgttttaggtatgtgcataggcctggtttgtcct

SEQ ID NO: 107017 - DNA, 1026 bp, Homo sapiens
tgaagacggaaggcaacatctatgaactgggaagcaggccctcactagacactaaatcttccagtgccttgatcttggagttctcagcctctggaactatgaaaataaatgtctgttgtttataagccacccagactatggtattatgttatagcagcccaagcaaactgagaaagtaggtatacctcagtctttttttttaagttttaaaaaaattattgtggtaaaatataaataacataaaatgtaccaccttaaccatttttaagtgtacaattcagtggcattaagtgcattcatgttattgtacaacctttaccattatccatctcctgaacttttttatcatctcaaaccaaaactgtatctgttaaacgataattacctatttttccttcccccagcccatggcaaccaccattctccttcctgcctcttgaatttgactactctagataccacataggtggtatcatacaggatttgtctttttatgactggctaatttcacttagtgtaaggtcctcaacattcttccatgtcatagcatgtatcagaatttcctttctttttaaggctaaataatatggcattgtatatcacattttgtttatccattcatccactaaatgaacacttgggttgcttctaccttttggctattgtgaataacaccactatgaatgtgggcatccaaatatctcttcaagaccctgctttccattcttttgggtatatacccacaagtggagttgctgaatcatatggtaattctatttttaattttttgaggatggccatactcttttcatctccagttatgtgtattctttgctttgacctgaaagacataacagttataattgccctatctgtatggtatcccacatcaaagaaacttattttagtcgtgcatgtgaggtcagctgtttttgtcttaaccatttataattttgatgctggaaaatattttggtgcacaaaacatattaccaaagtattatacattacagaaactctacatcgt

SEQ ID NO: 107018 - DNA, 1066 bp, Homo sapiens
ttgggaggccgaggtgggtggatcacgaggtcaggagatcgagaccatcctaacacggtgaaaccccgtctctactaaaaaaaaaatacagaaaatcagatgggcgtggtggtgggcgcctgtaatcccagctactcgggaggctgaggcaggagaatggcgtgaacctggaagcagagcttgcagtgagccaagatcgcgccactgcactccagcctgggcgacagagcgagactccgtctcaaaaaaaaagtttggaatttgttgccaatgattcaaaattgggagacttttacagaaaagtctggagttttggcattattttatacaacactctcctctccctgagtccccacagggccagctatcagcaggggctgaaagtggctgcttccgttgggtggagatgtatgtgctgggttcatttccctccttcatgtttctgcctgaaccctgaatgcagctaaagtattgatgacactcggtctagacattaggctgattagactcgatgagcaaatgtgtgtattttctgtgtgtagcattgggaatttgggaggctacatgtaggccttgagatgtgtttgtctctggaccaggaaggcagtcccttatacaccaatgactgaaggagagatgcctccttctgaggagcctgtctctttgattgagaatgcagctttggtagcaactaatcagaagtagtatttgggaagagggttgggacactgggtcaggcagaaagatcagccactataaccagccatggagcacagtgatagatacaatcccaagtcatcctcaagtgtaacacaggcaaacatggttatgatagagataggaacaagggaagattagggaaatagcatcagtagaataggacacatgactgaccgtggagaagccagggagaaaggcaggattcatttgattcaaaacaaacaggatagttcattttccaacaccttttgggacagtgttagcactcctttttttttttttttttttttttgagacgaagtctcgctctgtcacccaggctggagtgcagtggcgcgatctcggc

SEQ ID NO: 107019 - DNA, 1104 bp, Homo sapiens
tttccaaatattagactgattagtgtcacaggtttaagccacctggtcaaataaagcaaatttttcacccttattagagtaggttaactgctgtaacaaacaaccgtaacacttcagaggcttaacacaatatttattacttgttcaagtcaagggccaaatacagttcagcaggccaagggctctgttctttgcagggatttaggaacacagtcttctccatctgtggccccaccttccctaggatctctgaatctttccacttggaaagaggatgaagatccaacaggggagatttttatggggcaggctcaggagtggtgtacattgcatctgctcacattctgttggccagaactctgttacctgacccccagccaactgcaagagaggctgaaggctgaattgagctcagagcccagagcagcatcagtgagcattagcagtctctgccctagctttcctgttgaggaccagggcagaaggtcatggcaactgggactctcagacatagttttcagtctgagtacaaaataggaggcctctccagtgggcctggattatatgcaacgaaaacaactcttgcaatacaggagaaattctctgcaaacagagggattaagaccccacctctgcgacccccgtgacctaacagaagtaaagccacttgatcatatttatctcagagtccatttcctttcttgtgtctgatgcattggttcttgaatgtggaaaacctctttcccttgggtagagacctaccaccatgtgggacttaaggaccaggacagctgaataacacgtgtggcattctagacacatggccttcctttcagtctctaaattacgtatattggtttaaagaagcctttgtttcttaaaataagttctcaatgctccagattagaagcagctggaaatctttgggaaggggcagaggtttcagatgtgcttctgtgtatttttttcagtggacatgacagatgctccaaaatgacacacatacctgtcatgccagcaaagccacatcctcagggtgtctgccttagcagcagtgatgcctgggttgtcagggtgggctctggaccaccacaagcagtactg

SEQ ID NO: 107020 - DNA, 1050 bp, Homo sapiens
aaaattggaaagtggaaataaaataagatgtggtctctgcactcagtgacctgtgcaatacattgagctaaacaccacagtgtaaaatactagatgcttgaaattgctaaattagccacttaggagactgtgtggatttggagacacctagaaagtcttcttggtaaagatgagactttgctaatagttattcaaaaaaattgctatagaagtccaacatgtatatatcacatatataatgtagaaaaatgactggaaagaagtagcagaatcccagccaagtgacagcatgtgtaatgattcagagcttgcagccttaaaccagaatgcctagttcttcctattactggctgttggaccacataactaaggttacttaacctctctctacatcagttttcttgtgtaaaaaggagataattatggtacataactcataggcttatgtgggttaaatgaattaatatgtatcaagaatttagaccactgtctgacctaaagagtactcaataaatgttagctatattgggcatatttaaatggtgagattaggggagattatattttcttcatagtcttaaattttccggactttctacagtgaacatgttggactttgatagaaaaaaatatttctaaagtcaggtctttcagtaagcttttaaagatatgtataccacaggtgagtcatactttgatgactaaaaagtcaatttgagcatattttaatggaggttaggcaacattttttgctgacattcaattcaaaattttttattaacctccataaatggaattaaaagttttccacaagttcccaggacccctttgcttcttaagaagttttagcatacattagagtagacagtttgattccctttgtcatttgtaacagtaaggtatagtttaagaattgggtaaacatgcatctcaggggtaatgtaatgtgttacagttgtttccagaaaatattaataaatgtaagtgtttatatcttcttagagtaactttctgctaaattgtagtctctaatcatttgttatactcttg

SEQ ID NO: 107021 - DNA, 1050 bp, Homo sapiens
gaggctttaatgaaaggggccctggtggcacaggagataaagcagacttgaattcagcaccatccgtcgtggtgggggcttccactcatccctccccaggccctgtcaggagacgccaggcgcttggcacccagtgtgggctcagtaaaggttagcaatgatttttgttattgctactaaatgccagtataggtaggcatgctgtaaaatgaacaggataatctaagcggaccttttttttccttttatttcttcccttttacatcatttctattgttttgctgttatttgtatatatgtgtgcatgcattggagatggggaatacagctacggaggttttgaagaggcacagtattgggtttagttttcatatcaaatctcacacattctgaaatctgtgaagaaatgtgtcacatggtgatgcctggcatataatcagctcctcagaaaatgctgtgattaacagtaactccaacagatatttccttctcaaaagaaaagcacatgattttatagcatttttaaatgccagggcatctcatcagctcagtcttttcagtaatttaaaaaaaaaaaaacccagatagtggaaattcagggtagtcaatggaaaaaattcaataaagctgaatatctcggcaccacagagtggtgtcctttgaatgtttgtttatcattcaaatataataacaccaaaaagaaaaaagcatatgaagtgacggatatgttaattagcttgattatggtgatttcacagtgtatacacctactatcatatcaactagcataccttaaattatttttatttgtcaattatacctccataaaactggggggaaaagccactcttttaaaggcttaataggaaaaaaaaaatccaaaaatacgtaacagttcaaaatgcattgttaaaagagcaagtttaaaaatactgtgtataatatggtctcatctgtgtaatataataatggacatgggagtagaataacagtagaaagaaacacaccaacggtgtggggttggataagcacacaaaactttaactagtt

SEQ ID NO: 107022 - DNA, 1114 bp, Homo sapiens
gtctgtatcttctgcttcgtaactcccagcagccagcaaaatattcaatgttttggagctggttacaagaaacttccaaatcctcaaacatcatcagagaaagccacagaccccaagcgcctgtcacatttgggtatgtagtgcttgctctctctctacgtagcacctaaggttagctggtggatatcaaagccccatagaggaaggggtgtgggcgcggggttgttggcctagtcttaatttaggttcagcatatgtctgaagcttcccccgctttaacattttcacagagcccagacttatctcagcaagcactccacaacctcttcgttctgaaacccctgtgtattatgaaggaaatgaaatccatatgtttctgattcatttacatgtagctcatcaaaatgtagttttgtaagagctctttggtgtccaagaagcctttggagcctttttataagacttttaaccctcccccgcttcattcttcttagaaccaggaagttgggacttgccaagagtaaataaaagcaagcttcagagttgactctggctctggcctgacccatctctggtctgagtctgcagtggacttagcttcagcaaaaacagaaatgactgtctttaccctttttctggagccatggaagtaggcactaatcccacttacaccccacgtgacagtgagtttgggctcacagcatctcttggaggcagccacttgactctatgtagttatttccagctgagcctcttctctctgtcctgtgagcagagagctgatagggccagatggccacacctggaccagaacctcgaggaggagctcctttaagcagtgccgctcatctacccgcttgcaggccactgcactgtatctccaagactttccaggccagattcttaccaagggactgcctatgcatcagggacttctatcttttcactgggaccatgacagaggcacccacaactataccaggtttcatggtggtattgttggtgctgctgtcacttaatgatacttttgagtgtttagtttttcttcatcaagaaaggcttataagctttaaagaaaacaactatctactgccatgaagattccagagctttt

SEQ ID NO: 107023 - DNA, 1137 bp, Homo sapiens
ctgtttcagtttattcatcctttccttaccctgatcattggcacttctatttctttataattcacaaacctgatattagaccaggacatctttgggtagacgtcaccatatacaggtgtgccttcattttttagaaaccagcatttaatcaataatagtaagttgctttggggtaactacttgcagttattggcaatgtctgctgctgtgagatttggcttgaagctgcacagggcaggtctgcttacaacagtggttttcaattttgcctttgcagtcaaatcaggtggggggcttttaaataaagactgattcctgggccctgccttagagatttctggtttaattggtctagggtaagaccaggtattgattgtttttaaaaacaaccctccaggtgattataatgtgcagccaggattgagaaccagtgccttagagtgtccattctcaaacttgaacgtgaagcagaatgacctaaagggcctgttaaaacgcaggccactgggccacaccccagaatttctggttcattaggtctggggggttgaggggtggcggcgagactttgcatttctaaccagttcccggatgattcagctgttgctagttctgggaacccactttgaaaaccactggcctgcggagatctttccagtagctttgtaagattttataacaagaaaaaagacaggatttcctgtgcttttaagtaaaacaactgcttaaggcacaaatattaaaatattatgcttcccggttcataggcaagttggaccataccctctgtttgctaaggcagcatctgcactaacaggcagccagggcccaggatctgaaaggacatggattagaggcaggtgagaagttggttttttaaataaaaaatgctacaaggatctatagaattgttactaaggttagcaaattacctatggattgtacagctctactgagatacgtagcttaagatgtgaataattccctgggcagcatgaaatatggcacagaagtacgaaggtgactcagacaaacatggtacttgatcccctaaagagggcagtttaacagtagaatgtactgcctgtgatgagacatatccatttcttatttaaattcacgccctacatttctctt

SEQ ID NO: 107024 - DNA, 1054 bp, Homo sapiens
tctctcaacaatcctgtgagatattcttatataccttcttattctctttttatatttgagtaaaatgaggcgcagagaaattttgtgacttggccaatgtcacacctcgtaagctgcatactggatttgaatccaggtggaacctcatgggtatatataagattgtaaaaatacacgttccccttcaccaggcctttcttctgacctaagtggtggccattctccacatcagcccttggccctctattctccatctcaggctgcatataaccttcactcagcagctctgtgctggtcatgcccagatatccaggcctcatgggcctctactttgtacctccagctgccagtgagatagttgtatacagttgtcagtttcttccttccagccccattctttctcattcttgtttccatgagtccttatgcccgttgtggctctggccagcatgaacttcctggtcatgtgtgtgccatgcgtattccagcatctcctgtcaccctgtccatgccttcctcacctatccagatgccgccactactttgccagagctgaagtagggataaggtactccctgtcaccttggcctactcctccagcctgtattgacatttcttcctgcgtgttctgaagtcacaccacggaattcttaaggatatacactgtgacattagagggcttgagttcaagtactgggtctgggctactttgctttgctgccctttagtttccttgtctctgaaatggggataatagttctttttttttttttttagatggagtcttactctgtcacacccaggctggagtgcaatggtgccatctcggctcactgcaacctctgcctcccgggttcaagcgattctcctgcctcagcctcccgagtagctgggattacaggcatgtgccaccacgcccggctaattttttgtattttttagtagagatggggtttcaccatgttggtcaggctggtctcgaactcctgacctcaggtgatccacccgcctcggcctcccaaagtgctgggattacaggtgtgagccaccacac

SEQ ID NO: 107025 - DNA, 1026 bp, Homo sapiens
agattcaggcattgcatctcggcatgacagtctccagagacaccagcaagacaccgttttcttgtctttataggtgtgaagagagctttccaagaagctctagaacaggctgccccttgttagtggtttgttggacagaatgaaacaaaccactaatcctattatgggccataaattaccatgaatggcttggaccaattgggatttatgcactttctctgagggcaaataaaatatgggtcacaccatcaaaggaaaggcagcaaagagatgagtaggcaataagtagtcattgccataccagattcatcctactggaacccccctttatggatacattttcttactctcaaataatgagcattttcaaaatcaggacaaaggagtggttcttttgttgcagagttccttacataaattcatattttccttctaaattttctaagagaattttatggataaagactttccttcagtattttctcttatgagttgaatgttgtgctcacagttcatgtaaatattttgagaaaatgttataattccattttaatctaaagacttgtgagcctgcctgtttatcgctgaggttttctgcaatcctcgtactagaggaagtgtcattttgtgtaaaccaggaaaagaaattggttcaagtaagtctaattgcaaagttgctgaatgaagatatccctttctctctcttacaacaaaaatttaaaatataatttaaaattgtcaaacaatgatcatgtcacatctggaaatttcaggtttttactcccttgccttttttcctaattacctgaatgctctggatattcaggctttcagctgtttgacttttctggaggtaagaaaaggtatccagtttatttcacttttctcagatgtgactcatgtctttgacataaaaatccttatcgcacaggataagcctcaggaattggtttgaagaatgaagacaaacctggtttttatgagaatagggaattttttttttattggaagcatagttttctgtgt

SEQ ID NO: 107026 - DNA, 1057 bp, Homo sapiens
taaagggcagaacaacaatttcagcaaggctctatcatttcagttatccttccctgctacagtgcaaatctctcttaaagactgtaggtctggcttccgtgaatcaaatagaaacagttacagcataagcctgggccactgtgttgccttgggatatgcatatcacctgttttaatcccaggatttgactttcctcctagtgctgtggctgattatttaatttttagataatcatgtagcaaatatcatgtattagaaggtagggctataaaaagagtatgccacaaacagagtttggttgttggccagcaagtcccaagctgcctctgctgccatgtgctaccatatcaagcgagttgcccgggaatcccctgctgacatcggtctgtctcacatgcgtgatatttggaaggtagttttggtgtgtatttgtgttgatcattatagtaatgacatgcatttaccacagttttgtaggagagcgactctcagctgtggtttagagacatagccctttggatctccaggtatctcaaaggctgtaaaacttctcaagtcaaaactagttttaattttactgcttgagagatgcagtatgaaacatatgacagcaatgagtgtctatttctgtagcaactcaagccacctgcttttttaggggaagatttataataaaggcacataactatagggcttttaaccttgatttaaaaagaaaaaaaaagactttcctgttcattatcatatctagctctggggagatagacaggttagtgatgatctgcaccattttacagatgagatccctgaggtggcttgtggctttggtccaagaagccatttatttttgattgctggcttcacatggctcctcccttggctggctccttcttatccctaatcccctatctttgttgcttgtctgttacctatcaaaagaagccatgcctgatttctctattggaggttaaactgcttttcccacctctggtttcccttcaactccttatttatttcattatcgcattagccactagttttatttcttgggttttca

SEQ ID NO: 107027 - DNA, 1291 bp, Homo sapiens
gcttgcttttctttaaaagaaaggtaccaaatgaaatgatttttaagacctttttttgcactgaatcaacattttgttgtcacaaacctgattagatttctaaaaagtatcatactgtcccttgctcaagttaagtacaaaattgcctaggaaattttttctaaacccaatgccatgttccattctttaccctgccgtttcccagcccgaggattggagtgagtggaaagtatgttcctgttttttcaaaacggtgctcgggacacatttgtgaccacaccagcttccatctcactgccacttctgctcttccggttctgagcagccgtcttagaggtcaactcttggagcagtctgttgatgaggtgagagccgcctgctcaggggagataaaggtagaggtctccaggctcttctctgggggcaggactctcaccccggcagctgcggctttgattgaaaaggtatgtggccctctggagctgacttcaaccaaatggcattggtctttgaaaaatgtactttagcacagcccctgtggaacgtgtttacttaaggattttacccttgctttagaagtgagaatgtgactacagctggactgcccctcactgaaggcatttgctgcgaatgtgtcttctgctaatatgtttaaggatctataatgaaaacagagtcattctgaaataaaaggacattgacataaaaagcagtaatggttgacgctatctgtttttgaagataagggttttgtcacaaaggcacgatttatggtgggaatactgaatagcgggagtgtggcaggtgataaatcactgttctcaccactggatatggagaaaaaagggatacaaagaccttttaaaaataggaaaaataaaagcactccagggcatgtaattttatggaaaacatggtagagaaagtacaataggactgagattgtatgttgttgactgaaatgttttaatctcatttggaggaaaaccatagttaaggtagatttttgtaaaactgaatcgtcaaaaacttagtccatacactgagcagcatataatcatgctttttaatgtagggcttccatggtagctatgatggtgataaaaatcacaatctttctcttctctttatcttgtgcacaagttttcttctgcccacagccaggtagatgagagcaagcaaaagcagatgtatttataggatgttaagggcaagaataaaactaataccttaagagactttttaggaacctcttggaaggcatgagtccagggaggggttacagagtctg

SEQ ID NO: 107028 - DNA, 1653 bp, Homo sapiens
ttaatcctgacaactgttacttctctgtgatgttagaataaagggtatttgcccttttaatgtcaggccttcttgcctcctgcaaaccactcatgtccagaggatgtactaagaagctagctgcatgcttttccaggcagctagaagtttgcatatatggcaaggcaaacttggccagcttatcttgaatgggatagaaacacccttctatatttgctgtgaattttttttaaagtggtacaatatgggttaatgtttagagctgactatggtaaggaccgtatatgtatatgtatatgtatatgtatatgtatatgtataggtgtatgtgtatgtatatgtatatgtatatgtatatgtgtgtatgtatttgtgtgtgtggctatttttaaagcctgctaaagtatttttggtggacttgcatagattgggaaaaatgaaaaccatctctgacgctcaccttttacaactgaggtattaccatagaacgggcgttggcaaacttttcctgtaaagagccagatggtaaatgttttcagctttgggggtcatgcagtctttgttgcagctactcaactctgccattgtagtgtgaaagcagttacaggcaatatgtgactggatgagcatggctttgttccaataaaactttatttaataaaacaggtggtgggacaaatatgacctggtgagtgacgtgtgttaacctctgctagaaagttctactgcttaaatatagctctggctttgtggctagatttcatcttagaggacactttgcccctcactttgcctcctcgtcttcccagatgccacattgcagattgtcacttgctacagtctgtaacaagaacatatgattctgggtgctttatatatactctgtctttccctggcaactgaaggccctggagatcttgcctagctgttgatctgctctggggtcctaccttaatatgttctggggtcttgtcttgccagagagggtcactgtaggacctcagagaggcccttgggacaggtaagacagatcagcatttcaacagatgacccctggtttccagtcaactatcaacaaccaacctctgtatcttattagaggctctgagataagccttaattccggcacactgtgggacacaaaagagcctaaaacctcccttttgctaatgagttgtgtgttattttctcactttatctcagttctccagcctaactgctcccggagccatcttttcaaaattccaacaattttttccaagtttcccattaaatcattgaaatccaaatgatacatatgcatagttttcccaaatgcaggagggaatctgcatttttttattgaaaaagggagggggcactcttgcaaaataaagctactccctctgcctcatccctcttggcttgatgtaattatttctctgagtatctgatttgttgctgtctctggacagtgctgctccttttttgtactgctgtcccactgcttgcagtgactcaggtgtgcttggaacaaggacgcaaccaactgtggttgaattatatgcaccctgacagccggaatgtacagtgtgatttatgggagttgttcacacagagatccccagatagcctggttttctgacatacatgtgaagttttaaggcccagggt

SEQ ID NO: 107029 - DNA, 1033 bp, Homo sapiens
tttaaaattgtattttccacaataagcagatatttctttataatcagaaatcttaaataaaatagaaatgaaatcttaaaatataaataactaaatcatgcgttcacacccacacacagacatacccacacaaattccaaggctggttattgaaagatgtgtcttccaaaagtagagtcatgtttattcaaagacaaacataacatagttgagtgtgtatgttcacagcatggggagtgtttagtgtgttttaaaatatgaggaaaaataaaaaacatcataagcaaaccatcagttctctttgagagaaagctgctctcacacacaggtgattctttccatgaaaactccaaaaggaatgttgcttatgcttttgcataggtctgttcttcttatgtaggagtacatctgaactttagaaatttacatttgagtaaacctcaaactccaaaatgtatccctcctccccaaaaagggacattttactgaaataaaatctgttgctggttgcttctggtatgttatgtcaaagttgttaaccggatacagcaaaggcagctgcattgtatttcagaattagtttgaggtagattttattgttataaagcaagacgcaattgaagccacactctgggaaaatagcagtaacacaaaacatagtaatttaggcagaattactcagccacagatgtccagagaggtataggaaaaggtccatatgcactttttgtaggcaaacaagtcaaggttaaataaaagccctattttgagtcttaggctggatgtcaagaaattgcctcacaggtgaaacaggtccagccacagaagaggctctgttgttacttgagtcactaaaccatttggatggaggccagtgcagccttctcctctttatgtcaagttcccatctgtaggaaatagtgcctatagtgcctggtgacatcacaggatcactttgagtcagtggtgagtaaggcataatgcaaagagtaatgggaaacactctacacttgagagaattcagaagagcagg

SEQ ID NO: 107030 - DNA, 1055 bp, Homo sapiens
gaggaagtcagtccttctgatatatcacagggcagtggaaagagtcccccttcatcggagaaaaatcagagtgagggatagtcagtgaagcctgtttagcattttgcatcgatcatcaaacctaaacaagtgtttctcagacttgagtcagtcatacaccacctgctcagtctttgctatatatgtgccacctgttttgctaaatgctcaacattattcttaaagcaacattcttttaactttattttaaaaagaaactgtgtgtcatgactgtaaatggaaagtcattgtcatgtgttgtaaatagaagataagagtaaaaataaacactgaacatgtagaggtagtcaatttaagctagacagctgaaaactctggtctttgagccttgctttctctttgtctaagagcaaaactaattagtgggagtagaagtcaggacagtggtgggaaacaggactgaggagggcttttgagggtgctggtcccattctgctcccgatctgggcagtagttcaggagcatgttcacctgtgtaaatacaccaagatgtacacttaggatgagttcactttctttatgttacatttggataaactttatttttaaaagtggtgttacctgtttacaatagtaaagatgtggaaccaacccaaatgcccatcaacgatagcctggacaaagaaaatgtggtacataaacaccatggaatactatgcagccataaaaaggaatgagatcatgtcctttgcagggacgtggatgaagctggaagccatcatcctcagcaaactaacacaggaacagaaaaccaaatactgcacgttctcactcatgagtaggagttgaatattgagaacacatggacacagagaggaacagcacacaccagggcctgttgaggggtggagggtgaggggagggaacttagaggacaggtcaacaggtgccgcaaaccaccatggcacacatatacctattaaacaacctgcatgttctgcacatgtatccctgtttggtttcgtttttagaagaaataaatttttttaaaaaac

SEQ ID NO: 107031 - DNA, 1046 bp, Homo sapiens
agcatgatctgtataattgttgtgacttgttaaaaaatcttcatgttgtgtgagttgttaggataagagaggataacaggggaagagaaaccattagtagacatatgttcacttgttgggtgtgcactgagttctgcctaatatgagataggtcaggatacccagagataaactccctggctctagggagtttacatgtgagacctatgtttataggaaaataacaccaagttaattagaagggcagccagtatatgcagaggttaagagctaaggactctggaatcagatcaacttttgaattctagttctatcatttgcgagcttcatgatcttggggaaacttcttatctctgagcattgctttcttctgtaaaatgtggataaagttgccataataaagaaaatattctttgtgtgtctgaatactgcaattttggccccggaataaatgctcaccaggtggttagctatgctgtgttgtttcctgtgggtctttagaggctgggctggaggaggtttccagcaagccaacactttgatgacggctatatgacacagtttcataaacctgaaattacagttgtgagtagaccattttaatttgttttttatttctttttgatattagtgagcctttgtatctgcattaagagctgccacttcctaaggccatataaatcagaataattgatcaatcaggaataattcttaatttacatcttagtgtgaacaacatggtaattcattgcatatgtgctgacataagtgttccaaaaataaagtcaaacaattgtgtgttcaatatcagctatttttaaagtgccaaaaacattaagatttctgtttttataatgactcatgagtaatattgggattttcttaaaattaggaacagttcatctttctttagcaaaaatgtcccttaaaattgaaatagtttagtttctttttagggtaactttttatgtcttgatatgaatgtaatacaccattgtagaaaaattgaaaaatacaataagacataaagatgaatatagaaaccc

SEQ ID NO: 107032 - DNA, 1238 bp, Homo sapiens
tgaaaaatcacataagatcaatattaccctcaaaattctcttagggatgtgacacgtggagaacataccatctcttcgtaagtccagccagctggttttgcacagcattggatcacctcactgtttctcagttgactgtcatatggagtttttggattgttctgtgaatacctcatttgacaaaatgctcacactgagaaaacaccgagaaactgaggcctactaagaaaccagcaaattcactttgaggcatgtgctgttcaatatattatttctctcttcatcttttttttttttttttggtcatggcttgcctataagttaaacactcctctgatgcaactccactgaaattctttctcaaagacttgtagaggccatccacatctatatttcttgccagtcttcaagccatatggcttggagaaccaagctcatttttgtgttacaggaggcttgcctttggtgataaatgagtctgtgtagtgattgcgtgggttaaacgctgttctgctttgagctagcaatcttgattccctggatccaatgaaagtgggagacttaagccctctattcccaataaccattatttcgtacaatcttctgtaaatatgcattcatcttgcaagtgttatgatttgaagacccgaggatatgattacagaagctgtggaacctcaaaggcttttgtgtaaaccggtcattctctttttttgtttatttttggtttagttggactgtcattgctaacaaggtttgttacagggtcagctagaaaggattagcaatgctttccctcccagagccaggctacttggtggaacaaagtgagatttcactgcttgtgattattaggtgagaagatactgttctgagacccactaaagttgcaaaatggaatgtgaattaagctggagtatttatttaaaaataaagtaatagaagactcccctttaaaaaatgtttcatttcgacataatttcagacttgtagacatggatttctgtacaccgttaacccagattccccaaatattaacatctactacatttactttattcttttcttcctctactctttatcactaaattcatcagtgtgaactttttaggaataagacattctcatatgtaacagtatggtaatctaaactaggaaattcatgttggtacaaaactgttatctaatcttcagaatttattctgatcttgctaatggtccctatgatgccctttata

SEQ ID NO: 107033 - DNA, 1087 bp, Homo sapiens
tgttgtctgtatttaccacattttgtccattcattcacccagtgatggacacttgggttgctttaaccttttggttgtcttgaataatgctgctgtggatgtgggtgtacaatgtgtgtatgtttaaactgccaaaaactctgttgtgtttatatgtaaaacagagctaggtctatgctcaggtaattataaaaagcttgttattttatcttcatgactgtctggtgggatatgtgatagttgtgctggaggcagaaccattcttcattgcaggagattcttcgtgtcatctctggcacatacccctattgttgtgatggtgaaaaatgcccctgcagattgctgaaactcccactggggagtgacagggacatcagggacaatcactgaggtagaggtttgacttattccaaaaccttgagataggaattgagttgctcagggacagagatgtcaacatccctttcttccagctagactgcctacatgatgtcccctatttgggttccctacatgagtgctcccaaggcctggtaagaaagcctgagctggcctgtcctggggctgtggctgggaatctggggcccccttagatgaagtgcccttccagcccacatggctgcagggcccatgctgtcccctggaatcctgtgtgtccatctgccctgggcttgttgggcagactttggtcatacctattccatctcacatttggtactaggattcagcaagttctgacttactcagtattggcttctgatttttttgtgtcttccctgcactcctcttacctgtgagctgtcctggtcctttttacaacttccgaccccacctttgattgcatatacttattgcagttagaaaactaaatttaatttctccctgatgtctttaatattcattcgaaactgtaaatatctcagtgccttttgtttttctgcctctgaacctactgtctgaactatattttaaagacaatgcaaggttcctatactttaatatcaccagatttcttaaaggaactatgctcatattctttcaaatagtttgagaactttggaaaaattttcccagtgcccaaagtgtg

SEQ ID NO: 107034 - DNA, 2715 bp, Homo sapiens
gaggcaaggacataagagtcagactagcataatcacatttgtatgcaaaaaggaacaaatgcatatttaggaatatgatgtgttaaaatgttttcaaaaggatgcataaagtcaaatagctaccataggcgggggaagaaggacaatgggttggagatggcagggatgcatcattttatgtcctttggtgtggtttgaaatattttactgtgtgtgtattttagtttaaaacagaaattaggagaaacaaataccttttaccctattgccactcttgacacagcaagagtcaattactgttttaagagtgcaagctttactttcatgctcaacttaatgcctagcattcatgcatgtttttttttttaacccaaaggataaccacgatggatcatccagtgaaggaatctttgtatccaagatagttgacagtgggcctgcagccaaggaaggaggcctgcaaattcatgacaggattattgaggtatgtgaatactggccagtgtctttgaataggctgaatgccatcccatcttcgtctagctcaaagcaagatgtttgactggggagggaggcctaaagtggtagatggttgagcgggagtctcacttttcccattgtgtgggaccagattgagtgttgattgccttggtgttaaatttttgttaaatgtagaaaagccagattatgagtggaatgttcacaatttggcttttttcatgtggacctcaatctgtttcgtatgcatcagttacagtttcgcgcgaaaaccgttgaagagttggatgttagaaccagatgaacgaaccctgttgtacaaattgtgcaccctgttcatattgattaccagggtacaattgtgtcagctttggagtcattctaatgtcctcagagctcacacagcacacacttatttctacaaatgcattgttctctctgttagtttgtcgtctttgcctgttgttagttgtacaacctgattgcccagggatttgcaggcagaggttgatattagggttcacatatcatcacttactccattttcagttcgtcattcatcatttcaaacttttatacagcaggtttgtagactcatgtaggggaagtggatctctcagccccaccagacaacactttgtaacagggttgcagtgttctaggatgctctgagtcactaaaagggagagaatgatttgttgccttctcatatgggctcttgttgcaaagtttgatataaatgagtaattttttactggtgttttgaccattttcatagctctttggatggatacacatatgggctaaattgattggctttcctattaggcaaaaagtaaatttgagaatccacgatgatatgccagaccccacaagaaattcacccatgggccacagccgtaatatagtgcaaatagaagaaaccagaaaaacagcaccgataccagtgggtgtttgttttccacatgcatttttatcatgtctgtatttcctgagtattttcatggcctatttcaaaatttaggactgagtgggagctaggaccacgagctaagccataagtgaagttcacatcactcactggaatgtggccacaggcttctcctggggaaaggagcctcagcaagacagagaacaaagtcttgcatttccagtctcatctggacacattctgcaacgtgcagtatgcttcaggataatttgtaatcctcaggaaaatacacagttaaatctcacagggaaagcaaactgaactagttagggtgtaaggctccctcctcggagggagtgtgatgtgctaacttacatgctaaaatgatacttgattttgttttaaggacattattaatattgttgcatcccctttgaatgtttgaagggttcttaaacttggagctttttttgctgcatggtttagagtcagtctttgtacttcccaggtcaggagactggattttccctaacaggaatttgcttgggcaagagtgctttcttaagagctcaaatgcgttacttactgtcttttttgagagtgaatacattttctgagactattgttcaaaaagataagtacagcttccgttgccaagggtttggtggaacagccagtttctctaagtaatggaatttcattgctcttgtgttttgcaaatgagaaatctacagctgggcaggattttctcttggcaaaggatgatctgtatttgaaatgttgagtacggtttctggtaagtcacattcctattttggacagtatgtaaaatattaatcatgtagtgttgagatggaaagaaggatgaccacaatagagaaacgatatatgtataattgcaattgacaacactgtgccttttgcagtcaaattctaatctcttttgacatgatacagtgattcccatgactgaaaatatgttctctggtttacctcatctgcgtctgagtttattaccaggaggcataaatgtgattattttgagagagagagagagagagagagagagagtgtgtgtgtgtgtgtgtgtgtgtgtgtgtgtgtttcattactaagaagagtcaaagtctctagttttccaccagatgtcttctttttcaggggaatgggcaaaccaccaccagatcttcaccgtaagacccttaattcttgcaaaggggtattattaaatccagagatactaattgagtcttttctttgctgcagagttcctctgctcttaatgg

SEQ ID NO: 107035 - DNA, 1133 bp, Homo sapiens
ataaaaagttacgtacaaaagggagtattttaaataatgaaattaaaatatgactatgaagaaaatgtgaagtatgttctcctgccattccaatgcattgtgttacacgcattcacctgtgaagacccctgagctagaagaaagcggttggacgctggggttttgcaggggtggggattggcgctcatacaaggcctggagcaggaacagagttgggaactgggggagctgcaagtaagcagagtgtggaaagagttgagggatgggcagggaagtggccagaaagaggcctggtgaagaaaacaagggcttgaccccaaagggcctaagtcttgagtctgggatttaaattacctagggcgggagtggccaacacatggcttcagttgaagggaatgacacaaagagatttatgattaaattccctttgcttttagcccattccacagtttcaaaaagaaacaaacaatggcttattataagaaacaacaacttaattatgtgtttgcagttgttaaaatgatgaacattatctgtcttatcaaacatacatataaaaaagaacattttaaatggtgagactaaattgtaaatatgaaggtagatggggacagggataattcccactttattgagccccagggatgtcatcacatggttgtatttcttgcattcgctctgtggaattcttaaaaaactatagaaccgcgtgaggttggtatatttttattttttccttttaccagttgtctgagatcccaggctgcatgtcatcatgtgctgttctgatttagtccttgctgccaggggtcctccgtactctccagccttcggagggactgagggagcaaactgcactcaaatatctagacatttggctccaggaagcagcagggtcagacttgagcccgtggttcagaacatgagcccatgttctacaacttaccatcaagaacatgttttgccatttagcacagatgagttggctgttccttgtttacattcataattattcctccaccctttgttaccagttttgagaaacaactttaataaattaagattcacttcacaattaggtgtttcacaagctatagcaaacaaaagaacccaaaccaagaagacctattccc

SEQ ID NO: 107036 - DNA, 1056 bp, Homo sapiens
tgctacacttgagtgagttaaagagttctgctcccagcctcagtttcccatcctgacttaccccctgattcttagagcaaaagcactccagagcaaacatcttttttgcttttctttctgggaaaggaacaattctggacataactttccttggattgattgaaaaacttgagatacatcctcgataccttttgttctttaacctcccatccggtctgtctttgaatcctgcggattttacctcctaaatacattttgaatctattcacagctctccagctcactcaaatgaccaccgtggtccaaaccagagtttctgaatcagcactgccaacattttggaatggataattcttgggtgtgggtgtgttgttggtggtggtggtagtggtgatgggggtgggaggctgacctgtgcattgtaggatgtttagcaacatcccgggcatctacctacctacctactagaggctagtagcgctttccaagtagtatcaacagtatttgtggacattgccaaacgtcccttgaggggcaaaattggcctttgtctcagacactcttgcctggaccataactctttcctctacaaatcttcttgctcctcttcaattccttctttacctagcatcaggaattaatctcttataaatgtgtatcttttatcactctccctcaagcctcctatgctgtcccatttctcttggttggctataaggtccaacatgctctggatcctaccggcttccacctgcctggattcttctccccttcatcctcttctttcagcttctcatgtctctgagagtcgatgcatgtgcccctgagctcctctctgcctccaggcctttgcacttgctcttctgtctacctggaacaatcttaccaagtactctgcactaaataacctgcaaaatttccacttctctcctcttgcccacagcctttctgtctgcacttaggatttgcttatcactagacaatggttctttctattctcatctcagctgaagcatcactacctctaggaagccaggcctctcggacctcgcagac

SEQ ID NO: 107037 - DNA, 1021 bp, Homo sapiens
gatccgttcgggaaggggctcgaagagaacccttgggagaaagcagtagcctcagctccaaactcagcgagcttttctcggctggcgttttgtctcctatagcgtagactgtaagagaacagaaaggagtttcccgagaagattcaggctggcgtcctgggctggcccgtcccttctggcgagcctcagtgtcctcccacgcgcttctgccttccagcctcctccctttttcggggggctggcgggaggcatccaaggcacgatgtatgtgcgctcgcgctcgcgcaaatacggccggaggagtcctgttcctcgggcattttccgaggaagtctggatcaattaggctcagtccggggagagccagcgagcgcgcgggcggcgtagccggcctgtctgggccgcctcgtggggagggagggggcgcccggccgcccggcggcgaccccggggcctggccgccaccatgggcttcgagctggaccgcttcgacggcgacgtggacccggacctgaagtgcgcgctgtgccacaaggtcctggaggacccgctgaccacgccgtgcggccacgtcttctgcgccggctgcgtgctgccctgggtggtgcaggagggcagctgcccggcgcgctgccgcggtcgcctgtcggccaaagagctcaaccacgtcctgccgctcaagcgccttatcctcaagctggacatcaagtgcgcgtacgcgacgcgcggctgcggccgggtggtcaagctgcagcagctgccggagcacctcgagcgctgcgacttcgcgcccgcgcgctgtcgccacgcgggttgcggccaggtgctgctgcggcgcgacgtggaggcgcacatgcgcgacgcctgcgacgcgcggccagtgggccgctgccaggagggctgcgggctacccttgacgcacggcgagcagcgcgcgggcggccactgctgcgcgcgagcgctgcgggcgcacaacggcgcgctccaggcccgcctgggcgcgctgcacaaggcgctcaag

SEQ ID NO: 107038 - DNA, 1006 bp, Homo sapiens
aacaaaacaaaacaaaaacactggtaccagcagatgggttgaagtggtaccaggactgaaagcaagatccctcattagcagcaatccacctgtctgagcaaaacagtattacagcctgaactaaagaaatgacagtgggaatgaagtgaagccttgaggagtttgagaaaatgttatatcaacaagacctgttgattagaggcatgatttgaagagaagacaggagtcgaggataaatcctagatttccaggttaggattcagggagcatggcagacccattcagagtgacagggaaccttatagaaatggcagaaatgagggcaaataggataagttcagtttgggattggttgagtttgaagtacctactgaaaaaccaactggatatatccgtgcatacaaaggttgactgaatctggaacttaggagaaagactcaggctatagaaacagagatttatgtgtcatgagcttggagatggtagctgagccattgtagtggatacaactttctaggaagggtagatgtctttaaatggtagaggctgtacagcttacctctgaaactctcgtacatacaagttatcagtagagagaactgtgttacagcctcatttaatgatttagtgattgatttattaaataaatgccaagtcacctggtgctcaactattctaaacgtcataattactggcattcagtattgagtaaaggtttttctttttcttattttggctttttttgtttgtttgttttatattggtattatacagtccaatattgggtaaagttattgtgctttttttctccctgcagcaagaaacattttggaataaacaaaaatgtactgcctttttcagtattccatagtatttcaccaggtgtcaatgtttttgtgctatttcattcattcattcacttaaatccacctatttccaaaagagacaaatcaaaactgtatgttttgtctcttttaaggaaactaacattgaaaaagacccttga

SEQ ID NO: 107039 - DNA, 1055 bp, Homo sapiens
ccacactgtcttccacaatggttgtactatttacactcccaccaacagtgtaaaagcattccattctctccacaacctcactagcatctattgttttttgactttttaatagctaatggatgctggggttaatatctgggtgattgcatgatctgtgcagcaaaccaccatggcacatgtttacccatgtaacaaacctgcacatcctgtacatgtaccctgagcttaaaataaaagtgggaaattgaaaaacaaaataaaaattatgaatttctgtgcatttttgttccaatgttttatttcaacttcagaaagggcattataaaagagacaagagtctatgctgtggatcaggttaggtaaagaggaagaggaggcttagataagaagcaagtaatttatatttagtttccatttttacgatcagaaaaatagcatctctcttatacatttgttcaatttttttcttcattgacttttactatattcttaccggaataaagtcacgaatctttagccttttgaaatattttgttcttacttttcatgtgcactctgcatgacactttttacaggtcagtaatgtcatactaccttattatcttgctgaatattttatgcataggcacttctttctatatttgcttttacaactttgctggtcttccgttgactcccaaatactagctttctggtgatgctaataccttttgcaagtctgttatacctgtttcagtttttataaaagtacaccgaaatttctgatgcacttttaaatagtgtaattaacatacaaaattttgaaattaggaaatcatgaatataattataaaaattatgatttaagtatattattgccctcttatttaatgtatacatagtatttactaataaaaactactatagcctcagattatttctcaaatccaattatatgtcttactctgccatccagtcacttcagagtgaataattgctttgtaataaataaattaccttattaggaagatggattaagtagatatctgcatgattccaagtattttccttatgaa

SEQ ID NO: 107040 - DNA, 1759 bp, Homo sapiens
aagggaaaaaagagtgattttgagggaacacatagcctgcctcagctacgtcagatttctctcctatatgggtttgttgatgcctgctgaggtgtgacttctggcaaaaggttttcccacattccttacattcataaggtttttctcctgtgtgtgttctctgatgtatactgaggcctgacttctgggagaaagttttcctacattcattacatctaaagggtttttcccctgtgtgagttctgtgatgtacaaagagttttgacttctgggagaaggttttcctacattctttacattcaaatggcttctcacctgtgtgagttctctgatgtatggtgagaactgtcttatcgtaaaaagttttcctacattcatcacattcatagggtttctctcctgagtgagtcccctgatgcgtactgaggtttgacttgtgacaaaaggttttcccacactcattacattcataaggtttttctccggtatgggttctatgatgtacagtgaggactgacttctgacaaggtttttccacatttgctacattcatagggtttctcccccgtgtgaataccttgatgcttctgaagatttgccttctgatgaaaggattttccacattcattacattcatagggcttttccccggtgtgagttctctgatgtataataaggtatgatttctgacaaaaagtttttccacattcattacatccatacggtttttccccgtgtgagttctctggtgtatggtgaggaatgacttgcgatgaaaggtttttccacattcattacatacgtaaggtttctctcctgtgtgagttccctgatgggtgctgagatttgacttctgacgaaaggtttttccacattcattacattcatagggtctttcccctgtgtgagttctcttgtgtatcccaaggtttaacttattgataaaggttttctcacattcattacattcatagggttttttgccagcatgagttctctgatgtatagttaggaatgacttacagtgaaaggattttccacattcattacattcatagggtttttcccctgtgtgagttctgtgatgtactgtaaggtatgacttgtggctatatgtttttccacattcgttacatgcgtatggtttttccccagcatgagttctctgatggacagtgaggaatgacttacagcgaaaggttttcccacattcattgcattcgtagggtttttcccctgtgtgagtccattgatggatagtgaggaatgacttacggtgaaacgttttcccacattcattgcattcatagggtttttcccctgtgtgagttctctgatgtaacctgaggtttgacttattgataaagggttttccacactcattacattcatacggtttttcccctgtgtgtgttctctgatggacagtaagccttgacttatggctaaatgcttcttcacaatggtcacatgcatagggcttttcccctgtgtgagttctatgatgtattgtgaggtatgacttctggctaaaggtttttccacattcactacactgatagggcttttcccctgagtgagttctgtgatgtaaagtgagaagtgacttacagtgaaaagtttttccacattcaatacatttgtagggtttatcccctgtgtgagttctctcatgtaaagtgaggaatgacttacggcgaaaggttttaccacattcattgcatccatagggcttttcccctgtgtgaattctctgatg

SEQ ID NO: 107041 - DNA, 1452 bp, Homo sapiens
agaagcatttagccataagtcaaggcttactgtccatcagagaacacacacaggggaaaaaccgtatgaatgtaatgagtgtggaaaaccctttatcaataagtcaaacctcaggttacatcagagaactcacacaggggaaaaaccctatgaatgcaatgaatgtgggaaaacgtttcaccgtaagtcattcctcactatccatcaatggactcacacaggggaaaaaccctacgaatgcaatgaatgtgggaaaacctttcgctgtaagtcattcctcactgtccatcagagaactcatgctggggaaaaaccatacgcatgtaacgaatgtggaaaaacatatagccacaagtcataccttacagtacatcacagaactcacacaggggaaaaaccctatgaatgtaatgaatgtggaaaatcctttcactgtaagtcattcctaactatacatcagagaactcatgctggcaaaaaaccctatgaatgtaatgaatgtgagaaaacctttatcaataagttaaaccttgggatacacaagagaactcacacaggggaaagaccctatgaatgtaatgaatgtggaaaaacctttcgtcagaagtcaaatctcagcacccatcagggaactcacacaggagagaaaccttacgtatgtaatgaatgtggaaaaacctttcatcgcaagtcattcctcaccatacaccagagaactcacacggggaaaaaccgtatggatgtaatgaatgtggaaaaactttttgtcagaaatcataccttattatacatcagagaactcacaccggggaaaagccctatgaatgtaatgaatgtggaaaatcctttcatcagaaggcaaatcttcagaagcatcaaggtattcacacgggggagaaaccctatgaatgtagcaaatgtggaaaaaccttgtcagaagtcagtcctcactgtacatcatagaacccataccggagaaaaaccttatgaatgtaatgagtgtgggaaaaccttttgtcacaagtcaaacctcagtacgcatcaggggactcactcaggagagaaaccctatgaatgtgatgaatgtaggaaaactttttacgataagacagttctcaccatacatcagagaactcacacaggtgagaagccatttgaatgtaaagaatgtaggaaaaccttctcccagaagtcaaaactctttgtacatcacagaactcacacaggggaaaaaccctttagatgtaatgaatgtaggaaaactttctcccagaagtcaggcctcagtatacatcagagaacacacacaggagaaaaaccttatgaatgtaaggaatgtgggaaaaccttttgccagaagtcacacctcagcaggcatcaacaaacccatataggagagaaatctgacgtagctgaggcaggctatgtgttccctcaaaatcactctttttt

SEQ ID NO: 107042 - DNA, 1285 bp, Homo sapiens
tgcttccatgcttaggagacagaaaaatggccatctcctatacctaccagttgctgacccaggaaaaactggctatcttcaaagaagaataaagaaaaaatagcagctattaaaacagccactattgttatatgaataaataaaaaaaaagagagaaaacatatgacaataatgagcacttattaaaacctatgagtaggaagtagatgcatattattaccaaataattctttgtgaaataaaaaagaacaggaaaacttcaaaatgcaaagaaaaactcaattgaacattagaaaatatactgatttattacattatgtcagtaggaacagaaaccatatgcatataaaaccaatacccatatttatttttgtcaaatcttactccactgagataggaagtaattttttttacctttacacaagcattctgtaagacatgctcatgtgtggttcatggataccttttttctcatttcagctgtccagatcattgatgaccttattgaaaggagccatgaaagtcatgatagatttttctggcaaattgtaatcaccaacagcaacacatcaactcaggagagagttgaattaggaaaaacatttaatttgaactcaaaccatgttttaaatctgattataaataatggaaacagttcaggaatgaagcctgggcagtttaatgattgccagaacatgcttttccctattaagcctggggagacacagtctggagagaaacctcatgtctgtgatataaccaggagatcccacagacatcatgaacatcttactcagcatcacaagattcaaactctgctgcagacttttcaatgtaatgaacaagggaaaaccttcaacacggaggcaatgttctttatacataagagggttcatatagtacagacctttggtaaatataatgaatatgagaaagcctgtaataactcagctgttattgtccaagtgataactcaggtaggacagccaacttgctgtagaaagtctgacttcactaaacatcagcagacacacacaggagagaaaccctatgaatgtgttgaatgtgagaaaccctccattagcaaatcagaccttatgctacagtgcaagatgcctactgaggaaaaaccttatgcctgtaactggtgtgaaaaattgttcagctataagtccagcctcattatccatcagagaattcacacaggggaaaagccctatggatgcaatgaatgtggtaaaacctttcgccgtaagtcattcctcactttacatgagagaactca

SEQ ID NO: 107043 - DNA, 1043 bp, Homo sapiens
catagtattatgaaaacctacatgatatgtatatttttatttatatgtttttggtatataggtaactaggtggctcagagccattattgaatatcgttttctgcacttcatctgcaatgccaatatcaggtttctgtgtatgtttcatcatcatcttatgggactattgtgatatacatgtttcatcattgactgaaatgttattatgcagctcatgactgtatacaggaggatgtgcataagttatatgcaaatatgagaatagtttatataagagagttatccaatctgtggattttgatatctgggggtatcttggaatcagtccccatggatactgaggaagtaatataatgtaaaaacgataggtgcataagaatttttgaaattgggtcaaatatttaaatgcagaatcactgcataatcagttccttaaatattgcatttagctttcatcactgtccaggatcattcatctaggcatggtgctgtccagagttccattaaagtggtgtgtgttctctttgcctttgtgagtagacttctgatactttctcatagtcagagaattcatggttcatgtggaagagccaaacacctgatttttcagtaaagtggaacctcatggtgcaaaataaacaaaacttattttctccttctcttatcttagtctgcattgaacttgtgtctcaatgagttcacctaaacattattcccagtatgtgtttatacttatatattcataaccagatcatgagctcctttgaggagtagaattttattcttttttttttttttttttgagaggtaggctctctgttggtcaggctggagtgcagtggtgtgatcataactcactgcactgtcaaactcctggactcaagcaatccttcagcctcagcttccagagtagccaggactacaggcatgcagcattatgcctatatttttttattatttttgtagagacagggtcttgcattttgtttatacttttatccctagcaataagggtggttctagatctataaggtgaactttgt

SEQ ID NO: 107044 - DNA, 1133 bp, Homo sapiens
aaaaaatctcgtcaacagatttttcctgctccctaggatgtgttgagttgcttctttttctcagataccacatatgaatattaacaaaagaacagtatgcacaagagaaatgctttttttgtaaactcaacggaacgaatgttaacagttttaggaatctgttacgttaagggagggggatgtccatatgcgtgtgagtatttttaggtaagtaaattgccttccaaaggagccacatctgcagctttggttttcgttttctcactactcacactgataatgacagggtcattgaggagatggtcgcaggaaatcctatgaaacagacactgccttttgtgaaaatagggaaaaaaatgcatcttcatttttttttttttttttttttttttttttggctaagatgatgaaagggtagactcccattactggagtctgtttaaccaattgacaccatttttcttcgtagttactttatgtaaggataaggaatttgctgagggttattaaaacactggggaaaacaggaggggaagtttgcatattgaatattattcatgaattaaaagcaacattattttttggagtttttgtttctttatattgggaaaaactataaacttttttcatctcattcagttttaaaatgaggaaacttattgtgataaaacagcaagcacattatagaaatatttcacaacatgtccagtgtgccagtcatccatttattgcctttcaggctcaaatccattcttgtttgtcctgtttaatgacactgaagctggacctgtaaacacatctcctttgccagctggcagattgttacactttgttggtagagggtatggcgggggtcagtgtaagaggaaggtattcttttacacgttctggtgtgatttataattattactcctagggcatgactgccattggagaggagacactgagtcatactcaccttacagcaagtttaccagcactccctgagaagttgagaagcttcctaataagtttcatgagctcctaagctggaaatttcccagcaggttttattgggaccagcaggtgacttcatgcttggtagcactgtgctgcatcatctcagcaaactatactatcccgaggccacagct

SEQ ID NO: 107045 - DNA, 1050 bp, Homo sapiens
cctaaaaggatatcagctttttaaacttttctgctgcaatttagctcctcttgctacaagaagatcagggtaacctaaatcttcttttattttcacgagacatgagagttgtgtccagcaaaatcataacttttgtacctggtcgtttttagaacaggacttataaaacattaacatatagacaaatcacctggggatcttgtaaaaatgcagaattgaattctgcaattctggtgagcgaccccagattctgcatttctattaagccaccaggtgatatccattctactctgagtagcaacaaggtcctagaagacactgagaagggatagtccatcaaatcttgaaagtactaccaaagttttgatgtaaaaatcatgcaaatctaaataactcaagaagaagataatataatgcagcaggaattattattatgtcttcttctataagtaggtaaagaaaactgagctcaggaaaatgtcaccagccacacagaccagtgccctatattcctgtcaacagatagtaattctttaaatttctcattaatactcataaaatatttactataccaacaatgtaattgatgcactaatattctattttgagtcatatgatccctctcaacccttcttctggaagcagagtttgaacagcatcagatacatatatttaattatttattttcatatgatttatgatattacatttagcaaataaatatatttgttataatatatttatattaataatctaatataaattatataacaaaacatcattagggacaaaattgtgagccaatgctgtgattgatggcatttaaaaataaacacaattataaggtacttctataaagctcaagtggaaatgggataaagactccctcaccttttgctttgtagattattaacaaacaacatttgtttttgttattttaaaatcagtgaaaaggttgaaatagtggcatgagtatcagatttgaaaatgagaaggcttgtaataaaataactacttgtgtgatcaaaactgccatgagcctctgcttct

SEQ ID NO: 107046 - DNA, 1032 bp, Homo sapiens
tcctcacttatgattttaacatacctggtggagtaagtggaaatgtaccagccatctccacccatatgtaaacagagagctttaatagttaatacagaagcacatatacttcctgaactgtcagctgtcaaaaataccatgaataaataagggggtaggtattattcatgaaaaagagaagcttggcttagaaatcttgtagtaataaagccttaatccctgccaatcatcctatcttaagaggaaggaacttcatttaatgcaaatccagtgataacagttttcacccaaactaaaagcaacatggaagatcctcctgtaaggctctactgattccctgtaccgagaaagaattgtatacttccattcaacacagataatatttcaactttaatttacattttatgcaaaaatagtatactctttcttacaaagttggtagaagcaattattctatgactttaagcaactcagttttatacatttactactgatggttatgttttatgcacggtgacatgattatctgttgtctgagagattaaaaattttcagctttagtatgggacctcatcatttatttccttctctcctacaaactataaatggcatagaatataatgaaaaatataatatttggagagcaatcttagcatcaaagtcagaaatggaaagaaacttaaggattattttaatagccctcaaaatagagacgatattgatttatgcatctcttttccgtttaatatcctcttcctgatataagaattgactatgcctaaaccggacactttttaataatgcttttcctttttcttttcttgctccctccctcctttcccctgcctttactctctcacatcttcactctctccctccttccttctctttccctttctccccctttttaaaatctccttcaatgtagtttacagtctctaaattctttctttagctttagatattcacaggacaatacagaactcttgatgtggattaagattttgtcactcataaaaggtggaatgttcc

SEQ ID NO: 107047 - DNA, 1038 bp, Homo sapiens
tttctgtcatttgtaaccaaaaatttctaactaacagacatttttatatttgactttttaggagtttgggctattctactttcagttttcgtaaaaccttattagtccaatgttaatggctgaggacactggaaaactagctcaaggtcacaaagctagtaattgtcagagctgtgaatcaaatcaaagccttgtttatttgtttttttcctcctaatgtctcatacacagattaaacacctgaggggtactgagactggcttggtgaccagaaataactctcattggccctgcctcagagtctgaaatccttagcattctccacttctttctgttaaaggcagctgtttaaatgcaaattatatctgggaaggtgtcacattaatagctactaccagctattaactcctaaacacaaatcaatgtgcttgttcggtagactagacaggactctaaaagaatctatagtttgaaggaaatctttgaacagagaatgaggaagatgggaaaggttgtgagcataaggatgctgtcacgatgggggccttggacaagtgacagaccataagtgctgggaggtgagcagaccatgacacatgccggtaggacaggggaagcaatctgcaagggctgttaggagtgataaaagcaaagactgcctgctttacatttttgcatacaaccatttcaaattctggcatccattttggtcatgtttcagtctttatgataaaattcaggaaattaccctcccccttgagtgtgtagtatgttttaaatatgaaggattaatccaagactgccaaacctaattcacataaggttctagcatgagctcacatttgatgatcattaacatctttcacctattcttcaaattctttaatgaataaatgtatcttttttccttagaatacaggacaattggacctttcttcttcagtgtcatatacatatataatgtaaactatgatgctaaaaagattaaatcatgtgacgaacattaccatgttgctttgttgtcagaaacataactaa

SEQ ID NO: 107048 - DNA, 2308 bp, Homo sapiens
aaagctcaatgtatttcgattttgaggtttagaatgagaaagactttcctcctgcaaacagagaagttgtttttcaggtcttagtttattttaaaatagaagtagccttttgggggaacagaatggccttactgttaactccagtatttaaaaccaacaaaagcagagttgtaatgttgacttggggctgaggggattagataactcaacacattccttcccgcttctcagagccctgtgtcccaccacgcaacaccggggcactgtgcagaacccagtttggtacttgttgaatttgctgtgaagaccaattaaggttgatgaatgaattagttgacatgagccctttccaacatagtccattgaataaatgaaaagacacattaaattataataataataaatgcatataaataaatataacacaatcctcttaagatttattttcaaatgtgacaataacgtatctcttacaggaaactgaaagctgaagacaaccaagaggcttatgagatctaatgtgaaaatcatcactcaagatgcctcctgtcagatgacacatgacgccagataaaatgttcagtgcaatcagagtgtacaaattgtcgtttttattcctcttattgggatatcattttaaaaactttattgggtttttattgttgttgtttgatccctaaccctacaaagagccttcctattcccctcgctgttggagcaaaccattataccttacttccagcaagcaaagtgctttgacttcttgcttcagtcatcagccagcaagagggaacaaaactgttcttttgcattttgccgctgagatatggcattgcactgcttatatgccaagctaatttatagcaagatattgatcaaatatagaaagttgatattcaacctcacaagggctctcaaagtataatctttctatagccaactgctaatgcaaattaaaacatatttcattttaacatgatttcaaaatcagtttttcatactaccctttgctggaagaaactaaaaatatagcaaatgcagaaccacaaacaattcgaatggggtagaaacattgtaaatatttactctttgcaaaccctggtggtattttattttggcttcatttcaatcattgaagtatattcttattggaaatgtacttttggataagtagggctaagccagttggatctctggttgtctagtcattgtcataagtaaacctagtaaaaccttgttctatttttcaatcatcaaaaagtaattataaatacgtattacaaacaagtggatgtttttaatgaccaattgagtaagaacatccctgtcttaactggcctaaatttcttctggtagtgtcagttcaactttcagaagtgccacttaaggaagtttgatttttgtttttgtaatgcactgtttttaatctctctctctttttttttttttttttggttttaaaagcacaatcactaaactttatttgtaaaccattgtaactattaaccttttttgtcttattgaaaaaaaaaatgttgagaagcgtttttaacctgttttgttaatgctctatgtttgtatttggaatatttgaataatgacagatggtgaagtaacatgcatactttattgtgggccatgaaccaaatggttcttacttttcctggacttaaagaaaaaaagaggtttaagtttgttgtggccaatgtcgaaacctacaagatttccttaaaatctctaatagaggcattacttgctttcaattgacaaatgatgccctctgactagtagatttctatgatccttttttgtcattttatgaatatcattgattttataattggtgctatttgaagaaaaaaatgtacatttattcatagatagataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaaaatccaataatcagaaaagtaattttgtcacattatttattaaaaatgttctcaaatacatctttctttcttgtgttgatttcttttttcattgtgtgctgatcaaatttattccatttaatcacaaagtcgttctgtcttaacatttcacccctgtattatcagatgagtgaaaattctcaattagttgtatgaataaccag

SEQ ID NO: 107049 - DNA, 1014 bp, Homo sapiens
aattggaagccaagtctgactccaggtttggtttacctcttttaatgatattggtctgtagtgagtttgagatggacaagagcttatgagtggaatcaatccaaatccctgactactaacaggaaaacaacaaggcttatacttttcattttcaacacactatgctacattattcattatgcttatagagtgtcctcatttataccttaaatcactgatgcttccttattcagaattacagatagacaggagtgatacaatatacagtgaaagtgtatgatggtactcacctgcatttattatatttcattacacagaggatattctaccttattgtagacctacttttccaacatcaaataatcccagagatcccagttcctcaagctcaatgtcatcaagaggatcaggaagcagacaaagagaacaagcaaatgtaggtcgaagaaatattgcagaaatgcaggtacttggaggatatgaaagaggagaagataataatgaagaattagaggtatctataatttttccccaagtttaccaatgttagactgtggttgttttatgtagttaggaaccttcatcagtgtacagaaatgttactgttttattgcaaacttttcagtactctaatgtctatgatggcagaaactgaagttctgagaatttgagaattttcttgaaatgtgtcccaaagttttaaatgttaatggcagtttatttgtttagctagggtttatcttcatttgcagattttcagataagaaacatatatggcaaacacattgttaagaagtaagagctgttgatctagagctattataattcatagcattgtagcaggctataaaaacccagtaagatgacagagttatatgatgtgagtgaggaagttgccatagtcagcaccagggtaatgtggctggtttggctaactgtccttcacctttacacttctgaaagtgtatgcctagtctgtgacactgacctccccagttggaggaaacttcttac

SEQ ID NO: 107050 - DNA, 1525 bp, Homo sapiens
taaaactgagctgtcagaatattatctgattttgaagggttattacagtggctttttgcatgtttgcctctgtgaagggacaaacactaggtataaatcccccaactctaccagcaattttacatttatgggaccaccagaatggcatttttcaagttttatggctgttttatcaaattttattatctagaagagagtgcttctcactgaaaaactgaccaaacatcaagcctggatgtaaacacatctaaattgaatacataagggagaaaatctggcctaaagccttgtgtagatctttctaccacatatttatacttgttcaaaggggaatctggcattgagtgatgctttttaaaaatgttttaaataatgtaagcatgccaagttaaagaatattgtatcacagttataaattacactatgcttgaaaattgtctgtatttattgtcccacgttccgtagtacttgtttcagtgttaataattaaatataattctaactaatccctgaataataactattaaattgaatgatgatgcctccaagttatgttttaaattaatttcagaaataccaaagacatatattgaaatatttatgaagccaaaagttaatctgaaatgtttatttggatttctaattgctcattccgcaaaagtgattatgcaaaattatgatagtgtatactgcaatgtaaaagccaataattattttctctaagtcacaaaaatagataaaatggagaaatgactaaagctattacagcattcactttctttcaatattttggtaactatccttcaagttatgtttactgtactaacaagtctttatgctgaatgcttactgtttggtaaagaaacacaaaataacaatgctgtgtcttattatatacatatcccatcatgcatattgattaaagtcatataatgcagattcttgttaatgcactaaataaaagaaatgcagacacgctggatggcagtggttatgacgtagagacaaaagccattttttcggaaattattttcccaaagtactacactgcatttttggaaaaaatattcatagaccaactcatgaagaagctcaatggcagacacaattggtacaatttattaaaaaagagaagggagaggaagaaaaaatttaaagagctaccgattgttaaaatgtgaattgaacatatttgtaagacatgaaggattttgtggggttttttttctttttagtgggcaaaatgtatggattatgatggatgagtttgattattgtcaatacatttatgtgaactattgttcagaatatggtttgtcagtattgattttgtagcatctttactttgtaaattttgttcagattatgacattcctttgtagagtctttaaaaactatataaagaaggataaagagtggccatgtctgaacggataaagagtaatttgcgatgatccttctcagttaatccttgtattagtttgctagggccgccataacaaagtaccatagaccaggtggcttc

SEQ ID NO: 107051 - DNA, 1033 bp, Homo sapiens
ttcagctgaagaaatagtgatctactataatttcagagaaaaaaaaatgggttgtattggactgaacaggttgacctccattatatctttctctgcaaagattgttaagagtaatttttcttggctgggcacagtggctcacgcctgtaatcccagcactttgggaggctgaggcggatggatcacttgaagtcagcagttcgagaccagcctaaccaacatggtgaaaccccatctctactaaaaatacaaaaattaactgggcatggtgatgagcacctgtaatcccagctactcaggaggctgagccaaaagaattgcttgaacctgggaggtggaggttgcgttgagctgagattgtgccattgcactccagcctgggcaacaagagcgaaactccatctcaaaaaaaaaaaaaaaagagtaatttttctctaaatgtagcagctcatcttcaggtcctctgtaataccatctttgagtcttttagagaacatattggagggacaaaatataccaaatacatttgggctgtactaaattaagccatgttaagtgaatttttttattgcatgacttctaagaccctataacatgctaatgtcaattacaatcccttagagaaaaatagtttatgcagtaattcacaaaccttgtgaggtaaaacctttttcaataatatctccttaatgtgactgagaacgttcagatttgaaaaacaatttaaaggtgacatttcattactatccaaatagtttatttgaataacctgaagtaagtctacacatccttatcatttattttagctatgaccaagaaatgccatgtcccgtgccaccagcaaggatgtatttgcaacaagatgaattagaagaggaggaagatgaacgaggccccactccccctgttcggggagcagcttcttctccagctgccgtgtcctatagccatcagtccactgccactctgactccctccccacaggaagaactccagcccatgttacaggattgtccagaggagactggccaca

SEQ ID NO: 107052 - DNA, 1061 bp, Homo sapiens
caggtcttgaaatttttgaaagataatcgtgtgaatttataccacaacgatgggatcctgaaggctatttgttcttagatattatcaccttatgctgagaactctgtagaaatgtaaactttactggattgtttctcccaaagacttaacaagtataataatccacatgatagcaattaggaagctagtgtacctctttctcactccagaatctgtagaactggacatggtaccaccaaatgaaacaaaacagctgcttctttaacataaccaaagggggaaaactcctttaaggtggagaattaacgaataaatcgtaaaatatacctgaaaatacagttttttctgtgactgctgtaaagacatcattccttcattctccacacacagagaagtgtattactatgcccagaaacaaagcctctgtgcttcaggtttctaataatctttttataaaatgcatttttaagtaaaattcttatataaaaatattgacagggaaatctcattatccacaatatttatgtgttttaaaattcttgtgaacagtgagttagcaaatgttgaaccattcattgggcctaggagaaatacagggctaggttccttctaacctctagccacaacatatttgtccactgaccaatacataaccttgttttatgtatgtgtttttaaagaggcttatttaatatatattgttcatttattaacatggaacccaataagccatgcctcagcaaagctgatttcgtagatatatttctttaaggcacattacagccttctagggcgtggaaacactaacaagcccttcagcacttcttttgagggccattttaagcagggaaatcactaatataaagcttaaaacatttcgacaaacatggcactaaataaaccatgaaaaggacgcttgtttaccgtgtgagaactgacacaagaaagcaaagtgtatccttgttttacctcagctgggaacatgcacatcaggcgctcaaatttttggcctctttgtgagtctgtgggaatatgaccatgaaaatgccacagataccaat

SEQ ID NO: 107053 - DNA, 1471 bp, Homo sapiens
agctaatttttatatttttagtagagatagggttttaccatgttggccaggctggtcaaatgtatttatgttgataagaatgtatgtgattacaatttcttttaccttttttgcttgtttgttgttttttgagatagaatctcgctcttcacctaggctggagtgcagtggcattaacacagctcactgcaacctccacctcctgggctcaactaatcctctcacctcagcctcccaagtagctgagatcacaggcacgcaccaccatgcctggctaatttaaaaaattttttttgtagagatgcaggtcttgctatgttgctcaggctggtctcaaattcctgggctcaggcagccctcctgcctcagcctcccaaagtgttgggattacaggggtgagctactgtgcctggcatataatttttaattgtaattaaataatctttaatcatatttaatcatttttgagattttgggagtaacacagatcaaaaggtaaataaattcatagttataatgaaccaaattctttaatagcaaaaataataataatctacaacagtaataacaaaaaaatttaaataaaaattaactgaaatttaaaatcagattttatggtatagtagcaaatcctgaggacacgatatatatatatatgtacatattaagtgtgtgtgtatatatatacacacatatatgtatgtatatacacctatatgtaagtatatatatacacatatacatatatgtatgtgtgtatacacacatacatatatgtatataagtgtatatatatacacacatacacacatatatatacacacacacacactgcaggtgtgcatgcatacatttattttctattgtttgttttttgagtcagatgtatgtgtgagtaaattatcttgctaaaatttcatgccaaaacataatagtaaaaaatcagatgtacagtctgcaagatttaaaggaataaaaattaccaaagatttcttaccaaacaacccctcccccccccaaaaaaaaacccaatattgccaatataggaaatattaaaattattgtatggaatctctatgatgatagaagtaaaataacctgtggaattacggaaaggcgagagagaagttggatttaagtaaagatgctatgcactataaagaacaaatcatagagcagtctgcatgtctgcccttaaagcgaatcctgagtgtccactggacgtggatgtgacgtatccatgtgaccaagtctctgtcctctagaggcccatattctgaatgtctagacagatagatactcatgtaatcataagtacaagaaaaactgggttgagacctataggagagaaaaaatggcgatacccatttaataggtagagctgtgttgtccaatatggtagccattggcaacagatggctatttacattgaatttaataaaatatagtttaaaactcagtccctcttttg

SEQ ID NO: 107054 - DNA, 1040 bp, Homo sapiens
ctatgtgctagaataagaaccatggaaggtgaaatatcagatttcttgcttcccaggtaaataagaaacataattattgcattttaacatagaaaataaaaccaccaagaaaatctttgcagagtctgtaatgccagtctgtttattgtgaatgggacgtcacctcttttgctgaatggaggtaagtatgaagtcggtgctggaaaaggaaatgaagaatcccactcttcaactccagtttgagtccctggctctgttggtccaaggctcccattaataatcgctgatgtacttggcattcccaatgcacagtaaaagaggaatagcatcttctgccaaaaaataacaaaatgaacactaatattctttttagtggacatctctgttttatcagatttaattcatcagctttcctttgcttatgttgggatttatgacattttacattgtcaccatcagaaaatgttgacaagcttacagaactatgctctgaaacattgatgaggatctgtgtaaaatgtcacagagccccaaactcattaagtatgaaacatggttttggagaaaaatacgccagtacatttaatttgaagaatctattgtctgagtaaagaggcttgtttcattttttaatgaagttgtaaggagtcacaattttttaatgggtcaaaatgaagaagtgccaactatctgaactagggtatttttttaaaccactaaaagactcaaaaatatgttcatattccatgtttgatttttaaccattatgactaaaggcagagtagaacattgcaaatgatacgagattttaggtctgatgcataactcttcccgtgtacagttatggctatgtaaatggaggcacatcccagaaccttatattacagttgcctgtgtgtagaataaaagggataataatgtcattcagcatagttcatcagatgatttgtgagcataacaagatgaggaatttattggaattttaaatagaaaatattactctctattcatataacatttgctttaatatttttttttta

SEQ ID NO: 107055 - DNA, 1036 bp, Homo sapiens
agcaaagtgtataaaaattcctgcccttccagaccttacattatagtggcggaaatgcgagatgaataataaacatttttttaaaaagtcagctgtacaatatcagcagttgataaatgctacggaaaaaataaaataggatgaggacaataaggatgctttacgaaggggcctcattcctagccacttacggatgtgtgtgtcattgtgtgtgtatgtgtgtctgtgtctatgtttcgtgatctagtgagatcagagagggaataatgaaccaaactcctacactgacttctcttgtgtctgccccttaagcactggtttccctcatgtgtttcagactttctgagtcctcactggacctcctacctcacatagttaatgacaccaaagccaaaaccttccagccatcctcttggacctcctgtatccattactgcattttgttgatgctgtctcttactcctttcactctcatattgtttcatttcaagccctacttctcctttgcctaatctatgacaaaagctctcaggagtcctacctttatctataataccttcattagcattatttcctgctaattccctttgctcactggagacagaacgatcttttgaaatgcatattgatcatgtttctgagctccagaaaatcccattatcaataggacctatcatgtttagaatatcagatccaaactcggcataatatgcaaagtccacagctctaggtctctgcagacttacttcacacctcaaaatgtgccagaccctacaatccactgtgtcaccccacctgccatttgccaagattgcattctcttatgtgtccttactacactgtgcatgtattacataggtctggactgtctccccacccagcgacccttctcagtttactgaattccacctactatgccctccattaactctctaatgtggaattacctcaatgaagtgcgtaacataaggtgatgcggttatcttttgtttatgtcagaggtcagtgaattatggctcttgggccaaatccagcc

SEQ ID NO: 107056 - DNA, 1048 bp, Homo sapiens
gggtataaattggggacacagcactgaggtttttgcttttcttctttctagtatgctcagagataaagtggcttggtaagaagtgacaattgtagaggacgctatagcgtttcggtttgcaaaccccaaatgctccgattctacagtaaatttcttggagatgttcaaatgtgaaatagaaaatataattctggcagtgttttgatacatgataagtaatcaatattctagtttgtttctactaaagattattttaaagaaactttaatcttagagggaataacatatatttccttgcttttttttttttttaaccagagcagcgtttactttaatttaacatgaagagattggaaataagtcaatctcctccctctatgaaatgacatggaaattgctctgccgttatccaaccccccaggaatgggagaagataggaaaagtgggggaggaatggctgctacttttgaggtctgcggttcaatttcaggcattattgattagattaagatttataactgcagagagagtgaaggttttcagaagggtgttattgttctattgtttagcttctactgtggtattaaaagaatgtccagcctacttctaggaagcttctaaaagtaaactcaaagaaattaaaatttaaaactccagttttttctgtccattcacaagtttttatgatgataaaaaatgtcagttatgtgataagatgtcaggcatttccactcagtgaaatagttaaattttatggttctcttttattcagttcatctttttctttcctttcctttacttgtgttgtgtttgtttgtttgttgtttcttcttcccctttccttgcctttccttcttttccttctttctctcttttttttctctcaatgttaagtacataagtgcacctagtagttcactttaataagcatttactttcagatttctagataaggttccagcaagactctgataatacttatttaagaatccatcatcctgtgtttggagatgattaatagtggaggattcttgtttgtacgaaagcc

SEQ ID NO: 107057 - DNA, 1039 bp, Homo sapiens
cactattattatttacaattttaaagatgacccaaatatgccaagattttcacatacttttgctacttatccttaaactctgaagactgctgatatttttgtgttttttattctcaaaggaaattgttaacagtgtcagacagatgatcctccatgccccttagataccttcatcaattctgggcctcagatctgggctgtagattaggttagatggttgtaagtcccagttttcagagacaccccagtttatgtcattagtccaacaagatcaattctagtaccccttcttgctctcaaaattgtactgacttaaatggcagattatacaaattatagggcccatccttcagtcgaatgcaacagctttgctttgctgcaaagcaaatttaaagaggatttccaatttaaaaaagtctcctaccctaccatcaccaactttttcccacgaattttctacataagtgaacatttcttacatgtgttggccagattgtttctctgaccaattatatgacaaagtcagaatttttcatgttagctagaacttgaatgtccctatgcatagaccaaaacagtatgggacagcagtctaaaatatttgtgttgtccgtcacaaggggacttagcaagagtcaacacaaatgcatcactaatactataaaaataaatctccttgccgcctgcctgtggctcagcagcaatctcttcatgtacatgcatttgctttagcattatcatccttaaatatgtttttttcagatatgtgtcctctctagggatgaagcagtatgtcaatattcccgcctgtgaaatggaaaatgagggcttggaggttactgaaaagagaactggtgctcattatgtatacaaagtagaagaatgtcaggcacatgctaccatataaaacctttgactgaaaataattgtagacaaggggttttgggtgtctttgtgtggtggagtggggaaggggtagggtgtttggggtagaagatgtttggatttgaatgaggaaaagagtgactaattaacatat

SEQ ID NO: 107058 - DNA, 1954 bp, Homo sapiens
cttagaaatatttccaagtagtattaagtaggcttttaaaatcagaaaatcatcaaacattttagcttctcatccccttgacccagggatgtcctacatgcaatgtcagagctgccatcaggcctcacatttctgcatgaagcatagaagttaatgccaccgaaatttttatcaaaagatagtggaattttttcagtattctacttatttgaatgttttagctgaagattcttttggattttctatgagcacactcatgttgtccacaaataatgatttttattttttcctttctaattcttacacatttcttgtgtaagaatgtgggatgaagccagacagaattttgtgcattttataacgtttaatttttattattttctgatgaaccaatacaataatatgaataattacattttacttgtctttttaataggtagatcaacagtctcagtatatacaaggatataaaattctctatcggccatctggagccaaccacggagaatcagactggttagtttttgaagtgaggacgccagccaaaaacagtgtggtaatccctgatctcagaaagggagtcaactatgaaattaaggctcgccctttttttaatgaatttcaaggagcagatagtgaaatcaagtttgccaaaaccctggaagaaggcaagtatgatgaagcgtttgatttccatgcattgcagtatatttgttagaattttattagcttaatttaaattgttataatgttaatagtggcattaattactaactttcttgatattgaacatacattttgctaacagtatttgtttatttagaaaactagaaaagcaaaatgctataatagttgacttgcttcaatagtggcctacctcaaatgtgtaaatgtgaacattatattacttaatggcatatagaaatttaattattcagaactaaaattcacatttaaaaatgaaattgttttccgtttggtttattttccattcagcattttctatttgtttattttgatccatgatttgaataatgtgttgatttgcccaggacttcgtgggattagcattttcttcctaaatctcatctcttttaaaacacctcagttctagacaaatcactatagctgaccaccctattcctagaaattaaacaatatttacataaaggtaaaagattacattaactaacaacaggatttttcccaacatgtctttgtcactttggctgtataagtaattatcatgaatgattaatattcattttcatacttttgaacatttcgggggagaacatgagactagagttacacggtagaagaaataggaattgtcctgggatgtttggtggaaacaaggtatttaactttggttatggaaaattcaccgtggcagtgaattagcattgagtgaggaacaacttaggtagtttgggactattcagacttggatgagatacatctttaaaacatatgcagctgggcacagtggctcacgcctgtaaccccagcactttaggaggctgaggcgggcggatcacctgaagtcacgagttcgagaccagcctggccaaggcggtgaaaccccatctctattaaaaatacaaaaattagtggggcatggtggtgggtgcctgtaatcccagctactcagggggctgaggcaggagaatcgcttgaacccgggagggggaggttgcagtgagccgagatcatgtcacagcactacagcctagatgacagagcgagcctccgtctcaaaaaaaaaaaaaaaaaaaagcatatattgatatagtattaatacatctattattgggtttgatattaattacctgctttcagtgttctctagcacattctaataacctaccttttaaaacaatttaatagcacccagtgccccaccccaaggtgtaactgtatccaagaatgatggaaacggaactgcaattct

SEQ ID NO: 107059 - DNA, 1050 bp, Homo sapiens
cccagtggtgaagcaacatggagtgcttacattgaagttcaaggtaaagtaaatggtgtgtttcccttaaagtgaagcttaaaatgcagttgtttacttactgggatattgatgaagtaaatgtcctcttccctgagtaggtgtatgaatatgttatctgcatttatccgcttatctgtgtatgtgtaaacatcttttattttggcctttttcctgctttttagaatttggagttccagttcagcctccaagacctactgacccaaatttaatccctagtgccccatcaaaacctgaagtgacagatgtcagcagaaatacagtcacattatcgtggcaaccaaatttgaattcaggagcaactccaacatcttatattatagaagccttcaggtagagtgaaggagatgcttcctagttgttcttttttgattctccattaaatacgcatgttctaacctgtgtgtctatccttagccatgcatctggtagcagctggcagaccgtagcagagaatgtgaaaacagaaacatctgccattaaaggactcaaacctaatgcaatttaccttttccttgtgagggcagctaatgcatatggaattagtgatccaagccaaatatcagatccagtgaaaacacaaggtaaatattgatttacttaaacctgtgacacctacttatccttagatgttataattgcactgacaaatcacttgtgctacatgctagaattgtacatttacagtgtgttgttcaagttgcccaagttgcttaattaatttttaatatacaaacacaatgtctacaaactttattattttctggactaagcataccaacataagatggattaacaaagagaactgtttctcataaaattacaaatatatcaagacaaaaatattacgtgaggagatggaaagtagaatgatggttaccagaggctgggaagggtagtagggtggctgtggggagggtggggatggttaacgggtacaaaaaaaagaatagttagatctaatgaataagatctagtattagatagcaa

SEQ ID NO: 107060 - DNA, 1040 bp, Homo sapiens
gtgaaacaatatagcttactgtagactttattgccagtaggggataaacttttaaaaacttgcattcaaaaacacctctggaggaaagaaggcctactttgtaaatctgtggtttccataaatagagttcactatgtttaactttctgtcagcgtatgagatctttgtgtgagatccataggattttttggagctcgtatgatagctaggcataaaataagtaatgagagaaaaaactgggtccttcagttctgaatttcctttctttgatgtagacttcatttaaatcatttgttggaacagcttccttaagttgctgatttgagaaaatctggcaatataatagtgcattgtttctgaccattaacgtggttatttgagtcaaagccaaaactaatagtgtcaagggacctttttgcagagtcagcttaggtttagtataatccaagatcttggttgagaactgtgagttcatcaacattttgatgaaacacatattatgagacccccccaaggctttatttgacaattttaagaaccttgatatgtgtgtgctgcttttgccagactctgacaagacatagcaaactggatctttagggaatgattcttaatgacatatggcaataatccacagatgcccactaaagtcactagtgctacagtaagcagtgcttcaggggttggaggattttatatatatatatgtgtgtgtgtgtaaaatggtggtaaatatatatattaaatttatatatattgggtagatatatgtatatacacacatattcaatgtaatatatatttaccactgcttgtatgtatggatactcttaatactaatctcaagagtcttattcaaaatgctacccttaagggatttgttgtggaggtttgtgtgtctttcttctccttctcctcctcatcctcctcctcctcttcctcttgtttattttgtagttaaaataaggattaaaaaattttcaactgaggactaggggggctgatggggaaagagatttgttatggtaaaaagaaaacca

SEQ ID NO: 107061 - DNA, 1022 bp, Homo sapiens
gaactccaagtaaggctaaaactaagaaaagaaaacctcttcacatttacagaaagcataaatataagaggtgtcaaatccaagttcaaaagccctccagaaggagtgaaaatagccaggatgaatacaagacatgaaaaggtgtgtctatctccaggcaattgtgataaggaggttgactgtctattacgttagtcagtgaaatgtgtttcactttgtgttttaaagtactttaccttggtagcctgatgcttttataactaacagctattctactgtgtatacagtagacattgaaatcaaaatagagtttcttcctgcaattttaaattcagttacaaaattcatttagccttaagttttccgtatggaaatcttgctctctaagcctggatttcaaaggaaattggcactaatgatcaaatccagaaactacttgaatttagaagttctcatttcaactgcgttgtgttttctataaatgtttaaaagatctttatatagttgaggatatattattcaatattaaaataaaatatgcctattaacatcactgttaaaacatctttaacatgctggaataataaacacagtatgttaaagaaagtaacatgattcccaactgcaaaagataaataagaaaaaaacattcaaaggaaacctgagaagatatgccttttttcgtcttttgagactgaacgtagaaaaacaccagttactacaaaggaaactaatcagaattgaagccatttggtagcaggaaataattacagttaaaaaaattcagtagtgtaattgtattgttaaaaaactttccgtgttttgtgtatagctcatttttaaaaggcagtgttggagtcactacgagctcaaacataatctttctctccctcacatctcatacaatgagtatttaattttgatcattgatgttaaggcaataaagcccagtaatgcaggtagaagctgtgggaataaattaccttacataagggtggccatttgattttcacccccagcac

SEQ ID NO: 107062 - DNA, 1034 bp, Homo sapiens
ataaaacatttaaagtctggcaaatggtaagaatttaattaatggtcactatctttttgttttagtgtgagcacaggagcttgaggaaataagtaaataaatgccaactttaccccaaaatgttcttttagaaagtagtttaatatgttagtccacataattataaaaacaagcttttcttctgccagctgacttagaggaataccatgttttactctttgttttaagttatcagaaaagaatgtagcatgtgctttgaagcattgtgtgtataataatgagatctttcaagtagaaagtcacttaactgtgctttcttttgttatgtcattagatatgaaatccgagatgatcataccttgaaaattaggaaggtgacagctggtgacatgggttcatacacttgtgttgcagaaaatatggtgggcaaagctgaagcatctgctactctgactgttcaaggtaggcattgggaaaggctttgttttggtggttttagcatacaaaatatagtgctgataattgaagaaaatattatgtatagggctatgttacatatagactttaagtattgctctaaataatgtatttcaaacatatttaaagaacacatattgttttgcctatgggagctctgtaagtgttacaggaaattgaattaaatgttgaaaattatgttcaaaattgaattaaatgttcaagatagttcaaaaactatcttggtcaagtagaggcgaagaatgtgctttaaactccaggtcttcaaacatagagcccttctaatcttttaattaaatgacagctattgctgtcttggaggaaactttgtctttggaggaaaacaagtctttcattacttcaagatcatccactttcaggggcctgtacaatttgtaacagaaaaagaagattctattactcttcagaatgtaggatttattgagcagggactttgcaattgttttgtgcgcacagagtgcctgcatcataacaaacactcaataaatatcagttgattgaacgaattgcagttg

SEQ ID NO: 107063 - DNA, 1049 bp, Homo sapiens
attaagccaagtgtaatatataattggagctatagtaatagggtgtatactacaaattccttaggcctttatagctgtctttgaattttggtttacctcagctattgtttcctcccattcatcttgaaattggaattttttcatgtctgtgaatctcctggcagtgccctcattactcttgttaactaaatccccctccttctccatttgtatagattctttcaacatataatagcattgggctgtaatatataatgttaattggtggcccacgtgtgcataagcaagttgatttaaaactctacattcccaagtatttaagatttgtaacagtaaattagtactgtattatactgaagctgtagaaataaatctaagctgttgcaaattatttatatgttattatcctttgactcacaatttttctatgtatttgaatatgtcttaaaattgtccttaaagccttacattttatagtagataaaaaacattgaacacttactcactcttaaaacaaagagaatgttaaattatgtgtttgtttcctcttattttggtatatcttttatgtatcattgtacaattctttcagcaatgaacttgtctcctaaatatccagagacttcaaggttagattctgaggcataagaagaggctcggcgtgctatccaaagttatagaactaataaagaaacatctagctacacctcagctcacttaacttccatttcagatattggatttttcatcttcctcttttcctgtaataattttgtttccttaggatttttggaaatgcttatgcgagtgttccaaaatcagcgcatgaaaggttacaaaagttcttaggaagattttgataagatgatactcaaattgttctggacctcaagaactcaagttttttaaactcaagtttattaagcagtaattaagataataaggatgtgagctgtgcatttattttcatttgtacaactcgtatagccaaagacacatatcttttttttttaattatactttaagttttagggtgcatgtgcacaacc

SEQ ID NO: 107064 - DNA, 1035 bp, Homo sapiens
gtgatcacaaagctttaaaagcctattgcattagaaacaggcttttgtttaagtcacctttaagagcatcatattgtatgggaacatttcaaaagcagttgagcttaatctgtataatactggctggaaataatgtaaatttgtctctttgagtggatagagtacaatttactaaggaatccatgatttcttattccttagcctattcacatgcatggtgtcactcttctctcacctcgatatatgacatcactgtattgttccatgcatcatgtatataaaagatcatgccacatttccccatctttattagggaagcttataaatattctgattaacctttaaacattcatgataataagcacatgtttgcatgggaagagaagaggcattcttcttcatagaaatgtatgtgggatatttaccttacaacattagtcctacagacaacacatgcaaatatgaaatgtaaacatacacattgttttttttctgctgacagttacatggactaatggccattaggttggatgtccagattggttaggcttaaatatggggtgtgctggaagggggaacttcaatgtaatatgcttaaggaggtccatggatagcacctatttgttcttccagccattcagtttggggatctatacgttttaaaaatattgtgaatttgtagtttatggcgtgagaagcaaagaaaatataagctgttgttctctatctcaaagaaagccctctatagaagctttactttggatctatgtagaatgagcttcagtgtacttaccaaatgatctggagcaagttttgatactctcagagccttaattttctaatccaaaatataggaaaatacaccttgtgagaatgttttcgacgttaaaaataatgcatgtaacaatgctatgtatatagctggtgttggtatatcacagttctcattaattaaaacaataccagtaatacagattgttgcttaaatacattggcacatttattaaattgaccacagattcactgatgcatttt

SEQ ID NO: 107065 - DNA, 1065 bp, Homo sapiens
atttttttggggttcatcttacataaagtgtcaatgcatattatgtattctatttattttccaaaataaattttctatttgggatttaaatatggtaagtcaacacaactttattgtaccagtcattggattgaataaatgacttaaaaataatttttcctgtctatcttaatttttatatttaataattgaaacactggggattagtagaacaaagcataggcttgggcattataagaccacattataatttcaggtttcaacacctattaaatgcctgatcttatggaagacatttgatctctatacatttcattgtttccatctgtgaaatgaattgtctaatcatacctagattagttcagtgtgtcgttgagggaattcagcgagaaaatgcatgttaaatgtcattgtaaatggtgacacacttaatacctattagtaatggtgttctctttattattgttgttagtatacctatttgaactctgaatatatttagtcatctaaatcttgatggaaaaggaaaatccaaaactactcatgccataacaattccaattttcttcaagaagcaagaagatgatataaatgtatgtgaacgaagatccagctttctatctcctctgcctgtacttctatctatatctgattcaccactgtgagaattttcagttgccacagaatcactaggggtattttgggtgaacattatgagtaagtaaagtgtttagactaacactgaaattaagaaactgattcaagttctatgtgtacctttattgggcaatgctatcatcaactggttattccacaggagaattctgtcctaatgccctaaaggtacccaccatgtgtaatgaatcaacttctttcccatgcatcgagaacagttctagttacgtattatccttaggggaattgagaaattatgtgattcagatgcaaagtactggttaagaaaggctggtttctcttctcaaggaacatcctgaaactttccacacacttgcaattttatttaaataattacacatacacttatcatgtttggaccctgaaact

SEQ ID NO: 107066 - DNA, 1012 bp, Homo sapiens
ggatttaacaacttggtaagcagtcataaatgaccttgacaagagccgtttcaggggaggggtgggggttcagacctcactgaacagttcaagacagactggaaagatcaaaactagacacagagcatagacgactctttttaatgtcatgttccatacactagataaaaaataatggtgattgtagtcttgcgttttgaaagatctcagttaattttaaaggttatattttgtgtgtatgcttgtgtatgtgttaattttttgtgacattcaccatttaaaatcactataataaatttgatttttaaaaattcttggaactccctgatgtatcatatagtgaactagatgacattttattgcttatgccaaaatatgtaatttattatagaatcttcatttacttttgctgtctaaggggatgctgtcctctaattaaagagcaccagttcccccacgccatcagtagcttctagtcaatgtaagaaccacctacaacaaggaatcaaacagtttaaagttgtaaaaacctatgactatgaaatgatgccaagatgttaatatataaataacttttaaatcatttacatgctgccaaaatgatgatccatgatggtgttccatatgctaggaagttgtaacatctgaaacttttactatttctaagaccatctgtgtgttttgtataaattatgactgtggaactgataaaacactggaggtaaaaagcacatttatacatttgggaaaaggaatacattaaaaatcagcagtttgggttcaaaatcactgatcttatgtagatcataattgtttttgttttattttcttcctttaggcaaaactgaaattgaataattaaaacaaaaacttagaacataaacagaatacatgacattatttccagttttttttttaatagtgaaaataaattcttaaaacatgttggttattagtcattgtacgtgattcttctttcctaagctttgtattcaaatgagtgttttcatct

SEQ ID NO: 107067 - DNA, 1636 bp, Homo sapiens
aaatggagtcttgctctgtcaccaggctggagtgcagtggcacgatctcggctcactgaaacctctgcctcctgggttcaagcgattctcctgcctcagcctcctaagtagctgggattacaggcatgcaccaccacacccagctaatttttgtatttttagtagagatgaggtttcaccgtgttggccaggatggtctcgatcttctgacctcatgatatgcctgccttgacctcccaaaatgctgggattacaggcatgagccaccacgcccggccaacaaaattcttagccctggagatgcaacttgatcaaaactcagtgagtgttctgctggagcttacattttatgagtgcgtatacagacaaaaccaaaataaataagtgtaatatacagtaaattaaactataataaatcctataaaaatagagaaagagtatacagacaaaaaccaaaataaataagtgtaacatacagtaagttaaactctagtaagtcctattaaaaatagtgaagaggtagatgaattcattagggttcaggtgggattgaaattttaaataggctgattagagagaatgcctcacataaaaacctcaaaaaattgatggaatcaactatacaagtgtctggaaaaagggtattctaggcagataaaatattaaatagaaaaaccctaaggtggggtatacctaacgcattcactagagagtaaaaaatcagtgttggttgaacagaatgagtaaagatttataggagatacaatcagggggtagcctttttaaaaaggctatgaatttaataattgtccaactgcgtaggctcttacaggtgttgtagatagtttggcttttcttctaagtaaggtgggaagcctctgctctcttgagaacacactgaaacgtggcaatggtagaggcagggagaaccactaagagctctcagggtaatctgggtaagagacaaatggtggtttgaaccaggctgttaggatgggaaggtagtgaggagtggctagattctgaatatactacaaagcaatagccaacagaatttgctaacagactggatgtgtttgtgagcaaaagggaaaagtcaaggacctcctaattaattggcctgctcaactgaaatggtatagatgccattaactgagatgccatagattataggggaagatttgggatgggaagtatcaggagcttagttttagacatggtaattttgaaatgcttattggatatccaagtataattgtcaaataggcagttggatacatgagtcagaaattcagaattgaggttaaggttggagaaaaaattacatcgtggtaggcatacaagtactcattactatgcagttctcccgtccttctggcggatgaaacactctacttcccagcttttttgctgtccggcagacctgtttgactttttcagcttcatgggttgtgagtgacaattaaagaaattaaatactagtggtttaaatactccagtactctctttaccactctgcaaccaaggaagctacttgtcttatttaggtagtgcaactgcaacgtggaagacaccctgagagcctgagcccctgagttatgtgtagaactttctaccccacacctgtcgtctcaag

SEQ ID NO: 107068 - DNA, 1031 bp, Homo sapiens
caaatttatcacctatttgaatatatacaaaagttttatgataatcagagattatattaatgacttataactaagttcagtagaagtacttggttcaactttcagaacatagaatataaaaagattgttaaaaatagtcaaaaagccagaagttgcaactgttttttgtggagaagtaaaaccttatacattagtttattttttttaatgtttataaaaagcgttgctgttccaagtggggcctgttaaaggagaaaagtaatccaaagcctgccagcattgcagagaaactgaaacatctttgtatttttttttttaagtttcttgaagttgctaatggttttatagttttttaaacaagttgcagggcattttcaaaagctggtcaggtaacctagtgctaagaaccgtttattcctcattataagcataggtcttaacatctccagagaaagcatttggccctcttccacctaggagactgagtttctgcctttttgattcctgttagactattgattatataagattgtactttaatctactgggccttagataatttaataactcaataataattaaatttgatttggattgtttttctttaaacgttacaatttaaaaaagaacatatcaaagatctatgttgggtgaagaaaaaaaaagaaaacacatatgggaggctgaggcaggaggattgcttgaggctaggagttcaagactaacccacgcaacaaagttagacccccctctctacaaaaaataaaaatttggctgggcacagtagcacacacctccagtcccagctacttgggaggctgaggttggaggatggcttgagcccaggagtttgatgttgccgtgagccatgataacaccactccactacagcatgggtgacagagcaagaccctgactcaaaacagcaacaacaaaagcatataacacataaacatgtcacctcaaatttatgaaatgtacccaaaattctgttcaaataggttaattcatgtttattgatgaggttctat

SEQ ID NO: 107069 - DNA, 1037 bp, Homo sapiens
gagtttaggaataaaataagtgcttgtctcttgtgtcacatcatgtggtatggtgcttatttcatcttcctcttcttccatacttaattacctttttcaacatgtctatgatcccctccaatcctggaacattttataattagtggttgtggttttttgttcactggtcatgatgttttgaaatgccttttttttgtttcttttgtttctaagcaaagagaaataatatcattttaaatattgaaatgattaaacagcatagtttgattagtaaagacaataaattaagtaatccttaatatgttatttcaattataaaaattaaatgtaactgatttttccttatatcttgctcatcgtcttttattttgggggaagttaaagaggaaattgctatgcatgaatcaagtaaagtttctctatagttctgacctggagaacaaaagaaaaaactaacttaagaaatgcatgattaagaagtgcctctacatcgtctgtttagtgaaattattatattaaattatatgtatcctcggttattatatgttcacatacatttcccttttgtaacactgaatgtaaaacaaacaaaaaacagataaaataacaactggaaatataaatgaaattaggagcaacaatgtgtttttaattttattatttcctaacttttagtatttaggtcaagggggaaatctatgttttgtcatttttaaaagctaataaaaaatcctttttatgactcaactttttgctcattaagaccatgggattactccatgatgtctgtaagcacagatcttcatctctattaaatcataggtcattgtcaattaaaaatacttatgcatttaaagtgtgccttttatttacttacctaaagatatctgtctttaggtaaatttagtcatgaatacctatttagacctagaacattttatcattttttccagaaaaatgtaatcttgcattattattgttaaattcccatttaaaaacaactgtgaatttcatttgcatagattgttaatgaaact

SEQ ID NO: 107070 - DNA, 1056 bp, Homo sapiens
gtttaactagctttgtcctctattaaagtgcacgataaaatgagactggatccctttgccttgctcatatatttatcttacagtacacagcattttgaatgaccactttattagtatgctagcctgttagatattagtgctcaccataataatctaaaaatatactttattttgtttccctctttgtgggcagtgtatctcctactctttcgcttagtaaaagcactatcttcatgaagtgtctttttttcaagttttaaagataatattgttttactttaatgtaatttcttaatcaactgaggttgctatatatgttgaattaaaatattttattgaaggcaagtttatatttaataataaattttatgtttctatatttttttaaaaaatatttaaaataatcatttcatccttttatgaagcttgacttacaaatgaatgaatctttgaagattaggatgttctgtcttgtaaatataatcaaaactttagggtggacccagttccaaataaaagagtcacctgccttccctgcaagacttagattaaacaacaatattcagtcatgatctgcatatagaaacttcgagagaaggcctaaaattatcatatgaaaattgatggtgacgtgctcctcttaactttgcaataccttactttttaaaaattcagcaacaacaataaaaccaaaggtctaaaatatacatttgaaaaaaaagtctaaaatgtgtattgattcattgatgagttgctacgatttgaatcaaaatcacgactataacttcctcatgtatgaaatcttttacttaaaaaaatcacacaaaccattatattatttttgtaccattttcttcttaagagagctgtcaatttttaaagctgtcatgatgacagaatgaaccatctattttatcggtagaggccttatgtctctgtgacaggtagcaattatgatgacattgtcttcaacctaaattcatgagcctgagaataaaattcctgagcttgaaattttcaaaactgaaagtaaactaacagatatagtatcaaatt

SEQ ID NO: 107071 - DNA, 1055 bp, Homo sapiens
ctggagctgaatgtctttactgatacaaatattaaaagcaatgaaccagggagatggttaatggtacaaaaaattgttagtaagcatgagtaagacctagtatttgatagcaccacagggtgatggtattgaataataattcaattgtacgttcaaaaataactaagagagtataactggattgtttgtaacacaaaggataaatgcttgaagtgatgaatatctcatgtactctaatgtaattattatacattgtatgcctgtatcaaaatatataatatactccataaatatatatatatgtacctactatgtatccacaaaaattaaaaaataaaaaataatgaaagcaatggaccaaaagttctaagctgcacaggaaaagctgtaagtctaggagataaatgataaaagcaaaggtggggtggagtgaggtctaagacctggatgtgttggtaacttttggtgtcctgacaccaggtataagaagaacaagaaagttagaaaacaaagctgtcagacatctgagagagacctgagagattatgttttaggactccaacagtccccagtattggtcaaggttcatggtatgtggacaatagaagacaaagctgcaatagaggagattaaatttattataaaagatcttttaaaaaagctgtaagtttgcatgcctcgtctgtatagatgttaagctagcccaagatgttggtccaatttgggaggtcatgcggaggatgtttgagactgaattatccaaattctgattcaacaaaggtggtggctgaaaatgatgaaatggcatagccagttgtatatatgaatggcttgagctctaaagaggggacagttttttctcaaaagtatagattaatgaactaaaagtccctgtgagatcaagaagaaaatgttagcactccttctagcactggaaaactgaagcagtgagagtcgccccgtgttctctcaagttaaccagattttacataagacaaaaggtatgaagagtgtgaaagagattgaaggtaaagagtagatcattcataatttcc

SEQ ID NO: 107072 - DNA, 1120 bp, Homo sapiens
cagaattatctaagtagttgtaaatatggtttactgacgtttatgtataagtaattaaatgtaagctttaaggagagatttataattctacattttttagtgactttctcatgtggtttgtatcattaagaaacaaaagaaggagggaaattaaattagtcacaagaaacctcagggaaatatatttcacaatattttaaagtgtaaatacttggaaagaaaaaagttcataaattctaaatatctcttaatttcatagaaactttcccacagaaaaccctagtagtgcactagtgagaaagtattaattgggcagacagaccttcaagtgatagagaaaggataggaccaacaccgattctttccaagcatttgaagatcaaatgaatcataatgaatcctgtaaaagttccaacagtcaatagttacttggaaaggggcatttaataaacaggcacaaacaggaagccatataaaggaacaagcagaaggaactcttgtgaccaagggagattctttaaactgaaccttcaaggagcttttacaagcccaagaagtgctgagcttaaaagagaaatgcctgaagcagatgaacccaaccaatagacactggaactcttaatagatgtacagcagttgtgctgcaagccaatggaacttgtccagaggaaaagttgtttgccaagccctaagtggattttttttttctttccttttgctttttttttttttttttttttgcctttgctccagtgagttgactcaaggaacagaaacccaatttcccacccagttgccaaattcctgaccattcattaatgaaaataagaagtctgcccaataactttatttttttccctctacactattttttcagagtaaaaagaagtgggggatgatggatgattgagaggtgcagtgagtttaataaaagactcttttgccagaaaggggaataaaaggaagccactttgaaataatagtatttgaaacatccccactggccaaaagcaactgttgtggttttccctaattatgttgtatacacagaagatgttttagtggaacaaagaagaaacctaacctaaaacgcttgagaaatgagggtagcttaactcca

SEQ ID NO: 107073 - DNA, 1050 bp, Homo sapiens
atagttcctactgtgaatgagcttgggcgtgactgacaggtgcaatgtattatgctctagcagaagttaggactataatgcgaacacatacaaatgagatttgcctcaccttatattgatgaggcagtgataaggaagtaaatgccttgggaagaaacgagatagagagaacttatagatgaaaaaaggattgaatttgagacacatataacaaataggagttagctacttaagattctggcatgtcggacacagtatactagttccaaattagtggctagaggaatagcgactagtttagggaactgagattgattcagtgggcctggaatatagagtgttatgggaggtcaagagatggagaggagaggtgagtaggagaggggccagatcataaaggtgctcatcaaacgaaaacatggattctattttcagggcaattgagagatattgtaggatttagctgtttccacaggcctgggagagcagttacaatgtcaaaagatcacagtagatatgtatagtgaaagagtcttacaaggttactatgctttgttagttggctcctataacatggaaatacttccaagtagcaaacgtttttcaattaaagagtgaattacagaaaattccattagggctttaaaactttcttgcctctaattacactagaatgtgcagactttttgaacttgaaccaactttagttgaatttgttaatgatacttttttacatttgttttagaaacaaaattgaaatccaaatcattttggcactttagccagcagactcacagggtaataggctttagggtttccatttgaatcccattaaggatttctgggtaatcttgaaagatactaataagctgtatagaccgagaacagtccttaaaaatgaatacttagtatttccagtgagagagcataatttcatgtaaagcaaactgcccagttacagagggtaactggttaggagtgaacacatttggcctcactggaaacaatcaactggcactttgatttcttcccagttttgtcctttttctt

SEQ ID NO: 107074 - DNA, 1062 bp, Homo sapiens
gctaaaatgaatgtcactagacttaggccaatactataaacaggcagtataaagcagtcattgagaattgactctagagtcagaatgcctgcgttgaggtctctgatccaccaactatgtaagctagagaatgaaagcacagatgtgcatgacatattttttttctgtaatgtgaatgacaaaaatatattttggttaaacagaacgattctgagaattctaagtgattgctgattaactggaagtaaggatattaatgtttcaatataaaataaactaatttaagttaagaaaatgtaaaaattcttttttggtccagttgaataaagacacgacagtttttagatctttatacatgtatttatcccttgtaaaatccaacaaaaccaagaaatgattttcaaattgactaatattttacaaacatgagctttaagttcagacaagatgtgaatttcaagctttatgactttgacaactttctgtattcattttgttatcaaagtggtgtgtgtgtgtgtgtgtgtgcatgtaaaacttctataataaatgagtaatatgtggaatacaaattattttcttccttattatttgaatattggctaaattgtgtttgtttttccaaagattagatcatatggcaattgacagatctgtatgtgttttttagttttgttaatgaatcacttaaaatgtcgatatctggaatagttcatagtttatattttttctaagatctaaagaaaattttatatggaaactcttctgtaaatttttataattctacaaagatggtaaaaatgcttttagaagttcaagtacaagatagttaatatttcattcttgtcagtttttaaattctaccatgtaaataattgcagtcatgtgattatgtgattaaataatagttaagttcaggattttagcttattttagcatagttagatatcatgcttagaactaaaattatagttcaattgtattatatttatcatacactattcaagtgaatattaatttagtatcgttttagtggcagtcactattctaggtgctggggtg

SEQ ID NO: 107075 - DNA, 1008 bp, Homo sapiens
tttcagtatttttgtgtctcagggaataggaaggcccaaggagaggaaagagataagggcaaatggtcagctggtagaacagtctgaacctgaacaaacatttattaagtttgccatcttacatggttgtgattcgtcacatcccaaaacaattacaatagttacatcaaagaacactgatcacagatcaccgtaacaatataatactgatgaaaatgtagaaatattgcaaaaattaccaaaatgtggcacagagacatgaagtaaagccatgctcttgggaaaatggccctgacagacttgctgctgtatgattgccataaatgttcaattagtaaaaagtgcaatatctgcaaagtgaagcactataaaatgaggtatgactgtatgtatatattttctaatgttaaaccaaccgtgaattggtagaatatagcaattcgacatgattccttatatttttatgaatacggcttgaattcagtttgccaaaatattgcttaggaattttttacatcatcgtttatgagcgggctggcctgcaatttacttttatcttacaggtcttgtctagctttgatttcaaagctatattttttttaacacaagatgaggtagaaattatttcatccttttttattatctagaactatgtcatcaataaggtagactctggccacatgaggctcttgggcccttgaaatggggctagtgtggattgacatgtgctataaaatgcactagatttcaaagacttcattttttaaaagtataaaatatctgattaacaatttttattattgattacatattgaatattttgatacattgagttaaataaaatatataaaattaatttcaactttttagttttatgtgattactagaaaaattttaaattgcatatgtggctcacattatatcaatattgggcaatgtggacatagataataaataatttctttcctcagaatcaaagaaagaacattgttattaaaggtacctttt

SEQ ID NO: 107076 - DNA, 1139 bp, Homo sapiens
gtgagacgagatcgcaccactgtactccagcctgggtgacagagtaagactctgtctcaaaaaaaaaaaaaaaaaaaaaatcagtatcataaaatgcacatataagcacttatctctacagtaatagaatttgaagtttcaccatgtatattttttccactttcagattaaaagattgaattttgctttatataatttgtacacaaaaggagaaatgaactaactggcttgaattattttcttagtaggccaggtagatgaagtttcttggtaattagaaacattttaaatcaagaaagatcacaacacagtttagattatatgtttgtgtatgtgtgtcagagagggaatttttttttttaacattcttgaaagggtgctagaacaaatctcatagcttccaaatcagaaagaaattgtgatggcacattgccactgaacttctggtgtgaatgatataagagtcagtctgcccagcagttatttgtagcagttttaatatagttacagactagtatgtgaggcttctcggactagctgaggttattggcatgagaaaccaagcatagatctagccacagctgaatggaataattccagagtggagaacacagagtctggtgtagactggagctatcaacaatgaatgatttgattaaataaaatctcaattaataccatacatctttaatcatttaaacagtagctactttggtctcttactaatctgagtttgattaccattttttatacatttaacaagcatttgttctacctacgttaacattagtacaaatttggctttgaatccaggccttgacatttcctagctgtctttgggtaagttacttaatgtctccaagagtcagtttctgtggctgtaaatgtagataatagtatccatctgataggattatttggaaccataaaatgactaaatataaaataattaattgctagtcatgtcctacatagatacatacaaaaaattaaaaccatcaaaaacaacagtgcaaaatataagtatgaagagttttcttagagtgagcaaattgttctctgtcttaaagaaatttgcgtataatcaaacagataacacgtttatagacccaacctgaaagacgtagagaaattgccaa

SEQ ID NO: 107077 - DNA, 1055 bp, Homo sapiens
ttagagaaataggatagtaaattaagtttcgagtactctattatgttacagatatttgcttgtccaatgagaaatccttaaaatatggccttttctgtatttatagattgtctttcattaacaataaggcacaaaggcatcgcagaaacgatgggaaaatgtgatgaagagcatcccaagagctgaaaatgcattggcaaaaaaaaaaaaaaaaatcattttaaatcattataattatgttttaaaagttttcctttaacacaaaaggctgaatcttcactattgaagacatgtcaaaagtagcttgattaaagacagcagcatttcagttttgccattagaataaaaagactgaattgttagtgaaaagcaatgaagtacagaactctggaatttgtggtgaaaggaaattgaaaaagaacagaacatttggattcatgtttcatgaaataatttgtgtgacagaataggaaggcagtctgagggaaaattgacataattttttcctaggactgggaaaggccagataaatatgtcactgttaacaaatgcactattgtgcatgaataaagtatattctactcaatttgtaaatgttaattttcaatcattggaaaatatttgcatgcttttcaaagtataaacaaaactctcctccttttgttccttttccattttctgtggctagacattaagttggaccagaatgaggaaggcagaaataatttttaactcatagaaatgttgctttttcagaggaaaccatgtattcttatatgtactgtgaaatatataatatgtggtatacctatggtactttcaaagtatctataatctgcttttttcagtttagagagtgtgtgtagaattcatccaccagattgtaggatcagaaaagctcattctctagtcccttggatgtgccgggactgtgtctttgtatcttcaatatttgtctttctcagagtgcctaatatagattttgtgttcagcaggtgcttatagaatattggcttgattcaaggcagctggcacaagcaacaggaccaggcaca

SEQ ID NO: 107078 - DNA, 1052 bp, Homo sapiens
tggtcaatttcaactcttacattgatttcagtagggttgttggtgaaggcagtattttatgcaaccatctctcgccttgtacactaagcaaatgcttatgcctctctgactgatctctaacatcaggtttttccaccgaagttgaactgtcctgaaaagaatctcctttcctcaaaaactattaattttagtcccaaatcatggcatattatggcctcaaaatgaagcaaattacagagctaaaaccatttttgagaaagacgattctgtaatggttcaataaacaaaaagttcatttaagcaataatgtgccagtacacactaattattctgtagaatataatgtgcgttctatatttattgcaggattacatgagactaaaggagtaatgcttacaaactagctagtcttttctgaatctattactgaagcagagttcctttatgtcagatgatgtgcttctggaaaatttaatttggctcaaacaacttccttaatgaattacagctgacttaagatttatcagggaaagtaaaatatgctatagctctgtggccatactacaaacagggatatgagtatgctgattcagagatttttggatatctgagatggtaggcattatgttttgaatgtagaatgttttcttccagtagtaaccacagcaaagtaatctttgtgaatacttcaagtctttcaaaatcttagcaggagtcatcattccttttatttaatgaaaatccttgggatatgacagatttaattaaggcattgagattgaacagtatcagcacattttatatgacatgattgtcccagagagaatatcacttttgcacttgataaccaaatcagatttacatgaagctgcagtttcttgaatttgaaacagagctgacatataggtaatgtatgttgtcaggtagggattctgttaaacgtcttatgccaagagtgacacctactatgggtgcatgtacccagtctttctcttcataatgataggatttaagggacagatcaaacatcaacagtagaaaatgtattttgc

SEQ ID NO: 107079 - DNA, 1021 bp, Homo sapiens
ggactgaagttcccttaggaagagaacattctgcctccagactgtcttcagatatgagccgccacattagcacattagctcttctctgcgtctccagcccactggcctatcctgcagatttcagagcttcgaacccccacaacagcatgatccatttgtttaaaatgaatctctctacagatagacagatagatacacacacatgaacacaagcacacacacacaacacattctttttctctggaaaaccctgagcagtatacactagaaaaacatgattccacaaataaagattgtggaatattagaaagaccactggcatgcacctgctatatgaacttggattagcctctttaactttagaagctcagatttattatttattaatttcagagattgaactacatttgtaagtttttagcttttttattcttagaaacaaagtattatggtgtagtgaagtagactatcccttatgttttcaaatgaaaaacagatttacatataacaagacaagaacttccattccaagaaggctaaaatatatagtttaatcatactttgctgtttaaacatagtatttagcagtatttccccacaatttcacataagttcttttattcttttcctacccaattgaaacacatggattgagtattctatattcaattgaaattaaaattaactttctacatgtctattttagatttataattatatttgaggactatgtttataactactagtcagcatttagtttcctatttcctctttgttttatataatataaataaaatttaagtacgtataagtatgtatatgcaaaatcatatgttaaaacaactatagaaacattgttgtccagtaaagatggcagctaccaaatttgaaacatcaactgtcaggttgtgttaccagaaagttacttcagctgaggtcccaatgtttcaattcacaatacaaaaacaactggagggtgtcaatacctaatgtataaatgtgtaggttgtataagaaacaa

SEQ ID NO: 107080 - DNA, 1258 bp, Homo sapiens
caagatccttagcatgcgatgtgaggccctccgttatcgtgctcctgccagatcaatggcctcctctctagtcatcctatactttctagcttattgtatattaaaactaaactgttaatggtttgctgaatacagcaccttgtttctctgctctgtgcttctacttgggttgtgctctataccaagagtgcctcctctcacctttgtatttccttttggacttttcactgttatcctcaagaagtacctctaaggtgttcttcctacctagcctagttttttctaccaacctagttcacctagtttcctgcctaacctcgttagatatcactcttcgctgcttcaagaatactaaagcaacactcctgatattaacctactactcagttttgtgtggcaaaacagagatcacatcctatttgtctttgtgtctctggctgttagcacaaagttagcacttaattcatgctctacaatgttagttgaataggtgagtgacagagtttgttatcctcaagcatcactgtttgttagtgagaggcagatgtcaagtagctcatgacgttacccctcttctgagtaaaggaaaaggagtaagatacaccaaggtctctgtggcccagtaatttaggctgagatctgctttaaaggcggaggcatatacacctgcataaatatctatgtttacacaaagagcaaaagatgaatcaaggaaaatattttgagtttagaaaggaaagagactgtggagaaaggttgagaaaagaaccagcaatttaagatgtgtgtaacattgaattatcatctatgagttactgaatggagaaaatgaatctctttcaaatgaatagaaagatggatgaggatctttgggtgactcttttttgttttgaaaatttaaaacagcttcacaggtagaaaaaaataataaaattaacccccatgtgtgcattactaagtgttaacagttacaatatttaccaaagttgtttcatttatcatttcctcatacctgatatggtttggctgtgtcctaacctgaatctcatattgaattgtagctcccataattcccatgttttgtgggagggacccagtgggagataattgaatcatggggacgggtctttcctgtgctgttcttgtgatagtgaatacatttcacaaaatctgatggttttataaaggggagttccctgtacaccctctcttgcctgtcaccacataagatgtgactttgctcatcctttgctttcca

SEQ ID NO: 107081 - DNA, 1036 bp, Homo sapiens
ttattaaaggtgtagttgtggactcaagttggactctacactttttaatttcatgtcattatataagcaaaagtttacattgtagaaaaatacttatgtctataatcagtatggaagaaagaaatttctgtaccaactgtttagtgcaacacgattgtagtattatggaaatataatcctttaagtaaaaatttttagacctgctttaaaaaaatgaagtcaagaatttggctacttcagttgaaaaccaggtcaacccctcaggtcagcttggttagacagtgcctagtaactcaaggccggataaagaagattgtcagtagatttagcaatatttgtcttttaaacttggtttatatttttcaaagaaattagcttgtctccatgttaataatagttctgatcattatatagcatatgcaccctgatgatgaaatgaatacatatttgtggttttgatgttaatatggaagtgctggagatgtatttctaataatcaaatatgaaaagctcactttattgctgtcttttcctacatctagttgcctgctctaatatttgtatttacttcctctgacccccgcaccatcaagttattctttccttctgtccattcaaactctcacttcctgttaactttcttctagtaaatacacctaagccgttcccaccaaaataacttcctcaagaacaaaatttattcccagattctctttctccctgtgccccttctttctctcctctttattaggactttttgaaagtttagtatatcctacttattttagatattagccttccattatctataaaaactgctttaatcttgtttcggtcaacaccacttcattgtatctcttcctaattcattcactgttgtccttctctttgtagtacataagcgataattttccatttcctaccttactggatctccgtactttattttgaactttcataatattactttgtcagattctgtgagattttattctcttaaataagcttcccatccccttctctctgcttatcccag

SEQ ID NO: 107082 - DNA, 1025 bp, Homo sapiens
cttatatattcccatggattttcagctgataagttgtcacataagtgctcatatcatcaaaaaatgatagttttgccatttattcttttcctacttaattgcatgggtatctcatttagaataacaaaaaataattttgacagcattttttctcttagaatttaataattctacccactgttaaacattgttagctattgatttactagatagaaatacctattttaaatcattttaagcaactatttttgctactatcagtaatgctgtactaagcagaatatatattaaacaaaagtccccattgtttggtagtatcataggagaggtttcttaggcagattcatgactgttgagaaattttaaatcatgcatttgtctattaactcaataaaaccaccaataccttttctttatttaaattttgtgcttacgttaggaatggttatatccaacattgaaaacaatatgtagcaacttagaatgattaaatgatttttaattgtgaagaaatttgatgaaccaacacttaatgttttaattatcgtatgtcatttattaattgatttaaaagtcaattcatccgtaattatgattttatatccattttatattgtttttatttcacactttttacaatataattacaatgtgtttaggtttaggcctgaagatgtgatgagcagatgaatattttctttaataaatggacagaaagttgtatggatgtgataatgacctctttttgtgttgctctgtgtcttacagcaggtgttttctgtgcttcccctttcttttagtatgaaaaatgattttagaagttatgagatttgagcactgtaaattaaaattgctgtaatgtttctgttttcattcttacaccaaaaagaaacattgtttacaacccaattttaaggaagtaggaatgaaaattttagaagactatgatgtttttctttattatcatacaggtcagttgaccaccttatacaaattaatacaaagtaaatggttgttgttctgtg

SEQ ID NO: 107083 - DNA, 1094 bp, Homo sapiens
tcttttttatcctaatatttgtttaattaatttactatgatgctccattaatgttatcaatggagcatcatagtaaattaatgaaaaaaatttcatagtaatgaaaaaaaatattcttttttcatagtaatgaaaaaaagaatattcagtacaaacccaaaaaagtttctggactagggaaggccacctatcatcactatacatcattacatcatacattattatacatcattacattatacatcattatacggatacatcattatatgtaatgatacatatgatggtagtagtaataatttttaaaaaaataacttaggatcaggtgatcaaatattctagcgatcaaacttttgtcttgaatgttggacaactgtgatgcaatgcaatgaatcttagctttttactctttggtatcatctggagaattcagcatctcagatcaatatgccttgggcaagaattctcaactaagggtgagaaaatgatagacctaaaaaatgatctctctggacatctggaatgaaggtttattgtttgcttatcaaacaaggtaatagttaaaaatagttgaaaacatgacactagcccagagtaaacaatgtttaacatctagatttagtcaaggagtgccaggtttaatctaagagtgccagaaatgtccatgttggggagtgtgggatgaggaataaggttgagagtccccttctctttttggccatatctttttgagcaaagacatgtctaagtggaagaactgaaaatagtgataggctgcaaaagtttgaatgattgtcccccaaggctaatgttggactttgatcccattgttggaggtagggcgggggtgcttccctcatgagtaaattgatgaactttctcaggggtaagtgagttctcgctcagctgggtcctttgagaactggttgttaaaaagaacctggcacgtccccaatctctctcttgcttcccctcctaccatgtgatctcttgcacatgacactccactttgcttttcaccatgagtgggagcagcctgaggccgtcaccagatgcccagtcttcaacttttccagacatgagtattgtgagcc

SEQ ID NO: 107084 - DNA, 1136 bp, Homo sapiens
gttttacctacactcaaatggaagcaggattcactaattattgaaccatgaggccatcctaacgtccatattattcacagaatgtatactttcttgaaaatatatgtaaaaatttgcatttaaaatattttcagtgttagattttgactttaaacttgtattttgttatatttatgtttatattgaggatcaagtgtattttcaggtgaggtaaaagagcagggagaacaatgttacccaagcacacggtatccctgaaccctctaaatgatttgccctttgctcataaatcttttgccatggtcaacacaaagcctagtattgatttaccagcgaaccatcttgtcatctctgggctcaggtcctttgaccttttgtttgttcctgtaaaattacggcatatcacaaacttcttttctaataggtcctttaaactttgaaaggccaagagactctgcgggaatatattaaacagttggataatccagaaaaaggaggttaaaaaaataattgcagacaggtaaaggtcagaaaaatctttattgagtccaaaaacacaaacaattctcttagaagcaaatgacagagaaggagaaggcctccgtttagtttagttctaactaaattcactttgagtttcttagaaaggcaaatatgtatttccttcatagtagcttagtagggtacaaagcaaattttaaaatgtggctgcttctaagcaatgtaaagggaacacaaaaatagcaatttaaacaactgtaatccatataaatggaatgatcacaatttatttctcaaaatacctgtattggcataaagtgatttagtggagttaatacagtcttcttggtgctatttgtcacacacatataggcaggtaaaccctacaattgctgatttacagataaggcaaagataagttcagtagcctgcaccttaatgaaataaatgtggggaattaggatttccacttttgttcagcttatttcatattctttgacttaattgattgagagcttaatttattatataggtccaccacgtgataattcctctgctacatatatattttattgcctgcaaagagattcttctcgaactttgatttctaggattatttttgctacagttctatg

SEQ ID NO: 107085 - DNA, 1771 bp, Homo sapiens
ttggaaaaccacagaaaggttctttaaaagtacaccacttatatactttaaatgaatgtttccattttaaggtaataacagcataatgtcaggagtcaacagatgatatttaactacacttggacatagtgtagacatgtctatatagaccaattataaaaaagaaaagaaacaccagaatcttgtgttggtatcctcaaaatgatctgatagtggtggaatgtctgaatcaaatattatattttcaaatattctatttataaagtgatattttcaataggcttaaatgcttttttctgatacaaaataaaatgtgaaaagatgccatcgtgaaaaataaagatgatattgattatctttactggtgagaaggcttgaactcacagggaaatgtctaagagtggactttggtttacttggggtttggggaggatttgcatccattttaattgcaattaaattatcagtaaaataaaaacatggctgctgatttataagactgtaagtcatttgagtaaaatttgacatttacctccaagaatacctctggacaagaagaacagcctttgttttttatatttgtcttggcttcatgaaggaaattaccactggaacttcacttgtactgactatgtggtgacttaactaaaactccatgttgcagttttgtttgtaattacaaaaaagattacacattagattttacatttatatctttcttaccatctccctagtgtttagtggcgagaagcctcatcctagggcaattggcagaggaaaaaaaaaatctttggggctaatttctatgtgtacttgaaatgttatataaaaataaaccaggtttcaatgtttcagagtctccaagggccacctttacaaaccagcgaagtagggaacactaccagagtacaggaagaataatttattagtctgaagaattctgaacacattgtttttaaaaatgatttactgcatggatttcaaagcttttcttcataatcacgtgtattaccttatctgaaaaggcagtttattgcacttttccagagcaactgcttgtgctactgggggattaaaacaggtagacatgctaccactttcccctccgggggttccccagacatgatgggcattaggcttagcttctagtgacctattcttgaacctgtgccattcaaagacagcatttgcttgtgtattatttagaggggccttttaaaaaattctgtatgctttatgaaaatattttctataatttattcaatttctttccagtaaatatttttcttttcattaggaaatatatgtgtgtctgtataaacacacacgtagatatcacacactaaagtgtatacatataaaatacaagagaaatatactgtaagctacaaatatgagccacatgtgtaattttaaatcatagcaacaataaaaggaaaaggaaaaaggtacaatcactttaaagaatatcatttaacccagtataatgtgagcactttaaggtgtaaacaatttaaaaatgttaatgagatctacacttttttcatattaaatctctaaaatctgtgcacattttatacttacacacatctgaattcatgagagatctacacttttttcatattaaatctctaaaacctgtgcacattttatacttacacacatctgaattcatgatattcacagtagttagtggctacttattaggcagcaaaaggataggatacatgcacactcaaagacttattttgtaataagtcttaaggtagaa

SEQ ID NO: 107086 - DNA, 1819 bp, Homo sapiens
acatttcccccctggctgctccttcctgcacttagttgtaaaaatctgaaagttggtagggaaaaatacaagtatgggctatataaaataggagagagtttcagtggatgtcataggctcatagagttctaaatggatcagatattgataatatttgtctctaaattgcctgtggcctgtaccactcactaggtgtgagacacagggcacgttagtgaactcatttttcctgtttcctcatcagaacaatagagacttagagagaccattctatgggtttactgaaagaattaaatgagatatgccatacagaacattgcctggttcagagtaagtactcaataatgactttccgtaatcactgttgttgtttttctagatattaaactgctatagaagtagtcagttatttcttctgaaaactggatcttattagggcagcattagcttaagcttcattaaataatgtcttcagaattcagagctggtccttgatatttctaagctgctatttctcaactaattggagtagagaaagtatggaggggaatttagggaaatggtgtatcagagttaccaaaatgacatgatgctctggaaattctgatataaacattcctcacccaagtactaccctctgctaattgctgagaggtttatatcatatctctgaagtatcttcagggtagaaaaaaactaaggaccatatttataaatgattaacttttaacatatttaaatttaccaaggctttccttgttgttgacttttcatggattaatcaatcctatggtactctaatacactcagatcctcacatccttgacagtacttctgcttttaatttgttgtagtatttttctattgctgccttcacaaattgccacaaatttagcagtttgaaacaacacaaacttaatatcttacaatttatgtaggtcagaagtctgagcgggttcagctgggtgttttgcttagggtctgataagactggaaagaaggtgttgatagggctgcgttccttattcaaggctatagaaaagaattcacttccaaattcattcaacttgttggcagttcaattcctagtggttatcagaatgagtttcctattttttttctctctcctgtcattcagaggctggtcttttctccctaaagattgcctttatgccttctcttgctttccaggtggcttcactccagccaaggtggttgagtctgtcacacttagagcctctctgacttctccttttcctccatcttggggtctaatgcaagcagagaaaattctctgcttttaagagctcctgtgattagatggggcccatctagataatctagcccactcttcctatcttaagttcggtaaccttaactacatctacaaagttcctttttttcatgcaagctagcatattcacgtgttctagggattaaggcatagacatctttggagagctggtctgtccattacccttaggttgttgtaaatctaaatattctaaatataagccataggcaggcagcctttccctgttcccttttctcacttgtttgagcagcttgtattaaatatcataggatgcttaagaaacttacagtctatttggggaataaaatctatatatttctagatataagggatttcagagctataaacaaggtggctgaggacacaaaggaaattgcagttatttctaatgggaagaaaagaagatcaaagaaagaaatctctcttgaataggtagcttttgaagtatgtcctgaaggatgtgtaagggaaaggtatttgttgtcttatgaacaacataacatg

SEQ ID NO: 107087 - DNA, 2056 bp, Homo sapiens
aaacaaattgagtttgaatccaaatttagacaagttgcttgatttccaaagtccttgtttcctcagctgtaaaactgaaatgaaagtaactatattagtcatagtattgctgtatatattcagtgagacaattgaagtgtaaactttccagcataaagttatggcccaaataaaagtcacgtgaaaagaaacagatgaacacagaaaatgaatattcattaactcttcaacttttcttcccaggaaagcattttttaaaaatttcctaacctcgctcaggaatatacatgatagtaagtattagttgttgaagaagtattcctttatcatttaattttatattgagccctttatatgattcaaatattagaaatttttgtaggaatattttccaaaattggcttcgtattttttatttactcataggtaagaagaggtttacttggtcgcaagcacatgacaagtaattaaacacgttcatacactatcactctggaaaaaaaaattggaattcatgtttttgatgttgtttcagctggggtttcaattcatagacagaattctgtggagaatccagaagtgagatctaacagtttagccagctcatctattttcttttcgaaggaagagataggacaaaattggatatctccagagggaggtccaagtacagtggcacaatgcatccccttttgactgacggaactacctgagttcccttggagagacaaaggaggaaagaaaagtaggaagtagagagaggctgactgatttagagacttaaacataaccctttaatatatagaggtgagttttcaatattcccccaagactgtttttgggagggaaaagaatttaaagtaaataaaatagaatatgggattcttaatatttattccacaaagggaaagaaaggaaagaacattatcaggtaagtcttgtttaatccaggcattttttccttttcttaactgtaaatgatgtactatttttcctgaggtaagaaatataaacagattacaatttgtaaatcttacaaagacctattcttttgaaacacccttactacttcatattataagtatttcttcacttaagatttctgaagtgagaaacattgttttgggaattaccagtatcatgggaatttctgtaactcttatactcaagctattgaattaaataaaaccttggaaggacaaatgccttgatttgtccagggagcttactgataacgtgagtgttacaacctgaaaactcatctgcttttaaatacctaggcactgccccacttcctccctgacactttgtatttaattttgaatttttaactaaacagaatttcttcttcattgtgcttgtttgatacaatgttagggttgcaaaggcagttaatgattgttaggaaaagaaactaatccttctcactgtcaaacatcaaacagaaggtcatcaaccttgtaacaataaaaaaaattcttttgttctttcccagtccgttaggattccagaatagattcagattgcagcaggggaagttgaaacaagagcagagctggaaagtccagacaagattatcaaaccagacaattgtgccttcccccaaactcagcgtagctgggagtcacttccctatcaaagcacgcaggcagttctgggaaggttgtctgtgttcccccaggagtggccctacttactgtaacatcagtcaggtttggtggaggatgggttgaggagaaatggagggggatggtcagaacaagtagtcacagaaaagagtatttgttagaagtcagaaaattccccaggctagagtatatgtaatcacaagtctcagaaaacagtgatatgctaggcaacttatgctcacatcttataaaatagttgcaataaaataaggcccagagagacctagactcaacctaaagtctcatattgtcgataacatagcaagtgacagaaaagctcttgtgtttaaaatagatgggtcatgaatttaaagcaaagacagatggttttctttcatttttattgtgtgttttaatatagttgagca

SEQ ID NO: 107088 - DNA, 2133 bp, Homo sapiens
ccagtatacacgatttaaaatttgagttattttggtagagaaatgagactttctcatgtcttcaaccctgcgtgtaatatcattgtgttataaatatctgcatccagtttttagttatatgctttattaatatttattaagtccaacttagcataaatcaaaaaatttgttacacataccatttagtttagtttaaaatgttttaggcagaagtatagtagaacacagtgaattaaggaaagagcagacaactgcaggagcaagacagtgaacaagttcaaagagcagcaacaacaaatacagtgactaatttttccccacgttgaaaggataatattgacacaaaatatccaagtatgcactttaaaattttggtttttgtaattgcactattttatttatttatttgtttattgtcatctgctaactatatagggaagtaggtactttttacctagactgtaaaaggtgatattcaacttttggtctacagaatctcctatgagtttcctattgcattgtttgtggtttttgaaaataaatgagagttttagatagataagttgcttcacatactctatttagcttaagtatgatactgttaacttttttatgattgagacagtaacttgtctattttattttggctggttatttccaaggtagttaaaaatacaggtgcccattatgcagtttttttttttttttttttttttttgagatggggtttcactcttttgcccaggctggagtgaagtggtgtgatctcggctcactgcaatctctgtcccccagttcaagcgattctcctgcctcagcctcacaagtagctggaattacaggcacccaccaccatgcccgactaatttttgtatttctagtagagacggggtttgccatgttggccaggctggtctcaaactcctgacctcaggagatccacccgtctcagcctcctaaagtgctaggattacaggcgtgagccactgcgcctggctgcagtattttaaaattacacatctcacagctttttagtatcttgcaaggtctgtggcatttagacattggagttttgctgaggtttgggtttgaactggaaggtgggtttgggagtaaattgttttcattgtgacagcctggattactcagcattagagtattgttgggttcttggtattttaaacaagagcattcctaaagtactatcatttttaattgagaacgatggccctcaagcaaaagaaatccttagtgaaaattgataaggtgatgggaggatatgcataggaaacgtcatccagcaggttcaagaggctgtcggaagccagatgcctgcacaaatatatgctatagtcccaatttggaaatcctaaataaaatgcatttttagttgaagtaggtgtaaaactttcaatgtggcacaaaattcaagaagtgtgagacaattttatactaatgttaccttttctcagctcttatttttctcagctccaatagcacatattggaggctcctccatgaatatgttacttttaattgttgaataatatttcattgtatgaatgaaaagcaggaaggcttaccttgtattcaaagacactttttaactctgtttacagggatactttaggaatggtctgagagatactaaaattaaaaatctagttagaagtgtgcaataatgctcacattactttaaactattttaaaagttagacctgtgctattttttaaaatataccagacttatttttcttaagtatttcttaagatatctgaatatctgtttgattttttttctttttgaaattcagcctaagccaatgtactatttttttttcattcaattagatttattttagggatgtttttattcttgttgttatttcatatcagagaattgttctaatgaatagaacagtgttcactgactttcttttgttattccattgtccttccattctctttcacatggaaatgttagttttacatcagaatttcttgttctcaatagatgtattcttggaggtcttaaaatgctccacaataatttcttttctatgttctttttcatttattatactttaaaatgtggatattatatgtatgtcccaaattaccaagtctagtatt

SEQ ID NO: 107089 - DNA, 1162 bp, Homo sapiens
aaaaatctgttgaaactaaacacaacgacttgtctcagtgcttctgccgtagagaagaagatgagagaaaagattgggaatggcccagcacagtggcttatgcttgtaatctcggcactttgggagtctgaggcaggaggatcatttgaggtcaggagttcaagaccggcctggccaacatggtgaaaccccatctctactaaaaatacaaaaattagcctggtgtggtggcgtatgcctgtaatcccagctacttgggaggctgaggcaggatcattgcttgaacctgggaggcggagattgcagtgagccaagatcacaccactgcactccagcctgggcaatagagtgagactcaggctcagaaaaaaaaaaaaaaaagattaggaagaacagaggtgttatcccgaaggtaaaggagctaagaaatattttccccaagtagttggtaaaaataagtaaacgaattaaatatataaatgacagggacacattagagggatacctggaggcaaaggagaaagatggagagataggaattgaggatggatatactgacattgagtagcagaaattggaaaatgtggaaagaggataacatgtatgatccccgaggtgacagaaagatgcagtggagaagaaatacttagcagatatttcattcagcatgatggccttatgctcaaaatgtcagctcaaaacagcttgttgtattttgaagtaggaaagggtgtgatctcgaagatgagaacggaaacataagggatggcagtacacagtggcgttgtgaaagtgcaggaggttcacatggtctttgtaaggcagatgaatacataatccaacttctatcgttttagaaaaaaattacttactactttctagttttgtagtggcctcatttcactatcaatttcttgacgccttttacaattacaatccaggaaattgaacagaaaatttagcattcatactagactctattggccattcttgttccaccttctccaaatgtagccctgtatctctactatttttaaatatataaaactgttcctaaatttgtaatatttagaattttggaactttaaaataaaaaataagaaaaggtatccaaaatctacttttttttacatactattagctttttaaaaaaatggagaaa

SEQ ID NO: 107090 - DNA, 1399 bp, Homo sapiens
taatgtgtcctaatagtttcactcttgaaattgcagcatctatgaaggtaagatcatgttctttgaaacctgctctctgtattgcctttaagagagtgtatctttctacagaaggcatcatcttgtctaaaagagaactgtagtattgtactttttagaggacccattgtttacattctgtttatattcagtatgacatacaaaaacatccaaccaaaggtgaacagttagtttttcaaatgactcatatatcttaaatcaatcttaatgtaatagctagctattttacagctactagagggaatttttataagacttacacagtttttagtatttttggaggttggatcaccatgacctgaaacagagccaggactcatttctcatcatgcagtataccactgcaaacttgatctaagcttatatatctctttgaagtcaagacaaaaaagcaacccagagggttttatgaaatgtaaagaactactgttttaaggtagagaaaggacttctataatcgtttgtttgctgacgatattcattttaaggttgaaatggttacttaattttaactaagtttctaaaaatagtgtgtatatgtgtgtctgtgtgtatttcgagcaagaaaatgaatttctgaaatctggcttgttttaagaatacaaacattagatattttaagtctctaaccacagaagactagcagtagctttgttgtagtagctcaatagtttaaactccaccttcccgtgatcagcctaaatattgaaaacactcatacctataacaattccaactttgtaaatcaatggctaaccagtagtaaatggtttacattagaactccttttactttaatatcaggattgggatattgtgattaatcaaatacaaggttatctagagaaatactttttcagtagttgactttgtcggaaacttttaattgatcaaaactgcattctcgaaaggatgaactgataacaggaatgaattcctctgtcctcaaattcccttggatgtgaggcagtgttctaagaaatacaatgtctgttgtttaattggaagttgtatgcatttgtgcaatgcagtttccttatgatcttttcactcgtgagacaagaggattaagagcattaaactcacaaatgctttctggaaaggttttttttctttttttttgagggtgtgttcttgtgaaaacctggggagatgctgagtatcatacttggtgatgcaatatgaaacagaaaccacaactgctgaagcaggattcagtgatatggcttaaaactttatttaggatttgacttagaagggaggtttgagctgattttattcagatctcaagcaaccaggttagcctaacatatctatgttacaccacttaactgtgggat

SEQ ID NO: 107091 - DNA, 1085 bp, Homo sapiens
tgatgtgtttatggttcccagactatctgcacactggaatcatctgtggggtgtgggtggaggatggtgcttcgaaaaatactgatgcttgtgttccttccccagagcctgtgaactaattgagtggaggtgtggcctgagctttgaaattctgaaaaggtcccaggtgattgtattgctcagccaagtttttgaatcactggtctagactgtgaaggtacagaataaggagggtgagatactgttcactgtcaggacaccaaattgtttccttacagaaacatagctatagagagatggcaaagcctaatgtgtgtggaattgtgtgtgcatgcatgcacattcatacacagctgatatgagtaaatcatacagttttgttgcattttctcacctcttgctatcctgcctccgttgattgtgaactaagaattatttctgtgtaggcagatgtgttcattgttaggattagtggtgtatgcagcagatactttagagcccaaggaattcctctttcttgtcccaccctacccccaccttttttacctatatgaacacaagatgaacaaatacaagaaactggctagaaaagcattttcaaagcgctgatgaaattatcacatttatcaatattttaaaatttagacacatggcaatatttattaggcacttcttaaaataactcttcttttttttttttttttttttttgtgagcaacaaggctgtttattttacttgggtgcaggcgggctgagtccgaaaagagagtcagcaaagggtagtgggattatcgttagttcttataggtttggggatagtcggtggagttaggagcaatgttttgtgggcagggggtggatctcacaaagtacattctcaagggtggggagagttacaaataatcttcttaagggtgggggagattacaaagtacattgatcagttagggtggggcagaagcaaattacaatggtggaatgtcatcagttaaggctattttcacgtcttttgtggatcttcagttgcttcaggccatctggatgtataggtgcaggtcactggggatatgatggcttagcttgtt

SEQ ID NO: 107092 - DNA, 2415 bp, Homo sapiens
gcatgatttgcatactaaaaacacctctgctttaccacatactaaaaatataagcatatattttcttacatttatttatttagagctttctataaaattctagatatttatttcataaatcctagaagatattttacccctacaatagctttaaaagtaatcaaagatgccaaaatgtcaagtggtcatggatttgtgacactaagtgatgcctgagttccattgctttctaggctggtatttatcaaggactccagaggttgagatggatgtggtctgtaagaaaataaaatgtaatatgctggaaagaaaataaaattttgaaataaacgtaatttcctggaaagaactttataggatacttatatttcatcagaccaatcttcccctccctaccccaggagtaaatgacagaaagaaaacaatggaaaaagtagccactctaatggaaagatgggcaatcacaaaagttattagtatagacatttgatggggtctaatctacctatggaatactgtgttctgtcaagaaaagagagctaatgtgtcttctaaatatcaaaagacaggagccaatttatgcctgtcaggcctcacttttcacagatttaaatcgctcctgttagggagagacacattactcccactgcagtcaaatttccctcttgattttagtcaaaaataattttaaaagctttctgacaatttaaaagagcattttaaaataaatggcattattttagaaatccctactggataccaggaattacctataattagtgataagttttaatattgtacattgctcctcttttatatttactatattttaaagtaaaatgtctttaaggcatactcccatccgttattaaatcattttctttgtacatgtttaagagttatataaaacttttgctgtctctaatctaagtgaactttattatttttgttgcctgaatgaaaattcctgatgatatttcgtgggtcaattagcttcctaatatttgcaggtgtggcatctgctgtgttcttgattgtcatggcataataaaattgtgggctggaagacatgaatgtgatatttccctacgcattatatttcttacacaagcaatatatcctagttacttcaagtcagcatgacatcgtgtgcaaaattgcatactgcattaggccagatgagacattgccatacattgctcatgtggatgcaaattgccacttatctggaaaagattctcacaataaatgaacaagcaatttctctctctgtactgaggctgttcgtgtcttggtggatgggtaatgagaaagagacagatgagatgaataaaggtgttgcatttcattttctattttatcttcttttttgtaacttctgtcaaattaatactgtaaaattatctgtttccaatttccattctttccatccaagaacatgacatttattttgcagaaaaaagtaacatttaaatttatattggaaattggttaacatattctgggactcaatatatatatatttttttgttttaaagataatattaaaaataaatttggaaatattttcagtattcaaaaatcatagctgaacatctgcacagttgagcattagcgcatatacactcattaagcaagtatgtaggcagagattaaaggaatggaatgtttttcatcattgaaactgctgtgtttatgtagctaaatctaagaccaattaattttaaaacatcaatgtatttgttaacataaatattttttgtaaatttggcagccagcatttttattaagaacatcatgcaagttcttccattagagctgcagtataagaactgaaaaagattatattcttaggtctgtcaaaatattctgaaatgttcaatgtaatatttttaagacccatgaatctattctcctattctttggggaattaaatatttagccacaattttctattttacatgatatgcatataaagacattgaggaatatagaaattatgaaataattcagaatttattaagaattcccctggcaaaccaaattaaatattattttaacatctagttgttaatatgttactattgattctatcttagaaaagtgcagttatgtgtaactgaactttttgttttcttgtggttgaaccctgaattaccatgtcttctggtttcagtgtttttcctgggaaacagatcgtatttcttactgccaaagcccagaaataatagcctcacaggtccatccacagccccaaaggcttttctgactagtacccagagagcaactgcagtgcttcagactatttgtggacaagaaatcctaaaacatcagacgctgtggaaagcaatttcatttcattaatacggttcctaattatctgcatttattttattgtctaagttccaaatgcta

SEQ ID NO: 107093 - DNA, 1039 bp, Homo sapiens
aggaagaagtatgccaggcagttcaattaataattaatgataaaggtgtaatctctcaaaatttaatatttctggtgtttctatattattcctgcagcatctttatgttttaattacttttaaatatggtagaagcaacttaggaaattatttagaaataagaccccataataaatatgactttattattggtgttatagtaagttacccaccaacagaaaagaatagaattgggtttatttgtaaacaaatttgattccatgatattggtatagtaaggaatcatttcattagtttaacaattgagaaaatgaactgttgaataaataaagataaccacacttgaagtagaatttcttctcttaatttctatgtttcattattttgctgaattccaatatcagcaaatgtatacatatatacctatacatatatatacacacatatatacatatacatatatgcatatatatacatatacatatatatatacatatatacatatgtatacgtatacatatacatacacacagacaaacccagaggacttgagttctcttggatgattcttgccattttttcgttcactccaacctttactgagagcatggaattctgagctacttttgcggcttatttatccagccccaattcctaatggacataaatgcaactggagtagagaatgacatattgacgtttgggaatttttctcccctagttacatctttgccagggatagtcttaatagccagaagaaagaaatggaatttgatcccagtgtaagaaactgtctgatgtagtacctgtcatgaataattacaatggattaatgctatggtgtataaaactttgtaaaatggattatatgttccttttagtattgctattagttatatgagcacctatgaatttcttctaagtgaacttcaacctactgaatggattcacaccctttgggtatgatacagacagacacacatacaaataagtgtggtatatgattgagaatgaattgttgaaaaactgaatatatgtg

SEQ ID NO: 107094 - DNA, 1050 bp, Homo sapiens
tacaggtgcagacatgtttacttaactgggcaaacatggagagaagctgcatcataaaggccaagtcagtggctgtcaggatggttttaattaacagtaaggcaccattggtcccattttgtgtgcacttcaaaatgttagttgtccattgaggtggctcacagatgaggcactacttgagcctagttgaaatgcagctgtgacatatgctttttaaagaagacaggagagaggagtttggggcacacgattccgtgtgaattagaagctgttttatgagagatggaggacagctggtctgttcataataaatgttagagaaagtctaatatggcaggaaaaatcgtaggattctgaaataagaatgttgttagcaatagcaatatatataaaacaaaaatgaaaaacaacaaaaaagtattcacatttataacattcttagacttttattagagttatgttgttttgtatgctctaccatcatacctcaccttgacagtcatgctgttagctgcagaagacaatctgtcatagtggtttaaacactggctttaaagtcagacgtacttagatccaaatcctgcccccgccacttaatgattgttttaatgttagcaagttacttcactgaggcttcatctcttcatcaaaaaatgagtaatcgtacttcctttaaagatttattgtgaatattaaagcacatttaagtatgaaatatagcaccttgtttatagtgagtgcttaattatattattatatgtgaatgtgtatatatacacattttttccaggtatagtcatctatcagtttgtttagtatttgatatcaacagtagagtttttgtgtgtgtgtgtttgtcttgctctgtcatccaaactgtagtacaatggcactatcacagctcactgcagcctccatctccctagctaaagccaccctcccaccttagcctcctgagtagctgggactataggtgcatactaccacgtctggctaatttagggtccctctatgttgcaaaggctaatcttgaactcctgagctcaagtg

SEQ ID NO: 107095 - DNA, 3095 bp, Homo sapiens
ggctggaaagttagtcaaagaactgatataatggtaaatatacattttatttttcaaataaaggtaacatttttcagctgtcgtaacaaaaaatcatatcaaaaaatctgtgcttctttacatatactatttctgttgagtgcattcaacaatataattgttttgtttaagtgaggaggagaaaattggacgttcaagagggcagtaaccagcagaaacacttcttgtgactcatacacaattctacatttttattcttcaaactaaagataacattctttttgttaaacatctgatgtttactcacagattatgtatgtgatcatttgaaaattaatgttttttaaaaagggtaacctaggttttaatttattgtgacatacagcctgaactttctacggctttgaaaataaactcacagttttctatttgcacatggatgcttcactatttagctaaaattgatgatattatcacaaatactatagcttgtgcaaggtttcaagaacaaggaaggaagtttaataaaacagaggctgagactcagctttaacaccctgtctcccatgctaatctcctgtttacaataatccattacgaatatttaatggtaggcagcatgcagaccagaattaaaggacatatgggtacagttatcctggttaaaatggccaacgtgccttgtattgtgtatggaagataacaggacaggtggtaatctgtcttcacggagtggagacagctggtattttctgtaagccgaagccatctttttcaatgtagtctcacctcgcagctgatatgttgcttattagtataatttaaaacatatattgatgttaaaaaccatgctctctttctgtccagtataaaaatgcagctcgtggcacagcataaacagatgaaaaatatgtatgtatattccagtatttgtaattaaaatcattctgcttaatttaactgttttttaactgtaaaatcaatattatctttaggctcatctataaagtattttttctttaagctgtgtaagggaactttcttccctgtgttgcatattctccagacttacgaagttattgggggaattattagttcattaccatcaaaatatttttgttaaatttcattttaaaaaatatttcttctctcttgtttaaactacagtatgtttcatttcttatactaaagaaagactcactggacatgtattggaatcaaaatagcggactatctcagcctttccttgggaagtggtgtttaatagttttgcctgctttgcgttatagaatataaagaagaaatgaaatgttgttagattctgtgtatattgaaaactgtagttctgtgtagtttacaggccattttagattccaattaccccctttgaaaactggaaaaaatttgacaagtccttcaattgcaatgaccatatcaattgatttagtgcttctcaaaattccccaaaggcaagttcaggttaaaggtcgggttactagtgcatgacaccttactcagtaggatcaggatcagcagtttccaacagcacaacggacattatttccatttctcctgtccaagtattgcacagacaatttcacgaatacagttcatatctataaaagaggtaggactagtcacaaagtaactctgaatgaaagagtttgggggttcagcacgtacatgaaatccatgtttgcaagaattagatgctctgctttttaaaacttaaccactcaaattcattttaataaatttcatggcctgaattctccatacattacttccataaaagcatttaggtaactatgctctacaaaagtgaatttaaaaactacagatgtgaatatcacaattatttgccatagattggattttggagcttctcaaagtatggatgcaattatctattatttcctttaggttctttcatgtctgtggttccatgttttctcattgtaaacttctgttacttacacattattggaacagttggcattatttagtgctgtgacaaactcaatgatctctttgacttaattttctcctcaggttataattaccccaaaccctgttttcttgaagtctagaacagcagcccttaaactttagtgcgtttcagaatcatctagatgttttcttaaaacctagattgctaggcctcactcccagatcttctgatttagcagatgtgggatgggacctgttaatttgtatttctaacaagttcccaagtattgcccatgtagctggttcagagaacacacactgagaacctctactctagaaaatatactttaacattgctttttgcatatgtcattacgcctttcaaaactgtgatctttaatgcaatggagagaatgttgtacccaaagtaatatgtaaaatatttgccgagcatttgagcaaatcattgtaaaaacatttgcttagttgacttgagagggtcatttatgtagaccacggtcatatcccgtcatttgccgtttctctctttttctcatttctctccatcctaatcctctttatccactttggagttttctacaagattgccctaatatttgattctggttaactgttacgaattacctgatgacatttcatattatcattgatcccttctaggagttgaatcagatttggtattagtaggattagaaacagtaaaacattcccacgttttctcctgtttccacaaatttgccagtcctcgggtgagcctaagtatgatttgaagtaattttgtatggaacagtaaaaaagttacagaaactaaacaaaaacaaacacaaaactttctggacgtttgcctctgttatgtatataaaagatgaatttataaagtggcttgaaatgtgaatttaacagcagctttattttataggaacacgcaggatccttaagaaacatataatgctaagtattttatatattgaagattattcattttcagctgcaaaattattatccatcatttgttcttgcattcaaaataaagaaatcctttatccttaagtaatataatgttaagattcaggaatattttaatacccatattcatcttcttaatgtctttatgaaatgtgtct

SEQ ID NO: 107096 - DNA, 1002 bp, Homo sapiens
atatagcctttatgatttttgaagagatttgaataatgtaatatgaaattattgttgcaaattgtgaagcacaacatatgtctctggcatattatatagtcagtgatttatacaaaatgaaacttaaaagtgaagaaataacggcccatacattaaaatgttttagccatatgggagattccattttcttactgccatttgtttcttttgaattggttttcccttgccctcagataagatgaaaatcacacccttgtcctcatactttgattactgaatcttagtgctcaatgaatgaattgttctcactacaaaactcaaggcctggggccgtgaagttttcttggtctctagcctagggaaatacgaccctctctagaagtacttcccatgtgcacacataaaagggctctgtctttaaccattataatagctttctgctttcctttaagaaaagttttgtaaatcaagaaagcttttgtaatgtgtttctttaatctctacttgcttctctttattctttttatttcaaagtttaatcagaaactctaacatttcacaagttgaaaaaaaataaaatgtttcagtaatacacgtaacaccgtaagacaatatattaatacatctgcaaacatcagtctattattttcctttgtgaggactggaatttattactatttacaaaggagagattatatttgaaattatttttctctttctagttaatccaaaatgaatcaatggaattttaaatattttttttactcttttttaaataaatgatttctcattgctctagattattaatcttttggattaatttatattggcttgacattttaaaaattgaaaactaagcaaaagaggcactggtaaatctcttgttacgtcccttgctcagttgactgcgatacataatgtaaatataaaagggccacaattttgggtttgatttctatttagctgggttagccctactgtcaccaaaacagaattcactat

SEQ ID NO: 107097 - DNA, 1022 bp, Homo sapiens
agccaccgcgactggcccagaataaagaattttttaggctgggcacagcggctctcgcacttgcactttgggaggccaaggcaggaggatgacttgaactcaggagttccagactaacctgggcagcatagtgagacctcatctctataaacattttttaaaaattagccaggcatgatgacgcacacctagtcctagctactcgggtggctgacgtgggaagatttaagctgcagggagctgtgatcatcccactgcagtccagcctgggtgacagagcaaaaccctgcctcaaaaaaaacagaaagaaatgaaggaaggaaggaattttaaatgcatatcttcagtaaattttactaaattttatgttaataattaaactttatgtctcagtaagtattatacaagatatttataaaaattggtataaataatatacataaagtggtaagaggaaaagctaatcattcttaaaatgtgtggaaatgctggaaatatgttatatcagataaaaatctatgttaatctgctctatttattatgatttcatttggaagtaaaaatggaggattatgaagttaatttgaaagtagaaattgaatataaatatctttaaacttttgtcagaagcggttaaaattaaatcggaaacacctggtggtaatttttctttttatctcttcaaattttgaaatattttcagaattaggaaactctttttgaacattcttgatgtttcttactattaggtgccttcataatcttaggtaagtctgaatctaaaccactgtcagtttcatatatttgagcattgtgtttccaggatcccagagtacaaaggctaaatttgactttgtcataatagatgatagtgtttcattactttatcatgccacatgcggaataagagtgccctggtaggacctgtattttctatatcgtttctgtcttctcagtttgccactgtttttgttttttaatttgtatcttaattttaatcaaacacctaataatgcaaaaag

SEQ ID NO: 107098 - DNA, 1056 bp, Homo sapiens
tacataagcagaaaaaagtattcattaacattatagctaaatgtatagtgtaaaagtttacctcaatgtttactttaataacctaacatgtaccgcttgaaactcaattaaaaggcatgacaacatagaaccttgaaaataatttggaatttagatttttaaaatattaaattaaaaaaataatagatttaaaaacaattgctactttatttttaaattatcaaaattattaatttaagtattttaaaatataaatatttccatgtaaatgtaaaacaatttacagatattaaatatttaagactctaaatatttaattatttttggaacactctgcttttgtttaaagtgagacacaaaattcagaaactagaatgtcacagcctttgccattgcagcttgcttcctttgactgagatgtgctgatagtaaccattttctaagctataatgattaatgctacttaggggaggtaggaaaaaagttaatttaactggagtcgttcagttttaaagggattttattgaacacagaaagtatacacaaacacacacacacactgaagaaatattttaatatgcctgttacagatgcagttacagctcttttttgtttttcagtgtttttagaatgtcagatccaaatattttttattttttaaaaataaagttgaaacatatgatttattcatgaaatttcagagggggaaaatatgaacaaaggaatccctctccctctaaccttgccctgaaatgctacaatgactgtgataattagctccatgttattatagattatttttcttataaataatttatatttcagtttgctttagttctttaaaaaggcaaagcatgaaattgattagatataattgtacgtttgattaatatttaatttgaaattattttgcagcttcaagtttagatgtaactgtcacattttagaatactaagtgtatattagatagcttggtataaatgtcttcctaattattcacttttttattattcaaaagcaccatttctcatagctatacatcatgttttataatgt

SEQ ID NO: 107099 - DNA, 1562 bp, Homo sapiens
tggcatcactgtgctccagcctgggcaatagagcgagactccatctctaaataaataaataaataaataaataaataaataaataaatgatactggaaaagaaataatttctgtgttgacagtgcctgaatttcctgaggttgcttgagacactttacatatgcaaaacaggacctagcaacctttactttctctttttctgtctggtaggggataaaatacacacaatgacaggactgtctttataaatgaataaaatggaaaggtgcatctggttatctggggcctaatttttaattcagtatatctgatgtttaagtctaatctcagtctcttagtctctaaagtgaaaattgtaacttcagtcgcattttaaattgtgttgtatttaacccagggtttaaattgaagttttaatagtgcaaatgacattttacatttgtcaggagaaataaaagtttatgatcaagttatttagtatgcctgaatgagaacattttaaatcttatccagtaaattatggagcaaattcagaataaaagctaaaaagttaaagagaaaatgggcaaagacaccacctccacgaaagtatttatatatctcaatctctccccctccccgactctgtacatatttaccaggtaatactgtcctgtatgtagatttagtcacattaagttactcttttatcagattttcatctcagtcaggcaccagaaaaatggattaagagccagcatttaatgtagaaggacctttagaacattttaattatgtaattcagcacttgtcatagcttatgagagtgttctcaaatggaagtgtagtacaggttgcaatctcgttgactcttgcttaaaggcattcttggaaaatatgatttagaatattttcctttgggaccacccctgggaagaaaccagtaaagagtcaataactgatgaaagaggaacaatatttatatgaccagtggatcgagaatctgtggatatttgcttttctctctgcttgtcacttttgcttaaatcacgcaaagtagccctaaaattctgtgtttggactctaacattggtagacaataaggtcaatttcttaacatttttctttttcttttcttcttttctttttaaaaagtaattaacacttaggtcactgcattgtctcccattaaatgagttctttctggaccatgttggtaataattcttaaagcctccctcagagttctaatcaatacatttcttatgaactgttctagaaggcgttttgttctgttttagtttaatgggttttcttaaccctatccaatgactcctttctgtagtggacattgtggatactctttttagttacagacaattaattctgtcattaagtcaaaacaaattttgttttcaacaaatttaataaatgatttatttagtacagctctgtgatcttgctgaaattatttagtctctgtgtgtttcagttctcttacctgtaaaatggggatatgaattatgcttacctaatagaggtttgggaaggattaatagttggtgtatctatagtgctcagaac

SEQ ID NO: 107100 - DNA, 1030 bp, Homo sapiens
tatggaaagctatttactgttcaataatatttactcttttcttaggtggccaaaaaaggcattaggtatgttggaatacatagtcagctatgtcataaagactaaatggaaaagtttgactctctagattggatgctacaaaacagctgctgtcaatataactgtgttcagtattactggatacactatcctggaacagattcaatctggtaatcttggggttaagggtgacgtattttattaccagtctcatgaactactccttttattttcttgaaaagtagctgatattcatacatgctgaaaagtgctaagatgagtatttcaacactagttgatacttagatataaagcctcttgagacgtccagaatatcaattcagtatttggttatttatgggaaattcttggcagtgtctccttgtatcaacagtactgtctttaaaaactaataaaatgagaaggtgcatctggttatctctgaagccttatcatcagatcactctttttaatcctcctaatttgcttattatttaaatgctagaaatctttctcatattcatagactaacttgagaatcatttgtatttaaaggttttggttcacaagtttaatttaaaccttagtataattaattttaattaataccgtagagtttaactgaagctctcagtacttaccagtttaaactttttttttatttttgagacaggatcttactgtgtcaccaaggatggtgtgcagtggcacagtcaccctcactgtagactcaacttcctgggctcaagcgatcctcctaactcagacttctgagtagctgggactaaagtgtgtgcctctacaccaggctatttgttttgttttgtttttactttttgtggagacaggatctctctgtattgcccaggctggtctcaaactcctggtctcaaatgatctcccttccttggcctcccgaagtgctgtgattataggcataagccactgtacctggacaatttaaaccttttaaaatctatacttgctgtac

SEQ ID NO: 107101 - DNA, 1140 bp, Homo sapiens
ggcaatgtgtaagcgagagaagtttctgagtggagactcaaaaggattcaagaattggaaggtgtagtcaaggcggacaccagaaagattgttagtaaatagggtaggaaggctaggccaatgttatgcagtgtttaaatagtaatggttaagccaatgctttaaaaataagcgattaactgttttcaagtgatatacgaagatattttgtgaattcttctgcaggctcccgtcttcgtcaggaagattttccacctcgcattgttgaacacccttcagacctgattgtctcaaaaggagaacctgcaactttgaactgcaaagctgaaggccgccccacacccactattgaatggtacaaagggggagagagagtggagacagacaaagatgaccctcgctcacaccgaatgttgctgccgagtggatctttatttttcttacgtatagtacatggacggaaaagtagacctgatgaaggagtctatgtctgtgtagcaaggaattaccttggagaggctgtgagccacaatgcatcgctggaagtagccagtaagtaaactgggcgctctgtgtttggcagagggagtggcagagtggcgtcatttgtttgatcatggcaatgaaaagtcgaatttgtatctcaggccttacctgaggataaactctagctttgtatgtgaatacaatctactatttcggttttctgtatttctcatcctaacttgttattcaagctaaattggtatttacacacagttggttaacaatttgacttttgattgggagtgattttctgttggaaagttttattaaaattgttccatcccctcctttgttacctttaaagatattgaatagggaaccatgtgctgcctatagttcagctacttgagacactgaggcaagagaattgcttgagcccaggggttctgggctgtactgcaccatgtccattgggtgtccaaactaagtttggtgtcagtacggtgacctcctgagaatggggaaccaccaggttggcctaaggaggagtgaacaggatcaggtcagaaatggagcagatcaaaactcccatgctgatcagtagtgggatcatgccggtgaatagccaaaaaatacacacacacacacacacac

SEQ ID NO: 107102 - DNA, 1052 bp, Homo sapiens
taattggagtagttacaaattagatacaaataagcctcatgtagggcttacagtctattaaaggttgaatgtatacgtattagttataactttgaaaaataacatattttcctgtcttgtcatagaatacatgattgttaaacttcctctccttctgcttagttaggtctttcttgtcagcacttcattcttttttgtcatttattcaacacatggtttactgagtactgtaatgtgcacagcactctgccaagcataagggaaataccatgagcaaaaccagacccacagatcttacagaagggtgggaaaaacggacaaatagcatccgacaaatagatttatatattgtaattctgatcattcttaccaagggtagctgtatagtgctatttcggtttataaaaccaacatttaacttgtaaagattagagagagcagagatttgaaatagagtaggtgtattctactgtaagattacttcaagcccaggccctgtggcaggcataaatcatgttgcaggaggatgcgcaaggtacttgtggagctaagagaagtcaggctgaagacagcagagaaaagcatggaacaggaagtgtctagacaggtggatcagggaatgaacaggctaactcttgtaggtctagttaaagacttacgttaagagcagtaagtttattttaagagccactgaagtagaggacaacccacattatatttgcatttcagagccttcatctggctacactgaagtgaaactatttcacaggctttcctacatcctggtggaaagagacggtagttggacttgtgatggtagctggttatatagatgaggctaagcagagtaatttgagaacttttcaggaggaatttggaaagaactaggggacagaaagagaggaagactggtttctaatttgccttattcattgaccttgaaacactagatgagggcatgatttgggactctttcagtaaggcctttggctgttgaatttgagaaatctttgataaatttacatatttactgtatataagcagaaataaga

SEQ ID NO: 107103 - DNA, 1901 bp, Homo sapiens
catatctctggggacatagccatacgatattagattctttaggaatattacaaaaacaccaggcattcactcctggaatttccttttggtctattttggtaaccattttagatgataaattctaccaatggcactcagttaattattagggttattctaaattttgactggagaagttttcctctaaatagtgtttgcttaggtagaagtttataatcaagagacattagaataaaataaagtagctgagcgaaatggcattatgtagtaatcatgtagttattataatccattccattttccttgtattcatgtactatgtataattttgggtgaaagtacttagctttttttgtagagtgtggactgtttttatgcttcttatttcaacagtaagcatgagtatttggaaatgtgtgtaacttaatagaggatatttaaatctactctgcacagtgagtaattaatgggtgctgccttcttattttttaacaaatgtcttcttgtaggatgaaattctgacaggaaaattacaggattagtgcccatgataggatttatgttaataattggaggcagttctgctcctttaaaggtaaatggagcttaaataaaagtgttaagcagcaaggctcttttaagaatataggtttgaacctatatataaatatatagatttttatatattatatatataattacatccctgtccccaccttggacagatgtcgccaaattctctattaattgtctattaatatttatggtgtatctgtcagctactcactgaatttgttcctcttctgcttttaacagttttataagaatttttgtgctgcaagatacattaatatgatatttgatggagacagatactttaatcattttaggttttctaattttatacagcagagtatgaaaacggttggatcaaaacaaaactactaataaaataaatactgttttttctgtctgttaagaaacagacctgaaacacaaataaacaaaaccataaggtaaatattaatgtcatgatagaaaaaaatcatatatatgaataaagaataaaattatatatataattcttttaatacatatgtttatgcttacctcaacagaatagtaacacgagcagtctcttaaatggttactttctgtgtttgtgtaaaagtgacctctcagagggggaagcagtttacatccaactaggagtttggtttcctcatcataaatcttgtgtgactttgatatatttccttgaaatacttagcacttacgtgtatatctttttccagctgtggttgtgtaaatatttagatatttcagtcactcatgtttatattttatcttccaactgggcagttgttgaaggaatcctgccctgcgctttccctgatgctggtcttgcctgaagtgagttctcaagattctaccaggattcttgcagagggcagttgacagtgtcagagagagtatcatcctagttcctttgtaaaagcctcacgtcatcagtctgtgtggtgttgttgttttttttaaccccctcttctttgtaactattaggtttactatgcagaatgtggttgaaacctggaagttggttctgccaattgggatagaaattttgtatcttattacataaaatatgtacaaattcacataactagaatgatggttatcagatgttttataggaatgtggaatttatgaatgaagagagaaagctttttatgaataatgagtcgaatattatatatatgtactgtatgtaaatatataatattataaataattgtgacagagtgaaggtagacaccacttttagggtggaagactgcaatcactgatatctgggacttggaggctttcatccgtactcttatgagatttatatatgctct

SEQ ID NO: 107104 - DNA, 1059 bp, Homo sapiens
atgttaaaaagctggctaagaggtatataagtgcatatgcattgattaagtgcacacagtgtcacttgccatttgtattaactttgaaactttaataactagaagaaaagagagagagagagacaggtaccacttactgtttttgtttttttgaaggtttttttttttttttggcattcttgtatcaccagcatctagtgcagacctggtgcagcatggacatttagtacatatatttcgagtgaataaatgaatgcaaaagagttaacaaaggttcaattttattttctccatattttcccaaaaaatatttgttggttttcagaacttctaaaataaaagattttattatgaaaataacaccagaagatcgtggattatttagaaacgacacacacttatagagaaggaaacaaaaactacacatttttcaacagcctctaagaaataatgttaagattcttttcagacctttcttctgtgtctcttctttttctgtctctctttttctcagtctgtcttttaagctagaattgtacaactttcacctctgttaattcttgtatttataccacatgtgatactgtgttcacgtttcaggtttcagtgtcctcagaattaaatttaaggagagcttccagccatgaatgggccaagagccttgtatagccaattgcttacaggaaggctgtgtcttcaagactcccttcccttgtggatttctgcttcccataagcagaattaaggctattccttattttatcttcagctcagaggtacactgactgcctccaagaatgatgcttgtctataccactaggtataaatgcctatggcatcacttaacattttcttcttccattattattgattattcattcaacaaatgtttattgagtacctgccacatgctaggtgctgtttcaggcaatggggatgtggaaatatttcagttatggttaattatttattaattaaacacagatatttcaacaaaactggtttttatggcttttttccttcaaaattaagaattacaccactctcaagatagtttaa

SEQ ID NO: 107105 - DNA, 1025 bp, Homo sapiens
tcaggaaaaaaaaagaaaaaaaaaaaggttttattctttttttcctcactgaatgctgccatggaattataacctatgctgatagtaattgctagtgacccaagcatgttagaatatacattaactctttcattccatgattgtaattaaggactgatccagggcaccaaatggtgaggtggtggcttgaaatgcttttctagagccctttcgttttaagatagcctatcattcccttttggctcaaagcaaatgtatcatctgggttctcattttcttggaccttcccgtgaactctgcctctgattacacccttcttcaagctcctgatggctctggagaagatgagatgccataagcttgttctttccttttcaaaacttttttctcatgtcttttcttgtgcatgatcattaacttcatgttatctccttaaggctttgtcttgggctctgctgcccctccttcttttcattgttggggttttcatcatccacataacttgaatcttaactctgtatagctgatatttgactaggcagaatttccatgatactttagcaacatgtatttcccaggctttgtttgaatttcgagccttgttactgtctgcaaatcttatcttgactgctctgtataaataaaaattaataataaacaaaactaaattaaaatacattaaatctgtctaaaacagttgtcctgggatatttggtaactttggctgttacaactctgccaccaggatctcgtgagtagaggccaaggatgccgctaaatagcctgtaatgtacattacatcccttcgtaatgaagaatgatgtggcccgaaatgtcagtagtgccaagtctgagaaaccctgctaccaaataaaattacagttgaccctagaacaacactggggccaggggtgctgacccctcgtgcagtctaaaatcctggtataacttttgactccttgaaaatgtaattactaatagcctactgttgactggaagccttaccaataacataaacagtgaat

SEQ ID NO: 107106 - DNA, 1057 bp, Homo sapiens
acagtgtcatgctctaataagtctaagaactgatttgactgggttcaactacatatataagtgtattacacccttgcctccacttaaataaagaagtgagtaaatgcaggcttttaggcctttgtattcctgcctaaatttgactcaaattcaaggaatttacaactatgagggggaaaataaggtctccttacaatgcagtttacttaggatttgagtatgcttgttaagtaggatttttaaagaaacgttttgaaagtatgcatgtatgtatgcgtgtgcttgtgcttgtgcatgcacccttgagcatcttattgttaaaattaatctttttatcatatccatccacccacacatgtctgattccagaacatgtcagattcacaagtgtgaactaattttacattatttggcttgaatgcagtcctcttgtgttcagagttgatttcctttgatgatttaaaattgagttagattctataaatggtgggattatgagaggagaattgagaaagtctggctcagtgttgtgaaatacttagagaaaatattgttcagcttttctgccactccatggccaactagatatatgtattcgcatctcctacgaaaatcttggcgtgttcttttgtccttactgctgcttcagcttctggtaaatagaagaatctgatccacctcagagctttccttgaacaagggttttgttgctctggaaaacactaggtgtacacagacatgcttgaatttcatgaatgtcttctagtgtgaaacaatgtgtgataatattgtgtttctagactctttttttacttgtcttggtcttgattttaaatgcctttaagacaaagttgacacaggccacaactccaagggtatttgtattctgtttaaacagtggctttgggattgtgtagcttttactagcaagccacagcacaccttgactcacactgttttaaacagtaagtaaatgtattatgtcatacaagtaataattcaagtgacacaaactgctcacaaatgtcatcaagcactgcatatttcctgccattgc

SEQ ID NO: 107107 - DNA, 1064 bp, Homo sapiens
ttagtttcagtatttgaagagagttattttgttctttttaaacttgttattcttcaggcacaagatgcccttttttttaaatttttcttatttgatacagattcatttcccttggttatgttgtttttgttgttattgttttcaatatatctaattagccagtgtttttctaaagtgtaatgtcaagtttgaggagtctaccttcctgtttatttaaaaatgtaaataacttttaattttcttctaaccttccaacaaatcttgcattttataaatattcccttggtatcctgggatgtcctacttttctggatcaggagatttaaaatgtattaagaagctagataactggtcttttcatctttatttcccactgaaccatctgaagtctggtctaaagtcacagtctcacaataaaacttatgagagtctgtttttttttttttttttttccgatattttgtaagggttgaaaactgaaatgcctatacaaggtctgtataagaaaggaagtgcttgtattagggccaaggagtggctggctgaatcttgctccagggaaatacagcctcaatgtagacatactttcagatggactttcagatggacttttcaagaggaagcataattctgcgtttttaaatacaatttcctaaccaataaatatgggtagttgagtgtgaattaataataataataagcgcttgcaccaaatatgatatatagtcatcattttgtggctgcagtattacaccactcatcctatggccaactggcctatctgttgctgcctatttctactttaaatacatcagtatctccttactttttgttatcttctgtgttttaccttttcatttttctggtgtttgcccctcttctttgtatggttactagttaaatgtttacataatggcttacttaaccaaaagcttctcctttattggtagctatttacattttacaaattgtatttgttgagccaggcaaagtgatcagttttactgtttatgtttattcttttgtcctaaagctaacaaacaaagacaacaaaaccacgagcc

SEQ ID NO: 107108 - DNA, 1044 bp, Homo sapiens
agctgtccatggcttagagccggaaaataatattctgtttattttgtttaattaattcatattattttgaggggaaagtggatagaaggtaagcaattgtagaaaatgttctagggtcacaagatgagactaaatagtctatctgggcttaatgcttgtcacctagtttgacacttaaatgaagcgttaaaagcaccatcaaaggatacaagcaaatgtcaacagagcagtgtggttctgtgttaagtgggaatatagtctttttgtgtcaagtgattgctttgtatgcagcatataggaaatagtcggttttggttcctaataatacagtattttggggatctatttttcaaatcatgttagtctttcagttaagtagagcaaggtttactagaaaacatttttaagctacttctggcaataacagctcacagttaaaacactttctcaagatgctcttggttagatttcagaaagtatcaagttcaaagtatgtctaaattcaactcatgtgtacaggacctgagagctggggacagcttgtccacagtcagccatgaaaggagcgtggagtcctcaaagctctcctctaagattatttgcagtgttctgcttgaaacacagttcgtatgcccagtttgtatagaaagtaaaagagcaaaaaaaattgttatgtatgactagtaagttcttgaaaagccatttcaggtatatgttatctcttgatttaacttacaatttcaatgagcataacaagatagtattcatatgacataaaagtctttggatcatgttaggtatggtcataatttatgcaacattatgaaaacatatatataatatattatgaaaaacatatatatttatatataaatatatataaaacattatgaaaaaaatatatataaaacaccaacttgctaagttcattcctgggttttggtagaaggctagattttagcttctctgcactaacgtgattgaagcccttttatgttattagcaatttcaggtagagtaggaaaagaacatgaagccaaagaa

SEQ ID NO: 107109 - DNA, 1012 bp, Homo sapiens
tctgtatggtaacgcttttgcttaaaggagaccagtaaagtgaaagaaggaaataattaaaagatgagatggagttccaactctaggtgcaataagaaacttcatgaaaatggctacttttactgtgaagctaggactatcactttactaaacactcaccattatcttatttaatgctcataaaaatcctatgacatatatgctgttatttctaagatattactgtgccctgattttactgttgtagaaactatatcatagagaagttagggaatgtggttcagcagggatttgaaccaagctggctctaaaactctcaactactgtgcattttcctagtcgaaagagagaaatgaagaatttaaataaaaaagattatggttcaatcactttttattttaaaacttgtctcagaaaaaatccacttaaatgaaactgtggtttgaacacttgagaatttggaaggaaggcattattcttcctgtcattaagaaaatggtctctaatttttagatcaccaggcaagacagtcagttctttacatcatctaaccagttcacattgagccttgattatatctgcattttctggcatgcttaaaagaggagactgaatgtgattcaaaacattgtctgctggtgatgcagatgcacgtggctttcgagttgtattttggaaaatgaatggcattgttcttcttgcacactggaggaaagattttgctctgctctgaatcccaaggcaagtaattggtactcctcactgaagagcctgtggagagacaatcatttcccctgtggttgctcttaggctctgggttgagtatgggctggtgatcatttagtagatgagccttctgcttgactgctgttcacagataactcacttcatggttactgatcatggaagggttgagccttaatacctggttgatcagctggttggaaactgcttatgcatagccaataaagttgccatcctgtggagatcaaaaggctacctccattcttta

SEQ ID NO: 107110 - DNA, 1031 bp, Homo sapiens
taaggtatcactgaaagttggtcgtgtcaacttggaagttctgtcttcacttggagaattatttgggaagtactgtcctattagatttaataatttgagtagtagatatctgaggattgcaatttgaatagatatgagacaattataatgttagagctacactgatttctagcttttagaaatctaaaatttctagtttttctgtttctaatttaattttccatttaagccattgatgatttttgtaaacctaagtttttcctataggtgtgcctatctgctttgccacttttcaggacaaaagcttctttctaaagtgctccctcatacataacctgaagctttttattcctctgatcactttcgctcatgctgtgaatctgaacttgggaggccaaactattgagctagtagggtgatttcatgacagtgttcagttataaagcaacactatcgatttgaataatacttcacagaactcaagtgactagaaacctgggtgtgttgaagacacctggtcagagaatgaatgaagttcttgaaagattgtgtttcatgtcttgccccaagcctaagatcacagtctatcacttgttaatggagtgtatttaagagaaatgtggtgagcttaaataaatcaaagtgtactgaggggataacttaccttcaacaagatttaacctgtaaaagcatctattggttgtcagttctttttttcttttttcttttcttccttttttaactgcctgccaacttaacaaagtccaacagttttcttcaaacagattataaactccattttggtatgttgatggcatgcttagtactaagtcttgtgcttaagagtgttcacttctcatagccttttatctattaacttgatgctacaaaaaataacctttcattcaatgaaactgagatttataaaaagtggttattccttcagaaattcatttttcaggtagattcctttaattacttggtctatctgccttttctatggacagacagacttctggtgagtttgcggg

SEQ ID NO: 107111 - DNA, 1288 bp, Homo sapiens
cgatgttgggcgccgcgcggggctgggggcgcccagaagacgtgcgagtgtccgcggtcctgctgctgtctccagtaccctccgcatcccccaagtgatgggaacaagggcccgcccaggcagccgctgtcgccgcaccgccccctcgctcgctctctgcgcgcggagtcacccagtcacactcccggcaccccgagcccttcctccggagctgctgcttctactttggctgctatcgccgccgccgcgggtggcccgctgctgactgggctcgccgggagacggagaagcactttttggccctccctcagcagctctcacaccccaactttgccgccgccgccgcgcctgccctcgcagcggcgctcggccgcacattgtgggggcgcacgccgggaggctccgcaagaccgtggaggcaggaaacggcactactgcgcttctgcctcggctctttgttgttcgctttggatggttcttgaaagtgtctgagcctcctcggaaatcctggggccggagaagacaaaccttggaattcttcctctgcaaaagtctctgagatactgacaagcgtccggaaaggtcgacgagtaattgccctgaaaactcttggctaattgacccacgttgcttatattaagcctttgtgtgtggtgtgtggcttcatacatttggggaccctatttccactccctcctcttggcatgagactgtatacaggatccacccgaggacaatgattgcggagcccgctcacttttacctgtttggattaatatgtctctgttcaggtaaccccgcgtcttctttcttcacccttgatcctccctgttcgccccctctccactttgcacgatcaaacccagaagtgtattttggttacccctccctcctaaggccggaggggctcgattcctgctagacttttaggcgaaaatgttcctagttcgcatttggggttgtctctttttccccactccccaaaacctcccctccacccctgaacctcctcaagactctttgcagatctcggccttttgccaagttcagggcacgcccagattactctgggcaaacgcacgtctaagcactagggtgggaggaggcagcggctggcagtgagctagggcccccaggatgagccgaagtgagtatcagccgccggctgcttccctggggagggaaatgtgcgccctgggagcttgtggcccgcaggcttgccaggattcctgagcctagtcctctctagcccctcctcttccgagcacaaggggttattagtagttgt

SEQ ID NO: 107112 - DNA, 1017 bp, Homo sapiens
gtttttttctagctctgtacaaaaaagtgtgccaatctctattattatgtgcacctttgagggttattgagggaattacatgaaataattcatgcaaagcactcagtacaaggcctgccatttatttagtaagcattcaatatatatttgtaagtattagaatttttacacattcattttttactgtcaaacaatcaggtcaaattgactgtcataaatatgcactgttatgtgcgtttccatgtatctttagaggtaaagcacccaagcttgagaagtatttgtttaagtagccatattttggtgacacttggccatttctgcattaataacatgcctggatgttggaacttctattttggccactagtttatccttaattcggatattataaattatatatatgtaaaagtttttggttatattagagcaatatgggtagattgttaaattaatcattgcagaaccctttgaaagtctaggcagcaatgtgcaaatgcaaaatttataactggagcaaacaaaaagaagctgatgattccttaaggatattgatgtttttttggtttcttccttttgttgtcatcaccagagatttatattacatttggggaaattttcaatatttaatcataagcatttttattccaatgtaggccatacattcaccaatatgagcttactctcactagaggctggccatatttttttttgatttaaaaaaaattgaggcatatgtttgcatgaatgcccatgtgtgttaaaacttctaataaacaatacggaaagatgatcagtgaagaatttaatgattttacttcttatggtgttaaacatgttatgaaaggtctctaaagagaaattgtaagctgtggggggaaaggaagaaaagaagaggaaaatctattatttgaacatttcagttaaataatttcttacttaagttttcctcatgaaaataccacttttgtaggtttccaaaaagtatcataatcattgcttatgtgcctttatttt

SEQ ID NO: 107113 - DNA, 1060 bp, Homo sapiens
gcatggtggctcatgcctgtaatcccagcactttgggaggctgaggcaggtgaatcacttgaggtcaggagtttgacaccagcctggccaccatgtcaaaaccccatctctactgaaaatacaaaaattagttgggcatggtggcacgtgcctgtaatcccagctacttgggaggctgaggtgggaggatcgcttgagctagggaggaggaggttgcagtgagccaggatcacactgctgcactccagcctgcaagacagaataaaactctgtctcaaaaccaaccaaccaaacgaacaaaaaaaccgaaatcccaaaaataaaataggaaaagttaacatactttgtgaatttgttcacttactgtaagtgatacattttaatgtttttcaagtgagttttccaccaattttatttttgaccagttgtatcacacttacctagagcagaattttttttcttcaatggttcaacttattaaaattatttaagacatgctaagtaacaagtaatttaaactgagtatacaagattaagtcagctggtaaactgtaaactgcaaaacttactggggtgggcagggcgcggtggctaactcctataatcccagcactttgggaggtcgaggtgggcggatcacctgaggtcaggagtttgagaccagcctgaccaacgtggagaaatctcgtctctacaaaaatacaaaattagctgggtgtggtggtgcatgcctgtaatcccaactattagggaggctgaggcaggagaatcacttgaacccaggaggcggaggttgcggtgagccaagattgtgccatttcactccagcctgggcaacaagagcaaaactccatctcaaaaaacaaaacaaaacaaaacaaacaaaacaaacttattggagtgatattaagaatggtcaaggaccaatgctttggaggtaaaatcttgggtttatatttcagcttcacacacagactagctgtgtgaccttgagcaagattgcttaacctcttcagttttctcatctgtgcaataggaataatgctacttctcccggtgt

SEQ ID NO: 107114 - DNA, 1023 bp, Homo sapiens
tgatttactctcttaaaatagttctagtgcccaacaattattatacttaagcttcctgagggcaagctctgagcctcacatagctatgcaattttcttatcctcattttagtagatgcataaacagtcatgttggattgaataatatatatgtcctaattacttgtgatgggattaaatgatctcttcttttcataatatgaaagcactcatactttgtcaagtcacataagagttaattttgacattttgtaagctatattggtttatgaaagttatcctaaagtatcacataaatagttcttaatatacatctttaagtgaattcaatctgatcagtcatttttaacatttttcctaccatttttttcttttccttgattaaaaaccccagatactttacattagattagatcataaactaatttcataaaaaatgaaggacacaatttaaatttactgatttaacctaaaatatttaaaaggacacgttcattgccaacattttatttgaaaatgtcaagcatttttggagtgcaattctgttgtatcaagaaaggcatcttctgcaaattccttgtgtaaagaggtgggtgaggattaacctagagctgtggcagctgaagccccctgctgtgtgatgatgcaaatggcatctcaggcctaatgtgctctgcagaggccacaaactcacaggaaagcagtcatgtggcatgagagtgaaatgggaagtctttttcatagcttgtagtggacataaaacatcctttagctttttataaccagaaatgatccagagtatttgtaatcacatgaggttatgacaaagcaaaagagagaacatatattttgtttagagatgaataaaatcctactaaaactatcaacattttcatccaatgaatggtgaacatttaattttcttccaaactatcgggaacataggtcagtttaatgaagatgaatagcaaaattaaaataggatttccatgctattttttacgtgtgttggacttaataactg

SEQ ID NO: 107115 - DNA, 1045 bp, Homo sapiens
gcatttttttgaaagctccattccgtaatctcttaataaaaatggcaaaaagaaggggaaaggaatgtgagtcagccagccaaacacacagagaaaggcctggcaaagctgcctaaattagcatatgctaggctgagtatttccctctgttgttacataatccctttctaatacgaaatcagttctcatacttaaccctttcaggaggtttggaattctcccactgttatatttttattttgcttcatttattttctcatgaattgtgtaaatcatctattcaagggcttttatgtcaagttctttttttccctctccagcccttctgtatacaaatgttccattctgtgtccaacttcaggattcaagaatcaacttttctatagcttccactgagaggatctaattagcattttagtctccctttactcatgtgcagctttctttagaaaatgtattagttctacgaggttcccctaaggattcataatactctagtttgttacatgttctgtgatattcaatgtgccttaattatgcacgtgtcctcatttcaaagccttttcagggatcatgtgggatagaacaggggtctggctgtaagttcactgtcatgtattaatgtgtaggtggtattcagagaaggatgtttctgaaggcaattatatatctatgactccaatatagcaagcagttactcacattctgcacttactagttatcctgccaaggcagaattaaattcaccattgtgatacataatacagtatctgttatttctaaataacagatactgctctaggattgaaataaaataatgagtgaaaatgtgtatcccctaccctgaatagggattgttcctttcactttcccaaacaaaaagaagaatcagaaattgttcctaagtcaatactctattccttaactagcccattaacacatcttgctatggtgggatcttgaagttttgctggtttttatgtgaggctgtagatatttaagcagtattaattgcctgcaatctttatggactgccaaatatcag

SEQ ID NO: 107116 - DNA, 1102 bp, Homo sapiens
agatacaacagcataagagtacatgttttaataaaacaaatatgcttgatgggtatggacagactggggagattaatatttcttatcatttaatgatggactaactataaggtaaaagtaaattcgatcaggcattagggatattttctcccaggaaattctcatcacctagccataccatgatggagtatagaggtggattggtaatagaggaatgaagtggaacacaagcagcagacatggtcaaattgtggttcgtgtggaagtggtagtgagattggtctggtgcaggtcttttattttgtagtgagggttctttatgctgtaaagggaggagctatcaatggactaattaaaactttgattttggaagtgccttacagcagtaagacatgatggtaggaagcaagagacctaagttctcaggcaagccgtgtcacggtctcactggccttgagcaagttacttctcttgtagcttagttttttcagctgtagactgagtggttggaaccacattcattctttggtgatgtattgtagaaggaacttatggatgattgcaaactgcagagatggcatttttctttttcctttccacctaaagatgttttataacatagtataacattaactgcatgctcttaaaatagcatttcctaaaatttaactttttatatccatctatgcattgtttagtgcttaaggattttacatatgtaaacagattttttattgtgatatatgtgcctctgtaaatttcagagcttttctttctctgtcaatgaagtttataaattaattttgtagccattggcctgagtttgagccatacatacttttctcacaaaatcacatccatagatcaattctataaattaggaaattgattcctttgtcatttttattattaggaagtggactggataaggtttttcaattttgagtttgatttcatatttctgtgcatttcatgtacattaaaaattttctgtggtcattttattcttcatagcctttggttttctgaagcataacttattcattcgttgattcatttatcaacaaatacctatttgaaggcagtgttgtaaaatgctgga

SEQ ID NO: 107117 - DNA, 1163 bp, Homo sapiens
catgatctcatttcaaccctatttaaatcttatttcagaggaagcattgtgtaaatggaaagtacaaaagatagggcatcgagaattaaagttctgattgtggctgtgccattggctccccccatcacccggggaaacagctcatctctctagaggtcagttactcagagggtgttaggcttggatcatctccaaggtcccttttcaacttgaagactgactccaattcagcagctaaaattaaataaatggatatgctttgcaaaggttagaatatgattatgtctttgtcattagatgaaaaagttttaatctgacaaaagtgttatataatgatgaaatttatcactagtggtgtttgtaaacttctactgatgcacaattctttcatgtgctttaaaaataggtttgctgcttgtaaaatggaggaaacgtgtatatttattaatgtgtatatttatatattggcatacttactgatatctaagtatataaatcaataaatcttattgttacatgattccatttgtttaaaaaatgtgtgtgcctgtgtacatacttcattgcatttctgactttttacattattctctataaatagaggataactagagttattgagtaactagaagaggtatctttgaagaaatactcaattttgtaaaacacttcttctaagaaaaatcttaaattattaaaaactgtcggccttaagggggagagaaatagatgattccaggaataaacttcaataaatgaagatgattttacactaagtattataaactgttttttttatatccatagagactaaaaaaaaaaggtgttcttcaactactctaagagtcctttagatttttattaagaaataatttccaggcaggactcctaggctataaaattaaacgtggtgaaatgctttttttgatgtctaaaaggatagattaatttttccatctttcttggaataattaaaagtgtgctgtcttcaagataaagtaagagaactgaaggacttcaaatcacgagatagaaaacgtcatgaaaccagtttgcacatgtaactaatccaaaatttcacttttattaaatagaatttgtgttaagaaagccaaatacctattatttcctttgtaagtatgtcattcaataaaggttttatt

SEQ ID NO: 107118 - DNA, 1034 bp, Homo sapiens
gcaacctccccgtccctggttcaagcgattctcctgcaccagcctcccatgtagctgggactacaggcgtccgccaccatgcccagctaattttttttgtatttttagtagagatggggtttcaccatgttagccatgatggtctcaatctcctgaccacgtgatctgcccgcttcagcctcccaaagtcctgggattacaggcctgagccactgcgcccggccaagaatatatatttttaaatgttgtaactttagttaaacaggctatttatggaaccccatttaaaatggtgtatttatattttcatatatcctatttgaatattaaaggctggatatttcattttgcaatgtatcatttttgtactctcactaaaagaccatttaaaatagatataaagtttttttcatctgtttcttatttttgcatgaaatattttggacatcacatcttttaatctgtaagtgttatgctaaaaataaatcccaataaaatcagtttgttttcttctcctggagatttcttgtctatatctgtttttttttttcattgaaaatacagattttattattcccgtgtagtagtttggaatttgactattatgcctagaattccaaagccaatttttaataaaataaattttattataaataccacagataccttttaagagagtgctgatgaaataatacctgcatattgcagggaaagcttttttctgttcaaagttcttagaggtgtcagaaatcattgtctacctccctttatttctgcctggagccaagcggggaattaggaaacgaagagaagtgctctatacacaatggccttcagtgaatattattgatgactagacacctgctaggatgtaaaggcatttaatccatattattttcccttttaacttgtcaactcagacatggcagccagaagaattttctgtcaaacatcagcttttgcattgcattacgatttttatttttcattcttggaatttcaatacacaacacaagtggggctttaaataatat

SEQ ID NO: 107119 - DNA, 1044 bp, Homo sapiens
aatattaagtaccttaaaacattaatatctctgagacctttgaactattttctctttaaacataatttattttatgtaaaattaaaaaaataaacatgtattcttaatcccactccttcttcagcgaagacactcagatttcgaataattaaatgccttcaaatatgtgattaatagttgcagagaaacttaattgaatcaaaactgttaaatattttgctggtactctagccaagaaaatctgggggtgtcttctgtgattaacaggcttttgttaggtaaacccatatttaaaaatttttattctacattatgatgttatattatgttaggaccacattttttttcttaacatgatttgctcaatctgatatttacatttagtagcaacatcatttcttaatatttttggtgaaattttgtcccaattactgtcgatatcaattgtttctggccatgttctttgctcccttttcctctgtttatgctatatggttattttgttttttccccagaaatatttctccttctttacttttgtggtgtcttactgttatgccccttggtgttttccaaggttgcatctcttgctgtgcactgtcacatgcatttctctttgtgagcgacagcaaaaagaattttctacatccttagttttgttaaagtcagtgttatgaagatcagaattggagtctgtttcactttattacccatcacaatcagaagcaaaaatactgtaaaggcatacagattcattcaaaggaagcattgactgacaaattctcagatgtctttcaactatggattacttagaaaacaacttgctagagtaaataattattatttttttgtctttcctttttattattttcagcctaggctttctaacaactagctggtgaatatggtaaagttgaaagtgtcattatcatttgttaatctgggtagctcttttaccatctccacagacaaacatgtagagtcattgagcagaatttacaagaaatgccttttacctggctttccttttctttctttttttct

SEQ ID NO: 107120 - DNA, 1017 bp, Homo sapiens
tgcttgaaatagttgtgttctctccattttgtcatgtctatttttctatgtgcttaagaatatttttactatcagaacagatcatttattatttatgttaagataagtttgggatttgcttctcaagtcgtgttatacacacaaagtgacatttccagaagttttcatatcaaaaataagaaacaaacttatctttcttagatattgtgggggctaaatttaaagataccaaacatatatatttgctttccccagccatagcatttttaaacttcagtgattgaaaaatacagaactggagtgctctattgacacaaggagtgaaacatgtttttgctttctgatgtaaaagccacaaatatctcgcaagttatcagccatcaaaggaaaaatgtaaataacaataactgtcatggagagcccaacactggcctgtgcctttcctcattttactttcagatatattctttgaggtaagtaatactagttttccagttttatagacagaaaagggaagcttagggaatttaaactcagttgcccaagattatgtagccaattaatgtaggagtcagaattcaaaatccaagttgatctgattctagagcttattcccttaaccattatcctatgttgtatatgttataatcataagttataaaaagttctgctcgagcataaatatggttacagcatatatgcaagtatttcacattattctctgttcaaaaataaatggatattatatctttatccacgtaacaaaacatataaatgaaattataaaattatttatgagatgttactatgatatcgatttacagtcagagggaaaggcagtaattatagtttttctttttttttttactgtttacttatatgtagtcgtcactgaaaatacgttaattaatttatccattaaaaaactaaattcttgaagtaaagcagctgtgtaaaggaagcaagttctgaatttgtgtgtacataaataactgtttgattcagaagggaaatttg

SEQ ID NO: 107121 - DNA, 1107 bp, Homo sapiens
ctggtcatctatatgccaaatacagtttgtcatgagtaatccatttagggtacaaataaataagtggctatatttgaaatgaaaatcactttctagaaggtttggtagtcccagttactggttttttttttttatcttgagttgcataaattggaaaggatgacctggaaacaaggtcacaaagataacattggcatgaaagacaattcaaggaaatttgtgggcagaggaccacattgccattttggtgaagcagcttttctttcttcaatgctgttattgcaaaagcacagacagagaaagtcatgtggggacgctcagaatcaaaagagacaaatttaccactaaagacacatgcagaatgtactaaaattatgggtcttatttttaagaaaaaaatgtaaaagaaacaatctaccacagtataataattttgaatttaaatatatacatttaatctactgtgcattttctcttcagtagtatatctatcaattctgtatgcattgcaatgaaatatttacctgtctctccctttaatcatcggagaagtctgcattcttatattaagaattgtgctagagtaggttttgtcacattgacaatgtggaatatcatcttttgacttttaggaatagttttttttcaaatgacttcatttttcacatactatacgagcattcctgcatgacttaccttgaaaaagagaataaaatgaactaaatatacatgctttgacatcagtggccttccttcctgccaatttaatgaaagactctacaataaacttttcatggcaattgtgagaaaataacatttctttttcttaataaatcttgtttttctcttgcatgctgagagattttcagtaatattctctctatatatctttttttagttatcattgtttgcatagaggaaaagagagaataaggaaaaattctacttaaaaaaattacagataaaaaaacatagctgatgttttgctttcgtttttaattaagccaaatcaaaagctatgtctccattcttctgtgctatcatttttgctttttgagatgataaagtcacgttgtttttacaaaaatatgaaattaactagttgtg

SEQ ID NO: 107122 - DNA, 1053 bp, Homo sapiens
caatgtcttttatattacaaaaaccatataattacatttttcagacatgaaaaatgaattagtgctgcattatatgtggtgacaaattttcttgtttgttctaatttcactgaatagctacagtaagcttctttggcacagtttagaatagctcatttggctctcaatgcaaaactttggttaatatgaagagaccagtactgtactaaagaaacaaatcacatttttaagattctagaagacaaataccagtatcaaagattttccagtggaatatcaaatatgattcaaaattgctaatgataggcaaagtatttgccaaactagtaaaaaattatttaacttatataatgaaggctaaaatgttcagagctaaagcaaaagtttgaagttactataagatcaaaagtagttagctatgtcataaaactgtcaaaaatagtaatgggaactttggatgaataagaatataatacactgtcaccaagaggtgatcatgctatctctactttgttctccttgtcctatccctgcagttggggactgtattttaaaattatattgataaactggagagcacatacaggacaagtgaccaagaatttgaaggaaataaaacatgacaaattaattgaaagaactgggagtgttaagttagaagacaacatttatgatgaccacaaccatagtttttgaacacttaaggctctgtggtgaaaaatggatgagtgactcccataaaagagaataatttttggcaaatgagccatagagatattgtataaagaagaatgttctagaaattaaacttgttcctcaagcaaaaaggcccattctacaaatagtgaatacccagttcttggaggggattaagtagagtttggaatcggagaattgtttttagaaaaaatgattcagatgctggcttaaactagatgaacttaaatgtccctccttacactgaagttctctgactatgtaaaactttgtataaatatgtctttaccatctggaatggctgccaccctcatgtttaattagtacaaccaatca

SEQ ID NO: 107123 - DNA, 1051 bp, Homo sapiens
taattgaatttcttattttaacagaacagattcctgtagtcctcatgattgcaaagaaccttctgtgatatttcttctgttaaaagagcaaagtaatttcaaaatgctttatttaattatcacactaatcatctaccttaagaagtgtatccttaaaatttgttgtcatcagtatttaccgagagcctattatatgtaaggcagatataataaaggttctttgaattaaaaacagtgtcataagagtgcaaggacttaaaacaagaagaaaggaagagaaattttaaagcttatctaattggaggatcagaaaaagtttcatgggggatgagaggagatggtatttaaaataggtgtgagcgatgggaattatttgaattggcagagacagaagactttctctgagtacagggagcagctggagaaaatggaaaggaggaaaaatataaggcttatagtaaatgaagacttcaatgaactgagaaataattctggaaatatgattgggggatctatgacatggctttgttaaggcttagacattttgtatttaattccataggtgacaagggataattaagggctttgagtaggtgagccatggaattacctattaggaaggctagtcttatgaattatatggcatggattaaagagggaaagcatggcttcagtagagcagttatgaggttattaaaattgtttgaaacaaagttggtactagtcgaaaaggagaaatgcgatctttgttcctatgtcatgtttggaaatccttgaatgcttttggttagaatccagctagaagagctcttgtaaccatttttggccagcaaatgtacagacatagactttaacttggtgaaggacgtgcaagtactctggatgataaatgagacttgctaggaaacactacttaaaaacatgaaacaattgcttctctttttgatgcttgaagtacttgagtaaatagcctcaagtctatatggatcttgagaaatatttattaaatatttgagaggctttgctgctgtgaaaaatgattatgactacc

SEQ ID NO: 107124 - DNA, 1001 bp, Homo sapiens
ttacttttaatttaggacaggtatcatcctggcttctgtatacctttaaggattgatttaggtgatacatgtctcaaggggctcccctatctctgacacatatttgattttagagtttcattcaacaatgatgcattggtcataattgcccttgattttttagacaatttccaataaatgtgatcaaatacaatctacgtttgccccaaacaatacagtttctgatagctgcttgtgactatttaaatttaaatttaattaaataaaattaaatggaattcaaatttagtccctcagtcacactagccccatttcaagtcctcaagaaacgcatgtggctaatgattacggtggtatagtagagatagagaacatttccattattgcagaaagtttattgaatggtgcttatatatgtttttattgagaaataatgcaactgacttttagattaaaaatccatccaagttctccacaactctattaaacagaaaagctgaaactagcttccagatctttggcatcaagtaagacgctttttaagagttcagctgcgcccaggaacatgggccatttataatgcctaattttctatttaatggttttccttccttgaccttgcaatcaatataggagaaaagttttgctgtattcatttatatgaagaagaaaattattaggataccagaagttgtatttaattttttgtttgaaaatgtatacatgtatctagattctttgatgtgaacttaatatttaatgatgatccttaaaatatcagtatagcttaacatttctaacaatcctagaagtgagagataatagaatattttgacagtatgagtttaatttgtgttgtaaaggtcttagaagggtctgaaagcctcatgacaagtcagaaggtggaaggcattgtcaagatatctcatttacagatcacaaatatatactgtaccattgaactcatcttccaactttcttgtgaatcagatttggggtta

SEQ ID NO: 107125 - DNA, 1024 bp, Homo sapiens
gtatatcataactacacagaaatccttttagcatcttagaaaattctagaaactaggattatggctctgtaactaaatgaaacagtaagtcatttaaagatgttaattaaatgacctttaaaacactaaaaatcatctggaactgacactgccagctccacttctaacatatggttattgacattatcaaaaaaggatgggatcacctttgaaatttataaaactattagtcctgtccaccagagggcataaattttccacaggaaaaggacggaatataaaggtggaaaaatcaacggttgtaataactcacctttcttttgactggacatacgtttaactttgttttttaagacataataatttagaattgatttgcataggcataccaatagtttaatttcatggtgacccccaactctgatttcctgcagaatttattgcttctttcactccttggcagttcacatatattactatttattatcatgcaccttctttttatatgctctttcttcctaattatactgtccttcaaggacatagtcttttacttatgactctctatttccatagtaaaacacaataccttgtccaatgtaggtgataaattattatttgtcaatgaagatattaatggttttgaagtaatacaaattattgtagctattgaaaagtaaaattaccatagcaattgacagtttacagaacatttttacatccattatttattttagtctccaaacaccctattctctatttatatatgtcttaattttttctccaggtttgtggtagtaaataaattactgataaaaaatgaattttttataaatgacttttctaataggaaatatgtttttagtcctgaaagcaagacatttaatgaattttccttttaaataagacatcatgagattatttagtttccttcttaccacagtagcttagctatatttggaattcaaaatttaaaataatttatttttaactggaagggaaaaaaatccacattactcttctc

SEQ ID NO: 107126 - DNA, 1038 bp, Homo sapiens
acataggtgcagcattaaaaaataaatggggggttgatgtaacagggagaaaaagtcatatgaatacagaatgaagcagtacaacctagacctagcaggagatctggaaaaggaggaaagattatcagagaaaggcaatattcaagataatggcagatgcagtaacagaattggacaaacagaaaaaatatatgaatcctaagtttgaagaggcacacttcgtcctaaacagaataagtaaaaacaaattctgaacctagagccatcttagtaaaattgccaaaaaccaaacagaaaaaaaattaatagcaaccaaatataaaagatagattacctacaaagaaacaaggtccaaactaatagtacatttcttatcattaaaggacaaaagataacatagtaccttcagaatctttagggattcacttcacatatgaatatttttaaaaagttaaaaattgaaataaagaaaatacacttgctttattagaattttaaaactgtgacttagatcactcagaaaatgctattaataatgaaatgatattgagttggatagaccattgtagaatgatgcagagtgctaatttagcaagtaaggtcattgactgtaagtttccattaaaatatccaatattacgttccttttctaataatgtgatatgatttaatattttatttcattcaccctgatgaataatgtaatttacttattaatgtgacaacgttcgggctcttaacttgagattacaggattaaattgtgaatttttcagatagcttggtttataagacagagaagtttaaaggagcaacttcatatgctttgttttgctttttagcagctttaagattaaaggcaaatcaaaaggtaaaaaagaaaaattagactaagaacatgatataaggtcagattttgtattagaagttctgataataaatcaatgctaactgtcatttatttagcacctaattttttaacctcttgaattcatttaatcatttatttttatgttaatcaaagtcacaatgaaatacc

SEQ ID NO: 107127 - DNA, 1029 bp, Homo sapiens
cacagtagaaaggaacatagtattaaaaggaaggcaatctctaaaaggtgaatcatattgcatgcttgtacattgcttttgtgatgaatctcttcagtatacaaatggaaattctttttgcaatacttcagacaattcaaagaaaatcatatcattttacttatagaaaattgagcttgattatatagtgttattgtagaccaaataatttaggatagatgcagggttgaatttcttaaaaggtaacctggctttcagttgttttctggtacaagaatacccaagtaaaagtcacttgaacaataatatttctggttagctcagtggcccatgttctctgagattctccccatctttctcttacaggggcaagatggctgcagaagctccaggaatcttgtcctctcatgacattgtccaaaaccaaaaaaagggaaaacattttcttcacatttctctctccttttgacaggaagcaaaatgtccttagatgtactcagcacaatttccccaggtgtgggtatttaggccaggctctacccgaataagagactagaaatgggagtgtgtggaatttctagcctctatcctgggtgataggctctgccagtagtgagaagggaaagaaaggggactacgctgtgtcaaacagctactgataaatggtgtgtagcagagatgcttaaaaagaaaaaagttacattcttattaatatcaaattagtgtgaccctaaccagatgctgaaataaactatatttaagactattagattcaataaaactacactacttttgatttatgattttccttctcttactatgttataattgcaaatagttaattgtatatcatttattttattgctgattcattttcagtttattcctattgtattgccattcatggcttgccttttgaagcgagactaaaaagcatgtttgttggaactctgcatgtgtttttgattgtggatgccattcacacatagtgtgaattaagatgctcttgtatttttccattctttgatg

SEQ ID NO: 107128 - DNA, 1050 bp, Homo sapiens
tattaatggttttgcttactgtttcatgcttattgtctaggatagtagctgccacatagaagattctccaaaaagaataaaaatgtttgactgaatgactgctaacacactgataggttatccctttgcaatttcctttttcactcaatattatgttttttatattgttcatgttcattgttcatgttcagatttttcagatgctacacaatacttgtctgtgactatttaacagtttatttaatcactctgatgttcatttatgttgcttaatttttttaactcctacaaacaatatccaataaactttaaataagaatagcaaattaagttcaacgtcattacactgacaccatgtttaagatgtggcagaatgtttgatgttcgatttgaggattttggattccttggaataaagggaattaattcattttcatcattatcaccaataatgccatatcataaaagtttaaaagaatttattagtttagagactccccgctttttaacaaaaattaaatccagaggagatataatttctatttcttaggggagtacatattttctaggtttttatcttccatggtaataggacattgacatatctaaagctgcatatgagttcaaaacagaagggagaagtttctgagtgtcttctatgagcagctattgctctaggcattgaggatgtggccgtgaacaaaaacatctgttcatatgttcattcattcaataacactatattataccttttttttaggcaagtgaggtcttgaatgctaaaaatttaaaggcaaatatcagacttttcgttgatctaatttaagactttattcaaatttactaaatgctttgcctctgcttatttatgccagctttacaatttagagaagtggcacttttcgataattaaaaacagaaaataagcaagaaagaataaaactatttggtaaggagatgaaaataggaaaaatctaaagttaattttagaaaagtgcctcagagaataggtaaaaaatagaggtccagcaaagttaaagaactttccat

SEQ ID NO: 107129 - DNA, 1095 bp, Homo sapiens
aaagaataacttggaggttgactaataagaaagttggcataaactttcaatcaaatgaagagtttgcctagaggagactaattctctttctagcccatccaaatttgataaatggaaccagaggttatatacaactacaaggaaaaaaatgcatttaaccatgccacctatgagtgccagtgacttattttacttgtttttaattattcattcatggcaatttaaaaagtcatattttaagtgggatttgtttttcctgaagggcatttgaaggaacaatatctgggaaggtactagagaaattacaaagcccgagctctttcttataatgccacctatccctgtaagctaaacaaacaaacaaacaaacaaacaaacagttctatatataatagtttcaacacagaacttaacaagtctctttttttgtttgtttaaatctggctttacttgatttaattcctttttagaaagaaatttagggcaaaataaagtgtatattaggatttaaatttatgccacaatttaaaaataaaaccagaggttatatacaatttaaattgggctaaaaattaaaaatttgaggatttaacttgatatagctctcaggatctaaataaagtttaaattatcattaagacactgctaggagaagattaagattatgaaagtaacagttattgatactgctggacttcaaaggcaaagttcatttcttccattaactgcttccagagatgtcatgtaaaaaagttagtgtattagagaagttttttagctttataaagaggttttttcaaatttctcccatttttctctccacccacataaaatagtatgttcagtgaaatgccactttctatctttaattgttcgtatcatatatgcgaactttttagacatgaacatgacatgttcagctaggcagagttctcatagataattttcaaatattttccttggctgtaatttatgtattcatttatatcctatccgtcttttgagcttcagatctatatactcttttgtactctcatcactccgcactttgctgtttcttacctagactctcttttacacaatatgcacattttt

SEQ ID NO: 107130 - DNA, 1027 bp, Homo sapiens
agtatggtatgatcataagtcatttgtatttgccctccacgtgaaaaatgctcatctttaccaagaggctgttatcacaaatctcacattaggctttttccctttcctttatcagtctttaaactgagtttcatgggttccataggaaaaatactcagaatgtgataataagggcttaattgaaaaaagaaaagatctattatcaaatgaatttatttacattgcctaccatatacctcttagagatcacagttccctatagcatataaaatgttttatatattcttcagtaaaaaagcattttaaattgtgtttagcaggagattgtttcactctgcttttctgatgaacacattttttgagggtgtacttattaacttctcatttagctttgtcacttctgcataatagaagccatagttttcaacttttgtgaatgactttcaccttacattaagctgcgtgtaacctaggttaacaagggtagttggggccagagataacacctagaatagtacaatgaataagggagggtcacaggatgtggaggactgatttcagctatctcagagtattatactgggcccctttgtgtataaggaaggagagagttaaatgtggaaatatttgtgatcgtgtacaacatattaccaggcattcacgtgtgaatgcaagaatatgtctcctcttatcttcctcagattttttagtgataacattaagtaaattctgacatagtagtcctcttttagtggtcataatcattccgggcattttagtgaaatgttgtcattcttacttcctgttgttgccaataatttacctaatgtaagacatacaatcttgtacattccagccaagtttaaattaatttttcaagtgaagatttgttaataagggctttttactgaaatttaaacttgactttcataatttccacttcatccactttatttaaatgtaccaaaaacaaaagtagtcatgctttgtggtgtgacttctttataaacacaagctgctcatggca

SEQ ID NO: 107131 - DNA, 1016 bp, Homo sapiens
aatatatggccttttcttatgtgctgatccatttgcctaaagcttacttcccagggctagcccccactcagtctgtcagcttccacttatcactctctaagctgggtcggggctctctgtgcttcctgttgggagaatacctaccgtgtcaccttgcacatgtctgtttttacttatctatccttctgcagattgtgactaaaaatgatgtccatttggtcatccctgacgcctatgtttgatacatagtaggtcgtgtataaatgtgttattacgattgagtaggaaattgaactgatgaagagttaggggatcgttttctttcttattcgtctctaagtgctattctttgatatttccctctccccaaaatacttcctcaaacccatgacttctacttgaatttcctccactcatcatttccataggatcttcaccaaattcgagatgttgaggttcacagttacaattgcgccctcttgtggcactttatgaagaggcccagccattggccatttaggccacctggcttcaaagcctagtcccattcttgccatcttaagccttaggcttcttctctactgggattttctcatcatgggaataataacaataactaccccataggcctggaatgaaactcctatgagattatccatgaaaagcccctggaaaaatgttgggcatttgatactgtcattaaatattgaccatttttattctcggtctagagactcccagatctccacagaaaataaataaataaataaataaataaataaataaataaataaataaaatgaggttggaatacactcttcttaatggaaaatgagtgttagtgagtataagtaattgtaatcttacttccattgttaccttcggcattaaaatgtttcatttaaatgaaaattgtatttgcatttagaagttggtaaaaatgatcatgtccaacttatacaaacctcatttatggcataagatttctttaccagtgaagtgggtagatatgacct

SEQ ID NO: 107132 - DNA, 1035 bp, Homo sapiens
gaaaaattactgggtattctggagtgatttatctatttctactcacattcattttccagcatgcgtttttttcaaagtaaaaaaaaaaaaaaggtatgatcaaggatcaggttttgcagacataaagatgacagagaaagctcatttcgtcactagaataatacatttcatatctttagcattatctccttatatgtaattcgcattgaagttgataataaatggaatatgtgctcagtgaaaaatgtttggaaatactgaaaagcagaaataagaaaatgacaattaactataaacgtattacacagaaaaacaatacaaaatacatttttgtaatttttttactctagatatccctccctgcctttccccaccaaatgtatgcacacgcatatctatatgctagatatccctccctgccattcctcagaacatatatatgcacacacatgtctatacctgtatgtttttcttatgcattctgactctgcagcttacatgatttgtgacttttggcaagtaacttaatttttctgtgctttagctttttaatctttacaatatggatagtattaatagccatgttatagaattgtaaagattaagtgaggtgataaatataaagttttagaaacatgtctgaaataatgtatattattattagaattatatttttaaacattttaaattaacaaatctttctcatttttaattgaaagattaacccactactagtattttgtaatattttcactaagccataatgaaatcttttcccctcatgataatggtggtaaacggaacatctaaaaaatatgttccatgcaaaatgcatcttcacacagacttattttgccattttagtttgatttttgaagacatgagttcagcacatctgccaaatccttttataagatgctacattcctgtttttattttagtttattttatttatgaaaagttcttttcttctccactccacccccagacagtcattcctctctgtcctaaaccataacactgctgtacattgca

SEQ ID NO: 107133 - DNA, 1030 bp, Homo sapiens
gaaaaatttgttgctgttgtgcctaatggcaagcagtgtggtggttggatatggtctgtactgcccaagcgaactctccacattgatactttaacctctttgtgagttagctttaactttataactattaacccatttattgtttcatcttactccagagtcattttaccgagggaaaaattgtcataactatgtagtggtgaagagacataaatgtgcatttaagaaaaacaacaacttgtagtctttaaaatccctttagatgactttatttttgttaaaatttctgcagggtcttcgaagaaaaacataaatatttctgagaaatctggatatttttaggaagtgattgtgcattttgagaaaaataccaattagattacattgtgaccttcaatcaggaaatcttggttctgatgatttgatatttagtctcgatgttttgaattttatatattattcccaagaaagaatgtaacaccaggaaaatttcactgaaggagcaaacaccaagtgaatacagaatgtggcagaagtgcttatgagcaaaatacttagttaaaaaaaaaaaaaaagcagagctggacgcagtggctcatgcctgtaatcccagcactttgggaggctgaggcgggtaaatcacctgaggtcaggagtttgagagcagcctggccaacatagtgaaaccccgtctctacgaaaaatacaaaaaattagctgggcatcgtggcaggcacctgtaatcccagcttctagggaggctgaggcaggagaatcacttgaacctgggaggcggaggttgcagtgagccaagatcacaccattgcactccagcctgggcaacaagagcaaaagtccatctcaaaaaataaaaattaaaaaaagcaataaattgatttacagtcaacagaacacagacattagaaagtagttgaggcaccagagtctatggagaatgaaattaagatgggatgaaaggcagcatttgaatccattgctgtttaaatgctgtatttctgttttcctcatg

SEQ ID NO: 107134 - DNA, 1034 bp, Homo sapiens
tggttttctaattgtgcatggggatttttaacaatcacactttgggcttcatataaaatggagtatatttactctgtcctcttccagggtaacagctggatgaatctgcatgcatgctttcacttgaaaaaattaagtgcccttggagggagaacttcagttataagttttgtaaggtgttttttcaaactctctctggactctgctacgttggttgagtcataaaattgttctgcaattcggtttgtcagagaaaaaagccctggaaaaacataacttcaactcttctttttacaagtgagaaaatggatttttatagggctgaaatgcctagctaaagatttcaaagctggtgacaaaattaggatcaccagatccccctttctccggtgtagcatctttgtacaatgacatgaaatttcctaaagctttttaaatttttttaatgttttgctattgcacaataggcttatttttgtctttaggtccccaatcaattttttttctaatgaagattaatatgcaatagattctttggcgttggagtgcgagattctttccaagtccttggtagtgtacttttttaagtttaggcattccaaaggccgttagcaagcatttggattatgctaatgacttatgctatccatgttgcacccttgttgatgaaacagtatatccagttagcaaatgaatatttatttatctaaaataaaatacaggaagtggtattagcagttaagtgtctcatctattattgctattccaacataagtttagattcattaagagaaaagaatacagttataaccaaagtagtttcaattcacagacaacttatttgaggcagaggatctatttttcttgcaactgtaagtaaggacttaagtagatttataaaaatttatacaggacttctttgagaaagaacagcccctataacttcacactacacaaattaacttcactgtagagacttcgagacttaaagtgccccacagcttcatgctccctataacttcccagccagaaaa

SEQ ID NO: 107135 - DNA, 1759 bp, Homo sapiens
ccatatttgtaaggggcttcagagtcttcagcagaaatgaaaatatatctgcaagagtttctaatttagagattaaatatctaaaataatatcatttactaaccaaagtagtattccaatatccagggcttagaagagtctggatccacactttgccacccactgtgaactttagtgcaagttagaggtaatttgaagaacactacagagagaagaggaacaaagcttcttggcttttgcctcattgggatgatatttgtatatgctagttgtctagagttcaaaaactgtgaggttttgactaagttgggataaatcccctttcaatgtattagttgtgatgccacatttctgatgttaaaaggaaataaaacggaatacccttcagaaacattttttctgtattccagaataaaatacactattctcatggtggtacctgcagaattcagatctttcccaggatgctatgtgttcctttagtgctccttattctggatatttaaaaaactcaaattttactttctacttaacccctacattcttgacataccaaagaaaaataattgaacatgggattgaggaacacagtatactcttctgagcattttcttagaaaaacattctccctacttttagaatagatatttctgtaggaaaaatgtgttccctctgtatttctgcatccccagcatgacaacaaagacagacatttcctttctggctaccatttcctatcttcaggtccattggcctgtgaggcttttcttccaggacacattgcctctcattctctcatttatctaagatgaaaaatgtgctttgacagttttctgaactgcagttttattgatgatgttactaaagcctttgccgttgaggaccaaacaagactcaaaagtctactgacatgtgcccatctcaaaaccatcttttagctcttgaaaaccagtggcatttttatgtttataaattggttcacatgaattcctcagggcttgagtgacttttgagagttactagtaggagaaaaaaattatttttgctaccgcatatgctactgtagggcttggcttgactccccaatttctcttcagtattttgcctcttccaagtcctgctgtttttcagtttaaacctggttcttaagttagttggctctcttgacgatgtctaggtagaataaagctgttggcatgatccccctttgttctttttgttttctatagttgccttttgttttctttttaccgtgtattagaactgattagttaagctgataatatttgtccctgagtgtcagatataccattcccaaaacctgagaagcaaatttggtttgcatatcaaattctaattactttgtacccactctcactgtcattttccttctgcatttgagtaaatcttgttcctagaaccggaactttctggatagtgacctttaatatttctttttaatgccttagcttttgagtttgtcatatttttgcagtttttttttctcttcatcaagtcaagatgaaacatccttacgtagccaggacttcttttcactttactgttcattggcaagctccatcatgcctagttagctgaattgacgctcactctgggcttttcttatatccatagcacaatcaggatttgtccagtgctgttaccagtgtcacagtgcccactattcccactgacactagctgttacagagcttgcaggtaaagtctaaagtagaagctacctcttccctggagatctt

SEQ ID NO: 107136 - DNA, 1045 bp, Homo sapiens
atggactattttatttaatgtaattatctatattactagttttagatctatcactttgccctttattgctctgtcccaccaactctttgcttgtatgttttttccttttctcttaccttcttttggatagtcttttttttttttttaattttcttctgggctctacatgtgcactgttttgtagacttgctttgtattcatggatggagatactagttctgtcctttccatgtaaacatgtagactaaattgccttcttagatttctcttttgctctatgactttataatagcttcttcccctcttcatgatcggggacaaagggtctgttatgtgtattagatctgttcttctgaaataaattattgacgactaccctttaataattttattttcttttgtttgtttcttctcttaggaattagaaattaagaaaatggccaagattggtaataaggaagcttgcaaagttttagccaaacaacttgtgcatctacggaaacagaagacgagaacttttgctgtaagttcaaaagttacttctatgtctacacaaacaaaagtgatgaattcccaaatgaagatggctggagcaatgtctactacagcaaaagtaagtgagagcttttatattcatagatttttaattttatcaacgatatttaaatatcaatattgaaagcagatttaaaagcacctcctggtgtatatgtgatacaaaatgtgtgtaatttttagtaaaatgagttataatactagataatccaggtaattacttctagattctttattgatatgttttaatacaaaatttcttgtttgaggacaatccgttttctttcttcttttcttttttttttgagatggagtcttgctctgtcacacaggctggagtgcagtggcaagattttggctccctgcatcctccgcctcctggattcaagtgattctcctgcctcagcctcctgagtagctgggattacaggcatgcacctccacacctggctaatttttgtatttttagtagagacgaggtttcacatgc

SEQ ID NO: 107137 - DNA, 1023 bp, Homo sapiens
atatcgttaattctgtatctgttgcttgtcttttgtaagtgattatgtgttatgaccataggtggttacagctgccaaattatttttaaatggtcaaaaagaagagtgctatttaaacatctgtcttaaacaaaaactgtcataacttttcttttttctttttccattaggagaacattctagttggtaaatttcaaaatgtgcttgacacctgccttaaatagcacagacctattgtgcacatctttaaattatttcagctggcagaaaagaattacatttaaaactgaaatcaaggcctcaatacaaagattatcctggctcttttctatctctgtgggcctaattgaaatatgtactcttattttagacacgcctctgttaaaacagaccaggttttcctggtctcagacctatgatgacttgtccctttgatgtcactactgtgaattgaatataattagtaaaaatagacgatgaataaataacactttatagtaagaaaacaatatattttggccatctaaaaatgagaattataattatatgaattataatttaaactgtttaattttgtttaatgtgtatattgaatcttccaaattgaagccattattctcaattaagtactacaactatgacaatgcttgacctacatttctaaaataaaaattcacattttttgataaataaactacagttttaccagaaattactatctaaatgtgtattagcagtattttttaaggtgaaattgccttggtatctaatgaatgtgtagacagggagataaaatgaaggattgccagactagttagaatagaatttaggattaggttagttttgaaaaatgatgttgtaatatatgggttctaacacatcctaccataaaaactggaggagatatgtgtaacctggttaatttgggatggtggacattttgggctaatactgacaaaatacatcttaggactagtatacatgtgacacggattgctaggaggaatgaaaaactaaactgta

SEQ ID NO: 107138 - DNA, 1057 bp, Homo sapiens
tctcacgcctgtgatcccagcactttgggaggccgaggcgggcggatcacgaggtcaggagatcgagaccatcccggctaaaacggtgaaaccccgtctctactaaaactacaaaaaatagccgggcgtagtggcgggcgcctgtagtcctagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaatatcccagccctcagtgagcatgcattctagttaagagtcattgttatcttatagtgaccctgggggttgggtgtgattagggggaggtctttgttttttctaggcaactcctttaagtattcatcagacttgttgccagtaaatagttaatcactggttcatctggattctcgttttgtataggaagagcaataaaagttcaaaatttgcagattttttaaaaggtctgcctatcctttgaaagtctggtagtctatataatccataaaatatcaatttcagaatctattaggtgatggagctgaccaatttaaatgcctgtaaagtaagaacctgccacagacattttactgaaaagacaggaacttcattgaatatttgatatcaagatagtcactagtgtatctattcacacattaatgattatcataattcagtcttctgggttagtatgtatattagatgatatattctccaaacttttttttgagacgaagtctcgctctctcgcccaggctggagtgcaatggcgcgatctcggctcactgcaagttctgcctcccgggttcacgccattctcctgcctcagcctcccaagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcc

SEQ ID NO: 107139 - DNA, 3971 bp, Homo sapiens
ctttgtatgtgactcccctggatcgagtcactgagtttggaggtgagctgcatgaagatggaggaaaactcttctgcacttcttgcaatgtggttctgaatcatgttcgcaagtctgccattagtgaccacctcaagtcaaagactcataccaagaggaaggcagaatttgaagagcagaatgtgagaaagaagcagaggcccctaactgcatctcttcagtgcaacagtactgcgcaaacagagaaagtcagtgttatccaggactttgtgaaaatgtgcctggaagccaacatcccacttgagaaggctgatcacccagcagtccgtgctttcctatctcgccatgtgaagaatggaggctccatacctaagtcagaccagctacggagggcatatcttcctgatggatatgagaatgagaatcaactcctcaactcacaagattgttgactaggaggttaccaccattgtgatcaagataaatgtggagtattaaagttatgtgttgattgtgtggttcatttttgtatttatttcatttaaaatcatgtgacgcagaatagttttgcaatgtgtatatagttgcaggcaaaaaaaaaaccacctcactgcaaaacttattgttaattttagtcaccaatggtataaagcaaaacctaggtttagagtgtgctaggatacctgaaacctgatggttatctttaaaattaatggtttttctcctgaaatgtttgtgcatggaagaactgccctgcttttttaccctgttgccatgtatgattattccttgtgagattacttaattacttggattgaagactagcctattgaagctgctgccaggcaacaccacttaacagtaacttaaaggaattattttctttagaggatcctcttcaaaaaggaagggagatagtggaaaactgttcttatatcttcagatccctagcagaaatgactgtttatttcaaactatgttttacttgtatatgatgtagtcaccttaactatctttcaattccatacttcccccgcccccattttaaaggcttattgttgtattttgtagcagcttcaagtgaccaaaagactaaaatctttcaacgtcaatgccaaaagccaaggggaattttgcagtgacaggattttagtctcttactatgaatactaatttcgaaccatagctttcattttaagcatcatcttgaatttctaaacttttttctatgtcttggtgttaaaagatttcaagattggcatttttacttaaacagacattttatggttgagttttctctttattatagagaattagtaatttttttttggctgacagatcagataaaattactttctattcattaatttttctctacaactttatgagtttatttaggtgaatagtctagactagaaacaagtttactttatctgctttgcctctggtggtacaaggtttttaacatggatggtaaacaattgtctagaaattctggcaggttttttgtattggagatctggcagtatcctgcataactttgggtgaggaaattgttctcttaaagatcagccatgttcaggaaatgatctctgtttgaacctcactatcctgtaaggttatccaagtagcttagcccagctaagttctatcagagacccaaattatattttttaaaaatttaacagctggaaacttggactagagctttaataaaaaatcttaaattctttgaaattcaagttaaaaatacttatatatttctattacaaagcagtgacaaatgatgccctgtgtgacttggagttatctttgacttttaccacaaatcttcatttataaaagaaaaagccaaagtgaaaaaaagttagattgtgtatttttcagtaacagctttccatgtcttaagatttttttacagacttaagtttctaattcaggttgtcaaactggccatttgacttcagagatttgttttcattaaaaaataagcctgccgccaaaataaatcacttatcaaaatgtgaactgttttcctcatgttcagttatgttaaagtagtatgataaatgcatgcctagagtagtgctctcgttgatgaagcacatgtatgaggagaccagcagcaaaacataaccatatgtgttttgcgtttacttcctctagaaaagaatttgcaggcaaccatgtttaatttgaactatctaagatggtagattttagaagctaggaataattgagttttatagcactattttcagaatacgaaaagatacacaatcattctgttttttgaaattccatgtgattcaaactgctccctattatttgggtattaatttgcactaatagcaaaatgtaatggcagatcagctttgagagtggtcctaagcagtaaactggatgatgttgcattagaaaaacatcaataattcatatttaagttttagtagttactactgatttgataatcacttaaattttatatatcttaatgtattttttcagactcctaattaattcccacattcactgtaactaggggcatagtccattctgttaggattatatcctctccttagaaatgttttccatcctgttgtggggatttggtattaatgtttcttcattgattatggaacttttgttccctgaagctagttaactgtgtctaaagttaaataaatacagcagaatgattgttttagcctgctcgaactgatacaaatccctgaaaccatgattggcatatgttagataacaaatgaggatgtctaagaggcatatgctgctttggaggtgtagtgaacgtgtgtacagaagttttcaatcttaactatatagtgttagtgtgatgctatactattggaaaaatagcagcttttttctattttataagttgtatgcataaacataagatttgtaatgtttcatttataaactgccttcttcaacacatgttaatagtgttttctcaaagtattgatagtatgtcttccagaatttcacaatatgcttacagtaaatatttcctagcttgttgaaatgttcaattctttgttggctttcttcttgattctgtgggggtgtataacaagcctgaaggacattgtaatcatttcttacaaggtgaaaattaagaaagattgtgtatgagagcctatatagttgttttatccattatcatctttgattaagactttaaaaaaatgctatttccagttaatgcatttggccctattgaattttcagggaccagaaaacattaaaaagttctgcatcttataatggtaaccaattaagcttgagattgttctgaaagtatcaattgctttaaaactgttgtaagtacagttggcaagatctccaagctgaaacttccacgttaaaacttttgcctgtaagaatttgcacatgaatgttaatggaaaacacaaaacttaagatggcccaaaacaaaagccacaaacagttcatcatttggtgcttagtctttgtaagggctctctgtggtttgacttaccccagctaccgttaaatgaggacaaatcaccttaaaacatgttcatttgattcataacaaggaaaattgggtctatgattttttgccaatcttagcctaaaagaaattgctttagcttctggtcagcactgattaaaatgtgaatagtgaagtggctatcctaaactggtttatctccacccacactatcatagatttcttaggtaaatacaattcttatctagtggtattctacttgtattcagaatactgtattaaaattttactatttcatttttgtattctgtgcttattttttttgctcacgcatgtatgcttagtataaatgtgtcacttctaaagttttgtctctgacttttagaaataaatttcagaaaaattgtttcaaaagattttgaaagcacattttgttttgtgagtcaatgacaaatatatttcctgattacaa

SEQ ID NO: 107140 - DNA, 1216 bp, Homo sapiens
aggcgcctgccgccgcctcccttgagactgccgccaagtcggctgtcgagttcccgggcccacagctggcacctgggactcggccttgcccagctagcggggtcgggacggctgggcgccggcgtgctgggcttggcgccggaggagagagcccagacgccgggaacgtcccgggccccgcctctcccccgcccccgcccgaacccccgggcctggggagctggaggaggtgccaagcgggcggaccaccgaggaggacctgggaggggaagtgttagggtaaacgttgggatcgggtttgtagttacctataaagtgattttagaaacacctgcgtggtggcagttgttgacgttcttgttcatcttttcagtcaccctccttccgtcccccattttttccttccatttgtttttcgtgttttacagtaaaggcatgacttcctggcaccacagggaaaatcgggtgcaagcccagaaactatttccccaccaccacttgttgaaaaactgatttgaaggcatctccggggttgaacaaacggaaagtgccaggatttgatgcgtctctggtttcgctctggagaccattccctgctaagtatcaagacgaaaaaaactggaaactaatccggtaaacatttaaacttgaaaacttatgatgagttttcttttgatctagcaaacgatatgctttttctcttttgttggctaattcctgcactttttaatttcttcatttgttgaaaatgttttcttctattgaaaacacttttgttcttcgggtatgtaaactcgagcatcctctactgggtggaaatttgcctctgcagtaacacaaacagacttcttgaaattacgaaaacattggaaagtataggcctttcacattagcacaaatgattgagcattttatgctataaagaattacatgcttattgtttttgaaatccaaatatttaaagatacaagactttttacatagaaagtaagacttaacgcattacggggcacaaatatttaatatctaccacaactaggttagaaccattaaccatatttggtatagttacctcatatttaccacaactaggttatatttggtatatttaccacaactaggttagaaccattaatcataattggtactgatttgtgagggagtgtaaaacacataccatttacttaaagtataaacgtgtaatggtaagtactag

SEQ ID NO: 107141 - DNA, 1861 bp, Homo sapiens
gaggaggaggttagcctaggcatctacggcggcggcggcggcgcaggggctggtacgcgctgggcggcgagagcctcatggcggaggaagagagcgaccaagaggccgaacgcctcggagaagagcttgtggccattgtggagtccccgctgggccctgtggggcttagagctgcgggcgacggcagaggcggcgctggcagcggcaactgcggcggcggcgtcggaatcagcagtcgggattactgccgacgcttctgtcaggtgaggcgtccgttggccgccccgacttgtcacccgggtcctgggcctctctgcgtctcctggtcttctcgtccatgaatctggtctatgtccagtgcccgctcctccccaacaaggagggtgaggctgaagctccctcctccacttatccggcttggggtggggggcggggagcaaggcgagggtgacccacgggcttagggttgctgagaaagtgagtttgtcggggatggaggggctggaaagaaggaaggtcggctgtccggaaagctctgtcctgacatgccttccctaccccaaacagaccttcctgcccgagagtcccgcctttcttatgtttcctaccctggtctttctcacctcatttggcacctctggtaacattttctgccttcccctctccgccgattgccccccgtgttctcccctttttttccgggatgggagacatgccatctttcctgtcactgccactgttccccctcttctagggtctcctgtcatcccctcacaagatcccgctgggccggttctccagttggcgtagacgctgacccacggtgatttagttacttttttcggacagagagtgcgttaaggcaatgtgattgtctttttttttaacctccttcggttgacacacgcactcttttctaattaactgctcataatgaaagtaattttccttaaactcttgctccggttaacatcaccaacccccctcatccttcaatatataatgtattttatttagcctgtaaaatacagtgtctgaacggtgacattaaattatttactcagtcgaccgtcacaggggtttgatgttgttcaaagtgtttgtaatcaaatataacaaatatacccctacttttttaggggtaaagtttgtgtactctgcattctcatctacctgcatttgtaatttaaacggtttgttcccattcacaacaatctttttttgcaagctattttggggaaaaaaattaactgctccttttccatcccatcccttttaaaatgcgtccattaatttgggtgtatagggttcagattctggctccaccatctcctggcagaaattattaccttggacaagttactctgtgtctcagtttccccttctgtcaaagaggagtaatagttaaataaatatgtgaagggtttgaatcaggtagctattaatttcgttctgataacaagtaggaaataaagttaatgagaaatggacatcatgtttgctgacatttctttcaatgcttgtaagggattttttcaatgcttgtaaggaatttctttcaatgcttgtaagggaaagcttgtaagaattcccttacaagcattgaaagaaaaaggatggagttgacatttttcaggtaagtttttaatgctttaatttaaattgccttttgatttaatgttttcccccagtgtcataaagaagttggtttgaagagtatgtcagtttctttggcattgctatttaatgactttcttgaaaatgtatttttattttgataattggcattcacttttattttgataattggcattcactgaatttagaggttcagtgtcttgttttcagagcacttgttttg

SEQ ID NO: 107142 - DNA, 1053 bp, Homo sapiens
agcagggggattatttaatctaattcctagtcgaagatttctttttaaaaatttggttttctgacactgaggctaatattaagtataataatttgtttttattagtgaatgacttaatcgtgagtaatgcaatggatattgtgcagttggggtatgtgacagttaactaagtacatgaattatacagacaggctagtggtgtttcaaagaaaggctctggtttatcttcctctttttagagggaaatatgaatcaaaatttcttggcagttagttgtgtgggcaaagggagagaggaaggaacacttcttttccagaggggtttttgtgtcttttaccataaggaaaagtaaaacagaagatacagtgttaataatattggactggccctatcacatcctcccttggctcttgttagctgactcaataaatgcttaaataaaactggctcttaactgatacttaatttgctttgaggatgaaaggtaggggaaagtaacttttatggaaggcctactaactcttaagcttcagacagcaagtagcatagttgaaattgaggcatgaacaagttaaggtgtcttagtttccattatgtagacatgctgggatttgaactcagtcttcagtttctgctgaaaagcagtaagtaaatcctcaattatagaggggagttttttgttgttgttgcaagtgatgtgaaaggaaaaagaagttactggaaataacttggtattatggatgaaaagtttagaaagtactctttcattatgacacagtagtaagaaatacttcaagaagcagactgttattgtctgacttgttaagtgctgtaaacacttttctaattcctgaaagttttaataattcaatttgtcaccaaatacactgaattttttgtcataaattgattgtaaactaaggaagttaagatactttcttcttagttcagtgccagaatgaatataatgagtaataaaaaaggatttctggaaccactttgatatgttgattgaaatataatttaaaattatttcatactacagtggggtta

SEQ ID NO: 107143 - DNA, 1092 bp, Homo sapiens
tggctgtacccttactttgggactcttagtgggtaccttttatgcgtaatgccgatataaatggcagtaaagtttttaatgatcctcaaatagtttttaagtaacgactgtgggccaggcactgtaataggtgccttaagagatggtattcacagaaaagagagtttgtcccatggtattataaaatacattctaatgtctcttaatttagagaaattaaaatttgtctcaggaagaaacaatccttatttcttggtcttgatataggatttacataatacttattatagctctatgaatagttttctagggtataatacatttttactaattcttgctattaattgggattatttttaatttatctttaatttttattaatgtacttagttttaagaagtcatataaggcctaagtatcaggaattgcattttggtgctaatggagacctgacttaagtggttcaaacaaggtgggcatttattatgtaaaaaaatcttgaatagatagtgtagggatggtacagtggccatactatcatttgctctttcttactagtcatccttgtcttagcatcccgagtttgtgtcatgatccagggtagttgcttgagtcccaactatcacgtctgacttcccagtggcaggagctggttgtctctgtggtgtaaaccaaaacaacttgtcctaaatcctacttaatgacccactttcatcttgtgagttatccccatctgaaaagaatgttaggaaatttttctagatttttgtttctttgatcaacacatgcctatgattctgtcagtatggaagaaaacaagaatggatattattgaataacgagcttcttcttttttttttttttgccacagcttataacaaaaaatagcagtcatgccctgtcctcttcctttcctacttcttattctccagaggctatcactggcaactctttcagttttgatatttacctctatatttataagtaattttttccctagttgttttagatggaatcagttggcctagtacaggaaggagatagggactatcttactgtctcactattgatctcactattgagcatgttcac

SEQ ID NO: 107144 - DNA, 1001 bp, Homo sapiens
tgaatgcagagtgaccattagtatgtacctttgttcatcagtgcttatttgtctcggtgaaggtgtgaaaaatgagttacattcattcaggattaggtgtagactatgataaatcagttaattaactttgagacagaaagggacaggttcattttcgggctccacttgtggcaaaacatagcacagagaagtgaagggagaagaaaagtggttgtatcagtacatattaatagacaggtgcacaaaattgttctgtgtactgtgaaaataagtgtgcatatataatgtcataacaaaacatgtacaggttgttaatatgtatttctacaactagagtttattgacatcaaccagtatgttttggttactctaaagttgaaatattataaatactcttcccagtgatttgatgtgtgtatgttaatgtttttaatatctggaagctattattggaatgctttatatatgtatatgctgtatatatgtatataactcattttgaatgctttccatgaatcagggattgtgataagttgtttacctgttttagctcatttaatccactaccctacaagctatgtgccattattctcatttttataggtcaggaaactaagaccagaagagatggcttgaccaagtcctgtacctagtatgtgataatcagactgtaacctagccagtttgacagccaaaagccagcccgtgcacttagcctctgcagtgcaatacaatacattgtattgtatctaggaataagcatttggtatctattgtaccatctatgcatatatatttgatatatactgtagcttactaaagcagttttgattgagtggaagcagtggaatggacactgttaaaaagactcaaggcagcagaaactaaagatgttcataaatgtgaaacagaagaaaaaaatcaaattcaatctagcagaagttccccatcagaagtgattctcaggccaggcgccgtggcttacacctgtaatcccagta

SEQ ID NO: 107145 - DNA, 2322 bp, Homo sapiens
ttccgtaatgttagagaaggaaagtcaaggagttccaagtgcatcaaaaagcattcaatatcaagcaaattttgctcactcttgtatctgacttaagaaaaaaatcttaccagcacaacatcaaacccaagactgacctcttaactttgtttctcttcagcatagctcttcccatttacttccctgagacctaactttgactttctggagcacttttctttatggcacaatgccatactgtatgttgtcgtttgtggtaactattcatctgaaatgcacctgaaatgcttcagatattttaaggtaatctccctgctttttaatttatcaaatctgtacagattttatattacttgtatagtagtctcagtcttcaaggtgtggtttttcagttgcttttattatagactttctgccttttaaaaagcaagcttttgccatattgccatagttggatctccggtctggttcactcttgacatttccatcccatagttaccttctgtccctcagttaggtacttttgtaaccagtcacccttcctttattatgagtaacatctataattttttttccccattttcatctttaagtacagttacttctgatatatatctcctttttcttttttgatatctgtctagtctagcctctaagagtgaacttttattcctaaggaagtccctcttttcttttatcttaatcagtatgccctccttttatttttctttaatttttccactgttaattgtgagtgcatcatctgttttgttttgttttgttttgttttaaacaaatttagttcttgaaaccgagcatacctcatcctagagttggtgtttgttcatctgttattttaatttgatcttcatgtacttcttgtgcgtatattttggggttcccttgtccatgcaccaattttaatatttatgacggaagcatttaatatattactctcagctctgattttggaatcaaatgaaaaattggcagggatctaaattcatctaaagcctttaaaatgacctgctattcataagaggaaagttggatctttaggcagatacctaagctgccacatggaggactctgacctgcctcaaaggtggtgcaagtagctaactcaagagggatatgagaaccagaccaatacattaaccttggccaggagctgagagactcttattagtattgttgattttacttccctggagtaaaagaattttagggaaggaggaaaatcatcctctcactggtattttttgagatagagtaagttcttattttataaacaggaatgtagaggaaaagagaaaatgtttgccccaaacttaccatgtccagaatttgggaagaagataaaaatataagaatcagaataggggaggaggattgtgaatgaatttttgttgtttagccttctcaactcatctctgtttcactcaccaatataggcagtgtgctttccatttctttgccctggcttatgttggtagttacaaaaaagagaaaaagttgcagacttaaattgtttttttttttttttttgagacggagtctcgctctgttgcccaggctggagtacagtggcgcgatctcggctcactgcaagctccgccgccgggttcactccactctcctgcctcagcctcccgaggaggtgggactacagacgcctgccaccacgcccggctaattttttgtgatttttttagtagagacggggtttccctgtgtatggggaatcattgttcttcatttaatttatgaaatatacccatgaaaaacttgcatttgtgggaatgtcagaaaaattatactgcttctgagatagggaaaccttttcaaaataacacataggaaagataaatgaaacatgctgtaatacttactatttttatgtaaactgacagaatgcaatttaacagaatattttaaaaactgaagaagtcacaactgattttaaatattaatgtcaaatatcttggttcaaagagttatttactgtgtgtttaatggaaatcatttctcaaaaccaaggttgttttttagtgtagaagtaattctgtatactctgtgttgtagcttcactgtatttcatgagtcaccaaagccccttgttttgtatatatgttgaattttaggtgactattatgaatgtaaataaaactacttcataggttgaattcctttgtgaaatgttgtgaaatttctttgtatttaatataaaacatgcttaatatgctaattctggaatccctatattagcaagtataatactctttacatttcaaactattgtgaatatcggactgatttctt

SEQ ID NO: 107146 - DNA, 1055 bp, Homo sapiens
tacaactttgatgataaaaaactaacttttcagatttataggtgacacaaactgggaggaaaagctaatgtattggctaaaaagtcagtgttgaaggtttgggctgaaactaagaatgggaaaagtgagaggattaacgtacagttataccgtaaaaaatcaactataaaaagttattggatctatatgaaaaagagcatttttgctgactcaacctaaagtaacttcaggctacattaatattatcatcgagtcaaaaacagggagatgatagtccaactaattctgactagagttgactgaagtcttatgttccatattgggagctgtgttttgttgaagaggaacatccacattttggagcacaaacagatatgctaatgagaactgaaaattttgtagactatggagaaatagttaaaatggatgaaaggatagcagatatttaatctaggaagagactataataaagatgtatgtgatagctgccttataatatttgatgggacattgcatgttttgtttatataattttaaaacttcaaactggaactgatagatggatgtcacatctatctatttttgtttcataatgaagaattttctaataaagttatctgtaaagttaagtaaattgtcatttgagattgtgaattacccatcagtaacagtattcatgttggttaactctctgggagtgatactgtaatgggtatttttgctctggttggtaggttggactagataatcttcaagattccttttaacagtatgattgtatggaatattaatatttagagatgcttactccattttccattttgaaaagattctgtcttattacatttacagaacctatcaaatacattaatgttgtataaatatcaacttttaaggagtagtgagttgaacagtatgctttactaagcccccagaaataccaggttttaggttgcttgctactgtagattatgttctttgcagatttcacacaagttttaacttagaatgtatttctaaaccattttggtgtttttttttaaaacatgactttt

SEQ ID NO: 107147 - DNA, 1030 bp, Homo sapiens
gtcctactcatattttaatgtacataaagatcacctggggatcttgttaaaatttagattatgaatcagtagttgtgggaggggacctgatagtctgcatttctgataagctccaaggtgatattaatgctgctagtccctgaaccacactttgaataccaaggtattctttgttggatttgagttaacttctctttccccccgctgtatttcaactgtgagtttaccagctttgctgcttacactgtgtcatcctgggcaagtttcataatttctgtaccagtttctttatttgtaaaatggaggcaataactatacttgctgcatagtcactttatgggttaaatgagtaaagtgcttggcataattcctggcaaaatgatcatgtcactgtttttaaggtaggcagtagagcctgtctggtgaagggtatgggttctcaagtcttactacttggatttttatttttacaataataccaaaaccaagctattagatttattattttcttccatgaatttctgatctcctaaaatctgagttgttcaagtagaaatttttaactcttcttacctataatttttcctctccgttatttctagaagaaacttcattcttagagccaaatgttccatttactggcttccgaaagttttcttcttagccttttacttccagtagtttttgtttgcatttctcatatgatgcatctgcctcatcatcatcattatatctagcagttttcgagattcccaatgaagtgacaaaaataatgtaaaatgagggaaaataataatgataaatgctggaaattaggatgggaactttatgtcagttgctcagggatgaagccagattgacagatgggccaaacaatacttgattgactgaatgcgatgaaacagggaaatgtgtgagagaggaaaagataatatagagagaaagagagaacttccactggtatccagtcatgtccccctctatcccctgcttgtaacaacaagggctggaggaaatagcaggtggtagg

SEQ ID NO: 107148 - DNA, 1060 bp, Homo sapiens
tgaaaatgtaggactcatgtagaacaaacaggattcccacaaaggaaaaaatcaaatcaggctggcaataaaattctctatagtaacaaatgccagcataaataatgtctggatttttttaagaggaaaaatatgatttaataatatagttgtcaagccctatagtttataagatagagcaacagaaataaatagtctaaatacttggaaacaaactgatgacaggtcttttatcaggacaacaaagtagtatgccaggtgatcaaaataaagaatttacaaatggggtcattacagaataaaagaaataggactgacctgaggaaaaaataaggcatttttattatggttatcatgaagaatccattaatgtctaatgattccagaaaaggaaaatacaaattgtaaaaagcacacacaataatctggaactaggatctcagattatggtattgattggatggagataaggaagatagaatcaaatgtatttttgggcatctatgcggaaataactacagggtggtgacatttgttaagggagcagtgattatataaggggaagtgcagcatagagaaagttgttaagtttcattctagacacactgagttttaaatgtctggaacttaccagtactattgcccaatagatgattaaaaaaaaaaaacaaccaagaacatttactacttttataaattaagagaaacatagatgttttagttgttgttgttgttttaataataagggaaaaaagcaactgtggggtagtaactgaaatgccaactaaaccagtaatctaaaagtcttactaccaaagctctgcaagtggtttaatgagcctgccctgacgttagagaaaagtctatccttatccggtgaagccagtatataagtcgcaaagatcttttttgttcaggctagaagtaggccttaataaagccttctttccctgagacacaacctgttttttatttgcttgtcctttgggtcagtcaggaaagggagttaggaggtggtatgggatatcatgtcccaagcaggaggctcaacgctatctca

SEQ ID NO: 107149 - DNA, 1035 bp, Homo sapiens
atagcaaagacttggaaccaacccaaatgtccaacaatgatagactggattaagaaaatgtggcacatacacaccatggaatactatgcagccataaaaaatgatgagttcatgtcctttgtagggacatggatgaaattggaaatcatcattctcagtaaactatcgcaagaacaaaaaaccaaacactgcatattctcactcataggtgggaattgaacaatgagaacacatggacataggaaggggaacatcacactctggggactgttgtggggtggggggaggggggaggggggagggatagcattgggagatatacctaatgctagatgacgagttagtgggtgtgcgcaccagcatggcacatgtatacatatgtaactaacctgcacaatgtgcacgtgtaccctaaaacttaaagtataataataaattaaaaaaaaaaaaacaataattattggagactaactagcccactttgtagcttaggcagcactgtgacctgttgccttgactgactccagtgttctttctgctaaatcaaattttatatttatttctttgtatgcaaacctgtgctcaaaaaatcttgcatgcaccttaattctgcttcaaggcctgtgttaggatgatgacagttgttagaacagcgacaattaatatgatagccatattaattcattacttattttaaaatgctaatgatagggttgtacttccattagcatggcaactaccaactaattttgaaatatgactatgctgttagttgatggttttaccgtagttatgattggcttcctcttcagataaaactctgctaattaaaagtagcatgtacatttattactttttacttattaaacaaggaataattattcatattttaaatattctttttttcaagtcccaaaaaggatatccttaaatagctcaataaatacataattctacttatttaaaaaaaaatcaaataatgtaacttataggcattcatatatttttataattttgagactgagagtcatctta

SEQ ID NO: 107150 - DNA, 1053 bp, Homo sapiens
ttcaaagattacgtttttataatattaaccatattgaagaccttttacatttttgtcttaatttgctgcagtaacttgcttatgagtgaattggataggtggtgttctgtagctttattctggaatcttcatttcgttcagactccatagtgcttccatttacacagatttccataaaaccctattttgattaaaaagttacttattattgagaatgtatcttctctggcacacctttcccttcctgtctgtttgaaaaaacttttaaccacctaagaagatgtcaacacttaagatagtaatgcaaggccttcctcttacataataatgtagcacaaatgttcaatatggcaggagaagaaattaagtttattatggattaaggtagctagtagaagcttcttggggaaagtgggattgtgtaaagataggatttagatacgttcatggaagttgtaggagaatgacatgagaaatggcataggtaagaaaagacaaggtgaattttgggagatgtggaagagaccaggctgaagaaaagaatacatgatgtgcaataggtgaatgagtaggcaggtaagtccagaagtccttaaatttgagattaaagtggtaagactttcatcctatgataaactgctgacggatccagaccaattatgtagaatggccagaacactgatccatagcttcacagacacatgttgtaggtgccttctctaaaatggcaaccagttcagggaaaagaatcttccttttggggtaaaatattaagaaatgtattctgaaagaagtgagggagttgtattttcgctctacctttggccaagacacaaagttgaatggaagtaattaaggggattatatttagcacagtgtaatgtgggtatcaataatagtagactgatgacttaataaaggattaagttgatatagaggcacaatttattatttaagtaaatattctagaaaaatacaatatgtatggctgggtacggtggctcatacctgtaatcccagcactttgggaaaccgaggtgggcagatcacctg

SEQ ID NO: 107151 - DNA, 1173 bp, Homo sapiens
gtgattcaactttttcattaattcagattacatctctataattaatgtgaactaacatggttttaatgtgacagattaggattcagccttttaatcttaaagaaaatattgagcagtaagaagataaagtatgtaatcttagactaaaaagacatagacccatgttacttggaacatattttaacatattaatgaactgaaagaagaaaaaaaatttttttttaaattttgtttctgttatttactttttagactaagaaatcaacaaatatttcttgagcactgttttggtgtcactcttcttttcctttttccaaccatataactgaatattttcacaaataaactcctactaaggaaaatgctatttaagtagttaaatctaattagaaaccatattttagtggtaaagtttcaaagaacaaagtttgagagaatcttttcttgagagtaatagagtctgttttctttttaatatagtgaacaaatatttaagttctgaaaatccactgttctttgaactacgtgccagatacctaattgcttgtgaacgcatacccgaagcaatggctcttattaaatcttgtataaatcacccagaaatcagtaaagacttatacttccatcaagcactcttcacatgtctgtttatgtcacctgtagaagatcagctattccgggaggtattgtttgagactatttttgcctattaccattttaaccctaccaaaaaaaaaccaaaaaaaaaaagtagcccactgttgttgttaaattccttttacagtaatgccaaagatttaaggattacattatctggatgtgttttcttttggcaccataacttaaggtcatgttgaattagtcaaaatctgatattaacaaatgatgaaatcaataaaatatactcattaataagtattattcacattgcacttttgatgtgatggagaagaggtcaaataaaagtcaacaagctcacagcttgccaggagtaaaaaaaaaaaaaaaaaaaaaaaacccaagaagcattatgatcttgccttgaaaataaagtactagaggtaaaatgctcatgtttattttgtttcttaaggtgaaggaattaatcttttcctaatatggatcgtatgtacctataggttgtggacattaatgagattaaaagtagtcatt

SEQ ID NO: 107152 - DNA, 3103 bp, Homo sapiens
ttaaaatacacataattttgacccttctctcaaagaatatgagatttgtacctacaataataaatgggggtctagaagaaatcttaatcaccataagtttatgaatcaccataagtccattttgtattatggatagtgggcttgtcaaatgtgaaaattaaataaattagaagctaaaatgctatctattccagattattttcaagtttaagaaaaagagaaaggtatatatttaaaagagttaaacaaggctactaaatatggaaaattggacattggaatactatgtttattcagctttcattttaagagttgtgttttttaaagatagactagtataaccatttttttggaaaaaaagtatttagcactaatatttttctttttacaggttgaagaagaaggcttgcaaatttgtgttgaaatatgtggttgtgctctacaactcgaccttcatgatgatcccaaaactaaatgtctaatttataaaacaattgcacattttttgccaaatgatttggagatcctcaggatttgtgcactctcaatattttttctggagcgctccttagaagcgtatcgtactgttgaagagctttacaaacgtccagatgaagaatataatgaaggcacaagtagtgttcaaaatcgtgttcgttttgaattgcttccaattttgaaaaagggattgttttttgaccctgaattttggaacttcgtaatgattaagaaaaactgtgtagcattattgagtgataaatcagcagttagatttctaaatgaaagcacactggaaaataatgcaggtaatctaaaaaggacggaggaacagcaaggtttggatgaagggtttgactctcttacagatcagagcactggagagactgatcctgatgatgtatctggagtgcagcctaaaggtcatattaatacgaagaaaaatcttacagctctcagtacttccaaagtagatcacaatgtcccaaggcatcgttgtatgttatgtaacaaggaatttttaggtggtcacattgtaaggcatgcccaggctcatcagaaaaaaggcagttttgcatgtgtaatatgtggtaggaaatttagaaacagaggacttatgcagaagcatttgaagaatcatgttaagaagatacagaggcagcaaattgctgcagctcaacaggatgatcaggaagtcactgctttggaagaaataaattgttctagttcttccatttcatttgaaaatgggaattctgatagtaaggatttggaagtggagacacttactgcttctagtgaaggaaacaaagaagtcatccctgagcatgtggctgaattcattgaaattcccataagtgtaccagaagatgttattgaaaatgttattgaaaatggcagtcctaataattctttaaataatgttttcaagcctttaactgaatgtggggatgattatgaggaggaagaggatgaagaaggtgattatgaagaagatgattatgacctgaatcaagaaacttcagtaattcataaaatcaatggaactgtgtgccatccaaaagacatatatgccacagatcaagaaggaaactttaagtgtcctgctcttggttgtgtccggatatttaaaagaattgggtttctaaataaacatgcaatgaccgtacatccaaccgatttaaatgtgcgacaaacagtaatgaagtggagcaaaggaaaatgcaaattttgtcaaaggcaatttgaagattctcaacattttatagaccaccttaatagacatagctatccaaatgtgtatttttgtttgcattttaattgcaacgagtcgtttaagctgccgttccagcttgcccagcacacaaaaagtcacaggatatttcaggctcagtgtagttttccagaatgccatgagctttttgaagatcttcctctgctgtatgaacatgaagctcaacactatttaagtaaaacaccagagtcatctgcacaaccaagtgaaacaattctttgggatgttcagacagactcaaatcctaatcaggaaaaagactcatctagtaatgagaaacaaactattagtctgccagtttctactagcaaatcaaggaaagagtctacagaaccaaagacatgtatagaaagtatggaaaagaaaacagacagtttagttcagaatggaaacgaacgttctgatgacactgtttcaaatataagcttgatagaccaaaagatgcctgacatagagccaaattctgaaaataattgtagtagtagtgatatagtcaatggacacagtgaaatagagcaaacacctttagtttcatcagatcctgctttgaaaattgatacaaacagaatcaggacagaaaatggttccattttgcccagtgttgtaccacaagaacacaacaccttgccagtatctcaggcaccttccaaaccaaatctgacaagtgaacatacttcatatggcttaattttaacaaaaccatacgtcagaccattgcctcccagttaccttgatgaacggtatcttagtatgccaaaacgcagaaaatttctgactgatagagtagatgcctgttctgatcaagataacgtgtataaaaaatcagtgaaaagattaagatgtggcaaatgcctgaccacctactgtaatgcagaagcacttgaggctcatcttgcacaaaagaaatgtcagacactctttggatttgattcagatgatgaaagtaagtcttctgtcttcttagtagaggtatctgtagaaagagaaaatggcataaataaaactattatagatctttgagatttaaaaaattgatatttgtgtagcacaggtagtgaagcattactccatacattatttcctttaatacatacaaccactatgaggtgatactaatattcctgttttatagatcaagcaactgaaattcacaagtaatttgcatagggctttgcctatgaacttgtgcaaggcagaacctgaacacaggtttttcatattctttgattatacttcttcactgtatcaaaggttattcttcattccaagtttcatataataaaagttgtaattttgatgggaattattttt

SEQ ID NO: 107153 - DNA, 1050 bp, Homo sapiens
ttaacccattattaaaaagtgtgtgtggggaggggggctggtttacaatattaaaccatttaaagtattttattctacaaatggggtttgttttcttgtcatgcataatcagattatgtcccctcccttctggttaaacatggtttaaggaaccgctgctgtttggtttgtgattgatttagaaacttatacattaacttaccacagtgctatcaattaaagattgtaacaggtttccagatgattaattaggtcaaagttcaatgaatggcacgccagcattgaaaattaaaaaacaaaacaaaaaaaaccacagtgctttgctaataagctcttgatagaacctcccactaaccacttttgtggtacaaattagttaacatttaaagggcagcagtgtcaataaaatagaaaaaaaccgatcagtactctggggagagatgaaaggaatctaagactttacaggctttgtagttgaaggaaaacactgaattgcaaattattcaatgtgaataatggtaaaagcacactgggatacttctgtttgtgtatatgttgggacattgcttgatgattcatagtaaggtcctttagacattaatgtgagttatctaagtacagtcctattaaaataactggctcaaaaaatcagctaagaatcaggttgagaaatcattcattttattctattaggagaggtaattccaaaataagccatactattcctgtttttttaattcattagtgatgactctggtctgaacagtaatttttatatgtaaaaggaagtatttacacaaaacatttgcacaagaacacagtaagagatacattcaagcattgttttccttagtgatgttattttcctaagaagattttaacttaataaagtgttaaaacaataaatatttttaaaaataccctctcagatgttttccatttgtccattattgaaaggaagatgcttaaagacttccttttactaatagtgtgtaaatctaaaacagggattaaaataacaaaaaggcagtgtttcaaaacagatctcct

SEQ ID NO: 107154 - DNA, 1098 bp, Homo sapiens
ttccattttcattacttttactgttcatgccaagatgtttcaaatatattccatttgtaatctgtctttaacttgaggtttatttctacttttgtgttgctaaaattatttctgcaagactgagatcaaactggtttatatataactaaatcaaggaatgttttataaaattctatttgaccacactgtcttaacctcggtttatatacttctcaaatagctattgaaagaatgtgttcattttattacatctgtcttttaaaacataaacctacatcattttgcttttatagggtgcataaacttccaacagttctaatttgagcgcttcagaagaaaaggaagcttgcttcttattcctcagattcttctttttttctgttttgaggatgtattcatcctacatggaccaagtttcaaatctttgtttttaaataaaaatttccttcaaaaaattaaatgttaaatttctgctgtgtgtcagtaaggtgaagaaaatagcaaatctgaatttttgctgctcagatattatggaggaggtaaaaaggggaatctccgtggacaaggacactggtactttgggctttagccatattcatttttttgaaaccaccaattatataatacttaaataatttatatcattgaacttgtgattcttttcaaatcacactgaaggttcagccgtactcctttcatgtttggtttaatactgttgtatggatgaaaaacctaaaagggatgatagtgtttattttttaatttatttggtactgtaaaacaccttttcagaatgagtaaatgctgcatatgcattttggagttgttaatatgtgaaagatattacagattcagcaagaaaggaaatttgtgcttccttgttgaatgttaaattattttactttgcattttataagagtacaaattaaaactgagccattgaactgcaataaatcaacaatagtgtctcatttcaagaaattttttgtactgtacatagatttgttcaataaaacgtccttgttggtaatcaagtgttcaattttatgtagtatattgctttcaaaaggaattagacatataaggtatatattaaat

SEQ ID NO: 107155 - DNA, 1039 bp, Homo sapiens
cgtacttcattggtaccacatacagtgattacattataaaaggcctctagatcactttgttcaaatttaacagatggtttcggtaatgttccaggagcaagggaactctctcccataattttcaggttgataaatttgattttccaagtattctccacaaaagggcagcggatgagtccaaaaatttgttcaaaaatgcccaaacaagtgtttcctcgatggacagtcccagcaactccaaccataaccagcccatgaggagaagatgcacatttcagtccatgtgaatctaggttggggctgagaaaaagaaattcttcttttactagtgacagcaaacgaaggctcacgatttctgctccatggtagtccataacattttgttctgatgtgttgtaataaaacctaagcttcacatcatgccagaagtgctgtggtccccattcatcttgaggtggtcctagaaaaggattctgagaattaagaagtccaaagaaccaatgacagaattcttctcctaggcgacgaaaatcaactttttcagcttttttatcttctttcacctgctgattgaaacaaataaaataaatacaaaataacactaaggtttaactttcatatctatttttctatctagcctattaagtttgaatgaacccattacaccagagagaaatgaaccatatgtgaacttgctgaacccattatgcatagtaaaaatcttttttcaagaggagaaaaatcattttagaaatttccagcttaaattgctgaaaattcagctaagagagtaaggtttagtaaggccaatttaaaaatcagtatgaacttggcgggcgtggtggctcacgcctgtaatcccagcactttgggaggaggaggcaggcggatggtgaggtcaggagtttgagaccagcctggccaatatagtgaaaccccgtctctactaaaaatacaaaaattagccgggcatggtggcgtgtacctgtattcccagctactcaggaggctgaggcaggagaatcacttgaacttggga

SEQ ID NO: 107156 - DNA, 1018 bp, Homo sapiens
tggaaatttctaaaatgatttttctcctcttgaaaaaagatttttactatgcataatgggttcagcaagttcacatatggttcatttctctctggtgtaatgggttcattcaaacttaataggctagatagaaaaatagatatgaaagttaaaccttagtgttattttgtatttattttatttgtttcaatcagcaggtgaaagaagataaaaaagctgaaaaagttgattttcgtcgcctaggagaagaattctgtcattggttctttggacttcttaattctcagaatccttttctaggaccacctcaagatgaatggggaccacagcacttctggcatgatgtgaagcttaggttttattacaacacatcagaacaaaatgttatggactaccatggagcagaaatcgtgagccttcgtttgctgtcactagtaaaagaagaatttctttttctcagccccaacctagattcacatggactgaaatgtgcatcttctcctcatgggctggttatggttggagttgctgggactgtccatcgaggaaacacttgtttgggcatttttgaacaaatttttggactcatccgctgcccttttgtggagaatacttggaaaatcaaatttatcaacctgaaaattatgggagagagttcccttgctcctggaacattaccgaaaccatctgttaaatttgaacaaagtgatctagaggccttttataatgtaatcactgtatgtggtaccaatgaagtacgacataatgtaaagcaggcttcggatagtggaactggggaccaagtttgaggtagtggaaatgagacattgctgaacaaaagagaactgggtttacctgaccctctaaagcgctaagtactgtcagcctgaaaaaaatcttctatacagaaactcttccaaatactatatcagtaatgtctgaatgatttcagatgtgaaaattgacatattttagttgaaatacctttctggactacagacttacatatcatgtgaat

SEQ ID NO: 107157 - DNA, 1028 bp, Homo sapiens
ttccaaatatgggtctggggtggaaatgaattccccttttaggaaagtagtttcaatcaacgcttcttcaatcttcagacatatttttagtaaattgtttagttgtgaaaataatgttgaaattttgttcaaatttttttttctcacataatggtaaaaatgtttatttttatcaaaagggaagtttaaaagactaatgtaatttatagtgcatgctgggtcagtggtttggatatcaacaggtgatacatttatatactttgttgagacctaagtcacaactgtaagttcagtgacttgatggctgctagggttgtattagttttctgttgctgtgtaaaaaattaccacaaacttagcagcttaaaacaaaacccattttttatttcatagatccctaagtgataaatacggcatggtgtgactgggttcacaaggctgaatgaaaggtatcagctagttgtgttttcataaaaaatgggcatatcctcatattttcgattactggcagaatttaatccctggctgttgtcagagagaggtacccatttcccagctgggcatcagtgggccactgctcctctctcctgaaggccatctgtagttttcttaaggggctccctctgttctcagagtagccatggaatgtcatgaagtccttctcatgcttcagccctctctgacttcatcttttgccatgagctggagaaaactctccgcttttcagggctcatgtcatcgatcagattaggcccacctagatattctccctatcttaaggtaaacataatcacgggaataatactatatgcacaagctctgggagttggaggagatatctttagtgagaggattttagaaattttgtctaccatacctgtgtgatatcagcaactggacagtgtggttgtggttcacaacatgacctaggaaaaaaagcgaaaatggaattgttcttcttattgggattgtgggtaccatcatatctcattttaagttgacttagataaaaaaacaaattgctgcta

SEQ ID NO: 107158 - DNA, 1049 bp, Homo sapiens
ggctcattggattaaaaagatttaatctcattgcttttcctttctaagggaggaagaacagattggtttctgttttcttctctgaatgctaggaagaaattcccacataataggaataaataatatacatttttaacctaaaaaaaaaccatgaaagctctctgataaacttgaaatgccataaatgaatgctcattggtagcaagtcttataatttggcctgctgaattattttagaatgtgtggacaatttttctggcattttgtgactcagttgtttttaaattgcattaaaactcaggcaacgttgacagattttattttggatcatacattattttgtggttacttttgccatctggtcttttttttctttttcctttttcaaaagctttttattctttggctaatcttaatagcttctcagtttaaaaataactgttatcagatagtatgcacttatggcttgaccaatgaaaccatctctccaggagggatgttttgtttgtgggagcacagcgttgctgaactaatccccatggtacaaacacactatccaaggcaacacattgcagtgtattttaaatgaatagatacattccaaaatagaatgagggctttggggaattgcccacatttaaccaaataaccagctgtgcaaaatgctaaaacacaattgatctactacggtatttgaaaatcatgtaaggtcatttagttcaatactcagatggctacccagcaggtctagaagctttgcaggcccagcagtaactgatattagtcattactggagatgatcaaaaaggccgactgggcctttttgaatccagctaccattctgttcatgtattcctccccacaattccccagatcctgtaaatttcctccttaaattttggctaaggagaaggtttttggtacattttttttccctggttcatttgacttcttactcctagataggaataacaaaactaaacagacatacaatggagcaatggggtttgtatcaaagggaaaataagaattttaggcaaaagtatttt

SEQ ID NO: 107159 - DNA, 1302 bp, Homo sapiens
aaaaatacagaaatctgcttttattccaacaataataaaagagatatattgatcatgacatttaaaagagattcccaagtagctataatttggagttaagaaaatgatttaacaatgcttaaactgttgcttaagtttaaagagaaaatagtatgttatttgtataataaaaatagaatatcacaagaatatgcttgtttctactctccctcaaatgtgtttaagtttaaatggaactaattgtgtttatgaaatctgaggaactcatgacatgctgaattcaatgaagtacagtaacatgtatatcggcgtcacttaacatgtatttatggaatagaatttcactattaacttttcctttaggattagaatttggttggaaacaggaagtctgaatgacttctctcactgtaaacaaacaagatgctaaaagtcttggactaatattctaatattttccttttacagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaattttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaacagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggt

SEQ ID NO: 107160 - DNA, 1197 bp, Homo sapiens
ttttctttctcagggcctcttcatttattttatcccaagtctgtaggattgcttgtgtggcacaaagaaacctgttagtcctgctggcatatgcttactaaagcattttaaatttcccaagtcttttctcaacaaagagtgattcaactccttcccttttcatatgtaaacttggaaattaggaaggctcataaacagaaagatataagacactcctataggttccggttgttttacggaattttcagaaaccagtatacatttatattttagctaaactttgagtttgtaaaactaatgtgtattttaaattttagtcataattattataaattagtcttataataattagtgatttttcccttaaatttagaggctctatcatacattttctttccttattgaaatttagtttttgactttcaaaaactcaaaagtcactcttaagcagcattactcttactccttgcttatattgaatctttgctctgctcttcaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccaggtatctgcttactttttcttcagttttaaaaagtatattttaatcaaaccgataatattttaaatatataattatagtaaaaaagcatcagaagggaacataaaatccagtattcattattctttttctaggggctagtaccgacattttattggcatatttttgttttgttttgtttagtttaaaaatgttgaactaaggctgatcaagttttgcttcatttggctatcccagccagaaaggatatgttattttatttcatcatcacaatagtcttataagttcaatatttgttctaatttacccaatatttattcatctattattcagttcatcttatcatttatccagctttttttttttttttttttttttttgagatggagtctggctctgtcgcccaggctggagtgcagtggcacgatctcggctcactgcaagctccgcctcctgggttcacgccattctcctg

SEQ ID NO: 107161 - DNA, 1143 bp, Homo sapiens
gcttgcagtgagccgagattgcgccactgcagtccgcagtctggcctgggcgacagagcgagactccgtctcaaaaaaaaaaaaaaaaaaagaacttatttacactattgattccatgtgcgtattatcagacaattgcaaaataaggccacttaaatttttcctaagatagaatggctcacttaattgttaattttctagcagcctggaattgaaagatatataactggatgtttaagcttaacagaatagtattttttttaactttaaaatatggtatgcttttaatttttgatcgtgctgccaccctaaatgcctttttatcacatttatcataatttgacattccaaatgagttgtaacaaattaataattacattaaaatgattactttacagaagtattttattggaataataacataagttttagatcccagtatttcaaatgacatgtagtaatacttggttatttggtaatttttctttttaattgtaggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccggtaatgatccaagcttgtatcattcatcatggatgagttccttttgtctgtaatagatttgaatatgtgtgtttctgagaatcaatagaagttgttttgttaagcatactaagtgtgacaacttgaaatgatcatggaaaaataacattagtaacccttgaaattatattaatgaaataaaaaaatgacgtagtggttttgtgcccatttaaatccccagcataaatcatgaagtggatttctaaaattctcaagttaacacttgagaatgttaacactaatgttaacattagtaatgtaatgttcagtgttaacatcatgataatccatactcagttgttaaacatataaattcatatatttaagtccaaaattacaccattttgtaaaagccagtcaaaggactttctcaagtctatttttaggacttaaatgcaagagctaaagaatagcacataaggtgaaatttattgttaa

SEQ ID NO: 107162 - DNA, 1050 bp, Homo sapiens
ctccaggagagatatagtatgcctgatacttatacctgtgtattaatttcagcatttggaaggtgctatcaaaatatatgtcaaagaaagatgacaaattaccaaagcatctgttccctggggaaaagattccaagaataagcaagaaaatataataacttaattttaaacgtacatggaaccagagataatacatgagcagtctaattctgcccttctcttttattaattccagaaaaagaaataaataattgactctttgtctgtgttactgtttgtcagtacaagaaaaaaagaataatgcattgagctttctgtatttcttactcttaaggatctctctttgtccattgtttagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtacgtttgcagatttcatcaatatcttcccactttgatgcagtctgtataaaatcataatttatttttatagtgataccaaaccaaaatggatttggagttatctgatgctatatgaggtatattctacatactgtaaatccctgaagcatcctgagaaataatattctcacttaatatattagaatcattgtttttagttatttgcttgaactactctgtctttaactttttaccttttttagttgctgtttggtgaacagtggtgttagggactattaggaggcctaacatttttttttttttttgagacagagttttgctcttgttgcccaggctggagtgcagtggcgtgatctcagctcactgcaacctccacctcccaggttcaagtgattctcctgttttggcctctcgagtagctgggattacaggcatgcgccaccatgcccggctaattttgtgtttttagtagagacggggtttctccgtgttggtccag

SEQ ID NO: 107163 - DNA, 1075 bp, Homo sapiens
taaaggggtcttttcttcccttcccttccctaactttcctttcctttacttccccatcatgctctcccttcctctttcccttctcatttcttttttctttttttcaaagcaatgaattgtgaggtaatctcaatgaaattcaaatgatcagaaatgacagttaagttgagattctcaatcttttttttcttcaaattcaaaatgagaaatttggtagaattgttatactttacttaatcactgaaagttataaattaatttttgtttcaaatatgtaaataaaaactatacttgtaactcgtttaaatttccatgttcagtattatgtttaaatgtagtttgatgtcatagtatttctttccctaaggttcgattatcattgattatatcatactacaatcataatattcctctgcctataagattgaacatttaggggatattaaagtttgtgtgcgtgtgttttttttacctcagatatagatgaatgctctgagaacatgtgtgctcagctttgtgtcaattaccctggaggttacacttgctattgtgatgggaagaaaggattcaaacttgcccaagatcagaagagttgtgaggtaaacattttacaatgcttaacttctcacctgttttctaaaatgagagatcctagatacttattttcacatagctaagtcaggaaaatacagacgttctgcaataattgctgtagctttaagcaggttatgagtcatgattatttactaattatggtcatgtaagtcataaacattggggataattagtggctgggtttaaaaaaaagagggtagagtcacagtttagagagtacttatctgtagtctgtacatttataaaatacaacttgtatgtttacttaagaaatcaagaaaagctgagtttaatagccctcattgtgaaaaaaaatctctcatagaaacttcagtgaaaacattttccagtgtctacttttctggattccactctgactagtttgatcatgccttaggcgttatagggtttataaagtgctcataaaatttcagagggtacaagtgcagttttaatgtac

SEQ ID NO: 107164 - DNA, 1428 bp, Homo sapiens
aatagtagtgtactaattagatgtttgttcatttccaaagaaacaagatagaagagatgagccttcccatgtacaaaaaatacttgtgataatatggagtgaatctgttttcaagacctccatttattttcgcaccacaacctggcagataagaaaatttctaaagctttctccttcttaacataactagaaaggaacatggcaaacatcaatcaaatttccctctgcatttgtagaaagaaatcatatttagtgagctaacatatgatgatagatttaatgttttttggtccaaaggccaatctgttatctcattacatatattaaacaagatccaggaaacacaaatcaagggttctttggtagtgtctgctggtatgggaaaaatgttttttaatatagtgattttatttatagatgtggatgaatgctctttgaagccaagcatttgtggcacagctgtgtgcaagaacatcccaggagattttgaatgtgaatgccccgaaggctacagatataatctcaaatcaaagtcttgtgaaggtaggatgatggtggtatcattactgatggtggagagggtgggtgtgaaccctgaactgatatttaaaagcattggctttgtttgacatcaacagtcatattttcttatccctaatatagcttgttcaattgggtaatcattggcttccttccttccagagcaagagtatgtaaggcatatggtctttaagtttggtgttaggcacgccagttggccctttgagctacctatgaattggagacctccatgtgtggtaaaaacaagataaacatattttcacatcatttatatcatattcaaagataaagagaatttcactttggaaggaaaaacagtagatagaaaagaaagacacaagcttaaaaatcatcttattgagacaatgagcatggttaaaactttagtttttattccaagcttttcagtgatttttctgtgcatatataaataaatcatttattctaaaataaaaaatgacacagttctattatctcatgataaagaaatgataacaatactctagaaatttaagaaatactgatcggtaatgtcagagcctgtgggtttggggcaaccccttaaaggtgctgttacttcatgtgactgcagtggcgctgccctgtgtgcatcaggaagcttcaacatattatagttgtttgtttgtaggtttgtttattatgatatacagattatctcataccttcctttcgattttttaaaattttaaaacagatttactgccatggctggaactaatcaacactaatttttctattgtatctgtatatatatatgtatgtatgtatattcacacacatgtataatgtaccttttaaaaaatagatttaggggctacaagtacagttttaatgtactcttttaac

SEQ ID NO: 107165 - DNA, 1186 bp, Homo sapiens
gaagcatgatctatcatatggaaagagagatgccaaagaacttccaagatgctccatcttggaagcagtcccctgccccagccatcctggttgactccattggcagcagagacaaacaacccaaccaaactctgcaaatatttgacccgcaaatcatgagaaaaatacaatgattacttaagctactaattttgggggtggtttgttccttggcaaaagctaagtaaaacaccatcttttttatagtaagctggtgactgtctgaacaatgaagtaatacatatggtgtctttagtgcctcttaagaaatatatttttggcactaagtaactcctagttacgttaaagtcacaaagtatttcatctttacaattccagctgttatttcttagtttcctagcaatatctaccaggttgctatatctgatttcacagggttgtagtgaagaatgaagggaatgaagtaaacctgatttgtaatatagaagcattatacaaatattactgtattaatctcagggcaacatgagaagaattggaagtagcctatagcaagtagaaacacgaactgattctattgacttaattacatatactttataaatcagactctggtcagtagatttgagggcaacatcttgtttctgctgtggaattaaaaacatagacttatatgacaataaatttctatgctaaatcaaggtttttttcacttctgactttaaggttcttctccagagagaagaagctgtcacagacttattttttatgtttctgtatctgttgccatcttgcttgtagatttttaatttttcagaaaggtagatggaaacatttagtgttgcattttgaagactgaatcttgtgaatctacaggagcataaatgtcctacctcttgggacagttcctaccatgaattcagatcaagtatgtgtgtctactctaagaagattatgtttgtttttattttcagtttgtcttcgctcttttcaaactgggttattcactgctgcacgtcagtcaactaatgcttatcctgacctaagaagctgtgtcaatggtaagcacttctaccatcaattgaaaaaacaaaacaaaaactctgtaggtaaagtacacccatggtaatataaactaacgtttaaaaattgagaaatgatcctttgatgggttgtatgcccagca

SEQ ID NO: 107166 - DNA, 1640 bp, Homo sapiens
aactatattttctaacttcagagcttttaaatcaccaaatatgtcaacgtacataaataacttaatgtgtcaaaatttcttcagatgtattcttgtttaatcaacccatcatgtgaaacaaaaatatactttttattatgattttttttaatttaaatttcatattttggtctttatttgtatataggcatgtgtggtgaattccactgttaaaaacaatttttaaaaatgtcctgcctaagttacactttttttgttatttgatgtgtatattctataggccaatggctctaatttgaaaagcaaaacaaaacagtcctttctctggtaaatctaacagtagttttactaactacaacagctcatacaggaaggtccctgtagtgagataaggtcaccaaagaaattaaaaaattgtaacccatatatttggggcaatatttagacttcgttttcaggggctgataaagcacttcaattggcctacatattccatgtactatcttgaaaacatgcgatttggaaataagtactctgggtttcattatagtttttaaattgtgttcttctcttttgtaagaagtggaataaataactaccatttccataggcctagtatcacctaatagagtgagtgtttctagtaaagagagagaaacttcctgggaagaatggtgaactctgagcctaaatataaacattagaaatcattttttgatgtgagctggcaaaaaataaaataaggaaaaaacctgaaaaataaaaaaaagaaattatttttagtttctaagataagttggtgaattacctcagaatgctgactccctcccttcaaatcttctctaaagaaacaataagattccaagcactaataataacaaaataaaatgacaaaaagaagtttaagaaatgcctgggtaggcgaaaagctggcctgacctgctggtatgtgtggtgggggattgggttctaactgacaaggcagtagtgacaaaacagatttgataatttaaaaaatgacatgaactttccaattgagaaaacaaacacaaaaaatacaatagagcaaaccccaagtaacaagaagttttaaaataacaaaaacagagatagaaataagtggaatagaaaaacaaaagtgagcattaacaaaagcacattctcattctttgaaaaggttagtaagtgagactgacatctggcaggaataatcaaggaaaaacaaaaaagagaaagaggaaatgccaatacatagagtacaagatagaaagggaaaatattctaaactcaacacagattaaaaatattatcataaaatattacaaacagctatattaaatacacttggaaacctaaataaaatggatgtgttcctagaaaaacataaaatatctgtaatttcacaggaagcaatagagaacttagttatacaaacgagtattaaacaagttaaaaccgcagccaaagccctcttcttcctatttctcccgaaacccagatccagatggttttacaaatgaactcttccaaattttaagaaattgttaatgtttcccttattaagatattgtccttaaaaaatgagcttattctaagaggcttatgtaatcttgactccaaaatcaaataaagacatttag

SEQ ID NO: 107167 - DNA, 1021 bp, Homo sapiens
ctagagtgcagtggcatgatcatggttcactgcagccctgacccccccgctcaggcaatcctcccgtctcagcctcctgtgtcgctgagactacaggtgtgcagccccacacctggctaattttggtattttttgtcgagagggcgttttgccatgttgcccagtctgggctcgagcaatctgcccaccttagtctcccaaagtgctaggattacacgtgtgaccacagtgatccctctgccccacccccaccaaacatttgttactgtgttacaattctcatgattacaggtgtgatcattttcgaccctacccaaccactccctgtccacatccctaataccacagtccacatttccagtccccacagtactacttatgcctcaacatctctaatatattcctttgacggtcgcaatatcacctttgaatcccattatctattgtgtaggtttatatgagaggaggaaagaatgaggcctttgactcagttctggatgagcttatgttctgtacttactaagtggtaacattgaatatgtctttgtgtagaaattctggtttctcatgaggtattcttgtgctgttaatggtacacattagatatattatggcttaagaatgcttttgtggactagcctgagaaccttactatcagaaatttttaacatttttctctttttaagaaagcacattctttactccaaattgactgatttacagacaaacttttggtacacaaccaatttataggtaaggtactacatgtacataagatgtataagataaatgtctactttaattcacttcaaagtatgtcactgttagctgggcaccttggctcacacctgtaattccagcactttgggaggccaaggtgggaggatcgcttgagcccaggagtttgaggcctaggcaacatagtgagaccccatctctacaaaaaaataattaacaacaaaaaaccagctgtgcatggtggcatgtacctgtagttccagctacttggggggctgagatg

SEQ ID NO: 107168 - DNA, 1030 bp, Homo sapiens
accatcctagctaacacagtgaaactcatctctactaaaaatacaaaaaaattagctgggcatggtggtgggcacctgtagtcccagctactcaggaggctgaggcaggagaatggcgtgaacccaggaggctgagcttgcagtgagctaagatcgtgccactgcactccagcctgggcgacagagcgagactccatctccaaaaaaaaaaaaaaaaagtgacaaacgcacttctgcttatagttcaaatagttaaaactcaatgaagcacatggaatatttcttcggcactatgtctgttagaaacattttctcttaaggttgaaattaatgtattttcctctaagagaagtataaatacttattgcctatttaacctttggtaatatatattacaaagtgtgtggttgttttaattatctgaataaactttgtgatagagggagggcataatttactatgcctgctaacacaccagctggtagttacttagtattattacactgagttggctattaatgtagcagaacgaaaaaatatggtaacagctgatattgaaattactcctatggtgagaactgttgttacattagaaattaccttgaaaagaagcttgagttttggaaagtgaagtccctgaaacatggtctataactttgctattccagtatggtccgtggaacatcagcatcaggtttacctggggacttaactaaaaatgaaatatatctggccctaccctggatgtactcatccagaatatgcatttaaacaagactttcaggtaatttctatccacatttaaagtttgagacaatctagtttttaatgagatagagaagatagataagtgaacaaatttttgcagaatggccagaggtggcaattagggcaagagaagaggaaatgtcagagaagggagaaagaaagctgagcaccatggcaagagaatgcagcttgtggagaaggtctccagtgagaaattactagatgtgaggtgggtaaagacttttaggaatgggcatttctt

SEQ ID NO: 107169 - DNA, 1150 bp, Homo sapiens
acactagagcccatcccccagctccgaaaagcttcctggaaatgtccttgttatcacttcccctctcgggctgggcgctgggagcgggcggtctcctccgcccccggctgttccgccgaggctcgctgggtcgctggcgccgccgcgcagcacggctcagaccgaggcgcacaggctcgcagctccgcggcgcctagcgctccggtccccgccgcgacgcgccaccgtccctgccggcgcctccgcgcgcttcgaaatgagggtcctgggtgggcgctgcggggcgctgctggcgtgtctcctcctagtgcttcccgtctcagaggcaaactgtgagtaatcaatagcgtctcttctcccttccccagcattgtcgactgaactgcgtgccctggttggtaggattttcttctctagagctgcagcctcctagaaagtttccagtaagtaccgacagacacccagcggatggaaacagccgtggatagagcaggcagtgcaatggtggggcaggatcactatttgcacagttgcgagaatgtattgcctacaggacagatctaagaacctagatgacactaagtatcaatggagggatgagaacacctgcccatttcccttcaaagctgaagttcccagtcagagaactaggatgagcagattctagcttatgagtagggaagaaaaggtaacacactgtgtcttccctttgtccaagcgcctgcccccaacctgcacccgtctcctgaaacctgcctcccttttgcaatttctggactttgagcttggtttgcttgtctcacattaacgaaatgttttaggatgactgagggtttgtatagcagtagatatatgtcactttctaaccctgaaatcaaaaggactgttaaatactgtattctatttctcagatcgtttgtactgaggattttttaacactgcatgccactgatctgaggtggtggcatgaattctttatctttgtgtttcaggttctttatgtccttatgcccggattcaagacaggatattgagttttctctgaaaaatatataaggaataccaaggcaattagtacattttagtggtcagttaatttgttttctaaagttgtaagtgtgtttattgaataaaaacgcctttttgtttg

SEQ ID NO: 107170 - DNA, 1031 bp, Homo sapiens
aacctgaccaaagacgcagatacaccgtagccgagttagcgggacccggctaaagaaaagccccgcgtcgacgtgctgacgttacttcgaggcgcggaaggcgttccccaggcaacgcccgtactgcgctcgcccaatcatcggttgaggtcctgaggtagaggcctctgagtggctgaagagtcctggctacccgcccctgcgcgagactaggaaaagagaaaggggagtactctataagaaggaggcggagctcgaggtagctcgttctcgtaactaggcaaccggagcgtccggagataagctggaggatccgggacaaatctccagcaaggcctatctttatacctacataaaatgtgttgccaatccacggtgctgttcctttcctttctccagtgtccccaactgagattcagagatctcaggtcttgtgcatgggtttttctttttctttctttcttttttcttgttttttgtttgtttgttttttgctcagggatggggaccctctagaattctggccgacttaggcagcatgactacaggaacaatacactggggcaattcttgtaagttaaagacaagggggaaattcgcttgctaaattttctcagtagttcagatgagagtgaagccttaatctctaaaacgtttattactgttacatatgtgaaacggaattgtatgatatttgttgtaggggggattgtgattacaaaagaaaaatgcatttcttgtagaaaatgtgaaaaatactaaaaagaaacaagatgaagaaaatgagatctcacaggagctctcaaagataaccatttggggccgggcgcggtggctcacgcctgtaatcccagcactttgtgaggccgaggcgggcggatcacgaggccaggtgatctagaccatcctggctaacatggtgaaaccccgtctctagtaaaaatacaaaaaaaaaaaaacaaaaaaaaacaaaaacgggtgtggtggcacgcgcctgtagtcccagctacgctggagactgaggcagggga

SEQ ID NO: 107171 - DNA, 1834 bp, Homo sapiens
ttaggactataatttcttagaactacttgaaacttcccagatgtaagccttctctttcctttatatttttgtgttgttctcacttacctaactagagagaatatctactgatgtttaaagatgtatttttgtcgtatagtctcctcttttataaagtcctttttaattcccagctgccccaattactaccttacttagtagaattgatcatgtccacttttttggcctgctcttcctgatacctacttggtcactacttaattacattttgtttgtgtatcttttttcttcaggctgtaaattctctaaaggcattttgcttattttggtgtcacaattgtttaggccatgcgcctaggtcttcttaaaacacctctctcatggctcctacttttctacttatttctgattcttttctgacttctcagccttcttttttttttttttatttccgtgtgaaattgagaaaaagttatctgctagtttcttttcagatgtgtctacctctcctctgactgtgttgccattggctaaatccaaaccctcagtttcttttatctatgatgtcacagtagcttttttctaattcatattctatttatttatttatttatttatttataattttttatagaggtgagtctcactatgttgcccaggatggtcttgaactcctggcctcaagtgatcctcctgccttggcctcccgaagtgttgggatagtaggcatgagccactgagcctggtcatatttttttggttttttagagacagggtatcactttgtcatctaggctggagttcggtggcgtgatcatagctcactgtaatctcaaactcctgggctcaagctatcctcctgcctcagcctcgagagtagctagactagaggtgtgctccacaatgcctagctaatttttttattcacaatagctttttttcccttttttatttttaattttgtgagtacatagtaggtgtatatattacgaggtacatgagatttttgtataggcatgcaaggcataataatttcgtcatgaaaaattgggtatctattccctgaacatctattctttgcgttactctttcagttgtttttaaatgttcgattaaattattattgactatagtctgcctgttgtgctttcaaatactaggttttattcattctttctaaatttttttcacaatagcttcttaatataaaagtaacaccccttcctggaactttacttctttaaatcaaacttctcttcttcatggttgtcagtaattgcattagttggacacaggttcaattgttctcacagagacctaagataacagtggttcaacaagatagatgtttctttctttctcataacagcctaagcaaaagtagtctaggactggtttgtcagctccatcgtgttagtcctcaattctttgttctatttgctttgccatccccagtgttctccctcacctacatggttgaaggtagttcactacaaaatgtgcatttcagctagaaggaagaggtaaagggtaaggggaggccatcctccttttctttaggagctgaaccaaaagctgctgcatcattttagttcacatcatgactagaagcagtggtgttctggacctgcttttcatattggctcatatcaactagtgagagccgattatgcatatctcttcccaactctatgtttaggtacctcacattgttagtttgaaattggccatggtcaaagtatttatactgtggaaattggcagataccatacatgtatcagggttcttctcctccaaatatttaacaacacatcactggctagcctcccctcat

SEQ ID NO: 107172 - DNA, 1050 bp, Homo sapiens
taaatataactttaattcagctaattaaaaaagagtggccttattctttatagcttctctcattctttgattcttctaaactcttctattctctaagtgttcatggttttctttataactccacagatgttttaatagtccctggggatggctatggtattgaaaggttgacatttttattgtttgtaacttggacagtaaatagccttaaaggcaagagtttattcatttattaattcaacagatacttactaagtacctattatatactaggtgtgggtgttatatcaggggaaagaaagattcctatctgcatggagtaaaatttctagtttgatattctggcctgtccccaaaccagtatgcttcaaaataatgtttattgtgtcagtgaatgctaaatatttcacttgggtgctaaaattttagttgaaaaattaacgttgtcaattaaagtctaaagattttctttttttgtgtatcatttgtaacagaataccctgaagatgtagctcctactgttggattttcaaaaattaaccttagacaaggaaagtttgaagtcaccatctttgacttgggaggtggaataagaattcggggaatctggaagaattactatgctgaatcctatggggtaatatttgttgtggattccagtgatgaagagagaatggaagagacaaaagaggctatgtcagaaatgctaagacatcctaggatatcgggaaagcctatattggtgtaagtaatgttagcatcattgtaaatgtagggacgatggcattggccactaaagaaatttacctgttacagactagtgaataagctaaaatagtcacgctttagtatactaaaatgtatgtaattaactgggagttgttaatttactgaggccttgttatagtgctgtctataggggaaaagggctaaggctatagaattcttaaaagtggatctcttcgatattcaaatataaactcattgttttatgtgatagtttactttttatagaattttgcattttgaaatactccattaacaaggttc

SEQ ID NO: 107173 - DNA, 1012 bp, Homo sapiens
tttgcaagtttcttttagtcatattccgtattgtaagtgcccaggagaagttaaataggttatggttatcctaatacagttatcagaaattgaatcaaacatacttttagtatgttaaacatttaaataatagaagaatctgagtcctgttttagaatgctggagacctatagatatggaattacggtctgcctatgtcacataatcagttgatccttagatagagtggtgagtcccctaatttcctctgaaacccctacttattgaatttataaggtctattggcttaagatttctctcctttcagtggagcgttaccacactgtcatcttcattaatgtcatttacttatactgttgactcatctccagatgtccttactgaatgtttccttttgtctcttaatgacattcagcttcatagcagctgtaatttacagtaaagattctcagccaattgattttgtaggtaatttaagtactgggagcctgcagaggtccccatccctgccttccctatcacttcaatctagttaaaaacaaaataacagaaaaaaactctttggcagtgttactacgtagcaagatattgtccatggaccacctgcatcagcatcagcctagaccttcaaaatttttgagggtgagaccagatatactttgggctttttttccatacgtgctctccagatcattctgatttatagcaaaaattgagaactactggtgtaggagaaagtgttaagtcagaaaggccctaagtaggttatttaatctttctaagcttttatgtctgcacttgtaaatagggattataatatgtcatgttatgtgaattccaaataatgcatttaaagcctctcaagcctgtagtacagtgtttcactagtgttctgtaaatgcaatggtggatgtgaatatcattattattgataatatactgtgtccaagtgtagaagaattaggagaacctaatgtttcaaagtatttcatcttacgaattcaagctctat

SEQ ID NO: 107174 - DNA, 1143 bp, Homo sapiens
tgttcctctactaaaagagatatctgaatgaaaagatcccttaaatcctttatttggttctccaaattaacaagttccttgtgtctctgttcaatctctgaaagttgtgctttagtgatattgatttctgtaagtaagctttcattaaaaacttcccattttccttgatgaagcatatcatttacatcttcttcagacatctcttttccagcaacttcaagctgacgtaaaataaatgtcttgcacttctcttgctttgctgctattgtgtcattgtatataaacatgatttgctgaaaatggcggaacattgcagcatgctgagatttaagtatccttgtgaccactgaagatggaccattttcaacctctgactttttaacttctttaactaaatcattcaaacttctgttgatgtattctgcctgaatttttatctcctttgtaatggtagactctctcttaagtagactaaaccttctcattgaagccaccagacttttctgttgctgcccaaatttttgaacattatctgccaaattgttaatactttcctgtagtttttggatttcatgtaggtgtctctcagctacaggctctctttcataaataacagcttgctgtagaaacaccccttgttcctctgtttctgtagttgatacatgactgtctctagagagttcaatttcctttgttctctgctttagttcttgaagtcggtctttcatcttccctttcctcctaagaagcaaaaatttttgtgttgaacaagtagaaatttggtatttttccccagtagcagttgacttcacataactgtctatatcccagcaaaagttctcctagttttctcaaatgaggttaaaaagttagaaaaaaccaatgagtttcctcataaaaaccatttaaatagggaaagaaatataaaataatttgtaagttactttgcatgtgagtgctatttagttgtgtgcaatagctgagaaagcagtgatgcagacacagttggtcaaaaatatttgtcacatgatagtttttttttgtaataaagaatgcttttgactataccttcaacctataggattagtcttcagatgccaaaaatgcccttgttactaaagatactgtttccggttaatttgg

SEQ ID NO: 107175 - DNA, 1447 bp, Homo sapiens
gtttataggaagaattaaaaatgaaaatttctcttgtactaccaaatttcagacccattttttctacctgacttgttactatttgagggcaagaagaaggaaattgctgtatctatcaaaatcatatatatatatatatatatatatatatatatatttattttttttttatttttttttttttttgagaaggagtcttgctcttgtagcccaggctggagtgcagtggcacgatcttggctcactgcaacctccgtctcccgggttcaagcaattctgctgcctgagccccataagtagctgggattacagttgcctgccaccacgcccagctaatttttttgtagaaatggggtttcaccatgtttgccaggctggtctcgaactcctgacctcaggtgatccacctgcctcagcctcccaaagttctgggattacagatgtgaaccaccatgcccggccaatcacatttatatttattctttgttttaacagttctacttcctggaatctgtactcaaaataagaaatgactcctttacacacctactttttatagcactctttgtaaaaacaaaacactggaaacacaaaagtccttcagcgtagaactggctgaataaatgatggaacattcaaaggggagcattttgcaattatagaaaatagtgaagattttattatactgcttcagggtacttcaaaatttactgttcagttaaaacaagcatgctgcagaagaatatatataatatgctaagttttaggaagaaaggaagggtagatataaatattgtatatatacacaaatacataaaccagtcaatagcattgaatattcacagtgcccaaattatggtccttgaaataccattttctccatacgcttgtttatattttcaaaaagaaataatgggaggatgaactaaacacgaatgaaaatggttacctataagggaagggaaggaaaaggcagagagatagcaaatagttcctttctgattgtaccttgtttttatagttctgaatttagaaccatataaatatttttttatttttattttttgagacagggtctcactctgtcacccagcctggagtgcagtggcgcgatctcggctcactgcaacctctgcctcctgggttcaagcgattctcatgcctcagcctcccgagtagctggtattacaggtgcacgccaccacgcctggctcatttttttttttttttttttttagtaaagacagggtttcaccatgttggcaaagctggtcttgaacccctgacaaatgatccacccacattggcctcccagagtgctgagattacaggtgtgagccaccacgtccagccgatataaatattttagaaattaaatcttaaaacaaatacacaaacgatctctaaaatgcaaaagcacctagaaagaaatgaacctaggtatata

SEQ ID NO: 107176 - DNA, 1027 bp, Homo sapiens
tatattcttcaataaaaacttcaattcttttttgtttaaacaacaaatacataagtatatatagatacatatatttatgtatgtttctgggtgatgtatgtctgtacatgatataggtatgtatgtgtgggggttggcagagaaaatcatctcttagtgattatatactgaacagattatatacggaataatacagatgaatagtagtcatctctagattgtggaattactggtaatatttgtttgcttttgttatactttctgttttactgaatgtttgacatttagcatcttttaatgatgtattcatgaaatcatttttaaaatagaagtctcacagtgtccttgaagttacagaatcctgttaaggtatttgatttcctctcccttaaaactatcttagataaaaccatcatagtaaagataatgtattttattttttgttagaatgaaggaaaacttgaaagagagaaaaaaaaccaaaaaatggagaaagacagtgatggctgccacctgaaacataaaatggagcatgagcaaatagagacacaaggccaggttaatcacaatggccaaaaaaataatgaatttggactagtagaaaattataaggaggcattaacacagcagttaaagaatgaagatgagacagaccggccatcattggaatcaggtaataaatctagttatttaaagtaattatcttatgtatatataaataaaacttatacttcatctcattttttatgtttgtttttacaaacgagtacttcaatatttttctgtcttcaaatgccatatttaccatgattttctcaaggtcttttattattcagtttgttcctaacctgtttttccatgacttaaaatgtggtcctttgtaacttataaggatttcagcagaaaattccatttttattttcataaatttgggatacagcatagctctcaagaatccttggaatagccctccccctcctccccctcccccctccctcttcccctctccctcttcccctctctccct

SEQ ID NO: 107177 - DNA, 1052 bp, Homo sapiens
caataactcccacagctcatccttgttctgtactgtctcatatctgggatgtgatttaaaaaaaaaaaagatttcaagaggctttttttttttctgtagactttgtagcagtctggctactcatatcctataatgacttatttttctacttagtgtactcagaaagtcatatactattatttgaccctgagcaaaatgagcaatgaacctcaaatccatttaattagctgtgccttctgcttcatttaccctattgtggggtttttgtggtaatttaagttttgcataaacacacactaaatttgccataggcaaaataaaggtttctcagcttaggaagtagtctgagcatggaagatggtatggggaaataagaacagaatgaaatattttgtgttttaactgcttgtttgcaagacataatgtacttgtagagtctacttccagggaaagtcaagtgctctttttttggcctatttagaaagtaatttattcaatatttttagtttcctgtagtagtgaggaagatttagtatttagttttgctcttttttagtaacctttcttgtctagtcatcctctgagcagccctttaaaattggagtttaccctggttcaattcttgctctatttgttgcctccatgttctcctcaggtaagcccattcatggcatgacttttatcagtatgctgtcatctcaagctgtgaggttcttcctaagatttagtcccatacttctgttttttagcaacttcagttacttggcaaactcaaaagtgtattattatttttccctttcaaacttatgttgcctttgctacctgcatattttatctcaattaagtgtatcaccatcagtctggtttcctcctttcttctctataccttcactacctttgtagtaaaaaatgaaccttatataaaaataggtctggcaactgccctcagctcctgggaggcgatctctaagcccttggaatgtgcttcctgataagtgtgtctttgtttacctgggtgttgaggtcacacctgataatctaacgatgtgatt

SEQ ID NO: 107178 - DNA, 1032 bp, Homo sapiens
agtttttaaaataaagacaggatcataacaatgctggattcagtcctgtcagaggctcatgaggcaaaaggaagagtcaggaatactgatcctgtctcttaaaatcacaggtaagtgaagtgtaaaactaggaccacattcacctgattcgtaatataaaattgtattggtatgtatcatattaatattctcttattttctctttttctatttctagggagatactaacatctccatcatgctggcaatatgctgtcctgcttaaccgattcaattatccttttgaactggaaaaggatttacatttgaagggctatcacacactctctcagggatctttacccaactatcctaaatcagtgaagtgttaccttagcagaactccgggccgaatcccttcagaaagacaccaaattggaaacctgaaaaaatattatctcctaaatgctgcttctcttctcccagtgttggctctggaattaagggatggggagaaggttctggatctctgtgctgctcctggagggaaatcaatagctctgctgcagtgtgcttgtccaggtagtgtgctttcctttcagtatttgacaactttttaatatctgtatgttatagagaattctgaaagtatatatggggagaaacgtaagactgagtttgcaaactcaggaagcctgaaaactgagatgctatggagaagaatggaaatttttgctgaggaagtcagtataaataacatttttttcagcaatttaattctagcaggtgattgggaacaaaacttcaacatttcgcaaatacaaatctgtcagataatatgaatgctgataagcctgataggtattttttattgtttacctttatacttgagagtcttatgtagatatccctgtcatacttttctgcaacaaaaacatatacatttaaaataatttttgatgtcaatagactataaggttccaaggcaattctttccagtagaaatataatgtgaagtatatatatacccttaaatatttaagtagttccatt

SEQ ID NO: 107179 - DNA, 2030 bp, Homo sapiens
aaagcctgtggagtttttaaaaggaataatggttcctgtgggacaggaagcttttaagccaggacagttcctgcgtctgccgcaatgtgagtttcatcttcttgcacctgaattaccacctgtgtttactcttaagcgttagttctttagagtgagagccatgtctgaggtattggttgtataacatatctttaggaatttataattttttataggttttacctctaataaaattaaacttggtggagcaaatgctgagagcttctgagagactgtgtaggcatgactgttgtaaatgttttatgtagtaggtatgtgcatctatatatacatacacatataccttatttctgtttttaaagcataagaaaataataatgtttacctctgagccctatttctgcataattatgatgagttaatttctttctgaaatttatttgctgaaaagtagaaatttaacagttccattgccttcatttgaaactttttaatcctttttatttaggttatcttcattgtaatgaatatgatagtctgagattgaggtggctaaggcagacgttggaatctttcatcccacagcctttgataaatgtaattaaagtgtctgaattggatggcagaaaaatgggagatgcccagcctgaaatgtttgacaaggtacttttattacattgtgacaaactgatggacgcccagtaataccactattatgttgctttgtggttgttattttccatctgttctcagacatagcctgatacagtttctcagtaccctggaaaattttgataaagtgaacatggaagcagttttcatttgatggtcagcatggttcaaaggaagcagtaacattgggattgaggattatagaatgttttatattggcaggtaactcaaagatactcaggaaaagatcggatattatttgggtcagtactgtattgctttaattcagtaacatttcatatcagagtatgacagttgaagaaaaagaggttatttcagtaagctgaagttgaaatattagttcttagaaataagtgctgagaattcagaaatattattaatgtctgattacaatgagtaacttttgtaaaaatttttgctgtggttgtcaaggatatcaaatagcattagtagacctagtaaactttaattctcccatcctaagcccccaaaaacaaacactgaaagtacatggtaagtttttctgaaaagtgttagtgaggaaatgtcataaggaaaaacctactgtggtgtattttcagttaaaaaagaaatgtttttacttatttcctatttgtttaccatgttttagagaacttctctatctacttcgtgcctgagaatagattgtcagtgcatatttgcatcacttgtcttttttttctctaggtgttagtggatgctccgtgttcaaatgatcgaagctggttgttttcttctgactctcagaaggcatcctgtaggataagtcaaaggaggaatttgcctcttctacagatagagctgttaaggtaaggactgttaatacaaaagtgtattttggtgtctgatgtaatttacacaggcataatagaacatgtcaggcccccagtggagggcttgctgtgtaggtgtcaatgattattcctccaaaggctacactcaaaaaattcccaacttcttcccctttatcgctcatactgtaatgctcaccgcccctccctccacccccagtgatgtgtagtattgctgtgcattgtcttttaaagggcataggcaattttactgtagttcaaagttgtttgctcactgggacccaaccctgggggttcatagccctgtttcttttaccagaatctgagcagccccttaggaatagctttgaatcaggatgcatgttttgttattgttctggatgaatcagcccctagcaagttgtagctggttgttagcgcttatctcccctctgagaattttccagaaggacctggccactgaacatttggtttcattaagaacacagccattttgaaacatta

SEQ ID NO: 107180 - DNA, 1173 bp, Homo sapiens
tagggtttctgtggaatcgcttgaggagctgtcttgaaggaatagatagggatgaaccggagacccccttagtctggcacaccaaatctagctagaggcagggtatcttttttccggttaagcatgtagaatttcacttgaagaaagtttcttcttaacacacacacatacacacacacacacacacggtttgaataaacccttttaaatcattaaaatcaactataagcaatctccattcataagcacatttgccatgggacaaaatcaggtcaattctggtggttttcttgaaggcttttcttttttttttttcatttgtatgagttaagaggcaatggttgataggtcaaagaccctaccttgaagttaggcaggcctaatgtgggtttgttgtcactctttgctcacctaagcaacacaaaatgagatccttatgttcaattttagtggagcagttttaatccctactgttccatactcatattaatgaggcaatgaactgttaagaagaggtagtaaatgtgaagtctccaaatggaaaccaataataaatatgttaaaatttgtcatttataatctatttcaaaaatctaatgtcattactctgttgtactagtactttataagaaatattgaatataaatataaagaaatattctttataagaaatattgcttcttcaaggtaaaaacttactgtcagtggaaagaagataattatcagcatttgtttttgtttctgacaaaagaatagccgctgggtatggtatctctgaaaacggcaagcttggtcatgtttctttatcttgaatttacagaagtcttttgataataaacagtgtgatatctagaaatttgattacttaactgtgagcacagtgaaggctaccctcaggcttgtaaaataatacttttaaaactgatgacggcattaggtaactatcaacctagaaatgtctgtgttttagattcttatagtaccctgaaacttaattttaaatctgcatctatttgatagattgtacatgagcttcaacttttcaccttaatgttttctttggtcgtagtgtataatagtggtcggggttttttttgtatttgctttcttgcccagactgctgtttgccagcagaaatagtaaactgatagaaacagggtgaaatgatgagaa

SEQ ID NO: 107181 - DNA, 1047 bp, Homo sapiens
ttttaaatttaattttttgttgttgttgttgttaaacttttttgttaaaaactaagatgcaaacacatactttagcctaggcctgcacagggtcaagatcatcaatatcactgtcttccacctccatgtcttatcccactggaaggtcttcaggggaagtggcatgtgtggaactgtcatctatgataacagtaccttcttctggtaacctcctgtaggatctgtctgaagctgttttacagttaccttttttttttttaagaaggaggacctgcttaaataatgataaaaagtatagtaaatactagatgataggaatttttcagctgcattataatctcatgggaccactgtctgcctgtctttctatcgagagagagagagagatttaaggaactggcttatacagctatgaaggctaagtcccaaatttgctggatgtgctagagcctggagacccagggaagagtcaacatcgcaggtcaagtgcaaaggccatctgctggagaattccatcttgttccagggaggtcagtcttttgttctattcagttcttcaactgactgaagcccacccacattatggagggccatctgctttactcagtctaacaattcagatgttactgtcatctaaaaacaccctcacagacacacccagaataatacttgaccaaatatctgaatatcatggttcagccaagttgaacataaattatctagccatcatactggctttctaacctgtagtgtttgtgaccttgccctctgttacttgtttattaaggcagttcttcacttagattctgctacaacaactccacgtggtaccaaattcagtattagttaagacagtttttcttctaatataacggagagagaaagagactcaaaataatagggacttaaataagaatctgagtaggcttcccagagttgtctaggtaatcagtagatggccagactccagaatcatcagggatccaggcctaatcttcaacctcacaatccagggtggctatcccagttcttgctgtttaatctgca

SEQ ID NO: 107182 - DNA, 2520 bp, Homo sapiens
tgctagcacctgttatttttttactttttaagaatgggcattctccggcgctgcggctctgccgcggcggcagcatgggtggcccccggggcgcgggctgggtggctgcgggcctgctgctcggcgcgggcgcctgctactgcatttacaggctgacccggggtcggcggcggggcgaccgcgagctcgggatacgctcttcgaagtccgcagaagacttaactgatggttcatatgatgatgttctaaatgctgaacaacttcagaaactcctttacctgctggagtcaactgaggatcctgtaattattgaaagagctttgattactttgggtaacaatgcagccttttcagttaaccaagctattattcgtgaattgggtggtattccaattgttgcaaacaaaatcaaccattccaaccagagtattaaagacaaagctttaaatgcactaaataacctgagtgtgaatgttgaaaatcaaatcaagataaagatatacatcagtcaagtatgtgaggatgtcttctctggtcctctgaactctgctgtgcagctggccggactgagattgttgacaaacatgactgttaccaatgaccaccagcacatgcttcacagttacattacagacctgttccaggtgttacttactggaaatggaaacacgaaggtggattcatcattcctttccctttatgacagccacgtagcaaaggagattcttcttcgagtacttacgctatttcagcatataaagaactgcctcaaaatagaaggccatttagctgtgcagcctactttcactgaaggttcattgtttttcctgttacatggagaagaatgtgcccagaaaataagagctttagttgatcaccatgatgcagaggtgaaggaaaaggttgtaacaataatacccaaaatctgattggtcatatttttccaaagagtaatgcagtctggatataaacgtattttctgtcttccttataaggggattctcccagctgctgaatttaaatagtaaatatcacattttgttattaacacagctataacttgccgtggttctcagatttattttggactattttgatgccaagtgagtataagagcttgtactgaaaccatttatttctttctattttgctatttgcaaatgcttgttatcttccctacatgaagtggcagtaacctttttcacatttaagctacccttctaccttttgaagtgatttgcagttactcatctgagacagcatcagtatttgactaaatcattgtttcacaactgaatagtcttgttcttttagtagcaatgaaatcctaagctcttgaggccattcacctgccaacctgaccatactgctttcaaaagtcttttctcatcagtagaatctattttggtcacttctagtcaatgaaaaatgtaaacttttaggagagaatgtttcctaggactcacccactccattcaatgttacatataaaatagtgtgatcaatcacaatgtccatctttagacagttgattaaataaattatctggtctttgaaaagaccgtgctgggcgcggtggctcttgcctgtaatcccagcactttgggaggctgaggtgggcagatcacctgagatcgggagtttgagaccaagcctgaccaatatggagaaaccctgtctctactaagaatacaaaattagctgggcatggtggtgcatgcctgtaatcccagctacttgggaggccgaggcaggagaattgcttgaacccgggaggcagaggttgcagtgagctgagatagcgccattgcactccagcctgggcaacaagagcaaaactctgtctcaaaaaaaaaaaaaaaaaaatgatggagctctgaatgtgcttaagtggaaagatatctatgaaatatggttgttttttaaaacacaaaaattatagaatatgggatcccgtgtgtgtgtgtgtgtgtgtgtttgaatgaaaaatgcttatatattgacagaacacttctagaatgatacccaaactcctggagtgggagtggggaatgccttctatgtacacactgttctactgtttgaattttttactatgagcccaaattgtataatctttttttaataaaggggagaaaaatcacttaaaaaaaaaaagaaaaagaatgggcattctgactgtttagttatcttgaattttttaagagcatgaaaatgaaacaatatcttgatttagaaccaatttttatttagcacaaattatcaatctgtagaaagttttagtagtctatattgaatcataatttttctataataaagataatcactcactaataaatctatttttcaacattgaatgtctttacattagacttatttgcaataaggtagtttaaattttttatttccttgttttattggacacttggtgagaagaaacaaatagcactaaacaattaaattataaatgaataaaggtggtagatcatggaattcaacttccatcttaagaaactgaaa

SEQ ID NO: 107183 - DNA, 1035 bp, Homo sapiens
caacaaatacttgttgagctctgttaagagtaaatctacacagtgaggcctgatatatctgttttggtttggtacacacagtgaagaaattaccacggcaactcttatgttttgcattataagcatagactttatgttgtgcaaacacagcctaagtttaaatttgttataatgtttcaggggaagaaaaaggcaaaaactgtgaccagtgaaagaaagctagacctctacttttttctaagatgttctatataaaatttataaccaataaaattcctcatttgtacgtctgaaagggatgttacaataaattcattatttctaattgttggtctcgttcatgcactatttcgtgtaagaaaatattaaaaaaattaaaatgtttatttgtattccgaagctcactcggaatacaagaaagaacaaagattttggggaaatatgctgcccttggttacgttcaacagtagggtattgtttacaaggcatacagtatcatttccgaattctattatcacggttttctcagcctggtaacaattctaaacttggtagtaacactgtagtatgtaaaatattaatgtttctccttagactatataatatttaaatcaaaaggaaaagattatctagctctcgggagagcagataaggatatataagtaattggttttatttccaagtttttcagtattgttatggctttctccaaagaagcaccttgaatccattcattcttttaatagtggaaatcacagtagtaattgctttattccttgtatctcaagcaaagtgtaaggattaacatgcaggaaggcacacagagagaaaagtagtaattcaaagataccgatgtggaggctagtcccgaaagtgatcccttttaaaatcacacctcctggtattcagaccctaccacattgaaaatgggatacccctgtgtatccataatatgaaagtggaaatgacacaatatgacttgcaaagtcataagaagctttgaagcttctcctttggtctcttggaaggatttca

SEQ ID NO: 107184 - DNA, 2257 bp, Homo sapiens
tttaattagttatcacaataatccttcaaggaaggtattttaacaataagtaaatctcaaaaccttttttgatgttcttctttatgaaatggccttttaagttacattactacgttagccttatactgaaatttaagtatagaccacctcagatttaaagagtaagttgaaaacaaataaacaaataaaaaggatctttcggcagacgccattatcctctgtttctctgctgcaccgacctcgacgccttgcctgtggcccacttgttcactgactataggctactgcagcactggggtgtcagttgttggtcccacccagaacgcttcagttctgctctgcaaggatatataataactgattggtgtgcccatttaataaaagaatatgtaaactgaacagccggaagaaaccttcccgaacactgaaaccaatggtgaatttggtaaacaccctgcagaagatatggaagagtaacaagcatttaaaagatctagaaacactgatgagatggttgaattacgcattctgcttcagaccaagaatgctggggcagtgattggaaaaggaggcaagaatatcaaggctctccgtacagactacaatgccagtgtttcagtcccagacagcagtggccccgagcacatattgagtatcagtgctggtattgacacaattggagaaattctgaagaaaatcatccctaccttggaagagggcctgcagtttccatcacccactgcaaccagccagctgccgctcgaatctgttgctgtggaatgcttaagttaccaacactataaaggaagtgactttgactgcgagttgaggctgttgattcatcagagtctagcaggaggaattattggggtcgaaggtgctaaaatcaaagaacttcgagagaacactcaaaccaccatcaagcttttccaggaatgctgtccttattccactgacaagagttgttcttattggaggaaaacccgatagggttgtagagtgcataaagatcatccttgatcttatatatgagtctcccatcaaaggacgtgcacagccttatgatcccaatttttatgatgaaacctatgattatggtggttttacaattatgtttgatgaccgctgtggacgcccagtgggatttcccatgcggggaagaggtggttttgacagaatgcctcctggtcagggtgggcgtcccatgcctccatctagaagagattatgatgatatgagccctcgtcaaggaccacctccacctcctccaggacaaggtggtgagggtggtagcagagctcggaatcttcctcttcctcctccaccaccacctagagggggagacctcatggcctatgacagaagagggagacctggagactgttaccatggcatggttggtttcagtgctgatgaaacttgggactctgcaatagatacatggagcccatcagaatggcagatggcttatgaaccacagggtggctccagatatgattattcctatgcagggggtcgtggctcatatggtaatcttggtggacttattattactacacaagtaacgattcccaaagatttggctggatctattattggcaaaggtggtctgcagattaaacaaatccgtcatgagtcgggagcttcgatcaaaattgatgagcctttagaaggattggaagattggatcattaccattagagaaacacaggaccagatacagaatgcacagtatttgctgcagaacagtgtgaagcagtgtgcagatgttgaaggagtataatgcaagatatttttttcttttttatagtgtgacgcagtattctggaaagtttttctaagactagtgaagaactacgtcttttttttttttgttatctgcttctgtttaaaaagccaacacgcctctgcttcacaggtgttctgcatttgaggtgtagtgaaatctttgctgttcaccagatgtaatgttttagttccttacaaacagggttgggccagggaagggtgtgcaaaaactaacactgaaattttgaaacagcagcagagtgagtggattttattttttgttattgttggtggtttaaaaaaattccccccatgtaattattgtgaacaccttgctttgtggtcactgtaacacttgggggtgggacagggaggaaaagtaacaatagtccacatgtccctggtatctgttcagagcagtgtgcagaatgtaatgctcttttgtaagaaacgttttatgatttttaaa

SEQ ID NO: 107185 - DNA, 1283 bp, Homo sapiens
ccactctgagccaaacctagccctaaacccgttccaccttactatcaaataaccttaaccaaaccatttacccaaataaagtataggcgatagaaattgtaaaccggcgcaatagatatagtaccgcaagggaaagatgaaaaattataaccaagcataatacagcaaggactaacccctgtaccttttgcataatgaattaactagaaataactttgcaaagagaaccaaagctaaggcccccgaaaccagacgagctacctaagaacagctaaaagagcacacccgtctatgtagcaaaatagtgggaagatttataggtagaggcgacaaacctatcgagcctggtgatagctggttgtccaagatagaatcttagttcaactttaaatttacctacagaaccttctaaatccccttgtaaatttaactgttagtccaaagaggaacagctctttggacactaggaaaaaaccttgtaaagagagtaaaaaatttaatacccatagtaggcctaaaagcagccaccaattaagaaagcgttcaagctcaacacccatcgtctaaaaaatcccaaacatacaactgagctccttacactcaattggaccaatctattaccttatagaagaactaatgttagtataagtaacatgaaaacattctcctccgcataagcctacatcagaccaaaatattaaactgacaattaacagcccaatatctacaatcaaccaacaagccattattaccctcactgttaacccaacacaggcatgcccacaaggaaaggttaaaaaaagtaaaaggaactcggcaaatcttaccccgcctgtttaccaaaaacatcacctctagcattatcagtattagaggcaccgcctgcccggtgacatatgtttaacggccgcggtaccctaaccgtgcaaaggtagcataatcacttgttccttaaatagggacttgtatgaatggctccacgagggttcagctgtctcttactttcaaccagtgaaattgacctacccgtgaagaggcgggcataacatagcaagactatgttactacatacaactaacatgttactgagcaagtttttctcaaaaaagtagaatgctaggattatagaaaaataattaaaataatacatttcacccttaaaaggagctattagcaaactggaaggtatagatatacatgaaaaatatattttatatacacatgtacaagtatcaaataattttattttaaatgtgtgtgtgtatacacacatacaagtacca

SEQ ID NO: 107186 - DNA, 1048 bp, Homo sapiens
tccatgacacttaaatgggtttcagctgagggtctgttcatgttgctctgaatttgtaaggctaagtgaaccccttagcctcaccagaaagcatattcttccggctgcagtttactatacaatttagacctaattagatgaggcattagcagcacctgatgtagaacctccagcatccactgtcctttacatcaaaggctttttggttccaccttcaggattggcatactcaagagacatttcacaatcctaacgcatacttcaagttacttaaccaggcaacatactctgtcaaagaacttctttcaagttaaagtaaaaaaggccttaatgtagaacaaaaatcgctagccagaacgcagggggggccccctgccccgccgcgcacgccgcggagaccccgcgcggctgaggcgtcgccagagccggcctcgaccccgagctgggagccccgcgggccgcgcccgccgccggctccacccacccgggtccgggaggccgaggccatggccgcgacagaggagcggagcctgcacaacttctttgccaatcgggacaagaagaagaaggagcagagcaaccgggcggcgagttccgcgggcgcagcaggcagcgcggcgggagcagtggagctccgcattctagagggcggcggggcgggcgcagggacctggctgggcgaaggcaggaccgcgagtgcggaggctgcgggcccaggggccaccaccaaggctgtgaagaatggaaaggcttggagtaaaaagaggttgattacagaggcctgggggttcaggcaatgcaaataagtgaaaaggaagaagatattgaagagacaagatccaggtgataactgggaagaaggcggaggtggtggtgatacagaaaaatcttcaggtccctggaataaaacagctctggtacaagcacctcttgctccagtaattgttacagaaaccccagaactggcaatgactagtggtgtgtgtgtgtgtaggcctcctggggccaggttaaccacaacaaggaaaacaccacaaggaccaccaga

SEQ ID NO: 107187 - DNA, 1032 bp, Homo sapiens
taaggataaaaaattaatatccaagtgaataatgttagattgagcatagaacttttaaataagtgatgtgacttggcttttttttttaaagctttatcttaccctttaaaaatgttatatttagtgatgagagctttctttaaaatataacaacacaaaatctaaattttactagattctgtatgcttttgtttattgattattttacctttagatgaacataaaattgacagtacatgtatggtttacgatatatccaatttaaaatatttcttcaaatacctatagttacttgtcatcccctatcatgttaaatatttttattgttattttctctttcctaactgtattaaatatttgtttttagtagtattgcagaactttggaattgctggtgttctttaatatttatctttagaaattaggtaaattgctgtttgatagagcctttatttttatatttgagaagcacatagaattagaaattgctgccagaacttggtgtttttaaacagagaaaaatcaatagcagattacccgtgattagctgttgacatttagatttgtacttttagaatgtcaaaaggcagtgaaaactatcaatctagtttctgtattataattatactctatttttaaattaaacattttatggtccttcttcccatatatgtgatatagccttttggaaaaaattaattataataattaaagatattttggtaaaaatgatgacctttaataattatttagtcaaaaattagaggtctactgataacgctaatagattatccctcactttgaatacatctaggtttttttgttataattgcaacaccctattgcaggcatcatttttaaattgtgaaaataaatatttttataaggttagattaatatatttcttctataatctttatacagtatctagcatatagttatttattgctgtcataaaagttattttaattctatgccagattatatatcataagtctttgatgtgttttctctgatagtagattatttact

SEQ ID NO: 107188 - DNA, 1014 bp, Homo sapiens
ccttaacaaatgtggtggaatgaatctcgtcatttctgaatggagatgcatagtaaactttggcaagaaaaattatgcaaaaatattgccaagaatgtcacagtattaaggggaaataagcatcaatgatgattatttttcacattacttgtataaaattcatcttaggttctatttggtttatgtaggaagaaactctgaaatataatctagagataatacttggctactacatgaggtatgcagcacttgacaagtagctttcatctctgtgaattttttcataaacagtattctcttttctccttccttcaaatcacaaaatcacttttcttggcatcatactagtgcatgaataactatctggcaaaattatttagtccattaatatttaacctgaagtttgctaatttattgctaccatggggaaacatatgaagaagcttaaaaaataataacctttttcctaggttggcaccagacagattaactaggttggctaacactggtctttttgtggccttgggcagatattttaatctctttcagtcacagtttcctccttggtaaagtgctgataatccttgaaggttctattttacaaggttgttgtagcaatggaatactgtttgtcaaaacgttttgaaaattgtgaagtgttcaacaattgtattctttcacatactgttttacagcaatgctgacatctgtaaacattgccaatcaagtcatttaatcattcattccacatttactgaacaaacattaattgaattccaaaaactgtgattcatgttggcattaaacagatgagccgttctacctcccttttgagtcaaaaagaagagaacagtaaaaggaagggcagataagccagttgtatccaagtgtcaccattattgtgcctgtgcacacttcagtcctgcagcagcatctgacagtgcaccttattctgtgctgccaacacacatagtcttgtcttgggttattagattgaaatagggcaaaaagggg

SEQ ID NO: 107189 - DNA, 1111 bp, Homo sapiens
attacttttttccctttttgcagtgggatgccatcactgaaatggatgaacataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatggtaagaaacaaacatttaaataatttatcttgcatttaaatgattttaaaaaagttttattttttaaattaacaaatagtaattgtgcatattcatgggtgtgtagtaatgttttgatacatataatgtatactgatcagatcaaagtagttaatatatccatcatctcaaacactgatcttttcaaaatgacgatttattaaaagtaaatattatacatttatttcaaataatacatttttgagtggtatacttgataattaattgtgaaagcaattgattcatattaaccataagaaaatttctgtcatttttctcctgggaaaggtgtatgaaattgtgccaaagtgctttcagtaaagtcgttaaacaatatgaattgctgtatccgcctaatttttataaaggaaagcagcatcaacaa

SEQ ID NO: 107190 - DNA, 1044 bp, Homo sapiens
cttttgtgtgtgtgtgtgtgtgtgtgtgtgtgtgtgtgtgtgtgtttttgagatggagtttcactcttgtctcttgtcacccaggctggagtgcagtggtatgatctcgatttactgcaacctctgcctctcaggttcaagtaattgtcctgcctcagccccctgagtagctgagattacaggtgcctgccaccatgcccagctaattttttgtatttttagtagagacagggtttcaccatgttgggaaggctggtctcgaacacctgacctcaggtgatccacccacctcagcctccaaaagtggtgggattacaggcatgagccaccgcgcccggccactttggttatattttctgtgtaataacaaatagtttatattgtcatattcccaactgtctctagatttgaaaagagacaaaaatctatttttaaaaaataaatagcagtaaatataggagagtagtttgtgttagccaaagttctttatgtgaatgtagctgtgaagggtattctgaacttatatctgattttgcttccagaattctggaatttcctagtatgacaaacaagaaggcctttggttcatttggggctaatttaatattattatttaaaatttaagattggggccgggagcagtggctcatgccagtaatcccagcactttgggaggttgaggtggacagatcacttgaggacaggagttcgataccagcctagccaactatagtgaaacactattgtgactaaaaatacagaaaattagccaggcgtggtggtgcatgcctgtaatcccagctgctagggaggcttagacaggaactctgggggtggaggttgcagtgagccgagatcatgccactgcactccagcctgggtgacagagcaagactgtctcaaaaaaatttaaaaataaagtttaaggttagaagctttttggtgaaatattaaatggcacatgtaatggcacgattctgttgtctttggaaacagtctcaataatcgtgtatgtagaataacccaaagacaagaacactgaat

SEQ ID NO: 107191 - DNA, 1730 bp, Homo sapiens
agtaagaaatttaggttggaactgggttataaaggtctctagacaaaatgtttggctctagatttaaggctcagagaatttttgcaaaagcctgttatacagatattgctgaaatatgaaacttggaggaattcctgcctttatctgcttcaagaaatgattgctcaactttgtttcttggctgtatcatgcatgatggacctgtttaaaatgagttctgtgcaatgtttgtaactgtgaagagagatggtaaggtgagaacagtatttatcaagggctgactgtgcacttacttctgggctgggtacttttacttgcaacgtatcatgtaaatctcacactcagtgtgaaatgttggtccacttttacgatctgacaattgaagaaactgagtttgggagagtgctcagtgatggatgctatgggcgttttgaatggaacaattctttgaactggactcttttgtcctttgcaagatgtttggtatccatgattacacacactaattgccagtagcatcctctggtcattgggataactgaaaattcctccacccaggtgggtgggagggagagtgataccactcccagtggagagtgattaccctaaatcgtgagaggaggtgaatgggtgggaccaggctgctaatgagctgtggtgtaggaggtactctgtactgtcagaaatgtcagtagtacttctgatgaccagcatgggagagctattggccttcaggttaaactaccagtgttgacaacagcatcagttatgtgaggaaaggaagctttgttttctaaattgtcatgatgattgcatttttattgatttgaagcactaaaaataattggtaactagttagttggataggagatacctgtgtcacatcagcagttcatgccttcagtagtgaagatgacgagagaattccagaagtctttaggggtgtgtaatttgtgagaatcttgtccccctctgctcctctaggttaattcaaagcaaaagcttactcttggcagcagagtcaaaatatagcctgttgtagggtatcaaaagtccaccttttccaagtgatttccatctcttgggttcaataaggtgtctaccagatggctaatttgggaattctattttttgctgtgaacattccttggaaatggactcaattgtatgctctgaaagtgttaaagttgcaaaggtaccacaaattgacctgcagtaagtttatataatcagaacttctaactttattgacagttataacatttttaagtttttttactcataacagcggaaaatatgtaaaaagggtaatagcaagttttgtaaaataagagaaaatattccctcaagacaaaatattttctatccaaagttctgatgaaatataccaaagtccagatataagaaacgttagttaccaattattaaataaaatgatagcaacaaactgtaggtggttgtaaaattaaggaaaataatctaggctatatgctgaaaagaaggaatcagcatgaagtaaaagttaaggaggtaatacctactttgagtctgttcaatccataagttagagtggctgctttgtgtctcatatggtgcaaagcaatgtggatataaccataaatggatgaccaaatatgccttcatagaattcacacattaatggaggagataaaagtgtacatctctgttcttaatatgaactcattataaaccaaacatgtctttggagt

SEQ ID NO: 107192 - DNA, 1046 bp, Homo sapiens
acatttctgacaataatgcgtatatttatatgttgtaaaaataatttaaaatataattattagaacaacttagtcgtgtcatcacttttcagaatcttgtttgcatgtctaaatgtgtctctacttacatagggttgtattctaatggggagggcagaaaatatatagattaatatataatatgctttgaagtaaaaataaaatggggagggactcaccataatggaagtggtgagtctaggtagggtggatatgaaaggtgtctctattgggtagcatttgagcaaagacccagatgatatccgggagttgggcatgagcaagtctgaggaaagaactttctgggcagaaggaacattcacttagaaggtcctggggcacaatcatgtggcacagatgccagtgtggacagagacacagaattagaggaggagtgggtgttagtaacatggtgttagttcatagtaaggagttgaaatgaaatgatgagtttacttttggaaagtatcactgggcatgtgtttatatgtgtgtgtaaatgtgtttttatatccacacatatattatctgtttatctgtgtctggaagaatttacagaggaggaaggatttcagttgggggggaggtcagccaaggtcagattctggggagctctgtgagggcacagtcttgggtctccagtgcgctgtcttcaggacaatttgttgaatgatatgtgaatgaatgctccattttagaaagcagctaaaatactgttgtgagttcacatcacagcgagggattcagggtattgaatcttgtgggggtgagtcaaacattcagaatctgaaggttatgaggtggacggagaacttggggagaatggaacagtcattcacaacacatgtactgtagacagctcaggcacacctcagacgtactgagattctcactctgcagcctgtgatttaactgtaattatgggtcttattttgggggcgtgagttggggaacaggaaataagtcagcctcaaggtagatacataaattataggagaggactgacc

SEQ ID NO: 107193 - DNA, 1073 bp, Homo sapiens
ataatttaattttaagaaaataatatctcttaagtgacaggttaggagctctcctttatgtaaattatttgaaatttagaaggttaaagtgatccttttttttccattgcttatgaaaaatattttgtctggcacagagtcacacaaaggctaaatggctgtatgttggattcgttttcagccatggtccaaataaagttgcttgaaaaatgaggagcttttatgttacattgaccttcatatttgagctattttgaaagattgattcttaaagttctgttagctaagatgaggctatttagaaatgtaaggtggttttatttgtgcgtacatgtgattttgaattctgctcttcaccccctgccatgaataaaatgtgtgctttctaaaaatattcctaattgaaataccctgggtcccaaagggggttaaattgtgagcaaacaataggaacagattgtggtctctcatgaagcttgaggtgaacatggttctctttccttggtatttattttttaagagactgaaaatatcaccccaagccttttgagtcctttttattttatttattttattttatatttgtactaagcaaacatctgagtattcactgtttttgagtatatgtagctactgtgttctcattttttaatgttttgttttatttttaaatcaactgaaaatgaccttgttcttgttgagtaattttttcccaccagctccactccctacttaatggttttagagaagtatgttgtaggataggaatggctggcatattctttcaagagacttatatgctcctccttaagaaaaaaagactgatgttataattatattgttcccaatgtaacagtgttttctgatgaaggtaagcaggcgcaaatggaaatatggttatagatttttttttttcttttgagacagggtctcactctatcacccaggtggagtacagtggcgtcctgaatagctgggactacaaacacgtaccaccatgcccagcccccttttttttttttgtcaagacaaggttgccatgttgccctgtctggtctcgaactcttaatctt

SEQ ID NO: 107194 - DNA, 2241 bp, Homo sapiens
ctacatgttgatcttgtttactataccaggtgccacagcacccatcacatgctacgggctgcttaaggaggtgacaaaatactgctaattagacctgcaaaaaagttcagacatcactagaatgtaggtaccatgaaagccaggattttggtacatttttcactattgcatctaaatgcccataatagtatcttgttgattatttattgaatgaatcaatactttaaagtttacattgaacctaactgcttttttgtttacctagttttagcctgttcatttggagctgcattccccagaaacattgtttcaaattctctaaattttgagaacccaaatcctagtttcacctttttgtctctccttcagcttttctctcctttcactttactgaggtcagagccatttgttgggccatattgtcttttcacttacagaatttataaggctttagccactctccttgccactttacttggcagagaagatgtccttctctccaatgctaatactttgtctttattataagtattagaaattatattgttctcttcatatcatcacctccttcctttccttctggaacctgtcatctatctctttataccatagtcactccctttccaacaagtatagagctgattcacaaaacagtaagttctgtcctggaacttaaaatggattttgtctttccttccttctagttaaaaatctctgaaaaggtttcccatctacttatgactattcctatttccttgttagctactcactgtttagcacctcaagttttggactgaacacatgaattcttgaactgttatgactgtttctcctgcattcttaaggcttttccatttcttcatttattactctaacaaacatttgagcacctcttattatcaggcatgtttcaaggtggtagagatactgcagtgaataaaatagataaaaatcgttggccttgtggatgctacatcctaaaggaggaaacacatattaaatgttgtaggtgtgtgttgtgtgtgtatttactataatagtaagtacaagaagaaaaataaaacagaaagcggttaggcagttttacagtggaggggtctgctattttagatcatgctgagagaattttcattggtgagatggttttcaagtaaaggtctgaaggaggcgagagagagtgagtcatataggtatctgggggatgaatattgtaagtagagagaagagtaaaggcaaaattcccaaggtgggtgtgtgcctgatgtttctgaagactagtgaggaagatagtcctcatctttcttgagctcacagtggcatttggcattcttgactcctgtctgccttttgaagtgttctttgtttctttggagatctctggtattctatagagactaacctggtctggttttgacctcctctatctctttcactggtttcttcttttcattgtttttgacttgtaatcttttttttccatagggatcttttgttgtttcctctttttttcctgcgcacatcgtatattgccaaactacattcttaaattgtgcctctgtttatcagacatctcaacttttgtatcacaagggaccaaaaatttcacatttgacaactaaatagttcattgccctacctgccacttacccagagccctaattttcacctccctttctattctccatgtccattttttttggcttacctaatcaaattgttgtctaatttagagaactcagttatctgtgaccatattattcctcacccaccacttctaactggtcatcttatcaaactctttatcttctgtgctccagtcttcatcagccatatccctgccatagtaaacatatttcaaacttctgtgtctttgtgcatactatggcttgtgtctagaatactcttaacactcttcgaattaagctcaaatgttatcttctatgcaaagaaggtttctctacatccccactcgttaattatgtcttccattgtgtacatatctcttgtaagccccctacagtgatattaatataatgatgagtatgttcctagcttgtaagctccttgaagacctcagctaaatcttattaatcagtatacataatgctttcctgtattttgttgcgttgggccccaacatagcaaagagagtagatagagaaatgcatttggactaagagtactgcattacaacatattgaacatgagggaaaaacattgaaaattccaaagatacatatg

SEQ ID NO: 107195 - DNA, 1051 bp, Homo sapiens
gccaggttcttccaggttctgaagccagtggccctcacttaactgggttggagctattgagctttgactctggaaacctctctaaggattgcagttccattttatctcaagaccctaatagagtagagttagtgtcttcaaacactaaagcaaatatgagcataatagagaagtctgattctctttccttggaagccaaaactgctaacattgtatcaaaagctgaaattgatggtcagaacaatgttcttgtggagtcacattctggaagaggaaaaactatatccttgtccaaggtatctctttcaaaagtggagcccagaaacatttctcaggataaaatgtcttcttttccattgaaaattacccatgttccagaaaagcctattttgtcagaattaacctttctagaagttgaacagggcaaacgttttcaatcaattaatcataatgagataggagagaaatgttcagatgctggccttaaagagaattgccaagctgagctttctcctgctgcctccaaatatgaagataagccagaaccagaggtagatgccttaggctctcctcctgctcttcttaaaagtaatatatcttggattttaccacctattcatgatgaaaaaatcagtaggcaaatggcgcagaattgtgaagctcacacttgtgtgtttcatcaatctttggatatttgtgggactaaaaagatttctggtcactcagaaatggcggaactcagcttaactaatatttcccctaaattccaagaaactggcagcatgaaagtaaattcaccttttctggattctgattccagtttggaaaaaaattcttctgcatctgaggactcaagcttccttaaagtaccttctgtgctgaaattggaaaagaaatcctcatcttacagaaagaaagagaacatccattttttaaatggtggtattgatagtgtgtcatcttcctctagttaccctgaagaagttagcatgatagtaaattcacataagccccaaaataatttggattctatacaagttaccaaagatct

SEQ ID NO: 107196 - DNA, 1026 bp, Homo sapiens
tttgttagaagataaagctagggaattagtcaatgagattatttatgtagcccaagaaaaattgagaaatgatacttttgaagatactgaggatacttgggattctgaacttcaggctaatacttcaaaaattctgaacagtgatagtgttaagccacatgatgtagttagagagttcttggtttcagaacagccagtaaatcaaagcacacaaattagtgaaaataaagtattaaatgaattcttctccctaagtaacttagctagtggcacagagtcaattaagggaggagaaattgttctctaccaaaaatccctattttctggaaatggatctggactgtctgatagtataaatttgcaggaatcagatacggttttactagctgaagacatgtcacataaacggttagatgatagggtaaaaacacatttatttcgcagtgaggactgtaatgagacaatggaaatagagaatgtggataataacaaaactgagacagaggacagaagaactcttgtattaaatttcaaatggcctccacttgtgaatgatgacatccatgcacctggtacatctaaaagcagtttgtctgatagccttgtatgtatatctgaaaaaaacttgccaggacacagtaaaaacacacctcttgcaatgtcagatgtagggaaagtacacaagaaggataatgaaataaatatagggaaaattgaacttataccttccatgttagaaacagggaaaacaaacaaaaaggatgctgaattgaatattctgaaatatgaggcagtccctcctatgatagaaatgggaagaatacataaaatggatgctgaattgaatgtcacgaaaactgagccaaaagctaatgtttttaaaatgggagaagtataccaaatggatgccgagagctgtattgaaaaaactgagggatcagctgtcattttaggaatggaaaaagcttataagatgaaggatactgaaggggatattggcaaaattgaggtgatacctatgatgcc

SEQ ID NO: 107197 - DNA, 1086 bp, Homo sapiens
tgtttaggctacccaggtcagcattcatgtcttaaatcatatggtgtaatctcgtcttcatataataaaatgggacatgtgtcctgtgttattcagcaacaagaaaattagaagtataatttggaattgttgcactattgttttttatgcaactgtatagtttcgtatagaccacatctataaagagcatacatacataaatatagacatagaaatatattgtggtactatgttcagaaagtatttttatttccaaggtatatgcacttttattttttctttactgttcgcctgtacttaaattagcatatatcattgtttcaaaaaatagggttatatgctaatagtggaagatatcccagcttaaaaaatttaagtagacaaaatggtctgtgacttatatgccttatttcttagaaaattaaatataactcatcattgcatttctctttgtttagctggattttatatgagaaaccacatttccgaggtcagaaatgtgtgctagaagaaggggaaaaggtgttaaatcgtgactggattcttcagaacagaaggcatccacaaagaaactttatattgggttctctcaaacgtgtcttaaaggtaacaactgtagatttttctattttttatttgattttatttatcatatagtaaacctgtgctgtggcctggcgatgtttacaaatcattgctaatttttgtgctgttattaatcttcattaccatattgataatcttttgaatttatgcaaatagagtgaatggcaattaaaaatattaaccagaggtaatgtagtttataaaatgttacatgggccgggcgtggtggctcatgcctgtaatcccagcactttgggaggctgaggtgggcagatgacctaagattgggagttcgagaccatcctggccaacatggtgaaaccctgtctctactaaaaatacaaaaattggccgggcgtggtggtgcaagtctgtaatcccagctactctggaggctgaggcacaagaatcacttgaactcgggacacggaggttgcagtcaatcaggatcacgccactgcactccagcctgggcgacag

SEQ ID NO: 107198 - DNA, 1083 bp, Homo sapiens
tgtgttttactagtgtaattctgtgatggaggattttgtttttttattttggtagccctttttacttacagaaccagactaaagcagtactattatactttaactaactatctatttttatatagttggcttgcctacccagatattaattttaagggacaagctacagttctggaggaagaccatgggctctttgagatttctacagcagaaatgaaatcattacatccgcttcaaatggtaagcaaatttaaaaagaagcattccttttcccaagtacccatgaatccaaaattaaataaccatgatgtttgctcatgcatctcaatctcaagtgaatatgtgtactactgaattggcaaactattgtactgtagtgccttcagtatttacagtatttcttttttgttacaaacatttacttgagtggcagactgttcaattaaacattggctatgtgataaaccatttttggttagtccatgccccttaaaaacatagccactaggacaaactaaaacattttaagaaatatcacaacgtggagtagcacttgaaacaaaaaaaactacagaattggggtttttgtaaggaaagagttgctttttatgctgtacaactttgaggtcacaaagacagtgcatgtgagaaaaagtgttggtagaacttggaaaggttagtgtggttagctcagtgctctaatttaaaaagcccaaataattgtagggaagacctttggattagctggctaagaaatctactctgctgaatgagatttctaagtttactagcaataccacttttctttttgggacactctgaagtgggattaaatcttaattggtcatgtgtactcaaggactaaagctcagtttccttcctcatagtagttgtaatctggaaagtgtatccttaagatttcttgccccatctacattgatgaggaacactataacttggttttggctactatagagttctgtgcttaaagtttaaaatttagcacaatttgaatttgactggtgtgtaatcttcactggttagatttttatgtaacctacatatatcactttcagatattac

SEQ ID NO: 107199 - DNA, 1110 bp, Homo sapiens
tacttgaaatctatagacttttcacttcaagaattggttaaagaatatattcagtttatgtaagggtagcatgttagttatcttaatgccattcataatatactgaaaatatttaaaacatcttttgcgaagatgtgttatagcagcaggtttgtgggaggaacatgagggagtttggatatcctacaaagatctgcaaagtgaccatgaagacacctcaacaggggtcccaaagccttaagttgatcagacctagggagattgctatgtaaaccagaaggtcaatttagtgttttgtaataagtggattctagtgactggaatgctcgaaaattctgtcctgggcactttttccccctctctggaagaacaagggaaactgaattagtcatcaggaggttatttgttgagcataagatttgggtaaaataaggtagataccttgagattagcctgtaggctaatgttcctcctaaaagagagtccttttactctctaggtcccagttgctcacaccctccagattctgtctcatttccctggacagtgctagatacactacctattctgcttctctgattcattctgattctttctgtgattctccccactatcttcgtagttaggaattgatatgccttttttcgtagatttcctaatactgctgcctatgccacaatccagtgtaattctggattcattccaggaaatgtttctgtgtaattaagttgacattatgtaagtatgaggtaatcctttgcttttgcttttgttagttaaaactgcagaattctagggatgttgcctgcagttggtattcccagacatgctatggcttggtgcttaagtgtcacaatggtataatattgagaagtcttaagatttcatcttcatagaagataagtatattttgaaaatgacagtgtgctccaggctaacttctgttggtacaggtgaaggttacattctagaggggcattgacacatagtttgcagtgttgcagtcattttatagtgaatggagctaggagtgtagttcatagttctgcttctaacgaatatgaccttaagcaaatctcttaatttatctgtatctcagttaattcttct

SEQ ID NO: 107200 - DNA, 1032 bp, Homo sapiens
tgtaggagctgaggaactatttatttaatgaaggaatgaatatatcagtggatggatcaatgatattatgcaaagtataatggaaaatataaagatagatgcgatttctgccaatattattaaagcttacatttttgttgggtaaaacatgtccaactcaaagcagtaacataaaatgcaaaacaatgcataattatccaaaagccacaggcagtccctggttcagagaaaggaagtatcaacatgtgtaggagtagtggggaggtttcatggaaggtggaaaacccaagtgaaactgtcaggggtgtgatggcccgtggatatggcattagtacctctctctaatctctttagaacactttcttgcttgattccaacaacagtcctttgaggtaggaattattatccccattttctagttggaataataaggctctgagagaagaataaggctccatctggaaaatggggataatgattcctacctgtgacaataaaagcacatcaagtgtcagaaccaggatttggacccaaatctactatgctttaaaatctgtgttcttaagcaaccacactctactttccatcagcctaagatcagcacttagagagtaccacctatttcaggcactgagctgaatatagcctagtggatctaaatgctgaggctctgatgttctgacctgacacttatttaacccttacttaagtgttaaataaatggtagccaataaaatattaacctaattggtcttctctcaccctcttcacatgcacacatgcacacatgcacacacaccattctcatcccaccactcatgagttctgttggttcaaatcctggctctgccatttgtaagcagtgcagcttggtgagtcacttcatttcttggcaccttaggtttctcactggtgaagcagtgatcacattgcttacatctcattgctgtgacggttgaataagataatgtatatgaacagtctgatatggctctggctcatattactatggtaatacacttattttgaaaa

SEQ ID NO: 107201 - DNA, 1038 bp, Homo sapiens
attattatgtagttagtaaaagctaaactgaattcctatctctactttgctttttctgatggcttttcagtgggcttactccctgttccacatgataggagtggggaataagcaagatgtaaaggtcatgagatcgtctaccacacactctgtgccaggaaagccattaatgtttcagtatccctcaaaagagcatctcaagggacattgtgaataataataataataaaaaattttcaaaataagtgtattaccatagtaatatgagccagagccatatcagactgttcatatacattatcttattcaaccgtcacagcaatgagatgtaagcaatgtgatcactgcttcaccagtgagaaacctaaggtgccaagaaatgaagtgactcaccaagctgcactgcttacaaatggcagagccaggatttgaaccaacagaactcatgagtggtgggatgagaatggtgtgtgtgcatgtgtgcatgtgtgcatgtgaagagggtgagagaagaccaattaggttaatattttattggctaccatttatttaacacttaagtaagggttaaataagtgtcaggtcagaacatcagagcctcagcatttagatccactaggctatattcagctcagtgcctgaaataggtggtactctctaagtgctgatcttaggctgatggaaagtagagtgtggttgcttaagaacacagattttaaagcatagtagatttgggtccaaatcctggttctgacacttgatgtgcttttattgtcacaggtaggaatcattatccccattttccagatggagccttattcttctctcagagccttattattccaactagaaaatggggataataattcctacctcaaaggactgttgttggaatcaagcaagaaagtgttctaaagagattagagagaggtactaatgccatatccacgggccatcacacccctgacagtttcacttgggttttccaccttccatgaaacctccccactactcctacacatgttgatacttcctttc

SEQ ID NO: 107202 - DNA, 1001 bp, Homo sapiens
ggtgaggagtggggtggtaaagaattagggacttgatgagtttcattcaatagtgtgtcccagctgtgctgagggaggtaggggagttattacctacaaggattttctaaaaacttcagaaagacatactgtggagctatgactaaatgccataagttggccctgggaggtcttgaaaaacccagatagctgagggcactagtagctgtgattatttgtttatataagacctttatttcttcaaaagtagagaccatgtatgtttaatgactatacttaggtactcaaaaattgtgtaacaaaggacttcatccccttggcctggaagttttaagatacatacaaaaagttttaaaatattaaacctgggacttgcctctaaggagaatagctaatatttattgaacacgtagtatgtgtaagcagcatgctaaatgcattctgtgccattatgttatttgtcagaataaccacaaaaacctattaagaaagtacaattataccctagttttacaaataaggtgaacacagatgtaaagaagccaggttcctcttaaccaggatgctctcagacctatgttgaaatgcactagttgctcttaggcacagggaataagagacgaattccaaaggtggcagtgtaggacaatgaaagagcagggcacataatggaagcacaacagaagccattatttcagccctatgacttaggcctccagccttaatgtaataaatgacacccaacatgacacccaacatccccacctttggttcttctcattgccatcccaattagaaccctggctgagtaataacaaatggtctcttaagagagcactttcatgctaagaaacataagtgcttaggtaaatgcaataggtcatatggtaagagaaccaatgaacagtctactgtttttgaaacttgatagatcaacgtgaagctaactgaattttggtaattaaaccttcctaaggaaatacacattctcagcacttaag

SEQ ID NO: 107203 - DNA, 1157 bp, Homo sapiens
tgtgggtaggagatggtacagaaataaaccaactgaaatagaggtacttgtttttaataggatgtctacatctgacaacagatgttcaataaagatttggtgaattggaattaaatgttaaatccctgtttgcttaaaacgtattatgttgagcttggttttcttatgaaaacattgcatgatgggctaaagatatccagacaataattacttttaaaagtttttcatttttgaagcatgagaaaaagtagataatccattggtgatacaataaaacacagtttgaatgtttttaaagtagtgttctattcccaatgcattaaacataacggaagggtcatagaaaagaaccctaaattttattttctaagcttcttccaataacagctttcttcttctactgcttctttgtatactttgaaaatgaaaggtttcaacatatttagaatcacagagatggctgattttatctgggccatcaagtaaggaacatcttacaaaagcacattgtccaacttagatctggtgacttataccattggttgtaaaaaatcacttaggtatatccataatatgtgataacctttgtgtttacttaaaaattgaaactggattttcttgttcaaaaaattaagttaattttatataaatgttttagtaatatatggcagtatttttataatcaacacctgtttctaagaagttgcattgttttatcatgccagttgatttgacaggattctagttttcaaaataaaaaacagaccagaaagtggcatactgtatcagtgggattgcttaccttggatttaaagagtcctcggcagtagtaccagatctgagtattctttccactatagggagaaatgcacacagatgttgccctggtgtctgctagacttccagtgactgtcagatattcaccctgggcacggttctttattctgatgtacactgcaggctatgacaggagaaacagccatttagaaataaacttttgaatctggaaatgaatccttccagaggaggaaagctgggagggaaagtgagaggtaactatcttagttatatcagtttcactcttattccctttagtaaatctgcatagattaatatggtaaatccttaggccgtggagcataaagcttaaattgtac

SEQ ID NO: 107204 - DNA, 1046 bp, Homo sapiens
aggcaggtaggaatgaaggatggtagctgcagcccaggccagctgaagtcctaccttaaggaccccaggatacttcttccaacatgagccaggcttgtctactgtgctgcactgctgagctgtgtgacttgcagaatgagtggagtgccatgtgttatgtggtgatccaaagaactgtgatgttgtacagacagctctgtatttcacagtggcagtagcaggcagtgtgaaaatgttggttgagtaaatgaatagtacggccaggagaactgtagatttagcacacatcagattactagttaagagaaactcactgtactggagatcctggcctcggtgtattcgttggcctcctgttcttttattacattttgaaacaggagtgttatttgattagttttgagatgagtggattagagctgagttgagcaaaggttgctttctctgaagcattcatcttaggacagtgacctgctttccaaaaggcagagctcagactgtaccatatttccaaggatctctatttctaggcaaaattctgaaaattttttgcaaacaataggcagcttagaattaacagtgtttataaggaaatgatgagatatcattcttaggggctcaggttgtcccttcccctttggaatgacatggattaatgtctatacccggtggctggcagttttgcagtctactgtggagactgagctgggcagtaagttctgctggcatctgggccaggactcacttctgtgttcctagcaggtggaatccacaactgttgctacaagacgattaagtggcttcctgaggacacttgcagaccggctggagggcaccaaagaactgctttcctcagacatgaagaaggattttattatgcacagactccccccttactctgcgggagatggggcagagctgtcaacaccaggtggagcttgctgttttcttctgggtggtcagaggctaatgcaggatgtttacggtttttctgggtaggctcctttttgaacagatggaaagtatgaagtgctttcgtgttaatg

SEQ ID NO: 107205 - DNA, 1023 bp, Homo sapiens
cacggttcatccccatgctgttaggccaggcgtggtggctcacgcctgtaatcacttttggaggcccaggtgagaggagtgcttaaagccaggagttcaagaccattctgggcaacaaagtgacaccccatctctacaaagaagataaattagctgggagctgtggtgcatgccagcttcccaactacacaggaagctagggcaagaggatcattggagcccaggagtttgagaggctgcagtgagctgtaattgtgacactgcactccagcctggccaggagaatgagactgtctataacaactaaaaaaaaaaaaaaaaaaaaaaaacctgtgttgttcaaggttcacctatatatttgtctattagccccttagagggctaatagtccggaagcactttgtgtgtgagttgtcaggaagctctctgatgctcctgggccttgtgggtctctaggttttcatcctgcagctggagggagagaaacactggcgcctctaccaccccactgtgcccctggcacgagagtacagcgtggaggccgaggaaaggatcggcaggccggtgcatgagtttatgctgaaggtatgtgataaccgttgtgggcacctcattgttagagccattgtggtttcccctattgctaagacaagttcaggctcaaggtttagagttcgtgtgatggtccccgtgggaatatatccctgggtttcagggcagggtgcttctcattgctgtcagccagcacatgtaatttctgaaggagtcttggtggtttgcacttggagaagtgggttaaggaagtattaagttcatttcccaaataacctgttttcatgtacagttcaagtccaacaggaagaaagagaattcagtgaaccactgactcctctagaggaaaaatggaagctctggccttgggcagcttctccacatccaagacgatggtcagcacagggctggaagttgcttaggcagaacatagccagggatcccttagttttttttgttgttgttgctaaa

SEQ ID NO: 107206 - DNA, 1057 bp, Homo sapiens
ttcagcctgggtgacagagcaagaccatgtcttaaaaaagtcttttttcatattgacccagttcttcccagttctttctcacttgatatttttaatacagtggattctttttcactcctgtggtagaagggactcccaagctgtggccattggtttgctcagcaagtatttaaatatgttgtcatgcagtctgtgtgccaggcactgtacattcatatgtttaaaacttcagtctctttagtgccctttgtgatttgtcttttcttaaattctctgaaaggtatggactttggagccatgctgcctgaatttgaatcctggctccatcatttactagttgcatggtctcatgcctcagtttcctcatctgtaaactgaagataatgttagtaccctctttatgaggcagggttattgtgagggttgcataattgatatttgtaaagcacttggagacagtgcctggcacataggaagtgctaatatctacatggcctaattgcccccctcctctcttctcaccagccttggtaaaatcagacttccttctctctcctgggaatatatggcccatcgctaggcccctaagtctgatgtctgctctgaagagttgatagtggagagaaggaacattacccagcctgttatttcttctctgtctgtaccttcttcccgtgttatcatttctgttcccattgctttaaatatccattttgtgtaggcaattcccaagtgtaaatcttcagtccttagtttctgccagaacttcagaccgacttaaagacatctccatgtgggggggggggggggggtcttagcattccaaacttaacattcctaatataaaactcttttttttgtcctgaaaacttgttttttagtaagtttttcccatctcgttacgtggaaaggggaactgattgcccaagtcaaaaacccaagagtattttttttaactccgctcctttacattgagtctgtcggcaagtcctgtctgtgctgcttctagagtgcatcccactcttctacctccctccttgcctttcttaccacccca

SEQ ID NO: 107207 - DNA, 1113 bp, Homo sapiens
cagttattatatactcaattattataataaaggcacatgtgtaaataaatggtattctaataatcattactcatttgcttgggatcatgccaataatttcctcctctagtataagagtggtgcctccagttttcttttttttttttttttagttttttattctttttacctactagtgatttaaaaaggaaaagtgttttgaaaacatgtcttaagagtatgtagaattatgtactcttaagtacaaatatggtaatggtcatatctcatagtcagggagtgtcatagaatccttgacgtgggcaatgttgggaccttttctctggtgtcaaaaatatcagccttttccatttgtgctgtggttggtggagtagaggaacacagagaaaattttattgagactaaaagtacagtgccacacagggacaacacagatcagattccgaagtgtccctttgcagatcagcagcaaccacaggctgcatttgtgaagaagcaaatatccttagaaatccatttaatgagaaaatactgagagtagaattggagcaatttcagacagagcactgctgacacttgtacagttgagtcacccagaatcaggttcatgggcccagaaaacctgaatgacaaccaacagaatccagactagactgacatttcctagttacacctaacaaacgatttcaccacttccagtgtgagtcgaaattgatgttagtaacatcaacatttagttttgcgatggaaattttatgtacatatgtgttaaaataatttatatatttatatatgtagtcttttatatgttctctttccatataagccattctcgattaaaccttattgtctctatagtcctgagttttaaaaaatgttttcaattatggttgagaaaatataaatcctgcctaaatggatccaagctggttgttttaatcgagattcaaagatttaggccgggcgtggtggctcactcctgttatcccagcactttggcaggccgaggtggacggatcacttgaggacaggagtttgagaccagcttcaccaacatggtgaaaccccgtctctactaaaaatacaaaaattagccaggcgtgatggtgtgtg

SEQ ID NO: 107208 - DNA, 1048 bp, Homo sapiens
agttaatgggtgcagctctgaagatgcaaattgttatttcacaagcttgatgcagctgtgtcctggcacagatgggtggaggcttttgtcctcctttcagcactcttctcaaagggaacagtgattcataccttgaaaagtgaggaataaacaaggaaacggatctaaattatttttctactgctcatcaggtgttcttatactccatcgtaataagatacatttttccctggggccaaattacatgccatcatcctgcaaattcatgatgtgaaaatgctcaattgtaaaaagagtaacaattatttgccctatagaagaagttaccatagagtgattacattctcttcagtgccagaatttctattactagcattacgtgtatacaaatatacattatttgacatataaacatttacatactttcagcaaacttctataaaagcaagatccaatttatattactttgtatatttgcaaaggtttagaaatgtgaaatgagaattttctttctgccgtacaccttttaaaatatctgagttactaagtaatgtgtcatctttactggtccagtgttagtgtctcagtatgtgagctttacctcacctgccctgcagcctttcagcccctcccagtcttccgcattttgttcgtttctttccccccttagcttgtattgtcattgtatgttcacaaacatctttggttctcttgctcccataatttcctatgacacctcccttcgcaatccttagccctatcttcatagactgtgctgtccagttttcttaatcttaagatatcaaggatggctgttcagaactactaagttgattctataaaaaagtatgctgtttgacttcaactgctttataattctaagcatctctaattattgatcttttaacaccctgccacacattttccaagtctctacaaatgttagttgttggaaacctttattcttcctgcttaacttccatggaaggagtttatgctctcttttagaagggaatactggagtcaactcttgtagtatctcccagcc

SEQ ID NO: 107209 - DNA, 1184 bp, Homo sapiens
gaccaaagagttataaatctgaaatgttcacgtattaactgccctgtcacattgcctgaaaagctctttactgtgcttttatccagccatgttttgttttgttttctaaattttcccccaaggtctgtgtacactgggctcagtaagttgttatgttgctggaattgaactactccaccagaaactagagctccctgacaatgtatccggtgaatttggatggtccttctgcctggcttgtgtctctgctcccttacagttcatggcttctgctctcttcatctgggctgctcacaccaaccggaaagagtacaccttaatgaaggcatatcgtgtggcatgagcaagaaactgcctgctttacaattgccatttttatttttttaaaataatactgatattttccccacctctcaattgtttttaatttttatttgtggatataccattttattatgaaaatctattttatttatacacattcaccactaaatacacacttaataccactaaaatttatgtggtttactttaagcgatgccatctttcaaataaactaatctaggtctagacagaaagaaatggatagagacttgacacaaatttatgaaagaaaattgggagtaggaatgtgaccgaaaacaagttgtgctaatgtctgttagacttttcagtaaaactaaagtaactgtatctgttcaactaaaaactctatattagtttctttgggaaacctctcatcgtcaaaactttatgttcactttgctgttgtagatagccagtcaaccagcagtattagtgctgttttcaaagatttaagctctataaaattgggaaattatctaagatcattttccctaagcattgacacatagcttcatctgaggtgagatatggcagctgtttgtatctgcactgtgtctgtctacaaaaagtgaaaaatacagtgtttacttgaaattttaactttgtaactgcaagaattccagttcagccgggcgaggattagtattatttttaactctccgtaagattttcagtaccaccaaattgttttggattttttttctttcctcttcacataccagggttattaaaagtgtgctttctttttacattatattacagttacaaggtaaaattcctcaactgctatttatttattccagcccagtactataaag

SEQ ID NO: 107210 - DNA, 1027 bp, Homo sapiens
tccctcttcagaggaaactgggagaagccaatttccactgcttctttttcctgtgcctttttaacactcaaacccagaacacttaatcctctgcagctcgtgcaaaaattcagtctgtaatttaaaatgtgtgcacggtacactgctgaccatgggcatgtctattgtttgtatctgtaatgtgtatgtccatttcagtgttgtctgttttagtatgcaggtgatagactagagaacaagacctctgtctccgtagcatcctgggtatgtgagcattcaataagtacttttatgagaatgagttttgttttaagcttaattaaaaacatgcttgctttctaaaaaaaattcttaatggttatatgtacgaagggatggggaattgggtaaagggtgcatttggaataattcaaaataatctttcttatttgtccgtaaactctaacttatcttctttcttcaacttctaaacagagcagtctgaatgccagaatggataaccgttttgctacagcatttgtaattgcttgtgtgcttagcctcatttccaccatctacatggcagcctccattggcacagacttctggtatgaatatcgaagtccagttcaagaaaattccagtgatttgaataaaagcatctgggatgaattcattagtgatgaggcagatgaaaagacttataatgatgcactttttcgatacaatggcacagtgggattgtggagacggtgtatcaccatacccaaaaacatgcattggtatagcccaccagaaaggacaggtatttctcttattttaacttctgtcttcttcacctggttaataatagacaaaacgacgtaatgattgcccaattacatgtaagcaggtttgttggttctctctctccttaaagaaataaatcgtgtatcttctctttctactgccttctctccccaacttctttgcattaccatggtactcatcaatattggttggatgaggaacttttcttatcttgggaaagccttaatggctttttttt

SEQ ID NO: 107211 - DNA, 1006 bp, Homo sapiens
tttaaatagcttttagtttttgtttgagcatgtttttctatttaaggacccttatgcagagattatcaaaagaactacttttaggatataaactattttacaagtttaacagttaggaaatggcttcttttttgtttgtttgtttgtttgtttgtttgttttttgagatggagtctcactctgtcgcccaggctggagtgcagtggtgcgatctcggctcactgcaagctctgccttccgggttcacgccattctcctgcctcagcctcccgagtagctgggactacaggtgcccaccaccacgcctggctaattttttgtatttttagtggagacggggtttcaccgtgttagccaggatggtctcgatctcctgacctcgtgatccgcctgcctcggcctcccaaagtgctgggattacaggcgtcagccaccgcgtccggcccaggaaatggcttcttaggaaacctgttctagtagtcatagaggggaaaagactcaagaacagattaatagttttatgtgctgcctcacagggtaaactttcatatgtctgatatgacatatgaaataataaaagatatcatctgaacctttttttccaccaacttttccctgtctttcatgctatagaaccatcaaattttatttctgaaagagacctgagagattgtttatagtaccttcctttggtgaataaagaactcactcaagagagcttggatttgcaccatggttggtgtcattgttagtggaagattcctgtcctcctgcctcctacaaaagcagcagtgcttccgaaggcagcagcttattccaagaaatacactatcgatattggactgtttctcttttcactaaagttcttagagtttcacatcctttacagagacttgtgtgaaattgcctgttcgccttgaaaataagaggataagcagccaggcatggtggctcacgcctgtaatcccagcactttgggaggccgaggcaggcagatcacgaggtc

SEQ ID NO: 107212 - DNA, 1340 bp, Homo sapiens
gctaccatttcttgagaatttaatgccaacatttcctctgaccacagaaatgtttctggactactttattgtccttcctcacctttcctctggctttcctgtgatatttttatcagagcatctcagacacttctttttagcctgcaaagccatgcacttggcctgaagccaggccagctactctgagcacaagcctgcccgtcagcccacccagtcagactctcctcactgcagaacactgaagacagagttatgaaagataaattgtttcggcatgcacaaagagaccccaggaaggccctacaagggcaggaaaaaaacccaacttaaaattacatttccttgcaacataaatgaaaaacataaagataatatccatagataactacttttactaactcagagatggccctcagaaatcatctcatgagctgtggttctcatacagtttctgagagttcccaggaccctctatcctacctcagccagatctgtagtttgaaaccatgcagagataaatacatacctgatttttgggaaacacttttggaaaatgaagcagttcataagctgctgttctgataatgaaaggatctaatattcggatttgataaggtttataaatcaggtttaaggctggtttcttccaaaaaccattagtgttctgaaagtaaaaaatatagagaatagaacagtgtggctgtctgttttttaaggaaaaaaagcactaaaggtaatctgaaggcagaacaattttgcctacttactattttgtcacccatcaacaattccaacagccaccttaaatcatgtggcttaaaagcagtgagaatcactgtcgtattagggtcattgtgaataggatctgaaaaaacagattctggataaaaaagtcggaaggttgtccttctcccaacttcttcttcatgtcctaaaacaggaccattattcattctgtggatagtaaaacatacaagatatgtagaccaagtgcagtatctgccattcccatcacagttctcagaggtttcagagttggacaaacatcagccttttatcctgtgctctgaagccacaaagcaatagatcaatctttcacacataatggccaaggagatcattccttttcatgaaatagttggttgatcaaaggcagaaatgttcatttgtatttgaaaattaattgtggagccaatgataattcagtcttacctccaggggaactgaagactaaatttaaaaaagtgggaacacagagccacaggataccagagttgaaagagaacttggaggacaaacccctggagagaaaattacttgctcaaagccacacagtcatg

SEQ ID NO: 107213 - DNA, 1007 bp, Homo sapiens
aagtggaaaaccttcaaaatttaatgaataagtaagtcaggcaaaaaaaaataatgttcaagatttttttttccttcttgagcttgcctagcttagcttcactgtataaagttaaacttcatttctttaaaataatacaaagccatcagagtttagtaattgtattctttctttagttatttacttatctaataagaactttatgtttagcccatttcctttaacttaaaaacaaacactgccttcattgtaccaaattactcttcacaatcatggttcatttaattctgggggttgtcaggagagagcttaattaaaccagtatgaacttagatttccagagccaagtggtttcggcttgccacatcaagccacaatcgtgattttccaccagccatgtttacagtagccaaatatcctcctcaaaatgtcttattgtagtcagaattgttgtggtaaactaaatccttagtaggaagtcatatcccttcaaaaatctaagatgaagtaactataaaaagacgtgtgaaaacacctcagaaaactagcttattttaaaaacaatgcaatcaaaacttattttcctgttatctttacatttcttggttttcataagttaaatatacagtattcacagaaattaagctggtggttatgaatcaccaggcagcaacagacagtatacataattatttgacgagtgcatccaacatattttaaactaaaaattgcagtacaaaaataaaactaacactgttagcatcatcttctgagtctgtagagtcaatcttgagtcaagttgattacgaggtttttttctataatgtccttcaaaaagagctgctctgcagtcacattgtgatacgcgttctaaagaagaaaaatacaattaccatcattctttcccaatctcaaagtattagcagcaccaatggagtactttatatctaaaaaaatccgaataaagaactcgaatgttaagtaacgagttgcatgtacttttaact

SEQ ID NO: 107214 - DNA, 2250 bp, Homo sapiens
tttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttactagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctattttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaagtcaactgtggcaccaattctaatgtaatccaacttgtgactgtttttt

SEQ ID NO: 107215 - DNA, 1410 bp, Homo sapiens
tcacagagaaagtagggagtttccttccagtgaaactccctttttgtggagcctacaaacctatctgtatcctctgttcactgcagtgaaaagggggcttccttatgttgcccaaggctgattatatcacctgtgccctggttcccctcgatctacctctcagggacccaatcttactgattatcctctccccctcctgtatcttcagcctctttctctcttttggatacagttgttttaaggaataaagaagatggtgcaggttagactcattgcagtgtccggctctgagcccccagtaaatatcagcaggtgctgctattatcatcttcatggcaagtagggggttgagcgacaaaggaagaaactaatatcccaagtgaccttaggcagatcattttctatatctgggcccagaattccttatctctggagtgaaattaggggattaaatgatccctaaatctctcccagttccagcattatgctggcttctgacctggtcacacacacatttccaattgactttcttaacaccacattgttaccttcccatatatatatatatgaatgttttgccattatgatgtaacgtcatttcaattgctggattattttctcttgtaaggaggataccatgatttattccctctcatttttgggcatttggattatttccaatttttcactcttacgcagaaacagggagaacatctttaaggatgcatctttttttagtttctgagaataaattctaggaatggaattgccaatagatttttgtacatattgcccaaaaatgccaatcagtgagatagcatcagtttatatttccattaaaaaataactgtttcctggtagcctgttcatcaattagttgttgttttaaatatttgccactttgattagcaaaagtagtattttgttgttttaactttttttgtgttggttgtttaacttgtatttctttgattactagtgaagttaacatatttaatggttacttgtattttttaatgtattactagttaatctctgctgatttttctcttaaatgtttggatttggcttgtaatgccctacaatataataattatttaaagtaactcttctcatatgtagaaaatatattttcccaatttttcatttgtctttcaattttattttagtgatttaaaaatttaggaaaatttcacatctctacacagatggaatgaatagtgtaacaagcttttgtgtatctgcaaaagcttctacagttaccaccacatgcccagtcttgacaaataatgtttatggtatttccgtgaggtagaaaaatgttgaaagatgatgtggttaattttccctagtgatttctgcctttggtgttaatatggcttttgtttgtctgtttttgtctttgtaact

SEQ ID NO: 107216 - DNA, 1047 bp, Homo sapiens
aaaactgagaaatcctggcatatttgtgcctttattgcagagtataatatttatccttccaatatatttctctctgagagttaaaattattctgcagaattaaatactttaggaaatattgaagacatttagcattactatttttaattatgatttttaaaaacaaaatgtttaaatttttctaaaccatttttcaaggtcgtcctccaaaacttactcaacctccacctcctcggaacagcaatgacctcaaaaacactacagcccctccaaaaatagccaaaggtatgcctgtttttaatgtgagaatttgatattccttggatttatggtgcaactttccaaaaatatattaaaagcattatcaaataagtttatgttaatcaagttggtacagattaaaaagtaaagagcttttgaaacttttttaaaggtcgtgccccaaaatttacgcaaccactacaacctcgcagtagcaatgaatttcctgcacagacagaacaaacaactgccagtcctgatatcagaaatactaccgtaactccaaatgtaaccaaaggtatgcaaacatggaaatgaacgcctagtacatagtattgttttgttcttaactgaagttttcacgggcatttttaaaccttcagtttattttcttccaactatagtttttaagtatagcaaaaaaaaaaatttattttctttcataggaaaagactgcattgatctaagttgtagtctctgctgccatgtagaattgctctttaaatatttagagaaggccactgtgttgcaggcctcctcttgtgatttattgttccttacagctaaacatgttgactctcaggcttagaaatacaatattttctagaaataactgaaatcatagcaggaaacaaacttgtttcccttgataatatattaatttgatggatagggaacttgatggcaaaaaggggaaaataaaaacagaacttttagtagaaactagtaattgttaaaaaatactcatagttaacatattcataaaaaaaaactttggtctctttt

SEQ ID NO: 107217 - DNA, 1049 bp, Homo sapiens
ttccactaatatagtaagaatgaaaataattgcctttcattttatttcagagtaatatctgaggaaatcacgggagctcactagtatggaagttattgtaactgcaaaacaaactttttaggaaatgaaggatattaacacatctttcgagatttatagtctaatgccaagtgaattagccaagaagaaatagagccacaatacttggaaatagcttgattgagaagttaaacatttacttaatctcatcttagctgattagaaaaaaaatcactttgattttaggcaatatatgcttattaatggtctttagaaactacctagttgatctgacctagagaacaaacagggctctttttagcttattggagtccatacttaagtcggaagacccagagtcaagttgctgccctgtcattgactagctgtgcaatccacttacagattcctgtgccctcctatttcatagggttgtctgaattagttacattaaaatgttttataaataattaagtgctggtccattgtaagatactatcattatttgcttgaagtagttaagggaatgagactcacctaaactcatatttttacctagggattatttttataatgcatttgttgctagttagttacaagcattaaattagtcacaggccaggcgtggtagctcacacctgtaattccagcattttgggggaggtctaggtgtgagtatacttgaggacaggagtttgagaccagcctgaacagcatagcaagacccctttctacaaaaataaaaaatcaccaggtgcagtggctcattcctgtaatctcagcactttgggaggctgaggcaggtggatcccttgaggtcaacatggtaaaaccctgtctctactaaaaatgcaaaaattagccgggcgtgttggtgcacacctgtaatcccagctactcaggaggctgaggcaggagagttgcttgaacttgggaggaagaggttgcagtgagccaagattgcgccactgcacactagcctgggcaacaaagcgagacctcttttctaa

SEQ ID NO: 107218 - DNA, 1143 bp, Homo sapiens
ttcagtaaagtggtcttgagacatctaaaataacggtctcctacagtcattaagagaaatttatgttaaaggagtccattttaaatgatgagatcattaattttccacatgtggagagtataaatttaatttaggggaacttagcaaatggtcggaataattggttgggattggtttaattttgttaaaatatttattttgttttggtactgtaaataataccaataatcatctttaatctgttcattcccaggaagtcatcttacccagtagtcaaaatctattttacgacgttataaacacaagacaccaaaacagaatagttctttacttaattaatgcccacccataatccttcctctctctccaagggaataaggccaaggatttagtaattgttatgacaaaaacgtgcacttggatatggaaatgagccataattagaaatgttcgagctgtgcatttcaagtgtttatactttgatgctgaacaaacttagggaatcagaccatgtgcattaatgaaagcaactcttcattccccaggcattataaccactggatccaccatggtggagcacaattactatgtgtctgcctacagaatcctgtacagtgatgatgggcagaaatggactgtgtacagagagcctggtgtggagcaagataaggtaaaatgattaccaaggtatttttaaaaaacattttttaaatgggtggttgccaagtcacagagctctcctgtataaaagagatgtagaagtttagaatgtcttatactaccctcttgtggttattttaggtagtgttattggccttactctactgactttagaaaattctcagtagttctaggttccttttggtgattgtaacggtgagtacttttctgatttttgtcattgcatttttaattgaattgtttagacactttattaagaaagtctaaaagggaccttgtaatttcttatttttatgaagcttttttcaattcaccagatgatggagagcctttgttcccagatttctactctgtaggcaagaggtaaaaaaagaaaaaagctgaaaaccaacgtgcattaaattataggatattagagatgaaaattcatctgaagatcatctcaccaactttcatcttggg

SEQ ID NO: 107219 - DNA, 1390 bp, Homo sapiens
aagagaaggaagccactgaaatggtgtgttttgttttgttttttttgctttttttttaaccaaagccactttttacatagcctatgaacttggtcttaattagaggcagattagttcttgctcagctgtattggtttctaggcagaaaatgttaaattttagaagttttatttctttagagcaatgctactgcagcttccgtgtgcttaagaaattactgagaggacttgttaaaacagatttttgggcaccaccgccagagattctgtaagtctggatggagttcaagaatttgaatttctactaaatttccagaaggtgctgatgcaccagtcctgtctctggaccagattttaattagcagttattaatagttagagccataaaattaactctctttgtcattattttccttatgtgcaaacagcaaagggtcatttttagttatataataaccaagaaatatttctgtgtgtgggtagctgtattttacagaaaccactttaaagctataaattttacttatctatgcatgttctaaatatatatatatatatatatatatatatatatatataaatacacatatacatatatgtgtgtatatggtatgtgacttcctgaggtgatgtagtaaacagtattgaggggacattgctccaaaaatcaagaaacttaatatcagaaagaaattgtgattaacaaaagttggcaaagtttttagtaccactttgacagtgccattgagatttttgaaaattagagtagtacagtttgggattctgagacacttggagtttcagcaaggtaatcctgtatattaatggaatcagttttttatttttgtttttctagatctaattacttgtttggacactgcatccaattttttggaacctgagttcaggtatgattatatttgtgacttttttttttttttttgcttaaatgttacttttcattcacttcttcattttcattctgtatactcttagggttaatgtatattgtgtgatacatatcattgttccgagacttcaataaattagagcttacttaaagcataaagccatttagttgcatgtttacattttgcttttattgtagcatttagatctgcaaaatgaaagtatcattttaatatgctttgaaagtagaactagttgcttttcaaaatctagcaaaactcctagtaaaagttgaaaaggtatttatcttttttcaaaaaattgaaagagcatggttttggctgttatagaattctgcagtgttgttactcaagtaccatttctactatttctcttctttatgcctttgtctcttgcctagacaacttctaatcgagttcctatttctgtttgctggctgccattcacactgctgccaagtt

SEQ ID NO: 107220 - DNA, 1845 bp, Homo sapiens
ttctctttcttaatggtgtcctgtgaagtacaaaagtttttaatcttgatgaacttccatttatttttatttgttttcttgtgcttttggtgttttatctaagaaatcactgcttaatccagagttgtgatattctcatatatttttttctaaaagttttatagtttcagctcttgagtttagatccactttattttgtatgtagtttgaggtacgggtccaattcatttgtttgtttggtggatatccagttgtctcagcatcatttgtctaaaagataattcttccccccattgaattgtctaggcacccttgctgaaactcagttgactataaatttgagggtttatttctagattttcaattctgttcctttgattatgatgacttatacattgctatcagaaatctctggggcagatggatttttctggagctaggctgtgttcttattagctgggagcattgtagtaatgacaattttctggaaggctgtttacttgggaaaagcttttaagaaagacattttaaagcttcttaattgcctgctttatttgatgttgttttctttgtagagttgtaaaggtcaaagtgtgtacttaaggctttctttatcttcagtcttcttggctctccttgtagctgtccattttgaattcttatttttctccttgagagctctttgaacttccatggaatttgagagcaactttagtgagttgcacatttgcatggcatagttttggagtctcagcactgcatgcacttacaaccaaagccctgttctgatcaaataatccatagttgaccagatttctggcatgtggctggaagataatggggccagctggcagtcttcttgtggtttaagtgccatattggaccacacagtacctttcatcccaggctattaatcttagaaattcaacttctaatcttagaagtcggaaatttttttggtggagcagaaagtggaaaattgattcttgttgatgctgggcaaagattgacaggaataactagagaactggtaattcaatttgcctgctcttctggttggtcaactgggtggtagtgagcccctatttaggcatctatcctattaaattcctaaagcacagatttagcttaactgtcattcaaatgcctgtggtttataactattaatttatacacttgccttgaaaatacccctttcttactggtacaacacagttattaagctctagttcaagacacattttagttgaatagtaaacacaaaatttcttcagaattatggaataaaatgatcgattatcatatgcttgctgtggtaaccattaatttaacaaatatttatatactgttcagtgtgctaggagctatctccatcaagggtatattggctacccttgacacagttctttaatcaagcgtttatatgtaaaatcacttacttttgtgattgccttggggtcttcttccaggttttcttccctgcaggttagtaaataactggacttagccaaacatgctaatgatcagaaacttttattcatccattgattcaataaataagtctcctgtataccatatgctgttattgctactggaaatacaaaggtgaggacaaacagcctcaggctctgtccggggactaggctttatagagtgattttgcttataactctataattacaccaacaagtcaggcttacatattaacataacacattacgtttgacaacacagaatagtcatctgtttattaaaacaaacaaaacttaagtgcctactgtgtgctaaaggaatttgacttgtgaagctgagggacagcttctgtgaggaagtggcagtgaagct

SEQ ID NO: 107221 - DNA, 1182 bp, Homo sapiens
agacaagcctggccaacatgatgaaaacctgtctttactaaaaatataaaaaattagccgggcgtggtggtgggtgcctgtaatcccagctactcagggggctgaggcaggagaatcgtttgtttgtacccgggaggcgaaggttgcagtgagccaagactgcattactgcactccaacctgggcaacaagaatgaaactctatcccaaaataataataataataataataataataaatgctactgacattttattctgaaaagtagatttaaaaacagtggttgtcattggaattgaaaaataaaatgaattttatagatgatctaaatttctgtttttgaatctgttcaacaatgaccagtttctaggaggaactggacatttgtagaatggttctgggtgacgaattttttaagttgtagttataaaacagtgaactcaaaagaaatatatacatttgcattgaaagcttcaagtccttcaagacagcatttattcatatgtaccataattggggtgtgtgtgtgtgtgtgtgtgtgtgtgtgcatgcatgattggaaagtggtgatcctggtattctttttggagaacatgaaattgtcacttaaaacataatactgaatcttactactttagatttcaccaactcgaaattttgtagtgctcagtctataaagtttgcctttattttggacgggagaaatagtaaatagtttaaaatttcatgtgaaataatgtagatattaatatagttcctaatcggaactcataaacacatgttcattcattgtctgccaccccttagaatctgatgacagtgcacttaagacttgtaaacagctgagcctggaaaatattcccatttaacaagattatcattgctatatgatggattatttttagaattaacaccaatagtataaaaaatatttgctgcattttttaaccacatcatttttgcaaatatttgccattttttcattcttacatcagattatatgagtttgcaaatgaaacgtagggctgactagataattcctttctagcagagtccaaatttctgtaaccggttatttttttcctgcatggaatgttttcggctttgaaaatagagtgtgaattccttagattgtttgccttcttaaccgtacagtaattttatagaatctgttttgtttcc

SEQ ID NO: 107222 - DNA, 1063 bp, Homo sapiens
gaaagttttggacatgtataccatggaatactatgcagccatgaaaaagaatgagatgttctttgcagggacatggatggagctggaagcccttatctttagcaaactaattaatgcaggaacagaaaaccaaatactgcatgttttcacatataaataggagctaaattatgaaaacacatggacatatagaggggaacaacacacactggggcttttgggagggtgggaggtgggagaggatcaggaaaaataactaatggataccaggcttaatacctggatgataaaataatctgtaaaacaagcccccatgacgcaagcttacttatggaacaaacctgcacatgtaccccaaacttaaaagtttaaaaacaaaagattatcaaatagaataaaatccaaaatttacctgaatctctaagataaaatgcaagacctgcatgaactctctcacgtgttttagctgctgtgggatgtgttcatttccccctgctatataggggtaccatgatgagaaagtttaataagtgttgctagtacaagaatatatcaaaacaatcatttaaatttttaacagttgattattttgatattcagcattgaattaagttaccatttaaaagtttaaattggcttttacttcatattgtataaatgaggagattctcaagaacctcctagttgtgagaatgctgggcactgggaattataggggaaagcaagcgattcctcctcagctatggtgggcttgagataaacacgatatgtcttattgaaagtttcatatagaaagtgatagaggagagagctgttctgtgtggaggaacctgcctttccttagtttataagcagtagggcaagatgtgaaggctaacaaaatctttcatagtaaatgagaaggaaaattcatttggatgaaataatagaaaagaactagaaacattatgccaaatgaacaattaatattttcgacagaaccaggaaaacttagtcagtgtgatgttatggaaaggactcttggtatccctgcctctgccacgtgctagctggctaacctctg

SEQ ID NO: 107223 - DNA, 1802 bp, Homo sapiens
atcttagatctgtactgaggatatgttattttttatatatctgatagaccaagcttgtccaacctgtggcctgcaggccacatgcggcccaggacagctttgaatgcggcccaacagaaatttataaactttcttaaaacatgagatttttttgtgatttatttatgtttgtttgtttattggttgattgatcgtgcccaaaagctgtcattagtgttaatgcattttatgtgtggcccaagacaattctttttccactgtggcccagggagaccaaaagatgaggcacctctgtgatagacattaaaggatgaaatttaggcacacagttttatatatgcatctgacattcaaggaaaaagctgtggatggaaggttaagcttgtgagttgtcagatcatagttaaagccatgggatcagatatgatcacctaaagagattaactagaaatccaacaaccctcagaagtaaaattgagtaggtccaaaaaaaggcttgagggatgacctgaggctggaatctaaggggtttgagggaagcactttaagaatactactaattaatcatcaattcatttgtgagccacctgcctggatgaaatattttgttaattttttttttagtccctcattattgttttgaaagagtatacatgtctttcacaggaaattaatctctataagttcagtgatgcatgtactgcttttccttttgaatcatttgaatagacattacttgtcatttttttcctccagagcaatatgattggtaatcattaaacattttagtcattattccatactaatttaacagccagcttggtatattattctgcttctgttatctacattgcaaatattattgacttcatgagagtcatcccaaataatctgcttttctttcattcctaggcaaatactgtggtctggggttgcaaatgaaccattcaattgaatcaaaaggcaatgaaatcacattgctgttcatgagtggaatccatgtttctggacgcggatttttggcctcatactctgttatagataaacaaggtaattttcaccttttgcaatggttcctacagtttgtaatttctaacaacaaaaataaaatgctttttttaagtacctgttttctgaaattggaatagagcagaaagactgaacaattaatagcacatatataaatttgacaaataaggtgagttcagtttcaaagttccaaaaataaaagtacataaacgttacttccctttccttagtaaaggaaatactgctgaaatgctgattttttttatttttataagattggaacacgagctataataacttttttttttttttgagacagagttttgctcttgttgcccaggctggagtgcagtggtgtgatctcggctcaccgcaatctccacctcccgggttcaagcaattctcctgtcccagcctcctgagtagctgggattacaggcatgcgccaccatgcccagctaattttgtatttttagtagagatggggtttctacatgttggccaggctggtctcgaactcctgaccccaggtgatccgcctggctcggcctcccaaagtgctgggattacaggtgtgagctactgcacccggcctataataacatttttaaaatttataaattattgaaatgttttatatcaatttaaaacattattattcacagtttaccacttcatagtgctgtgttaaagaccatactaccattattttcaaagaataagatctcacatccccaggagtacctgaggagtgctgagacagcatgaaataa

SEQ ID NO: 107224 - DNA, 1005 bp, Homo sapiens
ttgtgacatatcttcctaaaataatatgtagactttgcttggatcttgattcaagctaaccactgaaagaaattatttttaagattatcagaccgaggtgggcggatcacgaggtcaggtgatcgagaccatcctggctaacatggtgaaaccctgcctctactgaaaatacaaaaaaatgagccgggcgtggtggcgggcgcctgtagtcccagctacttgggaggctgagggaggagaatggcgtgaacccgggagacggagcttgcagtgagccgagatcgagccactgcactccagcctgggtgacagagcaagactccgtctcaaaaaaagaaaaaaagattatcagagaaatttgaagcattgggcattcagtgatggtaaagaatgactgttttagatgtaataatgttaaaattatttttaagttctaatttgttagagacattctcaagttcaaatgtctaggatttatgtttaagtatttcagaaatagggagaaggataggagaaacaagggcacattagtgaagctgagtaatgggcagatgggaattgttacaccctcttctttctacttttgtgtaattttgaaaattcctataaagaaaagtggttatgttaaaataaaacaagagaattatatatttagataatacatagtggcactgttggtagagtggaagagtggcgtggggaagattctgagcacaggtttcaaattgctcgctgaattctagtcaaagctccaggagttacttgttgagagtcctttttctacaaagtgttgaacctgcccagacttcatagtcactttctgtacggtctgaagattaaaagaagtaatactttgcagtgtttggtgtgtaataggtatttaataaatctcagctttcccttatttccattgctttttcctattctcctcatgggtgaatggaaagctgcagaaaggtcaaggggcctgagtgatgatggttcctgttgggcttcagtttgtac

SEQ ID NO: 107225 - DNA, 2456 bp, Homo sapiens
acaatgagaacacacgtacacagggaagggagtatcacacactggggcctgtcagaggctgggaggctggggaagggatagcattaggagaaatacctaatgtagatgatgggttgatgggcacagcaaaccaacatggcacatgtatatctgtgtaacctgcgcattgtgcacatgtaccccagaacttgtataatttttaaaaagttaaaaaaaaaagagcttccattcagcttctcacagatattttggttcatgatttgtaaatagatgaagctgaccacatttctatattttacattcactttttgaacaattaagttgctcttcttttgaagattggatttattataacatgtatatgtatatttaatgactactaatttatatttacttttatttgttcagaattgaaatctccttgaacttataaattatataagtaaccattgattattttgacctaacttgtcttctcttgcctcctgtgaatagatatactaagaacaatgtcaggtcttgtgatttgttaaaggatacaaagttacagctagataggaggaatctaccactgcaggatggctatagttaacaaaattatgtagtttcaggtaacacaagtgataaatgtttgagatgatgcatttgctaattgccctgatctgatcactatacatcatatgtatcagaacatcactgtgaaccccatgagtatgtacaattatttgtccattaaaaaaaataaaatagaaagtatgggtggtataaaatatttgatgtcgtgcatatttttaaatcttcacaaaaaaatcattatagaggaagtaaaatatgtgagaataatttatcattcttttcactttttttaaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggtaggacttttttttgtaaatgtacatgtaaatacatcattgtctcaatgatgtatttttttgatattaacattaaataaccatgcagtgtaaggtgctatgtgggaaattattgaatatgtgtaaaaattttgaatttgaatcttttgggaagagaagattcttgtctgtttactttatttacttttctaataagcacatattggtacccttgcccaagatgccactgtactactaagaaggaggaagttaattctctgtttttttttttttgtttttttttttgagacagagtcttgcttttgtagcccaggctggagggcaatggcgcaattttggctcactgcaacctccgcctcctgggttcaagctatcctcctgcctcggcctcccaagtacctgattacaggcgctcgccaccatagccggctaatttttttttgatttttagtagagacggtttcaccatggtggccaggctgttggccaggctggtctcaaactccagcctcaggtgatccacccacctcagcctcccaaagtgctgggattacaggcgtaaaccactgcacccagccaattatctcatttttaaaaatgttttcctttcatagttttatttgcaattgaagaatacaagtataattaatgcttaggagacagtatagcatggtgattaaaaacaagggttttggatccaaacttcctgggattaaagcataactctcatcagcttgctgtgtgactttggccagattacctgacctctccattttttctcttgtaaaaaatacagggaatgaactagtatgtgtaacgtgcttagaaaagtaaacagcacctaagatataatatatgcttagtaaatggtagtggccattgttgttgttcttgattaagagcagtggttctcaattatagctgcatattagagccacctaagtagtaaacaataccataaacccagttaccatcctagaccagttgaatcagaattgattaggtggaacccaggcctcagtatcttaaacgcttcctgggaaaatctcttgcagtcacgtttaaaaacctttgatttaggcatcagtacctttcttaagcaagaaaggtggaaaaatttgtaaggctttttaggtgaactaacattataaaattaggaattctctgtgagtttatttagaaacattttttggttccagtgtgtaaaatatccttcagaactataataggaatccaatatactgttctttaaataccatactatgttcatcctctggcttcctctccatctctagtgaaatccttcatctcttctttacttttttggcctcttatctaccagaggaaaaattcctgc

SEQ ID NO: 107226 - DNA, 1367 bp, Homo sapiens
aaagtcctgtttttcatcagttagtatttcttttgttaacttttgtagaaattatccttcatgttggaaagggcagtaaatgttcgtgtatttattgagaatcaaacatgagcataagacacctaaaaattactcctaacactctgcgtgtactctttgtaaaaatcatttttaaatgacaaccgtaagttgaataatagcctacagggaataccttaagtgtgacaatctgccactacaaagtcgtagattcagctgttaatagaaaatacttgagtttctgaaattcatctacactttcaatcaccttaaaagctgcctttgttttctatttactaaagaacgtgcatttatattttgagttactttgtttattcagtggttattttatgaagattgaaccacctacaggaagaatgttttcatcttttcagtagtaagggcatttcagactagttttataatgttaggaactctgtcttagggtggtagttttttcctctgaggaaaaatgttagtgattgtttaagagttatttatcttacaattcatttattttcacagtagatttttttatatccctatgtttttaatttagctgatatccagcagagatattcaaggtattttcatgccagtttcaggggaaatttgtggttttttttttttatggactgtgtaacatcctacattttatatttgcaaaagaccagtggatatattgcacagaaatccacgtttattacattctgcccttatatatttttgtgttactgagttgctatgcctagttcttgtgtatgaaatgaaagcaagtatagaagatagctaaaatttaatgttgattaaaaactaagctttgtgtgagagatacttgttcagaaagccagatttctagtactgacctttaaaagtagactaaggagcaatactaatatggattcaacaataaaatttctttatcagccaaggatacgatttttaagtattatcataagaatttaggtacaaagttgttccatcattaaagttagctttgagactaatttgaaattactttttcatagattaatgtacagtttccttattcaattaataaacatttatttagcatccaccacttactaaaaactacatgaaattcttattcataggcttttgaaagttttcatcttttctagcaaatattagcactacatttgttcttaaaaataatcaacatagtagaaagttctattacagccctctgtgtccatattgagtttagaactcagcagtgtcacttttaatatagtttttgtgtaagtgctgtactgttccaaaaggtgatttgtaaataactgttttgaaggacaaaatgctgttat

SEQ ID NO: 107227 - DNA, 1337 bp, Homo sapiens
ctccatgctttctcattttaagatctcgcagatatattatgtgaccaaagtgacagttatttagagcaagtatagtcagactcaccagttcaccaaaaaaaaccttgaaaactcactggaaaagtttaaacctttgctctccatttttggcatatttgtgcaagtgtatcctgcatttgctgttaaaggaaataattttggaaatcacaatgttcatattattaaaattcagtaatgcatatataagaatataattaatacaatttatcagtagtgatatggctaaaatctgggggtggctggaaagtcatatggaatcagcatcacaagcacatacttaaacaaaaaacacacttgatttggagtttaattagagtagcctaaaaaagcatgcattctttgttgcaataattcattatcatttaaatacgtttaattttctttctcttttttctagggataagtagtaaaaaaaaaaaaaaaagggggggggttttcctgtaataatatcaaaatttgtatctggcttaacacatctgaccttacactcttcagaggaagtgaacacatgttctatgagtaattccctagataaatgtgcagccaaagaatcattaagatcaaattccagtgtttattcttagctgaaataaaattaaaattcaaaaattaggttaacaggcttctaccctttttgatcagttatagtctggtggagaacatgtcgaggaggaagatgaaaaagagaacctgtcagtgatagtgctgatggagtttggagaaggagaaagttagtgaagttggagttggtgagaatgtatggattggtgctctgaatgttgttttttccaagagtagttttactctttttgtcaattctgccttatgagcaggaataatagtaggtggtgtagcctggtcacagatcattattcttcccagtgtacaaagctactcagaattaatagcagtcacagatgattactgttagctcctttccctcctaatgttaagagctcctgacccagaaaaaatatatatcatttgaggtctgtagactaataaaaagcatttctttatgttaaagaaaaataaaacattccttttactttttttaaaaattggaaagtcggaacataaaactctttagtataactgctgatctttgggggaaaaccagtctcttagtgaatagaacagcattaccctttgggccaaatggaacccagccaagagctaaaccagatcttttttctgagattttctagctttaactctaagtcagcacttaacctcagcactattcacttttaaggttgatcattctttgttctgag

SEQ ID NO: 107228 - DNA, 1060 bp, Homo sapiens
gtagagtatgtgcatggtggagttgaagaggatttatatatagctcacattccttcatgttattcagttttgtagattatcacacatgcagagatgagtttgagcttaaaaagaatgaagctgggggcaatgtctttttaaaaaaatggtcacattgaccctctttggactctgaatgcatgtgcatcttatgcagtattttaaaaattaaataaatgagctatcaagccacaaaaaaccatggaggaaatttaaatacattctactaaatgaaagcagccaatccgaaaaggctaccaactatgtgattccaactgtttgatgctctggaaaaggcaaaactagggagacccgaaaaagatcagtggttaccagggttttgggggaggtagagatgagcaggtggaacatgggatttttagggcagtgaaactactctgtgtgatactatagtggtgggtacatgtcatatatttgtccagacctatagaatgtacaccaggagtgaaccctaatatgaactgtggactcagggtgataacaatgtgtcagtgtaggttcatcaattgtaacaaatgtatcagtttagtcaggaatgttaataatgaaggaggctatgcaagtgtaggggcaagggatatatgacaaatatctgttctttctattcagttttattatgaacctaaaactgctttaaaaagtgaaatatattttaaatactaaatttatgttatatatgttttaccacaatttaaaaactgtagggatggagaaagatataccttgtgaacactaaagaagactggagtcactgtattaatttcagacaaaacttcagaacaaggaaaattaccagggctaaagaggacattaaaaaattaagtgaaattagagtagtatttgaattatctgagatttgtagtgatgcaacttaacaaacctcacaattacaaggttgatatagtacttctggtctaaaaattcacagtaccaaataataaaaactttattgtaaccaaatgaaatcagatacgttagttaacagttgcaacttactctt

SEQ ID NO: 107229 - DNA, 1219 bp, Homo sapiens
tagagaacagaaatccatatctgattaaggtagaaggagaaactattgggaggattgagaggggaaggcaggaatgcagctagacttcaggaaccaaggactcagcttagttcttccctcttgtttcagtctggctttctctttgtggaaggaatcatggctgctggcaatcccgaaggcttacggttttaacacggagaaattctgtattttccctattgtacaaggtccaggaaagggtgagttggccctcacattgacccagtgtgattcagtacccacccttggaccagtcaaataaccagggggcatgaggtcatattaaaactgttgggaaactgcagagcaccttccagagaaggataaggcagggtactagataaacagaggcatcctcttctaggagaaagagtgttacatttataaagagaccactgtattttaaagaagttcttactgaacctttacatttatcttgggagatgggtggtggtatcctcatccgtgaggtagttgcatcctcaccagtatactggttagggtatgtaagcttgtggcagttaagtgtccaggatcttgaaaactggcatgtctagaatttgaatctaagtctgttggactccaaagcctatgtactttctaatgtgttagttgtctaccataacattagtttaggcttatttctcattcaacagcatgtgctaagagccttgtatgttttatttctgtgtgtatgcttataaaggtgagtagaatgcattgcctttctaaccaaattttataggttggtatggtaacctgacataaatatgcataattaagcatattaagtacagaaagatattattatggaaatagggagaaacaccaggagcttcagaaaggtttcacaaagaaaataacattgagtaggtatttgctaggtggataaaaggaggagggacgttattcttggcagagtggaatgttaagtgcagtggcacagaggtgagagcgtggagcatgtggggagtcacctatagttcaggactgtggaacaaagaggttgtgggaaaagtgaagagatgagaccagaaagggaatcaggggccagattatgatagcctttgtatcctggctgaagcatttgaacttcgttgtatcatcagtggaaaacagttaaaggatttctaaataagggacctacatgacccagttagtatttaagaaactctggctg

SEQ ID NO: 107230 - DNA, 2026 bp, Homo sapiens
acatttgtaattatttttcacattgacattaggttaatttagaaatttccattgtcttttctttgtctgataaaacattggggctcttatccagttttgttcagaagcaaataaatcaaagcatccttttctgctatatttctaattaattttacaaaatgaaaattagaagcagcacacaatccacacgtgtgaatgatcagattgaaacagcacatttttgaaacttgtaaatgaaaaattgattctaagattgcaggtaaattataggtagatttctcagtgttagaaacaaaaagaacatattattttccctggggatagttgataattccatttgaacatctgagcctcattttaaagacaaacatgtaaaaatatcttaaaatggtggaattggcataagtaaaataccagtagtagaattaaaatgacaaattaatttccaaaagttaatagatcatgtatgtgggaaagggctagatttacataggagtagaatttaaatttaggactacacttagcaaagtgacactgggaagtgaagctcaggtagtaatgttggacattaattgaatgcatacaagtagacagtttctgcttccacttcttgatatatttggaaggatatggaatgatgacccaacagtagaaggatgaggaaaagcttcataaagatagtgatatttgctaagtgtgattgttgaaatatgaagtgagacaatttggcaatttttctgatgtggctcctggattcggttttctttataacaaccttacggccataggactttgtatttatttttaaatattgtatggataacaatgattattactcaaaactaaaaacgtagatgattatccacatttctgtcttctaatccatcgacttataatttttaactttcctttctattacatattcacatacctgcataatcttttgtagttgtaattttaatagtgtgttcatgtaaaattaacttataggctaatttagcacacataagcatacctacaaaatacagtaaaacaaaaatttcaaaatgcaaaattttatcataagacattcagtatttataaagtaattactgtattgttcagagctgttattgtatttaattgaattcttcattctggagaaaaatctttgagaaagtatttcagttcaaaatgttagtttagaaacaaatatcaggctaatttttcagttcattatttgggttaaattagtacaacctatgaggacagaaaatacagatattcaaataaactagtatctaatgagtgccagtgcagtacccactgaagctgatgagatactcatgatttccaagggctactaaaacatcattcaccagctgaacgtgcaccctgatgggtgtgtaattgaaagaaaaactttgatttgctgcttgaattatgggagaatcccaagatgcacgttccctcaactgctttttaaggagagtggcccagaattccctgcaaggcttttgttgagtagggtgtgtgcaaccttgccttcaaaactgaattgcctgggatcaaagagaaggtattggcactctttatcattctctcattaagaactatcagtatgaaggggtaccaactgtgaactctcaagagagtgtgcatgtacctcagtatagtcctgagacattcagagaagagtaaaacattgttattgtcttcagagaacctacagtctatttgagaaagtaattcaagttggaatatatataataataaccaaggaaggatatcagaaggttatgtaaggcagagagaactcaccactcctggagaagcaggagacgcctactataataataatcaaggaaggttataagaaggttgtataaggcagaaaaagctcacaactcctggagaagtaggagacgcctcactgataaagtggttttagattggtaagctttgaagtttggtaggtttcttgtccacaaggaacagcagatatttgaagagtaagatcataagattataacctggggagtcagga

SEQ ID NO: 107231 - DNA, 2083 bp, Homo sapiens
ttggcaaactgaccccttacatctagacacgtttctatatagagtaactcaaaatttagatgcttagcatttaggttttagttagatcgtcttctaaaattactgaacatcatcatcatttaatatattaaagtgtgaaatccttctttccactgtagagatgtatttccctcctggtaggggggaaaacaggcttatatatggctaacacttagggcttactttgtggctggaacaactggactaagtggtttgggtttattaactccttgaatcttcactacaatcagctgagatagttattgttatcccagttcaaacgtaaggacattgagacacaaagaatataaggtaccttgatgcaggagggcatattactccataggcagagtactctgctttgcttgtttctggatctgatagtgtttgtatcatgttattaaaaaaaatcttggaacagtatagaatcagttacatgtctaccttccaaatgagggattgccttgtttttagaaaaggccagtctaccgggcgcggtggctcacacctgtaatccgagcactttgggaggctgaggcgggcagatcacgaggtcaggagatcgagaccatcctgaccaacatggtgaaaccccgtctctcctaaaatacaaaaaattagccgggcatggtggcacatgcctgtagtcccaggtactcaggaggctgaggcaggggaatcgcttgaacccgggaggcggaggttgcagcgatcgcgccactgcactccagcctggcgacagagcgagactgtctcaaaaaaaaaaaaaaaaaaagaaaaagaaatagccagtctaatcagacaagcaacattacttcattttttaaggtttaatataatttttttttaccagaacattttaacaaatacatttctctttaacagtgtcatcttatgtaaacatcaacataaatagaaatgattctgataattaaaagactttttttttttttagttcttctaaattgcttgggtaaattttgctaaatcatttaatatttaatctctttgtacctcagttttctacatcattaaggtgagcatgcatacctatctcatagcttaatataaatgaaatgatagtatgcaggaattttgcaaagggaaaagcttaaaatagctataaatgattattactaatctcgatcttactaagttgataaattaagagctaattaggtatacatcatctgaaaactcacaattatttgagatttgaattttctcatttttaaaaattaaattttttactcaaaggaccctaaagcagcccgtggtggaattccttttaagccagtcttcccagtctaacagatgttctttagggtctactgatattccctcacataacctgaaaagaagtctgtttaaaacacctttagaatttttaatgggatttgtacatgttgtaatgttcagctacaaggtagagtttttactctataagaagtcttaagactggaaggaaataaactgttgacagttgttgtcttttggtggtaaaattgtgggacatttctttatacttttctaaattttctgtaattcgcatatagtcagaataaaaattaaactgcaaaaaaggtttctttgatagattttttttctttatttgacaactgaaggtagaaatgcatctagtatggagaggtagaaatgtgcttcagtgtcttttttctttctgacatcattttgaaatagcagaatatattaccttcattccaattaatgtcatacatagctattcctcaatagattttctgttcacaatgacctttctttttatttggctccgaataaaatgtatcattagtttgaaaacttaccgacttttcacaacagatgtattttaaccagttctgtttcacttataaatttataaatatattctgtttacctctatttattatgttgatgtttcacatatggcttgtatttgtgtagagttctaagttggatatcaagaagttggtcttcgaaatcttttttattgaagactttttttctgtaaaatgtacctctcaaaaaaattaaattggtgaaa

SEQ ID NO: 107232 - DNA, 1047 bp, Homo sapiens
tcatctcatattgtaggctggtttccaggctgggccaaatgcttcctcagacatgtgcatttggaggaagggcagcttttctctctcaagggtgaaggggaaaagctgggtgatgggtacatcaggtttattcatctattctttctgaatttgaagcaaattttgcaaaagagcatggagttacccttagatcaagtatgctcccccaaaactgatattaattctcaaaaatatattgctgacatacgatgtgcaagctatgaaatgagtactggggagttaactaccagaaccagaagaatcagaaatcagaaacttgttgaatctgaaaaaagcaatggaacctgttcccagaaaatacaaatatgtaccaaattttgcactcaatttcaggaggctcaaaaagcctcctgaagcacaattagagctcccccgggagtctatgaacttcaaggctataaacccaacaaggctataaactgacccacggggcacaataattctaacagtatgcctttcttttcattctaggtccagaaattgccacaagtctctttttgagtctcagagaagcaaggccatcatgtataagccaggttgctttctgatcttaacttgataaatgaaatcagctgctgatatctcttcaacaagccctagcttcattctttctgcttcctatattgcgtactcttctttcagctctccacacactccacagaccttgacatatacagacccatccagttttcaggtcacactgacccttcctttctctttgccttaggctactccttagtttctgcagtttgcatcaaaatattccagattctaaagtgcagatttattaagtgtttactatggagtagggttggtagtaggtattttgcctacattaaattgctaaatgctgacaacaagttcatagggaaaggaatatttatgttgttctaagatgaggaagtcattctacacagacattagttaccaaagggcagaattgggatttgaacccaggccttcctgactctagattataatgctctt

SEQ ID NO: 107233 - DNA, 1005 bp, Homo sapiens
ataacaatttgagaaacggtgacacctttcacatctattctctaatcttgtagtgtggctgtattattcttattcttgctgtacagataggcaagcagagatgctgacagcttaagggacccagtcacaatctcacgccaagaccagaaagataagcagagcttcttgttcctaagtcaagctctcgacttcatccatactgtttatcattctaaaatatcttattcatctctcctacttaaaagccagatttgtatatgagaaattatttgttaaattaatgaactaatatttgaggcttaggaaatcccacagcaccttcaagaaattaagcaaatctactaattctaaaggagagatgtggaaagatgttattgaaccacacaaaaaataactctattctttcctatttcacatcatactgtatttaagcataagaggaaatatcttggccataaattattatatttaaaaactttgccaggcacaggaagaaaaatcctgcatattctctcttaaatgtggaatctaaaacaatcgaactcatagaaacccagaggagaatggtggttaccagaggccttggggtggggcaggagggagagaatggagagatgatgatgaaaggtttaaagcctcagttaggcaggagaaataagttgttttttggatatctattgcatagaatagcgagtatagttaataataatgtattacacacttcaaaatcactgaaagagtaaatttcaaatttctcacgagataaaaataagtatttgaagtgatagatatatttagcttgatttaattattccacattgtattcatgaatcatagtatcactttgtaccccataaataaaatacaactataatttggataacaactccaatattgtttaaaatacacacacacacacacacacacagatagaacaaatgagatgaaaatatatatacatgttaagtggttatctctgagtagtgggcttataggcaaatttga

SEQ ID NO: 107234 - DNA, 1049 bp, Homo sapiens
cagacagaactacaacccgcagacaggcatcttcacctgtgaggtccctggtgtctactactttgcataccacgttcactgcaaggggggcaacgtgtgggttgctctattcaagaacaacgagcccgtgatgtacacgtacgacgagtacaaaaagggcttcctggaccaggcatctgggagtgcagtgctgctgctcaggcccggagaccgggtgttcctccagatgccctcagaacaggctgcaggactgtatgccgggcagtatgtccactcctccttttcaggatatttattgtatcccatgtaaaaacaaaaaaacaaaaaacaaagaaaagaaagagattttatagaagaaaatgacacaccaaaaaatccaaatgaaaaacataattgcttcaaaacacttacacagttggaaagttatatgtaagtgaaaatttggaccattgtgtacaaataaaaactaagatgcatgtttaatactccacacagcagcctgtaattgcgaatgatgggatagagttatgtatcaagtactgacacttggttgtacccactggaatcatattagctgttttatgttatatgcttccacagtaacctgcttattcagatcagtcaaaatatatcagtatgaaagatcatagctaatgaaaggcactcactcatattgtttactttaaaatatttataaatatgccttaaagaaatacaaatgataacaattacataccgtatttacttgcttaatttcctctgtatttgtgtagatactttgacatggaatatatggtggggagacccgtagtgttaccgccccagtgggagggggccctggggaccctggtaatgctttagtcaaagggatatctctcttgtatcagaggctgtgtcttttagtaacaggagtcctcgtcagaattgcgtgtctgttgtctctaaaagaatgggtgaaccaatcggcctttgtgaatttattcagtgccttctctgtaccaagcactgggtaaggcacttttgtggagcattagacagtaaccctcaag

SEQ ID NO: 107235 - DNA, 1698 bp, Homo sapiens
gtacaaacacataaactctgaaacactgacgcacaagcgaaaacacacgcacatgtttgggtcttctcccgctgcgcaagttctttgaaactgagcggagaaaaatcgtcttcacatggtgtctcacactttcgacacaatcttatcgggaaacgtaacacgtaaacaaaattttttaaaatgcattatcaaaaacgatgacaatccctttcgtcttatgttcctttttgtctttaagctttggggggatttatgttgcgtttccaaactgcttctgcctgtcggcgcctgtgtggaaactgcgacgagtctgggagcggctgccggagaggcggggcagaggtgtgacgtcatcgccgcggggcggaggcgacagtgtctagcgggagctccgcgtgtagctacgccggccgcctggctttgagacaacgtgattctccgcagctggtcgcctacccgtgatgttctgcccacgtcgagacctgagctgaaatggcagacgatctcggagacgagtggtgggagaaccagccgactggagcaggcagcagcccaggtacccactctgtgcccgcgctcctacggggcctctcccggagcccttccgtgcgcctcagccctggtcgcttctggcgatcgcggtgtttgcccagcaggggtgtgcaccgccttgggagcgcgcaagcatctcggggaaaatggtgcaagagattctttaacacgtgaaacagacagctgtgacattaactcagatctgtctgccagccaggaaggatcctttccacaagctttctcttttccttatttcttgagaatggataagacagtttttgtgaagagaggcaactttgtatgatggttaagggtgacccatgaactgctttcaattcagactgaggtcagaagcaggggttgctgcttcagactccctccattcaaatcacgactccagtattctgatactgtttagcctccttttcctcatctgtaaaataatgataacaataatgtccatttcgtaaagttgtgaagattaagtgaagttagtacagtaatgcactttagcatagtgcttgacatataatgtgtggtaaatataagttactgtatttcttgtggtcatcatcattatcatggaatttggaatagtagaactggaaggaggcttaaatagagatcatcctttgaactcacttattttacagatgagaaacataacctaaagatgtcaagtaacttgacaagttcacaaagctagctcctttcagaaacaatactagaattcagttaacacaatttgaatagtttctactatgctctgctgtgtttaccaactcctgatgcagtgggcatttcatccccaagtagagtagcgttaagtgaccccccatgtcaggctagccttgaactttttaagttccatcacacctaccatgcaattattggttggttggtttttatcactcctcaaggtctgcctcttttctctacaagagaagacagggccaaagtcagattcatacttctgtcatccacagggccctgcacatgttagacacttgatacctatttgctgcaaacaatcttgaaatactagttgtgaaatatccattaaaaataaccaacttcatttgttgcattgtttccggaaggtcaagccttcaggtacaaactaagcagatgtcatttttagaaagg

SEQ ID NO: 107236 - DNA, 1040 bp, Homo sapiens
cccggctaattttgcatttttagtagagacgaggtttctccacgttggtgaagctggtctcgaactcccaacctcaggtgatccaccgcctcggactcccaaagtgctgggattacaggcgtgagccaccgtgcctggcttctacctaaattttttagtactttgtatactatcttgtccctctttttgtgcttcctcttaaacttatgctagcttggataaaaatgtactttaggaagtctcctgacatgggagaaaacaattttgaaagcttcaacatacaacgtattttgtgcttcatttcagagtaaaatttttcccaaggtattttgtttttctgggactattgttagtgcatgttgtttttcctgttttatgcttcttttcaacctgtttggttttcactaagggattccaatgggttttttttctattagcataattaccaatgttgaatgtcacctgggcataactacttttcctaaccctgtcataccattgctatctcttagcatgttttctcaagtgagaaaatgtcttgactgaatggccttctcttcttcatttactcattctctattcactctagatttatcaaatacctgctctatgtgaggcacaatactaagcactctgtacatacgtgtatttttttttttttgatgttagagcttcatcactgcacccttttttttttttttccccacaaacaaggtcttgctctgtcagtcagtctggagtgcagtggtgtgatcatgctcactgcagcctcggacttctgggctcaaacagtcctcttgcctcttcctcctaattagctaggactacaggtgtgcaccaccacacctggcttttttttttttttttcttttcggagagacaaggtcttgccaagttgcccagactggtcttgagctcctggcctcaagaaatcctctcacctcagcctcccaaagtgctggggttactggcgtgagccaccatgcccagtcttcaccttcttttgtagtccatccccttctactattctcttcctgctt

SEQ ID NO: 107237 - DNA, 1445 bp, Homo sapiens
ttaatagttgggcatattcataggttatcagaactggaagggacctgaggaattatttcactttcctgttttacatgtggaaactcaaggcttagattgatgaatgcaaagctcgttgtcacatgaatgaaaatctaggattggaatttgagtctcctaaccccaagcttttgttgaatcaactgattttcgatagtgtttattcagagaagagatatgaataaacaatgtcctgtgagatgataaattctgtattttttcaagcacctggaatattgattcatgtctccctaaaatatctcaatgttactgagactaagtgccagtggtcaggtatgcttactacaccagtgattgtcaggtattctgcacaaaggatatattcggctgttattcacttttgttatgcttttcctcctttaagaattatcactttgctttttccctcctggtcataaagaaatcatagttttagaccttaaagtgtgattttaattgtcctgtcatcttgatggaaataatctgattttcttgactcagattaggaatttttgctatcaccttttcttagcaaaatatgattaatcagcaaagttctgtagaatgaagaattacttctgttttcaccagaaaactcttgaactgttctagtgaattcagtcctatcccaggctgattctagatagttcatctttgggttagattatatgtcggatgaggaaatgggtagatttgggtgtgggtctaggcctgcgagtgtttgtgtgtgcatatacacatatagaagtaaaataattgtagacgtgctgctttttgggggatgatcttcatcaggtccacaaagctgcttcaccatttcctggagagatggtcctttggcctttcatagtggtaattttagctttccacatatttctgtagatgaatgtatccaggcagtgcattggtatgagttaccttctccctcccacgtggaggaaggtgttggaggtgacagttctcacgatgtgtagcttcccacagccattttggtaaataggcttatccataggcactgtgggggctttagtggaaatcttggtgatgcctgtagatttcggtttagggatccgtgctgggattctctgcttgcatacctccttgatcttgaattaaacaagagaacaaaaggtaattaatggtacagttggtggagaagtagaaattgtttaggacatggagtcagtttggaggatttggctttgaaagcaccagtttctggggatgtatcagatcaaagatcgtcaggttgaagaaaagaatgtcagtaaagtaatctggtgtgtgttgaatgtgtgctgtgtgcacagttcttgatagagatagtggtagatacagagatgaatagatatttggcaatcacggtgtagtaggacatatacaagagtagtgtcccaaattaatct

SEQ ID NO: 107238 - DNA, 1373 bp, Homo sapiens
catatttgataggtttggcctaaaaaaatagtaataatcgtccattgttctccctagtcttctcattgtccttagaagctataatcagcagcctcagaagcatttatatttttcagtttctgtaattaatacatactcttataatcaggaaatttcatatgaaataaatgggctgcttatataaattactatgagagctgttcttctcagcatgatccgtactcactgattccctccctgttgccctaaaggaataactatctgcctcttgtgttatggaacttttgaggacctcttgcagtttttagttagctcctgtttatataaaacagtggttttctgaggcttcaaaagtgactgatctcaggcacagtgaattcaggcaagaacaccatgaaaaggcataagaatagaagaagaatagctttttctagttaaagagaagagagaaaaaaaaaaaacagccaaaccactaattgtaaaggataataatgcatttttgaggaattactttgagttgtttgaagagtgtctgtgttgatgcagattattgtattgtgaggggagacataggagccaacttgacaactttcctttgcagtggcagtttttacttgggatgcttccttggtttacagttttgtactcctgaatttggagactgacagggttgaaccccaacacttctccttctgacctgggaagatacatagtgattatttctaaaaaatgattttgggagtgccagtcttattaagttacagtgttccttgagaaatagaaatccagatttagagtgtaccatctgggaaaattttctgtttctgcaaaggcagaatcacaccaaatgtggcctaagttggtggtgcttgtctttatagtggctggaccttgatcccttgattgccttttctgaaagtcttgggtcattatcataactgtcaaggcagccacctacttataagctcagatgtgcatggttgtgatgttccttccgtgaatcattttcactcacttctgatgcttttctatcccatcatctctgaggctaatcaggtacctcctgctctgcacatattgattgcctgtccaagctcattcttcatgcttggcatttgtgccctttgcttatagaatcttaccttaggataaagtggacactgactgcaccttttgtgttctgagaacagtctcctaatgagaacatgagcttctctttggacttgctttctcacatctcctatcccaggtcagtcttccccgtgcctgcccatttgtgtggggcttggcttctcacattcattatctcttgtcaccctaacagtggcttcagggaagcaggtggagttggaaggagaggcaaatcactcttg

SEQ ID NO: 107239 - DNA, 1011 bp, Homo sapiens
acagaaatcagtgccaagcatgcgatattcagagtctccccagaccggcagtcatcatggcagtttcagcgttcaaacagcaatagctcaagtgtgataactactgaggataataaaatccacattcacttaggaagtccttacatgcaagctgtagccagccctgtgagacctgccagcccttcagcaccactgcaggataaccgaactcaaggcttaattaacggggcactaaacaaaacaaccaataaagtcaccagcagtattactatcacaccaacagccacacctcttcctcgacaatcacaaattacagtaagtaatatatataactgaccacgctcaccctcatccagtccatactgatatttttgcaaggaactcaatccttttttaatcatccctccatatcccccaagactgactgaactcgtactttgggaaggtttgtgcatgaactatacaagagtatctgaaactaactgttgcctgcatagtcatatcgagtgtgcacttactgtatatcttttcatttacatacttgtatggaaaatatttagtctgcacttgtataaatacatctttatgtatttcattttccataactcactttaatttgactgcaacttgtcttggtgaaatactttaacattataaaacagtaaataatttgttatttttaccattgcttgctgaattttcttttggtcattctgtgttatatttctgcatgtacaatagaattttgtcttttgcttatagtctctattaattcttccttaaaaacaaacaggacctatgtcccatttatggtcaacttctaatcacatattagaggagagaaaagtggttcaaataaataaaaattacatctctttgatttcaaagtgaactataagatctttcagaagcaaacataacttcatgcttgggatatatttcagtatctctaagagcccagcacagtgcttagactacattaggaacttaaatgtttataataatgaaata

SEQ ID NO: 107240 - DNA, 1057 bp, Homo sapiens
tagttcactttgaaatcaaagagatgtaatttttatttatttgaaccacttttctctcctctaatatgtgattagaagttgaccataaatgggacataggtcctgtttgtttttaaggaagaattaatagagactataagcaaaagacaaaattctattgtacatgcagaaatataacacagaatgaccaaaagaaaattcagcaagcaatggtaaaaataacaaattatttactgttttataatgttaaagtatttcaccaagacaagttgcagtcaaattaaagtgagttatggaaaatgaaatacataaagatgtatttatacaagtgcagactaaatattttccatacaagtatgtaaatgaaaagatatacagtaagtgcacactcgatatgactatgcaggcaacagttagtttcagatactcttgtatagttcatgcacaaaccttcccaaagtacgagttcagtcagtcttgggggatatggagggatgattaaaaaaggattgagttccttgcaaaaatatcagtatggactggatgagggtgagcgtggtcagttatatatattacttactgtaatttgtgattgtcgaggaagaggtgtggctgttggtgtgatagtaatactgctggtgactttattggttgttttgtttagtgccccgttaattaagccttgagttcggttatcctgcagtggtgctgaagggctggcaggtctcacagggctggctacagcttgcatgtaaggacttcctaagtgaatgtggattttattatcctcagtagttatcacacttgagctattgctgtttgaacgctgaaactgccatgatgactgccggtctggggagactctgaatatcgcatgcttggcactgatttctgttggttctggggagcgtccctgctcaggagagctagctgaaccagtcacagccaaaacctgaataggggacattgtcctttctggagttagagaaccacaagactctggggtctgtgctctggcaaaggttgccatggtaattggggacatgccttgttctaa

SEQ ID NO: 107241 - DNA, 1044 bp, Homo sapiens
tcttcagttgccatgtattcatgaattttctcttttaatgcatccacttctcttgagaggtgccctgacttagcttcttcttcttgaagccttttgaaaagccattgttcatggctggtctctgtcttttctgctaacttgtacttagcaagttccattttaacatgttctagctctttagataaaaattgagctttgtctcgttcattagcataccttcgttctagagtctcatattcatcttctgttttcatgaggtcatcctcaatggctttcatgtcctttagcttcagtttcagtctttccacttcttgagagagctccttaatcttattgttttcttggtgtaatgctgttgtggatttcccagagtcttgatttaatttgttttttaggaaatctttctcaattgcttccaatgattgaagcctatttttcaacatattaactcttgacaggagatcatttcctttctcttcttccgctttcaatttgttttttaaatcatctctctccttggttacgctgtacatcttttcttctacatcggttttggacttgagcgcccttttagtttcctcaattaacttctcagtaactgttgttactttattttgctccacttgaagctgagaagaagcagcttgtaatttatcttcagttttctttaatttttcactcattgttttccgttcatctacaaacatcacagttaatgttttcagtttagttaaatcctcttttagagtgaattctgtcttttctagccgactttcaatggcttctagctctttgatccttacttttaaactctccagttcttgagacaactgctttgtggtcatcctttctttttctaaattgcatttcagagagtagcattcttgtttgcttttgttgaaagcgtcttctaacttttccagagccataattcttttactgagtttttcaacctctagtttaaagtctttactctgtaacgtctccctttcaagcctcttattgagatctctgcactgctcctccatttttatgagctcttca

SEQ ID NO: 107242 - DNA, 1093 bp, Homo sapiens
atcacaaaataaaatgcactttacatttttcagattaaagaagctaattgatcaagaaatcaagtctcaggaggagaaggagcaagaaaaggagaaaagggtcaccaccctgaaagaggagctgaccaagctgaagtcttttgctttgatggtggtggatgaacagcaaaggctgacggcacagctcacccttcaaagacagaaaatccaagagctgaccacaaatgcaaaggaaacacataccaaactagcccttgctgaagccagagttcaggaggaagagcagaaggcaaccagactagagaaggaactgcaaacgcagaccacaaagtttcaccaagaccaagacacaattatggcgaagctcaccaatgaggacagtcaaaatcgccagcttcaacaaaagctggcagcactcagccggcagattgatgagttagaagagacaaacaggtctttacgaaaagcagaagaggagctgcaagatataaaagaaaaaatcagtaagggagaatatggaaacgctggtatcatggctgaagtggaagagctcaggaaacgtgtgctagatatggaagggaaagatgaagagctcataaaaatggaggagcagtgcagagatctcaataagaggcttgaaagggagacgttacagagtaaagactttaaactagaggttgaaaaactcagtaaaagaattatggctctggaaaagttagaagacgctttcaacaaaagcaaacaagaatgctactctctgaaatgcaatttagaaaaagaaaggatgaccacaaagcagttgtctcaagaactggagagtttaaaagtaaggatcaaagagctagaagccattgaaagtcggctagaaaagacagaattcactctaaaagaggatttaactaaactgaaaacattaactgtgatgtttgtagatgaacggaaaacaatgagtgaaaaattaaagaaaactgaagataaattacaagctgcttcttctcagcttcaagtggagcaaaataaagtaacaacagttactgagaagttaattgaggaaactaaaagggcgctcaagtccaaaaccgatgtagaagaa

SEQ ID NO: 107243 - DNA, 1053 bp, Homo sapiens
tggtctgcgtttgcagttccttctctagtctggttgccttctgctcttcctcctgaactctggcttcagcaagggctagtttggtatgtgtttcctttgcatttgtggtcagctcttggattttctgtctttgaagggtgagctgtgccgtcagcctttgctgttcatccaccaccatcaaagcaaaagacttcagcttggtcagctcctctttcagggtggtgacccttttctccttttcttgctccttctcctcctgagacttgatttcttgatcaattagcttctttaatctgaaaaatgtaaagtgcattttattttgtgattgatgctttagtaactcatcgaatgtacttaaatatatatgtaatttagaaattatgtaattatatgagctgtgtcagttcatatacaatatgcaaaagagttcctgaatttgatgacagaggaaaatcttgataaagttatcttgcttttttatttgactaccattgatcagtaacagctgcatttcaccaggagccttagtaaaagagtaagggcaagaatatttagtttaaattgcttgggtaacatgtaattagtaggcagtctggcctgaaggctgtgaaaatagccacaagcttgagatgatgcagttagacctggcttcaaggccgaccctactcttaccaactaattgatctgggcagttatttaacatctctgagcctcaatttcctcatatgaaaaatgggggcaataattttatttacttcaggggctttttatgaaaattaaatgcggtaattcatctaagattctcattgtcctggcacatggtaagcatttggtattagttgttgctgctgtctttattaatatggttattatatttatcaaatggcttgcttgaaccaaagtgttcaattaatgtttgatgttcaagtccttgattcttagttaagaaaaaatttagtcacattgcttagaagttatgcacttcactgatagacctctgtgccaattaaaacttggtttgcactagcacaacattattctaggaactacttc

SEQ ID NO: 107244 - DNA, 1050 bp, Homo sapiens
atttgcagacacatataatatatgtcagcacagatgtgtgcctatattttatctcctctgtgagacactgagtattagtaataatgcatcatataatacacatatgaaacacatggtatatctaaatgctataataccagtcatacccataataacttatattataattcttaccgcttttgattttatcttattttttgtacattacagtcaaccctactaaaatacagacttcttgagaacaggatgagtatcactgtctgattcatttctgtgtcctacagtgtctaccacaaagcacttatatgtagagggaaccacatgaattttttttgaataaatgaaagaatgaacaaatactcccttttgtgaaaaatactgtagcactgtcctaagtagttttattcactatttaagaggatgctctaatatttaccatgtacatgtttttaggcatttaagaaaatgaggtatgagtgggtttcccatcagtgttctccaagaacattattttctctatttcatagctacagagcctctagaaagaatcaacactgttggaacaggtccttctctcctttcttcagatccctgcattagaactgtatgtgcttgcttgtttgaggagaacagggttaggtggtaaacgtccacatcctagcccatcagtctcctttggctttatcaactctgctaacaaaggagtgactattttatgttttcctcagagtccagagatctactggacaaatatgtttgtttattacataagcaacattgtatcaacagcagtgacagtggaaaggaaatatctataatctgaccaccctaaaacatcaattatgtttctgttttcacagattgttttgcagtttttcagatgcttggtccatagaaataaacttagggtgatcatcaagcaataaaacgaattccacaagccattaatggtactgtattgtttctattagtttcagaaatcagcctgtaaatagagaataacttcagagtcagcttagcttctcatctgtctctttaaggaaacctatt

SEQ ID NO: 107245 - DNA, 2164 bp, Homo sapiens
tgccttcaaatgttctctcccagtccacagaaaagtcctaaatgacaaaactgttttcataagacattgtgttttgtttgaaactccaatttgaaataagagtatggaaaccactaagttgcctggtttttataaatgggtccatccatagtgctatgcagttcagctgacatttaattcatttcagaccttgatgagacaaatacagtgacagctactatgtgcaaggcactgtacttgctatttgtcagttcttttttccccaaaacctgcctgtattcttgcacagatcagtctgatcatacttacagtattctcccagtaacaaccaaatagtatgatgataccaaagcttgtttggtcttaagatgtttgaaacagtgtaacagtcaccctagtcctaagtatgtaacttcattttgatgggcttaaattcctgtatttgttctcattattccagagctagtttaatacattactttttcttcctgatttaatatgttgattactaagcagaaaactgcatacatcacactcctttatttatttttatatctgctctcacagctagactttgatagcctgattatgattatatcccattttatcttttagcaattcttgtctaatacataattttaactgtgttgcgttgatagtagctgtgttcatggttaaataaccatggatttctagcagtttgcagagtaattacatggaatttattggaaagcttctttatttgagataaattttggtatcaggcctataatttatgtttccttgctttcctccctgctttttctatgggacttttcactgtttagtctaaattttaagagcactcataaaaatagctgtgacccgtcttttttattctgtgtatgctgcttccttgtatttcacaagtcaaaggttttctaaaaattacagctacagcataccatagccataatgtaatgtacaattcatttgacttagtcagcaagatcagtagaacagtaacactttttttggcatctgctagttgaatatgagtgtacatctatgtctgctttatgtccttgttactgaagatcctgtcatcatcactgagatcctttagagataccataaatgggtccagacccagcaatttgggttaatactattttccttcattgtgaaataagaattagggcaggaagttaagaaggaggctttagcttggtgtcagaggaatatatggtaaaaatggtatactgttagtcattactcttcatcacctgaacgattaatcttactaggccccccagaggtcaggagaagtgaaataagatggaaatagtcaaatgacccattaattataaggagcttggtagcttttagcagagaatcaggattctaaaaagcggtactgaaatcctcaaattgagcacaaggactggaattgaggcaaatctcactcttttaagagcagaaaaaggagcaaagtaactgagaaaaagggtctctgaaaggtgaggttccagaacaagtaaaaggccagtctgagggtccacaggcacagaacttgggtagttaggcagctacaaggagaatattttcatcttgagaacaaaggaggtgcccatgattctgggctagaaaagacactgtccatgctgctatgaaagggccaggtggagacttgaaaagatgctcaggctagacctggaagaagaaactggaactgacaggggagtgacaacaagtacagcacatgtaaatttgtaccaggataattactgcctaaataatgtgttttgacttctgcagtactgtattgttagggagctttctagtaagaacctttggacaatggatgttcatttaataccgtgaatattgtgcctctcctatcactcttttaatttttcttattaaaaatacctactcaaatgaagttttctttatgccgtttactcagatgacatctatcaagaaggagcttttaaaaagttaattactgtgaatacactgctgtgctagagagtctactcatttttctcacttttctttttgttttcctcccccaccccctgctcccaccaccactctgaattggggttcttgattatttagaaaagatcccttaaatcaaagtttcctcttttccatactttccattttgattgttaataca

SEQ ID NO: 107246 - DNA, 1720 bp, Homo sapiens
cctaatgctgctgctgatctaacaggaggcagagttcaggcagtaatgctgcctcatcccgctgctcacctcctgctatgtgacccggtaataggcctcaaactggtactggtcttcggccctggggttggggactcctgtacgtggggactcaaagtctgggtgggttgactgggttagtacactgtatatactattcctgggcttggtttccatagtcaaaaatgtcaagtagactattaaggatattttataatttttttgactcttcagaagaaaatacaaagcagcagattgaaagataccctagttgtctgagaaataggtcatttggggttttcatattgttggataattaatttttcagtctattttgtgtacttttaactctttaaatttcaattatggatttttagattaaattagtattcctaaatatttgacacatatttcaaaatgtgtgtattaaaacgtatactaggaacagtcttcctcttaccacatcgttcatctccccaactgtaaccactgatactagtttctcttatgtacttgtagagtttctttatgagtacataagcaaacataaataaagattcttatgctctcccctttttacacaaaagtagcttacaaacactgttcctcagcatcttgttttttgcagccaaacatttcttggagatctttccattggatcagtgttcttaagcaggagcaggaaaagggaataaaaataaacatggttgctaaatacatctttacaacttcatgctaaagaaattaaactttgtaggatctatttttaatggaattaatatgtaggaggtatggaagacatatacttttgctgttttgaaattattaagatagattgtaacagtaagattatttgacttataacaacagcttgagtgttgtatatctatctttataatgtctgtgtagagcacatgcatttattttcttagttgaaaaactgaggcccaggcagattaatactatgcaaggccatcattatggtggccctggaactggtactagagtgtgagacttggcttataaagagaaggaaacaagcatattgaaggtctactctgtgccactagatctcacttaatacttatagcaactgtatgagctaagtattattattctcattttgcagatggaggagaaaccaaaaaactaaaatttacagaggttaaataattttccaaacagtacaggtaacagaccagaataaaaattcactggctgcgaagtctgtgttctttctacctaacaaccaggctacatgccggaaaccccagacaaaaaatgttgacctcagaagagtttcctcttatcccataccatgtttttggtgttcatttgttcattcccatgctttctgctccacccacttggctccctgaccccttctactgttctcctctttgctcactctgctcctctgcccactcaccagcttctttgctattcctcaaacagaacacggcatggtgtgcttttgtgctcgctgtctccccaggaaccactggattccccctcacctcattagtaccatctggcatactatattttatgtatttattgattactgtctctcctactagaatgtaaactacatgcaggtaatggtgtgtgtgtatgtgcgcacacacgcatctcattcaatgattagtcaatcattggtctattttgtttaatactatat

SEQ ID NO: 107247 - DNA, 1056 bp, Homo sapiens
ttatttgtcttttaacctcaggttctcctttcataatagacttctgaagaataagtctgccatcttttttggaatgctgcattcagtcatctccatttacatttcagttcccatcttttccatgaatgtttcttaacttgtctaaccctggctgattttccttttctaagtccccacagcccttacagctttattacctaaatattctacattattttgtactgctttctaatttgttttagtatattacttttgccgttaagccaactgtaagctccttaaaggaataatacctctgtatccctcatatgggttgaactctgtgcatacttgaccaaatgatagagaggtaaaaagaaccacttcctaggggagtataaccatcccttaggctgagtggtacctaaagttctcagaatgacttgttattagaatggaagaaggacaagtagagttttgttcctcttgttcttgtcacttctggaaggagaaccatttagtgaagagaagaattcacttggagacaaatttaattaaagtccagatggggaaaattggccagagaatcttaactttgcctgtgattctttgcatctgtgttcagcctaatgaattttattgaactgtaaaaagaattttatggggcagaatttggggggagattagtggagccccaaatcacttggcaaagttactctcacttttatttgaaagcctcaagaataatatgcgacttcaaacataatgtatttattttaataatatgagtgtttgaaaagtagataattttccttttagcagcagtggattcattttcacaaaattccacagagtaattcacttcttctgccattcccaattaacagactaacaagttaagactaagggacttccacaatatctcactgaatgggtgtttgtcttcagcaagaaaccagcaactttctcatgttctctctaggctcctggaccaggcaactccttccttttcttcaaatttaacaggcagacacttaagtcttgcgagcccaaatgtgatgttttacattccactta

SEQ ID NO: 107248 - DNA, 2046 bp, Homo sapiens
aatttacaaaaactaaacaatcagtttaaattgaagctgaattcatggtcaaatacaaattaaatggaccttaaaatcgtttaaaattaatatgtccaacagataaggtagggtgtattagatttttcaaagatgacaggctctgtgaacaacagatggggccatttcagttcctgaagcaggttgagaccaatattgccttacatccacaatatccagtcttttataaacagttctcttcttgcccctcttcctttttcctttaaataggaggggctgtatgttttttttctattcaccttgtaaaatgttcactttgccctgaagcactagacatggacagaacatgacctaagcagaattattggaatcttattcttcctcctacattttcagttttttttcttaaatctcaaaatccatttattaccaaaggcacttttttggaggggaaattacagcagagaacccttaaacaaaatttacagccttttgagaaggcaaattaatgggaactgcaagagaaccggaaaattaagtcaaggcttgatttgtgttttcatactggctgttactatagtctccatcacagcattaggaaaatagcacaaaaataccagggcttaacagttaaggttaatcaccacaaaagtgcaaatgaacttactaagcataaaattattatgtgctttatttggaagtgtagaaattcacattcattctatcaaaaacattttcccatcatacagattgtcccaaggactaagaaattgctcatccaaagagcccagtgtgagatagggtatccatgataagtcatacttagctttcagttttaaaagaggtcttatgtgattgttctttgaaccatgctttaaagttaataaatgggaaaaagtgtggaatattaaagagtgttatttttaaattttaaaaaatcgatgcttgcctgctttaaaaaaataaaagacactgggaaacacagctgttagaattttgatggaagttatgattttcaacagttgagttgtagtttatggtacagatggtactctgggtatacctgaaacaataattgatggtttctgtttgtctcttcctctgttagattcagaagagcagaatatcttttttccagagcaggaatttttcagtttccaattaccgcttatatcagataaacaactcttccattgcatattctgtacttctccacagtgacatgggtgttggccccgctcttctcattatggtgggcttccctaggtttgaaataatagtttgtggaaaatcctacttctcagtactaacctgcagtttatatagcctatcctcaggccaaataacatataatttttcttttaaaatatgaaaaccaaagtcgtgcattgctccaaacaaaattagcaaaaacaaaaaaactgctatgaggcaaaaatgataggcaccaatgtcatatacttttaaaaaccatccaacagaaattattagaaatatacagatataacccacattttgagtattttttaaatgctgtgtttcaatgataaaatctgggatctgacattttcttctgacaattaaatataaaaacatgagtttgtaacacacacatacacctcagtggttatagtgctctgctcctctgttaaacttttactgtacctccaaacagttatcttatatggtcattttagtgccaactaaaatgccagcattttaaaatctcagagtaaatataaatggcagcctatgaattctgagtttgaattgtatatacttataaaacatagagactgttttaaaagggacaattctgtcacatagttgttaaagttttattttacaatatatgtttagaccagataaggattgaatgatgaatcaatttttcatctcctattccagtgttctaaagttgacataacctttttatttttaattcctacgttgacttttagttggaaaaaatgaagtaaaatattatggagatttttctgccaagtgttcagttatcatactgtaagagttcattggtagcaatag

SEQ ID NO: 107249 - DNA, 1942 bp, Homo sapiens
agaagtcatacctaaagttctagcccaactatatgaatctgctaaataaattagggacgtggcattcttatttgcaagcttcagatgagtaattttagtagcttgagtccttttaaaacctcttttaaaattacattaaaataggattgcttcctattatgatgtacatatgtctgtagaattattgtttccatatgttttgtcaaacaagaatgacgaaaatagtctgctcgcttcattttcttagtgtggagtggagaaaggatgtttgcagagttgttagtggaaatggtgtggaataaagatgcagggcacaacattaaatgtatgtcctcttcactaaattgggagttcactttatcattattctagatcactctaagtacctactgagaaacctaaagtaaactcactcttgcttttcatatacagtatactaagagatgtgaattacacatactcttcagccgaacttaaaatttaatatttgatttgcaattgtgtactaacattttggatgttgagtttgtagttttgttggttttaactcttctgccctatacttgtgaattgcattgtaatctttttagtctcctgtgcttacctcatacttattaaatatcctttttgagacttttatgctgcattttttattacaaatgagattaaatgacttttatgaaagttgtatgatgcataaacacctgaatctcagccccaaactgatagcatacttttaccccaaagctaacagttttgtagcttgttttgcatctttttccctctgataggcaaatatgtttcctaacatttaacactaccatttgtttctttctcacatatccatactcaagttttgcatttattttcattcttttgacttgctggttcccatgaaatatgttagtattatttcctccttttctttagctatattctgaagaatagaggaaagaggattagggcttctactccttgtatgcccttgcctggtacactacttgcctggttacattactaatgtgttactcctgaaacatcagtctcttgacccagctatgactcagctttccaagtgaggtcatagttatgtgaccactgtcttcaggaaccaatattaatagccctcatttgttgagcttttagatcatacctaccaccatacttagtgctctacaagcatttcatcatttaatcttcacaacacattttgatgtgatatgatccattcttttcagataaagacatttagaaggctaaagtggcttgaccaaggtcacaccgctactaaagtaatgatacagggatttaaagcaatgtttacatatatagccttctacatatatagtcttacatatatagccttcttctacataaatagtcttgtcttctcctaatagtttgttcagaatctctcagaggtatgtttggtaaaggagtgttcagatttaactgagaagtttctgtttattttctagactgaatcttgaactgggaaagccaagactcatcctcttttttgtggatttgtggatttactgacagttttctggaaggtggcagcaacgtatcttgttctagtaaaattagaatatcatcaccatttcacttcaaacgaaagtcaagggttttgagggagcaggacctttaactgatacaagagtaccctgggtggtgtattgcaaactccaaccagctgttggcattgtgcgccattggccacataagtagatgagtagacttttatttccttccctctttcaaccaaaattctttctgagatgtaatttttattctcttggtttctgaaattttcttcatttgtgaaattctcttggtttcatttgtgaaaatagtagagttatgatcactgtgcctcaaaattggatgagagagttttacttcctaaccttgttctgtccaattacttttgtgactttct

SEQ ID NO: 107250 - DNA, 1008 bp, Homo sapiens
gtggatggaccctgtatgtgtatgtatatgtgtatgtatattatgtttctttttgcctttattatatatttctgaatcatgttagtggcttttctgtagacattgggctatttaaaagcgcatgtttacatattctccctagcattggtggtcacaaagccaactactgcctgttggccccctaacattgccacggtcttgttcctcatcaaacaaagcaaggaagtctatttaataaggaatcatctgttggtaagagacttcctacccttggtttacaggggatgccataagttggctatggactctagtgagcatactagtaggtaagtagaatgacttagaaagaatgaagaattggtaatgtgacgccactgtaagattattaaatgggaagcaggaaaagtctgttacttaggtccagtccatttgcttatttattcctacaaacattttgtgtttccttggtaactaataatagttttgagaaaatgttgaactcacaagtattactgcagaagtgaaaaaaaacccccaaatcacagaaattagagacggaaaagacctattaggtcatcttccctgtcccttgccagtacagattgttctcagtgctttgttcagtccattttttaaagggaccttgtcatataatttgtagcccatctctctctctctttttttttttttgagacacagtctcactctgttgcccagattggagtgcagtagtgcaagctcggctcactgcaacctccgactcctgggttcagacagttctcctgcctcagcctccctagtagctgggattatacatgtgtgctaccacgcctggctaatttttgtatttttagtaaagacggggtttcaccatgttggccaggctggtctcgaactcctgacttcaggtgatctgcccgcctcggccttccaaagtgctgggattataggcgtgagccaccgtgactgacccatttcttttttaagtaatacatttttaaagaaacc

SEQ ID NO: 107251 - DNA, 1090 bp, Homo sapiens
aaagcagatagctaattcctttaaagttagctattttaaagtaatcttcaattgctttaatctcaaatcatttatactctacagataatttatttttctgtgatgagcagaaatagtttcatgctgattgagaatgatttttgtttgccagcatccctttatcaaatatagagatacttaaaaatatctttaggttttacttccctccaccccaacccaagacgttttgaaggtaaaaaatctggctccccctttgccaaatccacaaatatttctgtgagttgctctacagttttcttctttttgaagctgggtgtcaagatattcagtattcatttattaaggacctgctatgttaagtgagatacattttggaggaggaaggccagttaacatagaaccagcatataatagcttcagtaaattttctttcctctctgctatgatactcaaagtttttttgtgatattgcagaaagtaagacaaatctcctgctttaagacaattacagctaggagttggttggagaggtattaatagaaaaggagataggatggttaaaaactaagtagattgcataagatacataaataaaatactctttcagtgctaagggagaagatctgtatctgaaaaggtgtaagagaaggtggcacttaggagttcaggtgaagatctgccccatttgttcatctgttgtgggtgcctaacaggagctagtctggtgccaggtctggccagaggtggattcactggccccattagctttgtgtgctggtgtgctattttcttgtttccacttttagttgtcacctttttgttttgggttggttttttgatacttctaaagtctgtgttgcttattatttcttttgctcatggaagaaatgtaggataatgctgaatttactctgaatttagatcttagggcaatttgctttcttacagcaaggaggaaagtgaatactttaattttttaaatgtaggaagtttactatcttgcagaaagactgtttcaagatatttcctcataaaaacgatattattaattatggagttgattcccagactagcacaaggaagcttactc

SEQ ID NO: 107252 - DNA, 1041 bp, Homo sapiens
catcagaacttccataaagtaccaaatgggctgatcattgtgtaatcttccctctttcttcttttccacgcaagtcttaagtgctgatactcaaactgagctgcacgttggaactacctggtgtgagcttttagcacagttgctgtttcagcctcagagattctgacctaattgatgtgccccggttatcaggttttttaaaagcttctctggtgattcttacatgtagcaaagtgttagaagcactgatctaaaggaaaatgaaattggcctaggccctagagtatgcctgaggggaaggggcatgatggtagtaggatctggaccctggagaatccaggagttgaaactcaagccagtttgctttgcttcttattgataattatgaaggcaggcagggaatactgggtggaaatactggataacatttggtgtggaatttaccaaaggattaaactgtatacaacattcttttaacttgttatttaatacaaatcaagtaagctttagtattgctttaaggattgggtcttagatggtcattacaaatcttcaggaaagtgttgtttagaaaaacaaaatggctacacgttgaaataggatagtaccttcctttagagatgccaacttaattgctccaatgagaagagtagtctccctttactaaactgtttaggaaaattgatatttatttctaatgtttatggtttgttgtctcagaagattaatgccaaatcctcaaaaatgtagtgacaagcgatgactcattttagctcatgtcaaaacaatgcacttttgtaattttcctgtccctggagaagctattaaacactgaacaaaatgcctcagaatgaaactgattgagtgtttcaaattatgtacttttgcttggctattagccagatgttcgtcgggaaagctcactgtacatcaaggcctatgatttgtgctgacaataatattacatagtttacactgcttaaatatcagcgatgtgtattctaaagctaaatagtcaaagttcagtctctttgcataatc

SEQ ID NO: 107253 - DNA, 1231 bp, Homo sapiens
gcagtgttttcagccctagcatttttgaattatcaaattaaaatagagctttttaaaaatatatttactatgcttctttagaataggatattccattaaaatgaggtcaaagagccttccaaacattaattcttgttattttgacatctttttatttcaaacatagtaagccttgaggtttccttacttttctcttttttttgtttttttgtttgtttgtttttacttttctttatggctgcttattgccttccagtcaattttagattcatgctaattttaccccattatcactgtagcaactacctccttcttgcctcccacacccacttctcttctgcgagacttcgttctatccatcctcttttgctctagaatcttcaatctcagttggcttttccccctaatttcactgtttctacaagtgaccagcctctctctttcctaccagtccttggcaaacctcttgaaggagtattattacactctttacgtctacatcctcaccaccttctttgggtccttgaagtcaggtttcagtgtctaccattctgaagaaattgttctctcagaggtcattggtggcatcctcagatccaaaagccttcactctgacttcatcctctgccactgctccatgccagttaacatagttgactgcctggtgactcccactggtctttccaagttctctttctgtttcatagactgcttcttgtctaccttcctagatagcttatccccctttgaatgtaggcatttgccaggacaggccaactctttgctttccacagtatttctcccctgggactatcatctactactgtttcaacttcccttctgtgctgaaactcccaaatttttaccttcaccactgctggcctgagttccatctagtcccatgtgtgcacttactcctagatatctcaccagttcctcaaccacaggattccaaagccaaactctcttgtcctctaccagtcttctaattgctcttactaggactaatcttcttgtcatcagggcccacagcaattgctggtctagtctttgtatgtcttgcatctttagaacatgtaacatactccattttacatcttatagcataatcattatttctccatttttctcgtttattgaggtataatttatttttactaaatgtgcacaaatattaagcatacagattgatacacttttacatatgtgtgtactatatagtctctatcca

SEQ ID NO: 107254 - DNA, 1045 bp, Homo sapiens
tagattgggaatagaatctacaccattgattttctagctttcaggtctttcggctacatgactggctttcttgggtctccagtttgaagacagcagctcatgcaactgcccagccttcaggatcatgtgagccaacactttataataacggtttatacacacacacacacacacacacacacacacacacacacacacacacacgttctgtttctctggaggaccctgacaaatacagtgctaatggtcactgagtgctttttatgtgctagacaccttacttagcacttgctgtgcattatataattagtaatcacaggaacctatgagatctctatcattttttaaacagatggtgaatcggagacttaacaagattaaatgctttgcccaaggtcaaatagccagtaggatcagatgagaggatgggaccatgcttcatggtccatgctccacgtttgttgttctaactcgagtctatgcttttaactctgataccctgtgctcttccataaggcctttctgtgcagtgatactcactcatcacttgtgccagccatcatcttcacggctggccaaagctgtttggcttcatcttctcatctgaagaattaatacacttgccaggaaagtttacctatgagttgcaaattcaggatacagtttaattctaatatcccaccttgattttcacttatgaggcaaaaatttctattttgatatggtttagtggctcttattcctctttatattttttagtccaaatggaacagaagtttgaggttgcctttccacattcagtttttggctacctgttttatagggctgttaaactagtaaccaccagctagttagtagatgtattatagagtatttactgtatgtcctgcattctcctagggctgtgctggctgttggataattactgtgtttaatctcctttttgcctgatcttccacagtgttgcaacagtggtgtctgtgccacagaatgaacacctgcattcttcctaaattatctacagattattttgagtgccttgtct

SEQ ID NO: 107255 - DNA, 1551 bp, Homo sapiens
gactccacctgtaattcagccaagtacataattcaggtcattggtgacacacgtatccacatgttggagctggtcagtgaacgttgtcatgaaacatggatagaatattaccatatggacagaccaaaccgcacagattacagctaaggaaactttgcattaacatgcctgggaacaggctttcctgagctgatccctgcccccacccaccctcagtgggaaagccaattgcttactgattacgacagcgacatcacttggcaaacattttggcctgagctcaatgtgtgacatcagtctcctttagggttttccacataaaacaaattctccaaagaaaacacagaaattgagccttaatttgaaatccattattacatcctctgaggtctcattaactacctcaatcacgtagttcttaatttttgttttatttccaggtagatacaaaccaacacttagaatgtgagcagtaaacctttaccgtgtttatttcagagtttcaaccagatacccctttgtatctattttcaaccaacctcccttttactggggttatgatatctttgtttcactgctgggagggttgctagtttgggagtggtttacaacactttgtttgaggaaggaagtaaacattgttctttgacccttcaggataagttagtctcacttttgtgggaggcagctgtgtccttgagagaaagcactcagtgaagttggaaggactcagtcatggtgtgttttgccatgtcacttgaaagcaaggcacactacgggtatttcacactcttgtgtgtaagcacctcctctgagcgtttatttacctgaagtcattagtttcccccacttcctgtttcgttagatggtattcatttaatactactttgatgcacatggccttaaagcagatagaagtcagttatgcctcatgaggcctgcagtctcccagcagaaggcaggaaagcatgaagggtggacgtgaatgggcccacactaccaagatactggaattgtgatgttcaggcaaagcaagggaagtcacatatgcatcaagggagttgagaataggtttaatattgtcacattcaaagaattccatctggaaggtgttccttggcatatagaaatagatgaatattctcatatcttctggaatggctaaacagagtgatagacactttttcctacttcttgttaatggcatgttcactttaattattcttcaaggtaaagaatcctataaaggaaactttatatcctataaagctaaaagtaatctcttaagttctttctcttaaattcattttatatatttcaaaatactattcttcatatattgatttagtagtatacactttacatttttcccacaatttttcttttcctccagcccatggcctttatccccactgatcttttgttcccatttctcagtgttgttccttcttgctctcttggtttaaataatctttgccatctgcctcccaacattccagtataacttcaggatagccctctccagccttcctccagaagatagtagagata

SEQ ID NO: 107256 - DNA, 1111 bp, Homo sapiens
cctcatactcaacatgtctaaaccaggactcatctcctacctactcaccaagtagaaaccatcctgcctgatcaaaatcctacaacacagaaaactgtgccccattcccatatttcatatgttcctgaatagccaggagtgcttctcagtaactccttgttttccttgctcttctttccagtctaaccagtcactaattcatattgactaaacatcataagtagttcatgcgcacacccccctcccaacctcatggctgttggaacacatcccctcatctttctcatctggatatttgcctcctatgtgagtttcctgcgcccagtctaaagctcctccagttgttcctccatgttcccttaatcgttctttaggaaagcataactgatcatcttattttccctttcacaattttccatttgctccttcaggccaacagtataaagtccagctgctcaaggcaagcctttccttttctcatcctacaatcatgccctatgctgtagccatgtgaaaagcttgagttccctcaaaatgcaggttcttttctcacttctatactaacacacttatttcaccccttgccatgaatatggttttcattcttgtttgcctagggactagacccctgttgcctggtctttgcagccttcacagggcactcccttcaagagttaggggcctaacatttatggttccacagtccttatcacacatctggttatccatacattgtactgataatgtcttcaaacatatccttttcctcaccctggactatgagatctttgagaacagagactgtgtcatatttatctttgtatccctgagacctggtacagtggccagctcatagattgcagaatgggacattgtttgcccaaagcagccttacctttcacattcctgttctagtaggcatatgaattcatcactcttctccatgtattctttatgttttctcttttcttcctccaactccaatatggtttgcctacgggatttttctgccactaaaagctgtcccaggattcgtctgtaagattctttatgtttttccacaactttgtccaactacgaaagaaaacatttatagcctgttaccaaattg

SEQ ID NO: 107257 - DNA, 1240 bp, Homo sapiens
tcactctccagcctcaactcatgttcctagttgtttcttttctataaaaatgaaaaattatgaaattttccatgaaggtctcagaggaaaattaaagaataaaataagaattccaaagggtttcagaaatgtcagcaagtaaaagagcaagcagtactgccttctccctagtggtggccctgttgggactgcccacctttgccgttgtaattgctaggtacgcttggtgagggaaaggtctttgctgtcattaaactttgaaggaaaaagaaggtatgcactcatctaaaatatatgtttttaaaaactctatttcttggacagttctttagattatttccattcatgttcaaaatttctatgacataatacctcagtgttttccaaaaattaacctctatggttgaactttatgttttttattacagcctgggtaccctgcaagttcccagagtgtgtgtgtgtgtgtgtgtgtgtgtgtaagcacatgtatgtgtgtgcatgtgtgtgtttgtgtgtgtatgtgcctgcacatgcacgtgagagtggggagcattctctggcatttggtagattttggttgattcaagcaacaaacctagtggacgcatcctgtctatggttcattctttttaactttcctattgaacttgtcgtatttatctgttttgtgtaggctttaagtgcgttagaaagtaaaactgtaaggaatcaaagaggagttacagatcatgctcatctgcagggctagtgcttggctgcctcccaggtacacacccctattgtggtacatacctcattcattggtttctcatagatgtcctcctgccaaggggtagatttcgcttgaaaagcatctctctggagagcctctaacaccttttttggagtgacaaacccatactgagcttccagcaaagccaggtccattttttcagcctttaaaatgcctatgacctcatctcgagcctgtaggaacaaaaagtatttcagaaagcctgctgtctctaccagcagtctcagcaagtgatttttgtgatagttggcagtgctttttcttctctttcaaatctaaatgaatcatatttcattttcacacttttataaaaggtaacaaaactatatcccttcatccttcttgtagtctaattacacaattaatgttttaaaaagtgattactatacaacattggaggactactttttttattatgtttgacaagcagatatcatgatatcc

SEQ ID NO: 107258 - DNA, 1045 bp, Homo sapiens
tcttgattaaggccacttatgtccatgggtaaacaggctgtgtttgaacttcatcccccaagcattccacctcaggaacccaggtcagacctccaaccatgaccctaagtgcttgcttaagacgtacttaacataattataatattgtaaaatggtgactttgctaattcttctaactttcttcagatttactttatagtatttcctttaaaattgttgggagcttttatggggttttttgttttgtttttaaaatttgttagcctttaaaagtgcattaggacagaaatggcagagttactgctacagaattactgcattattttgttttgaaggccaagtctagtattaaaggaatgaaggcttggtccctggctgtattcctgtattcctgacattcttctaaaattctagatctatccttgggtaagtcaagggcttatatttaggaccctcatcttcaaagcggagatactactacctaacgtagttggccattctggaaacaatataaaataaattaatgtttaaaggacacattagctccacatctgattatataatcatccaaatgaatttataataggaagaaaaattcttccactgttgaggtttataactaggagagaaaatatcagttgaacttataattgactctatggcatataagcagattattaattttactctttgtccctacaaatcatgaaactttcatcatcgccagtaccttacttttagtttgtagtatttctttaaaaatctgaaaaactcaagtgtccagaaaagtatagaaaccataacaaactgctatatgctaccacacaaatttataaaattttaataatttactgtatattagaaaacagtttttaagtactgtattatagatgtattataatgtatgtatctcttctgaaaccccttctcctcccttcccactccagaagtaaccacgtaatcttgaatttggtatttatcattcccctgtatgtttcatactttttaaaaacatgtacatatatattgctgaacaatgtatagt

SEQ ID NO: 107259 - DNA, 1025 bp, Homo sapiens
gcgcgcgcgcgcgcgcgtgcatgcacactcgtgctgggtggggaagaaatgttagatccacgtaacttactggaaatctccatttaatttcactgaattttgtaaactttcgatcataaataccctgatctgctatccctcacccccagccctctcacagacaccctcacatgcatgaaatgaactgagtatgcactacactattttttaatttgacagcaccattaaccatcattagttctgtttttaagcatgtaacattttattaaggcagtcatttaaacttagtgtagtgggaaattttagacataaattgtttgttttgatggcaagaagactgcataacacggagtgagtctgtgctaactgtacgacactcatggccaaggaacaaagctgggagtgatccaaggctttaaatttgaatatatttaacaccccatactttgctgagtttagagggcagactgtctgctatctttacatttgcacttgcatttccccctatctttacacagaacctttaagctaagatttagttccctgaaagaatggaaagagatgtattaagattatggggttctcagcagagctggttggcccctttaatattaactgacttatggtaaatgtgattcatctatgaaaatagtggctataaatagatgttaatagcgctcagttgcagaacagccaggttgtgctcacatggccagattaggggaaaaaatcctgttgggtattttatgtggtctttcaaaaaaaaaaagtttccttttattgccctactcacccacatttgaagacactaaactcagccagctgcagtaaagctatctgatggctaaaaaaagacaattgaaaacaagataacctaatttagtaattggcctccgttatcttttttctcccattttcagtaaaaatcattgaaacattttcttagtgatatttttccttgtagggcatagacaagtctttagacaagggattggaaagtggggatgtatgattcaggttcatat

SEQ ID NO: 107260 - DNA, 1078 bp, Homo sapiens
aggtttagtttgaatttaagagaacagtaacagaaagggaaaataaccagccacccagggtctatttttaactgccacggcttgagcagagccatgaagagagagaactagggcctgttaatgccagccatgaaaaagctgctacagtgggcagtgtgtgactgagcccagcaggaaagtgcttacatagcactcaggcccacctttcaaggaccatgcaaagaaaggagacatttgagagccaacaagaattataacatgtatgtgccacagaagggtaggaggaattccacggggaaatggtcacatgggtctacggttagtagaattagacaacatttcagaatacacttccagtgaagcttggtttgaatcttggtactcttgcaggagaagaagagagctgggggcagagcaggcagtgtgaggcatagaggcatgagccagcagggctccttcagggaacagcagtgtggatcatggggctagagcttgaggttttggagaggctggtgatgtagtggaacaggcagagaagggaccagaggagatgtcaaaatgaactggagatagctgtactagtttggcatcttaaagaattttggctttacacttaggcagtgggaagctattagttgtctctaagcaagttttcttgtctctaaaatggaaataatgagctctataccactggattcttgtgtgtaaaaacagcaaattatcatgccttggtaactatttgttccttcatttttttaatccgataaattattgaaataggttataaatgtaacagaatttgaaaacacatcaggatatgatggtaatttaaaaaaaattcattgtgtaaatgttcaagtagtttccatttttcccaaactttatttttattttattttttgaggcagagtctcactctcttgcccaggttagagtatagtggcacaacttcagctcactgcaacctccaactcccaggttacaagtgattctcatgcctcagcctcctgagtagttgggattacagatgtgcagcactgtgcccagctaatttttgtatttttagcagaggcggggt

SEQ ID NO: 107261 - DNA, 1124 bp, Homo sapiens
ttgactgagccccccagcccactcagtgtagtaggactaaaactcagaccactcccattgtacaaaggagatgcattcaatgcattcagatggctaacatctgtcacttgcagaaaaaaagatgggagttaggcctagctgttcctttcacctttcctcctttcctgcctccctccttcatttataaattgtctaaagtgtgtatagcattatgcctctcaatgttataacgattggctccatcccgacctgggttaagtttaacattgaaaaattagtggtagctcacaacctgccaagtaccggagagaagtagttcttttctctccaagatgtttgacatcttggaaacggcagtttctgtgtgtttttctagttagagtagccacctttacacacctagtttttgttattcctctcaacaacactatgaggtaggttttaggatccccattttacagatgaggaaaacgagggctccaaaaagttaagtggcagaacctggatgtcagatcaaacactgtaactcccagcccagccctctttaccacagctgctcctcaattaggcagcccaagtgtttgtccctacccacaggggaaaaatcaaagattttgaacactagtagaagcaacattctgattaggaatataaaagattacagcgtgaagtgaaataatctccctcctcacctcctgtaggtcttgcccaaatcattctttagcatcttcttctatccctccctcctacagtctttttacctgcttcctaatcattagattgacatctcaaggtaggggagaagtaggggagtccagagtcctggtactgggattgaggggaggaacactttcactttcagggctattgttcttgctttcctttgtatgaagtagtattttctgttattgattttatgtttacttactgtctgaattgaatactgttaatttatgtgcccttggctctaaagctctggttatatatttttgcgttgttaatatttttaattggtgtttctaaagtaaatgtactctgtgtgtttggcagaccaacaaagtgaaatgtaaaaagagtctatttttaaaagtaaccatataaggtgaaaagtccctttttgtgtg

SEQ ID NO: 107262 - DNA, 1011 bp, Homo sapiens
cattatgtagttcattttgccagcccatgtgtgaacccatccagtgacgtgcagctgaatactggtcaaagtatcccatgttttacattttaggacattctttgccatattattttggggagctggaaaggctcctgggaaccgatacctttggccctggtgcctctttttgaagctacttagaatattcttttataagtgatttagtctaaaaaaaattttttaagaatattcttctccttccaagacatttgtagatatttaaagataatgacaccgatcttgcctttccccctttctagatgtcaaacatctttaggtctgccaacctattttcttatgtcatagttcgtttgtacatttgtagagcacaaaccgggtatgcattagacacagctagaaactagggaagcactgagggaccaagtagtctgtgattcctgcccttcaggaacttctgatctattaatagcagagtggcaagggctattataggggccccaaatttagccttgctgattgggggttagggatgtcggggaaatttttctgcaggacacaccacacaagcaaagtcctgaagagtactatgagttacccaaggaagcgagatgaatgaggagaggaaggtattccaggaaggactggcttgctggaaaggctgaaggtgaggggatgcgtggtgagttcagggaagtgagggtggttcattgtggttgaggcactaagtgggaggtgaggagtggggaaaacagatgcagaaatgctagggcagaaaccagggctaacagtgggaagatgaggtcgcatgtgatgggagagtggaagatgatgggcagtcctcatcaggaaggatatttattgttctcttgggaacataattactatgggcaacataaaaggttctgcatgaggtcatttaggttttggaatattttgtatattatcttttgttgttagagaaaggatatattcagtcattagggttagacagatatagctctttcagta

SEQ ID NO: 107263 - DNA, 1008 bp, Homo sapiens
acatcaatgagaaaagataattggataatatgaaattcaacaaatgaggctgttacatcagaggcattagggagtaatggtttagaagcattataaaaaggaataatcagttaggcattggcttaaaatttggataagccatataaacttgttgatatttgagtattttgacatataaaaatagtaatttcatatggttcaacctcatactttgcgtgcattaaatcattcattctcacaactaccttctgaaatgggttatcattttgcagctgagaaagtgaaggcatagaaataataagtaatttgcccaaagtcatctgataagttttggagctcagtttcagacccaggcagtctggctttagaggctgcaatcactctgaatagggaatgcccaccttaccctcactgcccttcaggccttctggtgtgtgaggtggatgagaccaaactcctcttaagcatgtaataactgagataaatgctgtaaaggaaatgaatgtggttcactagtcagttttgaagtctcattctcacatactctgtgcttccccaccctatttgtgttcgctttcactcccaaactacttctacctaattgcagaacactttctctacattttgcctaactgaaacctagcatatccctgctttccttgtagtttactagtagataagtaggaaaatagttctagaccttgcatgtacagggtcacaagagtttaaaaagagcaaggaaaaccattcagtaaatgacaagacattctgtatatgggatatgaactgggctgggagagaggtagagtacttaagagagcgtgctacgatagacctcaaaggactttttaccattctaaagaccttaaacattatactatctgctacagccagccacagaaagattttaagaagcaaaatgttgtgaggatattatagataaatgttggtgtggatgcaattaaagggaaaaagactagaggtgggaagatgggttaggaagctgtt

SEQ ID NO: 107264 - DNA, 1045 bp, Homo sapiens
aatataagatattgtgtggctgctttctgatatttcgattatgataattcccatatcaattatcatttacctgaattggatttcttttgaaaacctttgtgaggggggtggtatgtggtaagcaagggatgaatatcatcattgaactcaaaagtattcaaaaagcaacctaaaaaatgcaaaatgaaatatttgttaattctaaacttgagtgggatttataatgtctatatctgtcttttatattccaaaaggataaaatatctaaaattatttgttttatatctttatactagaaagaagattggtagaattattactttgtcaaccaattagaaggcctgccaaatatgagatgtataaaaataatttcagtgctgtttccccattttctttcctgagaatctctagttttctcatcatatcattaaaagcccaaaacgaaacaaaatattatttgtatttttcaaaaaattgattatccagaggaaactccagctttctagtgtagtattttctaactttggaggaaatcaagagccttaaggactacatatcacttagtaaagggtagaaacttatgggaataagaattttctctaacattgggaaggctgggagaggttctagtgcttcaggaggatttcagattcccccaccgtgggcctaattatttcatagactcagttcagctaaactaccatcataaaaggcagacatacatggttgccccaattataaaatcagttgacatcaagttttccagattaaatcactagtgatggattgatttctggatccaggaagcatattcttttttttttttttttttgggttgggggagggacaggttttctctctgttgccaaggctggagtgcagtagcatgatccccagctcactgcagcttccacctcccaggctcaagcagtcctcccatctcagcctcctaagtagctaggattacagactgtgccaccacacccaaccaattttttattttatgtatgtatgtatttatttatttatttggagagacagggtt

SEQ ID NO: 107265 - DNA, 1011 bp, Homo sapiens
tataataagttcattcttctttggagttgttaaaaagtgaggctcaggtttttgtgccctcaactttatcccccttggtttattgctgccttccaagttcagcatctcagcatttttatttcaagaaataagcttatgatgcacagcattaagcaagacactttgggagaggaggaacccttcccggaatttcagaagtctccttgtagagaaaattcctgtaatgttttgttttacttcaaaaatctgagtgccagaaagaacagagtcaagaaaggagctatcgtgagctcttgaatttgaagcaaagtctgtactgtgaccccattttagaagatcactggccctccatagagcactactttgaacaaatcagtgaattttaaatcaagtgtcttggttgcttatatttttaaaatctcaaaagatctaaattcagatgccagtgaaagctttgtaaagggaacctccccttcctcagcctacccttaacttgcattctaggaacttctaggtgctttagatatcccctaaatgattaaagaatagattataattcaatagaacagtgatttgctggttaaaggaagaatagctgatactttatgaaactgttcttagaatagcttggatgctagatcccattgtgtgtgtgtgtgtgtgtgtgtgtgtgtgtgtgtgtgtgtgtgtgagagagagagagagagagagagagagagagagatatgaggggggcaccaagacagacatagttatacccatttcctttttccataaagcatttgcagtagcttgtaaccaacacacattataaaatttacatagggatttttaaaattttaaataaaaatagagggaagcccttggaaaagaaatgatattagaataatgttgagtctcttgggaatcctgcaagttttttgcttcagatgcaattgcagtagcattgagagagatgtcaaacgtcaaacacagttctgtcctgaagaaaaggagcagaccttccattgg

SEQ ID NO: 107266 - DNA, 1066 bp, Homo sapiens
catttttgcctgctgttagagtagccacacctctccatgagtttcaggtgttttaaccatttaggaaaaagaggggagggagaaagaaatgaatcagtagtaaagagatggtgcctgagaatggaaagatcacagctgaaagtggagtatgtgctaccttctggcccagaccaggtggctgggtgtagatggacgttgtgtgtatccccaatgcagtaacccttacagagataattctcccagtttagccaccacgaagtattgttctttgtttttccatagtgcttgtcaaaatgctatgacaactgactggttttatgcaaacagagcctggctctcaagagacagtgtgtctgaaagtcaaacatggatggcagccattggcacacaaaggagtcagaaaccacagattgttttctcgttggatgaacagcttaaagcaacgtaaagttaattgaagaattccttgaaagtgaagtcagactaaaaagaaatgctccgagtctataatttactaaatgtgaaagaactgtaagtggtatgagactaaaacagtttcttggggggagagaacatttttgtaaacagatctggcttttatttttgcttgggctgttttaattatttgctctaataatgtagatctccagaagaatctctaattaggtaaggcttgatttatggagttggcctcatataaaccatgatgtatgtcatggtatgctgcagaaaattacaggcctggtctcgccattgcaaactagtatttctacctagaactactcctgctctgcatgtcttactctcaggaaagcaaagcatactatgttctccttcacagtgctcattgcccaggtaaactcaacatatagtattactcatcaaataattttagcaaacatttttaaaactggggagagaggagtagaagaaaaatgctagcagttaaagaaatctttacttcctgggaacttagtaaataccaacctatgattctcagtagaagtgggttcactcccccttcagctgacagactggcaaggatatgccagactatcaagagtag

SEQ ID NO: 107267 - DNA, 1289 bp, Homo sapiens
aggtatcctttttatggcctgttttaaaatactttgtcaaaaatgcccttcgtttagtcaaaattgtgggcaaatttatgttatatttttgctgccatgagtatatggtagaactttgggcagggatcctaaactcaagctgtctgcaggaaacagacaggcacggacagctatttattattcagaaggccagacataaaacaaggagcaaggtcgatagtgaaccaaagggccagtgtcttgtctcgatggggcaactgcttctcagctcctgttcattttttatcatgtgaaaaatgcagttatgtagttgaccagatcttccagtattttgagaggagctggaagtctggattattaaattaaatctcctgattttaaatgttggcaactcttttcttctacttgttcaaagcagaaaacttggagttgtccttcactcctgtcttcctttcaaaacccacatctaattcatcaggaaatcctgttggctctatcctcaaaatatattcagaatctgatcacttcttacggatttctgttgcactactgtggtccaaaccaccaccgtctctctccaagattgttgcagtagcctcctaactggtctcactgcttccattctttctctcctgcagccagaactgtaagtcagatcacatcgccccactgcccacaatcctccaaagtctccgcatcttactcagcatgaaagccaagatcctcccaataacccataagactctccgacctcatctctgcagctacattggcctcctgtctgttcctcacatatgccagctcatttcctccttgtgacctttgtccttgctgttccctatttttccaggtatctctacggcccattcatcccctgcatccctttgcttaaatgtcatcttctcagtgaaacctgccttggacacgctatctaaacttacacacatgaatacacacatccttcctctccaccttctctgctttttgtttctccttatcacatatggtctagtacactccatcaattttttattacctgttttctgcactagaatgtagattccacgtggatagggactttatatgattttgtgtatttgttcactgctgtttacatctggaaatgagcctcacacatggtaggtgttcaataaatgtttgatgaatgaatgaatcttaaaaacaatttttttaactttgggccaaataaaactcttcaataggccaaacctgggctgtacttcttttggcctagagtcaaaaagaagaatgagtgcttctccagcagc

SEQ ID NO: 107268 - DNA, 1109 bp, Homo sapiens
cgtttatttgcctcactttctccaaagggaaacaccccactagggcagtgtcaacagacttttttgtaaaagcaaaaataggaaatattttaggccttgctggccatatggtctgtgtagtaactactaaactaggtcaaaatcagccaaagacaatacataaattaatgagcatggctgtgtttccataaaactatattttggacagttaaatttgaattttatgtatttttcatgcatcatgaaaaatcctaatttttaattttttcagctgtttaaaaatgtaaaaattatgctttcagattatataaagacaggctacagaccagatctagcccattagccatagtttgctaaaccctgccctatgggaataaataatgaaacatgaggaagattgtaggtgttaaaacatggagtaaaatatgatacttgaaagacaattatttaaatgtggtagaggaaattattgatatgtatgcctctttcagagagagcagatggatgcgttggcccttgattctgttttaggtaatcttagttggtactaggtcaaattccagattggttattttgatttactctcttaagatttatgaaatgcaggttatagctggctttagagaagaaaagtggaaataagaagaggacatgtgacttagagcttgccataaggtatgcagagccaacagaacattttattcggaatggcagctggtggtttctgttatctgtgaatcattgtgaagtctgtctgaggcagagaggagacagctagccgaattcccctttcgcaaaaactgattcataacattgtaaagctcacagaaaatgcattttgtatcacaagaacacataaaaatctctattttttgacataaaggctatattgacgaactttaaaataaaaagaacctgtaaatgtaaaaccataaagaaacattttttaaaatagtatgaataatttatgggcagttgaatacagcttttgttgctttgtaggtaactcacttataacaattgcataaatggtaatgcagttgtgtgtaacaaaggaccattaattatgacacttatgacaatgataacataattaactattttttgag

SEQ ID NO: 107269 - DNA, 1036 bp, Homo sapiens
cagctgctccttatgtactgatacagcaggatctcccagatgtattgttaagtccaaaaggcacagtacagaacatattgtctatatcgtatgctaccttttgcatgtaataaaaagaagaaagaatgaacgtacatgtttgtctgcatatgtataaaacgtctttgaaaaatgcacacacaatattgcttgcctaaggaaataagaattttgtgttgggagacaataattttgcattaattcagcaataacagatgttggaaaaactcctaaatttaatgcttataaaaagaataggaaattatgctttcaccagtgttgtattggtattgaaattatcatcatctaataatagttcatcaaacacagagacattcccagacctttcactgtagtggtgaaaaccattatgcattttatctaattcagttagtctgctttacttattaacttgacctcaaaaaactgagcaaccttttctaagtgttcttgatcacagtagtacagcctatgaagtacataagaagtacagccaagactcacctgctacaggaatatcaaagagcagatgaaatataatctatgattatatttcacagtatgtagtataaagatttcacagtataaagatttcagtggagttctacaaaaataccaacttggtttaatacttaatggaaaggaaaacagtaaaatttatttcaaattagatagtgtaagattcagtcttataatatgcgggataccaggagtaccttggaaaagccagataccaaataagatctaggaaatttttaggaatccagaagaatctagaaaagcattgtccctagagttgatatttcagtatatcaccaagtaatttttcatccaagatctcagtgcttcccttaaattagatattaaatggcatgtggtaattccccccagtggttttcttcacagttaacgactttcttctttttttttttttttgagatggagtcttgttctgttgcccaggctggagtgcagtggcatgatctcggctcactgc

SEQ ID NO: 107270 - DNA, 1040 bp, Homo sapiens
ttcatcttggtgggttctcattattgctgctgcagtgactgattgatttgttgagaaatatctgtctaaatattcttctggtaacattatttttaggaaggcaaagcctttacatttccagacggcagctttgctgtgaatgtggggaaaccacagaaagctgtaacacattgcacatgtcagcaaggccttctgggcttcttggcattcctaatgatgataatgatcccacttggtggagtctgaccctccctgcagctggtgtcctttctgcgcagggatgaggtcactggggaagggggaggaggcggagctggggtggatgagagaagggaaggggaagaagctgtcacatctgcattcttggtggaaaaatggaaacatgtttgccacatgcttgctttgtttgtttattttttaaggaaagggtatggagaggcaagagaatagtgaggaattgtaacatgatgactgcttggttttcccccaaggcttcacagctaaatagctgtattctcaataacaggctcatcaaatttcccagggcactgataactctatgaatctaatcctgaatacttgaaactgatcagggccaggatattccagcgtttggatccagtaacttctttagagttgtgaaaattcctaattctagatagtccactcctccttatgcctcagacatgtcttaaaaagggaaattcagaatttgcagaattatttttatatttggcaatgtagttaaaagtatcaggttgttcacctatttctcaaagttgtcactgaaagtaaacaacctttttttttttttaagtttactagtagtagcctaactggtagatcatagttttatctctagagcttgttgtatatacagagattataaatctagaattccccaactccccccaggatttgggattgttgttacaattggttgttgttgatgtttttgtgaggagagaggttagcaaaagaggggtcctgttgtcattacagggaatgacctggcctgggcaaaatcacaaccaaccact

SEQ ID NO: 107271 - DNA, 2053 bp, Homo sapiens
catacattagcaattcaatgctagtataggaaagagggcctgagacatgaagatagctcaggagcaagtattaacactgagaatccatgggtaagttaatgcaatgtttctttctataaccacattttaagataagtatattctaaaattttacaaaggcaaggtggaaggtaccttccccaacctcatgtaaaccagttgtttgagtatatactgtataaggtaaactttctggatatgatacaagataaagttataaataaattcatatttgatcttgtttttaaatatgtaaatatccttaagtgccttgttattattttctaggatttgttttttcacaggaatttttaaaacctgtaatatataatttcccctaaataagatgaaatttagttcatccctgggataaatgctctgtatatcacctgtggagttgttcgcctgctctccctttggttaccagtcattatttcttatttctattctctcctgaaacaagggtgctccttgttgacagtatgcttcctgtgcctttatctcttaaaccctatatattgctccaatttggggcatagttgtaagtcattgtataattcaccatagcaagccttctgccccagaagtgtcttgaaaagacacagtttcctaggactgccataacagattaccacaaattgggtgatttataataacaagaatatatactctcacagttctagaggctagaagtttgaaatcaaagtgtcagcagggctatgcttccttcaaaggccgtagggaagaatactttcttgctttttgtagcttctggtgcttgccaacagtccttggcattccttggcttgtggcagcataactcccaaatctgccgctgtctttacatagttgtcttccctcgttgtgtctgtatccaaatttctgtcttctcatgaggacaccagtcactggattggggcctaccctaatccagtttgacctcatcttaacttgattacgtcagcaaacaccctatttccaaatatagtcacattcacaggttttgctaggtgcataaatttgggggagtggggagaatgggtattcaacctggtacagccagtaagaatcttactacattctctcatttctctgagcatttaggggtctacacttgagcattctgtttgttttcactgtgttatctttcttacctggaaatctatccaaagccacagaaaccctaactaatcaattctttagtgactgccacaacacatgctgagtctgtattattttataaaactgccccctggggccagattttgttctccattattcatatgcagcttcctactagaatcaaagtaaattgcatccaagtgtttccaagcattgactctggcccacacttcttcccaaattctatactttgttctttgtatatctggacattcggcttacttaaaagtatgtaatattctccccaaggctttgaagagctacattatttccaaatcttttaccacttgagcttccctagtattgtaaaagctggccaagggtcaaacatttgtgtgctttcaagatagcatgtagtgtttaaatcccttccttaaccaaagttgccattgtactgtgaaggaggttcagagcaaaggtcacaaactaaccgagacatcacattcccccttccctcttgatatgttctctttgacttgcttgatggttttttgaaagaacatgagttagttgctagtaatagcaaatttcacaaagaaattgagatatctggcttttcttgaaagctcagatctggaaaacctaggcctacattcttgtagctggccagagctggggagtggctgtcccgtcaagtggagcacgtactcttgcctgcaccatgagccagtctgacctgcttcgttcattatattatgttatgttttgttatgttatgttatgttatgttatgttatgttatgttatgttatgttatgtcatgttatgttgttacctacctgcccctgttggcatttgaactatccactcctggcccaggacttgggaatac

SEQ ID NO: 107272 - DNA, 1162 bp, Homo sapiens
catatgggacagttggtttcatgcagagaagccccctgcttgcccgggtgtttcataaatgcatgcatttggtcgcagaaggtatggatgtgagcgtggctggctcagcataacctacccctgctactggaaaaatcactcaaaccctaggtttttttaacagggtcactgccctcatccttgtttagaattaacaactgtgaatacaatgccggtccaacttctatgtattcctcaaagatcctgatgaccttttacccaactaactgactgtctaaatctttcgacatcgtgagagtctgatgaaaatagctagttattagaggctgactctctgtgaggtactatgctaagtgtttgtgtccattctcccactcatgcctcaaagtaatcccaggcaatatgcacaattttttattttctttttgcagttgaggaaactggctggggaagttacctagctttcctagggctccacatttactgactggcagaaccaagactgagactcctatctgtctgactctagagcctatgctattactctctataccctactgcctctctcaggcagaaaattaagaggcatctgaatactgttctatgttcaaggcacggaacagagttggagattttagaaactgtgataagctcctacttacagaatgaaactttgtacaatcagatgcttataaacgggtatgattttccattgtcattctttggaatgtaaaatgagatcacctctgaaggcaggcagagaaaagttgacacatagttaagtgaggcacaagtctgttcttgggtgcttctacaagcttcccattgatgacctcctctctgtcccggcagcttgagatactcacatccccaatctaaagctttgctcagcttttgctcctccaactttcatttcaaacacaaatccccttggtggacaaagagaaaagtttctctccgctttttttctcctctaaattcccaagcacctcaccacaaactgacttcattttacaccctcaaacccagaagcatcaacagacaacagggcccatttttcctgactgtcccactcagaggcttttcagtagaaggaggacgctgtataacctcctttgttagaacactgagttaagccatgacttctcttctggagccacag

SEQ ID NO: 107273 - DNA, 1114 bp, Homo sapiens
gaacagattgactaacttcactgttgatacagaaacatatacttggagttgaagagctttgttagatactctaggttgtttctgtccagtttctgggaagctatcctttaaaaaatacaatgcctcttaattttctttttccttaaagggctttataaatctctggcatttgaggctataatgggacgagccttccatgtgacatcttttttgagacaatgaaaaatgcttcacacctgtgtccttgtccgtggcttgcttttagcctcatctccgtgatcatcactgctttcccctgcttcttcactctagccttgcttcctttcattcaggaagcatttttttttagcacctgttattaaataatggtgtgctaggccctgaggaggtgaggagatgaagacaaagtttctatcctccaagggtagagggtgtagttcagaggttgaagattcaaacagcgttaggagccaggaaggtttgtgagccagaaggcgggggccaagtgcaggacagagtagtgactgggactgtactgtaatgaaaaggacccatcatgcctgaagaagtcagtcattacacaactccagctgactggaaccatccatatgtgccggcctagaattgtcagagcttccagtttgtcaagagaaatcagaaatccagatttctgtgtgtatgtatcatctcctgatttttaaaaaactctggcaactaattcatattcttcaaaaacatcatgtaggccaaacaaaacatgcatgtggactggattcaacctatgagcctccagtctggggagttctggcctcgttagtgaggtaaatcacatatgtatgaaatgattaatttaaaatgtgacccatatgactaggggtggcacaggcagttttcctgctggaggaggacggttggggaaatgggggcggggggaagatgggctccaggtacatgtgccctcagctgtgccgggtatggtaaagggatttgaggaaactggaggtgtgtgtcacatggtgggtgggctacggtgccagactgaagaggttgagatttactttctatgtcatgaggagcccctaaagatttttttgatctactattttagaaaata

SEQ ID NO: 107274 - DNA, 1032 bp, Homo sapiens
taaagcatctaatttcttctctctgtaaagaggattccattaaagaaataaagtgatttgttctgttacttgaagtatagagaaaaacctaatcaaatgttaaaatctctccacatgtttaccccaagactgtcaggagtacataccgtcagccaaacccattggtgccagtactgaatgttcacacttaaggttggaaaagttgcttctagttctcctctcaaacctcggacctctagaagcaggtggaagagttcttgttttgtttgttctttgttttgttgcttctggtttcagagaacccagaagaatggagattttgaaagtgaatttgaggtctgctgtaaaccttcaagggctctttcctgttaggattgtggggttgtcttccgggaatgtatttaggacgtgtggtggattgggaaagaggaggatgtatcaaagtaaacatttcatgagcttctgctttgcagtttaacttactaatagacaaaacttctgacgatttcctgtgtatcctaaaggaccaatttgccaccagctccccagtcccacggcctctctttttccagctaatcctgacccccccaacacccttttttttttttcaacattaaagccactcattcaatgtgcaacagtgttcgtgtttgccagccccttactgcattaagtgtgctgtgacttcttggtttaatttgtgatgtagctggttttcattctttatgttttgacaaatgccacccactattatatgtagagaactttaagatcctttggctctccagaggatagaaggccctggagcagaggaagggagactggcaaaagggcttggaaaatgcttacagacctaatggaactttttatttccacttgctgattttctttagcttcagattcattaagggcatgttggcaaatcatactcatctgtaagaacattctaataagttccgtgttgctgtctactacatgagagtcaatttgacaaacagctaattttttaaggaattcagcagttggatttcc

SEQ ID NO: 107275 - DNA, 1104 bp, Homo sapiens
aagaagatatatcaatgcaatatgattacctttcaaataatggacttctaatgacacaagagaacaatctagagcatgctagttgctgccacagaaatggatacagagacaacccacagtctggttctcatcctcgtgtcctttaccctacaggagagaagggcttatgataacgagcagagattccacttttattttaggaagcttagaggttaggaagaccataatttgttctttaaacatctcttgcatttttataagttctcttaccttcaaagctttattcgaagcttcgggtttttgctttttacttcatatcccaatctttgtcttctcttttctttttctttttttttttttaactgtctcctatacccactgatggcagactctgttttcttttatcttcttttccttattacacaagaattaaatgaagcaacatctataatataaattctcggaaaaattacacaacatggtaataactaattataaaggcaatttatagatttggggagaatttcatcccacagtgatagtaacatcgttggacctgaaaccaggacctattgatgactgacctggggcaatttatctctgagcttgacttttcttatctataaacttatcttaaactctacaagcttcttgagctaatccttctggggtattaggattcgattcaggagagctgagttggagcctagaaatcttcatttctgataagctctccaggcaataggccctcagacctcactttgaagacacaaaactatgtaatttctaagatcatttcctgcctaaaattctgtgattctgagtcttctttcaactacatggctttgggcagggctgatgcttcctggaaactcactgtttcatctgccatatgtataattaagaaatatatttgttagttatcttgcccggaaaacccttaaaaatgtaaacaataattttgatcagagttaagtacctctttttgtcactgctcagtggaggcttgtctgtttcattcctttaatctctcatcatatgcttatctctgtaaatatatttttccctctctaaaggcctctcagatgcttttcatctttctga

SEQ ID NO: 107276 - DNA, 1029 bp, Homo sapiens
tccaggaatctcttggagaagacagcccataatatctgagtgaggaatgagccagctttgaagaccctaaacagcagcatggcattcatatttctggtcagaagaatgcagctctgggaaacagggtcccacagggtaactattttttggttatagtcgagctccaacaaattttatttaggaagcctttatagatgccacacaaacacacccattttttatacccttacttaaatttattgttacatgtttctgtttctgtgaggtccatacatgtcacaaaatctgtttttcagcatggtagtcatagacttaccttcgttgacttaagacaccacctagtttgaagagatataattcaccccttgggtttattttgtgagaatggcctattgtacattccacaatctgtagaattagcttgcctgtggttttgaaaaaagaacaaattgagaactcttgcccttgtggttttatttaatgtttagaaaaattcaagtttagtctagtactttgggatgtgtatattctactggctatatttatgaaattacaattattttccagcaatttccaggtctaaataaaatcatgtatggattttattgtttagggtcagacatattggcagtcagtacctgacagggtcaaagtgagagtttttttacttaatgcttcaggatattcaacataagactctccagaatattcaacataagaattaactaaatagttttactttatcttgggcttgcttgcgcctgtaattatttgtttttatcttgaccgactagttaattgccaaaggattattttagataagtagcccttaacgtatgttgtgtggaacagcagcatcagcattacctgggaacttgcaagacatgaaacttcctagacccaaccccaggcctactgaatcagaaaccctaggggtggagcccagtgatctgtattttagcaagctctccgtctgattctaatgcacagcgagatttcagaaccattgtttcagaccataatcattgt

SEQ ID NO: 107277 - DNA, 1194 bp, Homo sapiens
cgaacctgcataaagagcatagaacagttgcgtttcctttctggcagtggtagagagtctttgacctgccatgggctgctttattttattcagtctcaaatagttaacctattgagctgattagaaaacaactagaagtcattcagtaccacagaagaaagggacagaaaagccacgaagttagttgtacttgtttggacatcaatatcattgattatatcattccaagtattactactgagaaatgtcttggaatcagctgaccccctctagttctaataccataaagggggaaaaaaaatccaggttctactcttatctgtgctttctcacttataacagtacctaactcctagttgatactcaaatactttttttacaatttgttttagccctaagcctgtttacccaaatcaaatacctttttaagaaaaattaaactggtatttattacccaccaggctaacgtccaaaatatgtgccttcctatgaatcattgcagcaatttagtgtagagcctctttaaatttttgataaaaatcattggagagttgggagcaatggctaacccattttttcactttttaaaatttacatatggtaaaattcacttttgtgtctaggacaggtctgtgattcagacaaatgcatacagcagtgtgatcaccaccataatcaaaatgcaaagcacttccatcacccccagaaatccttcaggctccctttttaatcagtccctctctctattctcaacccctagtaactactgattttttttctgttcctctaattttaccttttcctgaatgtcatataaatggaatcacagtattttgaatctggtttcttttacttagcagaatgtacttgagatactatccaaattgtcatgtgtaccaacagtttgttcctttttgctgctgtttaatgtgctgtcatacagctgtaccatagtttgctaatccaattacgagttgaaggacatttggtttattttctgtttggggcaattatgaataaagccactattaatgttcacgtacaggttttaagtgaatgtagctttcttgtgagtgtttctctaggagtggaattactgggctttgttgtaaatgaatgtttagcatcttataaagaactgccaaactgttttccaaagtgattgtactattttgtgttcccaccaacagtgta

SEQ ID NO: 107278 - DNA, 1047 bp, Homo sapiens
aatttgaatcttgaagaaaacaatagcaaacagctgcacaatggacccatgtggacaaaggtgcctggggccttactagaaggggcattcatagagtgcttcatagtttagggagggactgcccttggaacaagccctccatggaaggagctcagaaggatcagctgcagacagtgaagcaatgagctttgagataaacatcagtgaagttttctgtggctccacgcactcctatcaggagaaaagctagctggctttgcagttgcgggggagtagggaagatgagtgtactatttcctccctccaattttgttcagtactagaggaggtcttagagatcatctgagtcaattcctacagttcacagcctaggaaacggaagacaagacttgctccaggtcactgaactagtaggtggcaaaaatggagactagaatccagttgttcctaatatgacattctacttaaaaagcctgactaaatcttcctcaattagccacgggtgtcttcttttccagattattaacgagcaatgaattcttacttcatacaaatgcctatgaaatttgtatttatattatactaccttttcactcaatgtaagacatcagtaaagtgattcagttatcaaatatcatataaagaaccataatgggaaatgcttagttctagtctgttaaattgttcagttttagaaatgtttctgcttcctatcctttttgcttgacatgaggctttgacttataggtggatgcagaaaaatcttcatatcttcatctccatctactctttagggctttaaattcagttaatccattacttgcataaagttagtaaaaacaaagaatatttaattttgaagagtattagctagcattgttgagtaggaaagaacaggaaaaccaagtaaatctctctggatggttttgcttgtggatatgcgtgtagtaatagaaaatgcaactgaactctaaataataaaatacttcctgtagggcaaatacagccagaaaaattggaaagcagatcaataagattactacatat

SEQ ID NO: 107279 - DNA, 1068 bp, Homo sapiens
atacttcctcacacatttttaagttggatctaaaactttttatcatggctttcaaagtttatttttgttaaataggaggtagaaaagagtaaatattctataacagtattaaataagaattgattgtgattggaaatagttgacatgctggctaaagatgtcctgatgaaagcatgtgtccctgaaaccagtagatttcccgtcatagcatattttggattccaggagtctgtttaccccaaagacaatggtatacaagataatgaactgtaataagatttgttttgagtgagaagtttggcttttttttaacatggaaaagccaatatgaatgtagttggattctcaggcagctgaaaaataaagtacaaatggaagttaaggtctaaagacaaatttccttaaaatacccttgcatgtgtatatcttgtatttgcatgcccagtacacataccccagttggaaggccactagttatgagggttaaatgagtcaatgcatgttaagctcctagaataacgcctggtatctagtatgcactgagcaaacatacattattgctattattattttaggttctccctttagagaaaaaaatattcatacttactctgaggtcctaccttgtcctcatgtcttatctccctgcattcagcatcctttagaattaagtgactaaggatcagaagtatctattacctctgtattgggatcatggttccattcttctcacaagacaaactcattccaggagttaacagcggggactttctggtcaaattctattcagtttagctatctataaatatgacattctcctggatacacataactctcactacctatggatccagcctgatgctaaaggttccataaattgagaatttgtggggtttcataaatacgttgaaggagtagaggttactagataactgcagaaatagaatacagaatggaaaaaattgaagtgtaaaattttaaaagaaaaggttagctcattttaaacatactctatgcactggtcatcagacacttagaaatctcaaaatcaaaacagggacctctggc

SEQ ID NO: 107280 - DNA, 1037 bp, Homo sapiens
ccccacattgctttgggaaattactgagaaaattctcatcagagtagtagaccttaattacccaggtggaaagagcccatgaatattattgctgcctttagaagtttttattaacaaacagctcttacagtatttatgctgatttttaattaagcataatgagagtttcataatagtgtcaactgataaatgtagagaaatgtttacttggaatatttggctttgggagatagcagattgataaatcagaaaatgtcatcacaggaaaaacaagtttaactgtagctaaaggaacattgctgtaattgcaatgcattctctctagtattaactacaccatgttctcctttatgcatatctaatacacacgtggaatatggtagtgtagttaaacagtgtatgtgttgcacctcttctattccttcctgagatgtgaacagataatgaataaagaaagatatgtaatcattaattggtatggaaagaaaaaagaataactgaatatgtcacaaccattttaactgaacacatatctctcttcagtggagcgcctatatacaaaactgtgcagccaccctaaacattgaataatcctcccattgaggagtacagtgagcagaattttctgtgatatcatttggcagcagcctagcatcatttcccatttatatccagatgtgatgtgcccatggatatccagtcatcttctgtggggtgttacagaacaagttcttgataggtatctcccaagacctgccaaaaaccttatctcagaaacctgcttctgttctctggctctcattcattaaatcttaacatcaacagaaggtaaacaaacaaaagaaaaaagatacaatatagttgccatttgaaaatgttagtttcttccattaatctttccatgaaaagagaattcctcctctgcaatttaacctattcagtataattctccattttcaacacattgtgatgattttgacactgtatattgatcattcacatcagcttacaaaatcaagctattaagaaggaaagcc

SEQ ID NO: 107281 - DNA, 1055 bp, Homo sapiens
ctttagggttgtggttctcgaagatcaatccaaacacaaatcattatgtgaatacttttcgtatagttggtagtcagttgataggctaattccttaagcccagtttgtcaataggaaactttaaggatgaagcaatgaaggaccttgtcctaagctatacccaaaaactctgtaagaaaaggctttttccattgagaagctgggtgagaaaattaagcattctgaagcagggtaggtgagcattatacctaccttgaataatttacattaacgggatacattatgtattaatagtataataggtagttgaagtctctgtgaatgccaaagggtactcttaacagaagtactgtgttttttccattgtaacacttctcttccttggggttacactctataacaagggtgagtggatagtaggtctagatgtagcctcataggcttttttcttatgaaatttctgttcggggaaattatgtaactcacatacccacatgtgggccacattaacctatttttttttaatgttaccctattcctctgtacttcagcattccacctcactctggaaattttgacacatccagggtatatagcattcttaacagaagttggcccaaaccagtagagaatcataaatcacagcagtatgacttcatcaatccacaattaagaaaactgtggcataaagtggtttgctcaggatcacaaaaattaaagctaaaatttaggctttcttctgtcgctgttctgggagctgttaacaggtgttccgcagtgaggggtttggggatcaaataagttcgaggatggcctcatctccatttccttacttggacagtagtaatccatattaatatattaaagaatctctgcaataagacagataatattaataaaccagatgggatatagggaaaacaagtataaatcaggactagccaaggcaaaccaggatatattttcttcctagctaaaagataggatggggtggaaggagtggtagagagttactgacagatatttgaactcaattaggtttaggtttttttgga

SEQ ID NO: 107282 - DNA, 1039 bp, Homo sapiens
aaattatgggcagctccgtgacaggttaaaagtttacttgttgctgctgctgttattttaaatataggcaacactttaagatataaaatgggcccccaattcactaatattttacaaccttatacatcactcataactcacatataatctgttttgattgtgtgtgtgtttacaaaattatctacaaagcatgtttattatatttctagactcctgtttcctcaaggccaatgatttgactcacagtctttcctcatacctaaaagaaagtaagtaaactctgattttaatctatttaaactcattcttattttgctctggttttgggaatttaggttttggtctcgtttttgttttataacacattaggccattattgctctaggaatccagagaatggtgttctagtcccaggtcccccaccaatttgctgtttgacctgagacgagtcactgagtactcccctggacttaatttcctatctgaaaaataaggaagatggactatgtgatatgtgttccatctgtgagattctgaaattctgtttgcatgtttaccactcagaccatggctattgtgaagtcaatctaattttatcttttcaaaatttattttttgggaggctggagagggacagggtctcactccatctcccaggctggagtgcagtgggtctggtcacagctcagtggagcctcaacctcctgggctctagcgatcctcctgtctcagcctcccaagcagctgggactatagttgtgtgccaccacaagcagctaattttttttttttaattatttttggtagagacagggtctttctatgttgcccaggctggtctcaaactcctgggctcaagagatcctccccactcagcctcccaaagtgctgagattacaggcatgagctactgtgtctggcccttcaatatgtattatatgtagccagcagtaattaaattattcatatcaactgttcatttattcatggccagcaatgaaatagtttagatatagggagtttccattcttctttcaaa

SEQ ID NO: 107283 - DNA, 1020 bp, Homo sapiens
actaaaaagaaaatgtatgtaaagtgcttagcaccatgtcagtatttagtaaatgtttgctgtttttaaatgtttgttccattttatatcttatgttgaatgtccctttaaaatttaacatgattgaatcagcatttgtttcctatttaatcaacattgtcttcaagtatcaaacctaaattaaaatatcaaaaatgtaatattccaaatttttttacttaattttaaaattagtcacatttagggacttggtatgtttgttttgtgttacaaattaatgatactttattttaatctaatatttacaataaccagaaaattgaattacaattgtaattataatgaaccatgcttactatattttgttttgtttaaatactcaacaaagaagaaatgctcaacttgggaggtgtgccctgttttgccatatttcaaataattgttttctgttcttttttccagtttgtcctaagtgggtaaaacttaggaagaaccacagtgagaagaaatcggtcctgatgctgatcatctgcagctcggccgtccgagccctggagctcattaggttggaaggttcacctattccatatcataaatgttttctgaataactgatatatgccaagctattatgttctatgtgctggagatgtagcaataaacaaaacagagtccctgccctcatggaatttatatttcagtgggggagacagataataaacaaatgaagatacattataacgtcaagtacattgataagttatgtaaggaaaaaataaagcatggcaaagggatataagtagatcaggactacttttaaaagggtggtcacagaaagcttctctaaggagatgacaatttgatcagagacttgaacaaagtgaagaagaaagcccagcagctatctggaagaaaagcattccaggtagaggggagagtaagcacaaaagaccccaagataggatgccattataggattttgaggacttacttgatctgaatcatcattttaaaggttcac

SEQ ID NO: 107284 - DNA, 1051 bp, Homo sapiens
ctctgaagtctcaataaaataattaacagtatggaactggcacatgcatgacagatcagatgagtggaacagaattgaaagttcaggatcagacccaaatgcatatgaaaatgtagcatatgcctaaggtgacaaatcagaaatcagtagggaaagacggattgtttaataagtggtgttggaacaactgagtagccatctggaaaaataaagttggattcatatctcacttataacaagataaattccaaatggaataaaaacttaaaggtaaagattatgttttaaagataatttgtcagtgctttactaagggcttgcacatacgttttcatttactattgtttttgtagaataaacaaaaaggcttccactggtcagtggtaatattcagctttcagagaagagccgtgagagtcagatgggatttgctaggaccagctctctctgagagcctggctctgggccaggctttgacaggagacaaaacaaaggaaaatccaagtcctgaagaaagaggaacttggtcaaatagactaaggtgcaaatctagatattcaatagttatttacatctgttttttctaaatgaactaatctaatcatgaatttagaaaagtagttgttaaactgaaatagtccttcaaaccctcctttctccactgaagtggagacacacattaaattgtatcacattatgcacacacattaaattgtagcatataatctcccagtgaaacacttgtgtttctttccattttttctgctctaaacataattatcttgaagattccaactgcttccgggcagctgtacttgccggtcctgaaatcatgggaattcacactgacttttcagtgctttaaaaactacctcatttcacattcagatgctaagggcaaagagtgtggcctggaggtggactcttaaaataaagctatcaaattgatttgaacttttgttatacataaattccttactgagggcataaaagtactgtgttgtcacacttcatttaccaatttgcagtatttttttgtgtccccagtaat

SEQ ID NO: 107285 - DNA, 1069 bp, Homo sapiens
taggatacccagatagttggttaaacattattctgggtgttctgtgatggtatatttgcatgagattaacatttaaatgggtagacctgagcaaagaggattgcccttcataatgtgagagggccttgtcctgtcagttgaaggcctcaatagaacaaaagactgactctccccaaccccccaagagaattctgcctgactgcctcctaactgaaacattggctcttcctgattctgtggcagcctgttggccttcagacttgaattgggacatcagctttgcagattttgggcttttcagccccataatcatgtgagccaattccttataatatatatatatatggtcatataatctcctgttggttctgtttctctggtgaaccctgagtaatacactatctgtgaagctccttttagtctgggatttgagttagttggttttgttgttttataaacagtctaagaaatactattctcattggttttttgctgtaattaccctcttgctaggcattatctatgtaatataatgccatccaatccaatgttggaataagtatttgaatcacaaacataccccaatgttgtgtaggtcaaccctgttcttataatctaatctcatagccttttactgccttttaaacccaagctcttgaccatgttttatttagtaaaacaaatggtaaatgttaactagaagtgttcactgccatctcctcacacaaggctgtttgataccaacaaccgtactagttgccacctccaaattagattcaaatgtcatgctgaaaatttcccgttggtattttgctttttatacagtttgtaaatggaaagctttaactccgaattggaaacttcctagtgtaagcatttgcatcaattttgtattctttcaaactaggtacatttgccaaagtcattactttctttgatacaaaaatagtccaggatggcttctctgactaatgtaaattaaaagggaagattagaaattcacatgctccctaattttaaaaattctaattctaaatcctaaatgccagttttaaaagaagtaattatt

SEQ ID NO: 107286 - DNA, 1044 bp, Homo sapiens
gaacgtatctcctttagtatatagcttcatttacaacttttaaatattcagtcaaaaagtatgtgggccttcatttacacttttgacggggcctcacaaataggggtggtctgcccctttccttacgtcccactctttcttcaaattaaattgctacagcaggaaattactgaactgtggctcttctcctacgtccgccttccctatgtcaattcccatttcccttgctttctccaatagttaggactgtaaattctaactttgttaatttcgacgccaagctggaatgaagacgctaagtggacgctaaaaagacacgctgtttgtcacacaaggcctccaactgggacggcgtccaccgcgccccgccccgcccgcggcaccgtggcatcttgggacatgtagtctttggaggggcagctgcctccaccaagtctcctcccccaagacgctgcctttcggcctcgggacgccgtgacgttgcgttcctccagtcccttgccacctccctctttcttcccctctggggaagctcagtgctggacttccgaagaccttttacgacattgagtctcggagttggtctcagcgccggatccacttttcggcaaagtgacgtggacgtcaacagcaatggcggaaggagaagatgtgccgccgctgccaacgtcgagcggcgacggctggtgagtgaaagccggggctaatttccaatgcccctttattcttccttctcaccatcttgccggtccccgaggagccgtctggcgtcggcatggaacggagaggccggtcctaggcgaagtccggtgccctgccctacccctctgccagctgggtgccccctgcctgcctggttctgcccaagggactggggcgggactcccaaggagaggggtgtcatccaggtgctgggcctcagaacggtcctcctgtgtcgtctgtcagtctccaaagtgtgctggagtgggtggcttcagggctgggtttggccggagtcctggctgtgggagttggagtaggctgaagaaggaagtttgttgg

SEQ ID NO: 107287 - DNA, 1060 bp, Homo sapiens
ttttctaaaatgtatcatatatcttactgcctagctcaaactcatcttaatgacttgagtcattcagtttacaaatgtaagtgtaatttaaggatagaactaggtctctgtcctcagggaatttatgttctagatacaggaggcatgtttgagaacatcgattacttttgtgttattgtaatgtggtgagacttttagggcctatctagacaaattgttgctatgttaagtgacacagctatccctttttgagattgctttttataagtttttcctattttctttttttgttgtcagtggtatctcaatttgttcctagtctgtgaaactaagccattgaacttgttgaaattgtatatacattcttaaaaaggctcaggatggaccttgaagatcttaaaagtatgtggactctatgacattgtttttgctgattttcagttatgttctagttcactgcttctcaaaatttaaacgtacattggaattatctggggagcttgttaaaatgctctccaggtaactgtgattgtgattcaatatattttgaggtggaacttgagagtctctgtttctgactagctgctgggggttgccaattctggtggtttatggaccacacttaagttagcagggttctaggttatatatatatcagaatgagtaggtcagaggaatttgtatatgtcacattgtatcaccttacatgttatactaaaatatgtgtaattacatgacttatcattgttctttagataatgaacttctcaagggcagtggctgataaaaggcaggtgtctcagtaaatgtttattgaatgaatgtacgcatgaatgaaaactttcctgtaattatgtgcaatagcatactaagctgtcatttcatataaatttcctgactccagtgtttttgtgagctgtggaattgtctgttggtataatgcttattctttatggaaagccaaagtaatcagaaaatgcctcagctttcaagctccctgggattcagccatgtaagctcaaagggtgtggtgaaattcttgtaaaaatgcttatagtta

SEQ ID NO: 107288 - DNA, 1008 bp, Homo sapiens
ctgattacattcacatggtgtcatttatcatgttctgtccctggtattttctgtaagccagtagtttagagatgtgttcagacttctttgtttaggggaaggaggttctgagggggtgatgcctgcctcttttagatgataaatactatttagatgtcttttttgtgtttctctttttttttatttatattacttagatccattatgtttttagtagtttgcaaaatggtaacattcccttatttcttcataattagctgtaatgtttctttttatattatcttttaataaaggacccaaaatattttgaaagcttttaaaaatcactctgattacatcctaaaatactgtttaactaattttggtttgaccattgcactattgaaacaataatacaagcaaaatcaagacttgttaatagccttgaagttgttcccttcttcccacccaagcaccagaacttacaatgcataataaggtaaatggatatacctctctctgccaaagtccaaaatgtcaaggaaatgagaaagcccggtaatttaatgtatcacttggtattgtatttatcagtgttttagaactagctaaagttttaattaagtcgcagttttggaagaatttaaattttcttttccattacagaaaaacaaagaatatgtgagtattgccagtggaggatttatgggtaagattttgatttattagtttttttcctctatgtttcagaagaaattgtattgattatcaatagagttgatctggagtggtcacattagttaaagggtagactcttcattcattcaatattttcagaaaaggcaaggccaggaggacttacagataacagacaaacgtaataggcaattgaaattggtgactatttgatgtaagactattttaatagatttgtttccaaaaaatatttttgtaaagatgaatgaaaaactgcccatatgattgcctctatggagaagaaggattaaatgatgggacagggaaggaaga

SEQ ID NO: 107289 - DNA, 1044 bp, Homo sapiens
aaaaccatgaagtatttctttaccaagaataatctctctttccgtaactgttaatggctaacaatgcttctttattatgggagagattgattgatatctccttatggtataacaaaagtcacaatcggttttctgttatcctttatgtcataaaaatgttgcagaaattatctgttaatacttgaaagatttcctttcaaagaagaaaacgtaaagcctatacagttatcatcacattggcgtcagttaagaaaagttatccgtgtacagagggttttagaaggaagaataggaaggtttgctctagcttggaggcctttactcctttacagacgtgcagaaagaaatacctgtgattatttccttcagtccttttttctcagctgtgacatgtttattgtatttcgttggtaatgaatttttccaaagagtgttgatattttaggtttttcttttttttttaatttatcttaagcactgcagcagcacctggcagacattaatgtggatggaccagaaaatggatatggccattggattgctagtacctcaggctcaaggagcagtatcaattctgttgatgtaagtatatgtagagaatatgttaccggatttggataagttcccagaaaaggtgattaactactaaacccccaccataacagaaatggagtcaaaacatttcaaacacatgcaatgaagagtcatattattgtgagattaatgagatgatacagcaagccattatttattgtgagattaatgaaatgatacagcaagccttcacagttaaactaggtgggagctcttgaagttcagctgctgaattcaaatttctccctgtccagctgtagtttggtatcatgtagtgacagttttatgttccagcttaaatatcaatggggacaaatctgggtcctgtaaatagctgggactcttaagcaagctgattccaggcatctcccagttagtttttgccagaatactagggctcataatcatctcgtgcacactatgtctgtacccatccccatcacagactta

SEQ ID NO: 107290 - DNA, 1103 bp, Homo sapiens
gccaccgcgcccagcatctaccttctattcttaaaatgatttcacctaatgaattagtttgcagctgccgcaacaaaatatcatactacaaactgggggcttaaccaatgtaaatttattttcttactgttctggaggctaaaagtccaagatgaaagtattggcaggtttagtttatcctgaggcctctctccttggcttgcagatggatgccttgccttgtgtgtccttacatggcttctctgttttcatgtgctcatgtctttctctcttataaggacaccagtcagactggattagagaccacctgaagacctcatttaaccttaattatgcctgtagaggccttgtctccaaatacagtcacattctgagatatactgggagttaggacttcaacatatgattttggtgggattgcaattcagtctataacatgtagataaccattagcagtagtatgtcttttagtcattcagaggcagttaatccattatgttctttttttagggtgaatctcctaatggctcaagtgatagaggaatgaaatcactagtaaataaaatgactgtggctttgaagacaaaatccgttaatgtcagggaaaaagttatcagttttatagagaatacatcaactcctgtggatcggtgagttgtttatacagtatgagtttatgatgagtaattaaaactaaagaaacaatgtcttagagtaagtaaatgttagttgaatttaatgtgttccagaaaaggattataaagtatattttctattagatgatttcatagttttcattagaattgcaggaatgtactttatatccataattattctctcttactactcaaagatgcaaataatgtatctgtcacatcatgccattcactaaaagaaatttatgtcccagtatgtatcacatttcatatagtagctgcttcccaaatgtcaaatggatggagaatcatctgccgaattcagtgatctcatagtaggaacttcttcttctgctccaagattttaaaacctagaaaatctggtcatgctaaatatagcagaaacccaccttctgatgtttaagatcagaccttcatagaatttcg

SEQ ID NO: 107291 - DNA, 1043 bp, Homo sapiens
ccgcctagcagcagagaaaattatagcacctaaaaataggcaccgttcatggttcaaaatttttgttaatttgtgtacattatgtaattttatatttttagatttttcttaataagatgtatgtatataggttgagttagcatatataaatctcttccaagaaactacagttctagggttctgcctttggtttttgttgaaaaaaaattacatttttttctaggtagttgattactttaatgtataatctgtcacttctctaacccaaataaaacgaggtgcttctcattaaagacaataagtttaaggtttaaaaatctactggatcttcaattagggtaacaaaagaactttactaacttaactctgtgtgactttacagttcttatactcacagaatttttcagcaatttaatttagaatatcaattacagcaacacctacaaacatttaaaaagaaattctataaatcctaagtgggccagaaaaaaaaataaattctagtcatattttcaatgtaagttaagctttggaataatggaatggaatttttctcgggtcacttcagtattctcagtgacttgaagtagcatttttaagaataatacttcactctctaagactatactttcagccgggcgcaatggctcacacctgtaatcccagcactttgggagttggaggtgggcggatcacgaggtcaggaggttgagaccatcctggctaacatagtgaaaccccgtctctacagagtgagactgcgtctcaaaaaataataataataataataatataataataatagttcaccctctaataacttatcttctaagagttttgatttattgtgactatgcctacacaacgccaattacaggacttctgctaataattttacctagcactactttaaaggaaattgcttgttttaaaattacaatctatttgtgaatcatcctttccattttcttctgttacaggaccattgaattagtctaatttttttcaactcccaagttctcaaattattaatttttgtaact

SEQ ID NO: 107292 - DNA, 1048 bp, Homo sapiens
tcttcatttctattgaaacaaaagtaacagtaataaaaaaatgtgaagataacccttaagacacctgcacttatatgagaagccttaaccaatcatattggaatttgaatatttggtgttagtaacttattttacctaacagacatgaaggtagcaccaggcattgtcctaatagttttacaataaaattgactgatttagttcttactataaccctgacaggtagatattgttagcactattttacagaggaggaatcagaaacacaaaaggctaaataacttccgcaaggccaaacagatctaagcattggttttaatatggatattgaaattgtttaaaatttaatttttacatatttaagagcattcagcctaccaaggccttatgccacttttgctaacataatttctttatcttcttttaatttccttaacatagctctcctaaaactatgggtagtacatggggttttgggggggtcaggtaaggaataattacattttgtgtgaatattcaaatgatgcttggtaaaaatctttgataacttcttaagtgattatttctctcctaaaattctttgaatataggcatgtgagcagcagtgacagagtgggcaagccttaccgtggcgtaaagcctgttttcagcattggggatgaagaagaatacgacacaggtgtagtaatacacttagctacagacagctttgctgtcattaggagtgattacagcagtcattctgggaatagccaatcaactgcttttttaaaaaaatgagattctgtagaaataattggagaatctgtggctttctattaagagtttggttttagacaccttgaattgttgtacgtattagaaatccaagcaccaacatggcacatgtatacatatgtaacaaacctgcatgttgtgcgcatgtaccctaaaacttaaagtataataataataaaattttaaaaaaaaggaatccaagcagaaatgttgagtagaggcagttgattataggtgtcttcagctaaggagagaggtttaaactgatgat

SEQ ID NO: 107293 - DNA, 1035 bp, Homo sapiens
aggatttgacacgattttgccctttgatttgattgtagcttcctgttacggcttccagagtatacctattaggctacagttgagtacctcccatctagataataagcattcaattagaatgaatttctcatctttactccgctgatgtaaatgatgtctttatgagatgaagtccaagtaggaatgagcttgtaaattatctctgtcctcaggtcctgtgttaatttatccctgtcagtgttttgtgatcattatgtcatggaggatttcccctgccacaccatgctgtagggagttaacttttcatttgtgcattttctgtttggaaacagcttactgcagagtgggtctgggcatctgctacgacatgcggtttgcagagcttgcacaaatctacgcacagagaggtgaggcagtgtaatagctgtgttatgtgggtgcttggaggcttggttctaggctggtctatgtgggatccttagtcaagaaaagctgggagagggctctttaatttctccatcttcagccctttcacccccatgaggcttcccagacttttgctgtgtatggatgacagggtttttggggggttgtaattaaacacatcatgtagctaaggtaggagctgtgctcataaaggtctggtctacccttgagtccttgttactgtgtttggagagtcacttgaagcccagtagaaatgaagtggatttcaccactcagtacccctagacattgggtacaagtagaaatgtggtctgtgatattttggtccagacgaggagaaatgtgccagtatctgggaagagcgagttcaaaagatgtgggttctagttccaactcttccctttaattggcacagtactttgctaaaatgatttcacctctagagcagtgtggttctcagtttagtcacaggaatgatatgaggattaagaagagagaacctataaagcccctcgtgtggtactcaacaaataccagcatccttactagactgcttgaagctacttccaaatagactgtcacttaacc

SEQ ID NO: 107294 - DNA, 1040 bp, Homo sapiens
attgactacagggctgttgataatcaggtgtatgtggccacagcctctcctgcccgggatgacaaagcctcctatgttgcctggggacacagcaccgtggtgaacccttggtgagtaaggctaagtgagaataggctcagtcggagcttgagcttgagtggtggctcgttggcagatgggttttctggttcctgagcagccaggcgctcacttctcactcccatttccccacatatcctgccagctttctgcctgtctctgtgagaggagcttccatttgaaaaccatgtgagaagcaaatcaccctgctctcatgatcaagcacttggccttagccctcttctgagtttctggtgaccttcactgtcagtcatacttggatcacatggggaaacaaggcagcagtgacaggcaggttgtagtaagagactctgaaatttttggttaaaatttaagttggctgactagtcccagggtaggaatgagttacagggtgaggactttgcttccagcataatgatcagaggagcagtcaggatggttcaataagtgaaactatgaccctctccccaacaaaagggtgaagcattttattactcagtggagccagcacataagcctgcccagacagaattacagtcatacgctcatacgcattccttacagtctacatttgtacagtttacatcctactttcacaacatggtctcaacttgaactctcaggaaattgttcttattaagcccagtttatagatggtagaattacagaggaagcgactggaattccagatgtagcggctagacccagtgtttgaatccaggatatttgccttcagaacttggatgtattccacactagttctctgtatgaaagcacacacacacactggtatgtatgtctacatttcaggatgagtataccagtaacaagactgagaagagttaaatgttactgtggggttcctgagggttctgtcttctgcctttataggtagggctcagagctcaatgtgtgtggtggggaggccttggaagata

SEQ ID NO: 107295 - DNA, 1033 bp, Homo sapiens
aagcaatcgtgtattcagacataggtaagattttcctgggcatggtttaggtctctgatgtccccattgttctgaggccagactccatggctgggaagtccctgtcatttggaggggttcctttatgccccttctcattgatctctggggatattctagggtctggttctctggccaatccctggggagtgtatcagcttgaattttcttggtttggtttgaaatgatgccaggccatctgtgcacctagataagacctatgttactaagttacttactaagactctggtggtttatacagtcaggggaagaaatccccttggttagtgaggagttgcaaattattaatagtgcactttcctgttttttgcagacctgaagaagctggctgaaatacgccagcaaatccccgtttttagacagaagcgatcagacctctatgctgtggagatgaaaaagccctaaagtttatgtttctaatgtgtcacagaataggacgatatgattctacaacataatcaactccctattaaattctttaatgaagattttttttttaattcggccttgtccttcctaggttctctattgagatgagaaagcctcattatgctgacattttccacgccacattaaatagttaaaaaggatgcagcctggagccagagagcagaaagctgggctggttctgaagcttcttccatacttaagttgcctccaagcagtttgtgaaagtatcagatcttggtatcctggtgattgattcacctaatataaatatatttgtgtcatgaacctcttatcccgttgctggagttgtaatctccatcatctagaaaacgtggtctggtgctattcttttccaagcagtaccttgaagttccatttttggttcatgagtagctatagaacgcaaggtgatacatctttggtgtttgccagagaagttggcagccccacccctcctaccagcctttgcactcttcaaatttaaaaaggagctacttatcaaccccaggcccttctggtctta

SEQ ID NO: 107296 - DNA, 3405 bp, Homo sapiens
aattgaactttgaaaaaatccattctgaaccttacaattaaataagtgaatttgaataaatgaaattgcagattatcctaggattttgcagatctgctagctgttggcctaatgccagaacatgaactcttgaaaaaagttttttttaaaaataagcctatcacgttgccatatattataatgggggattaaatatagtcaccctagtggtacctcttactggcatataaagtctaactggcacatatgccaataaaatgtaccttactaacatgtatgccagttagactctgtatatgcaggtatatatatatatagtagggacttaatattctttgtaggattgcatatatatgtagctaatactagttacttaaaacagttggttcttagatagctgtggatttgaccagaatcaggcagaggcaataaatctgagtatttattgagtaggtgtgaggaactcacatagactgcctgaagagtagagatgcatggggttggggatgtgctggtaagagatgaaacagaaagaggtgggcccacatcagtctgtgaaggtaaggcccttgcatgtcattagtgtcccggtattatgtcactgctttctaaaggagtctcatgttaacagtagaaacatgtaaaatttaggaaccagacggaattgtgattttaaataagccaatcaatttccctagtctgactgttcttatcagtaaacacagaatacaagggatataatgtaagcacatagtatttgtaatagtagttgacattcattgagtgctttcaatgtggtaggtactcttgtttattttaaaagaagcattttactagaatcatagtagaaacttagtggtcagacttcatgtagcatcacttacaaccttcattgaatattgtgaagaaacttagtggtcagacttcatgtaccatcacttacaaccttcattgaatattgtgaagtgcttgttgaatctgagacttaaaaattttgttcttttagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattcaagctcttctatctattctttaaatagaaagataggtagtttaggctgggcatggtggctcacacctgtaatcccagcactttagcaggccgaggcgggcagatcacgaggtcaggagatcgagaccatcctggctaacacggtga

SEQ ID NO: 107297 - DNA, 2065 bp, Homo sapiens
agggggatcacttgaacccaagaggcggaggttgcagaaaacagagattgcgccactacaccccagcctgggtgacaagaatgaaactctatctcaaaaaaaaaaaaaaaaaaattcccttgggctgtattatgataaattatgaataagtgatgtgactgtacctatgagaatgtgatattagagctgtgactaagaatgggattatctgtattgaacagtttaccagagattatctgctgtggcatataactaaccacttgctgaagaaagaggatagttaagatttcatatttatagcagtgccacctaaaaactccgataattaagatgtaaaatgtaaatcagtctgtatccccaaaacgtgataattttgtaataatgaatgaagtaaatttttataatgaataataagtatacttttaactgcttaggttgacggttaccttaatataactgaagtatctcctcacataggcattaacagatcaacaacagtttggtaaagctgatgaaatgtatgataaatgtattgatttggaaccagataatgctacaacatatgttcataaagggtatgtatttttgtgattgttccaatgagataataaatttcttgcatagtaataaaatgtatttattttggccactgaggaaggggactgtggtagagaagttaattgacaaacttcttaatgctcctagatgtcttttcattcttacagaaattagttaaggaggccaggcgcagtggcttacacgtaatcctagtactttgggaggccgaggcaggcagatcatctgaggttgggagttcgaaaccctcctgaccaacatggtgaaacccggtgtctactaaaactacaaaaaattagccaggtgtggtggcacatgcccgattcccagctactcagcaggctaaggagtgagaatcacttgaacctgggaggcagaggttgcagtgagccaagattgcaccactgctctccagcctgggcggcagagtgaggctctgtcccaaaaaaaacaaaaagaaagaaattaatgtactattcttgctctgtgttaagggttttaatttcaaactgaacatcctgtcagctgttggcttatatccaaatacgaagcatacacaagtgttcgtgtccttgcgtacttgaattatcctaagaaacttcacttaaatttatataaagtgaaaaataagggatgcaagattggtaatagagcctagaccattgaacactttttgtaataaggaacttagactagcaaaccaatataagctgagaaaaaaaacacaatttgatgctgattatatattgccttataagttataagttaacttataagttcattgaaggcagaaattgagtcatattaatgtgtgtgtattcctactgatactgggccatggtcacatctgacatttttttgcatttgcagtttacttcaacttcagtggaagcaagatctggatagaggtttggaacttatcagcaaggctattgaaattgacaataaatgtgattttgcctatgaaaccatgggaactattgaagtacaaaggtaacttctggagtctgttaggaaatatatggtagctccatagatatttagctttttgttcttattacgtacatgttaaagtctgttatgttctttcctcttttcacctgtattattcacgttggaaaaaaaaatgtgctaaggcagtgacataaggattggtagccaagttgccagaaaatctggaccctcctccaaagaagcatccagccaaatggctgggcaagttgcaacatcaactcagagcccctgaattttctttaaaatcagagttggataagaacattttttgcagctctgtccttaacctcttattttgtgtaagtgtttatccagagttgctcttaagatccaccattaaaaggtgacagctgttttatatatgggatttattgtataccatcttaatactggtattgccattcatttgagtttcctactttaggccaagtattaaactttagatgtttcctaagtactatttcaattaatcttc

SEQ ID NO: 107298 - DNA, 1495 bp, Homo sapiens
gcccttttggaaattagtttggcaattcctcagaaacttaccatatgatctagtaattccactcctaggtatatacccaagagaatttaatacgttcgttaacacaaaaacttgtacatgagagctgggtgtggaggctcacacctgtaatcccagcactttggaaacccaggagttctagactaccctgggtaacgtagcaaaatctcatctctatttttaaaaagcttttttaaaaaccttgtatgtgaatgttcatagcagcattatttatggtagccaaaaagtggaagcagctcaaatgtccatcagttgatgaatggataaataaaatgtgatatctgtacaatggaatatttttcaggcataacaaaagaatgaaaaactgatacatgctacaatatggatgaaccttgaaaacattatgctaaatcaaagaagccagacacaaaaggctatatataatgtatgattccacttacatgaaacatccagaatatacaaatccatagaaatagaaaataggttggtgttttctaggggctgaagagtaggaggtgagggggatggagagtgactgcttatttgtatgtggtttcttttaagggtgatgaaaatgttctggaattagatagtggtaatcaacacacaacttagtgaatacactaaaaacaggtgacatgcatactttaaaagggtgacctttgtgatatgtggattatagaaaaaagctgttatttaaagaaactagattggagggaaaaaaaagtaatgatgaacctttcctcacttggggtatatagcttcgagcaaatgctctcatcaaaagaggcagcatgtacatgcaacagcagcagcctttgctgtccactcaagattttaacatggctgctgacatcgatcctcagaatgcagatgtttatcaccaccgaggacaggtaagtctgttttcttacctagaggtctgacttgtggattgagctttgataccatttttgagaatttcttatgtaattttcttgagttttcttatataatttctgatagctgtgaacaaagtatcacagtggtttacagtttgaattggcctttgtttagtctgtcttgaatatttgtctttaattttggtatttacttatgaaaaaagagtaaaggaaggcaaaaactgttggcttaccagttcaagtttgtttttctggtgtttctggttcataggtttcaatgagtaaaacattaataacatttagtaagcaatgtgagttaattctagaatcaacaggatgatttttgtgagcttcttgctataaggaaatagtctggactgtccaaatagtaaaaataaatatatttatcttttgaagttttataacaggcatattagttttttagtagaaatatatagtgaagaaacagtttccaattactgcctcaagtggggaaaacatggctttataatcagcttaacatggcttcttggaatgcattatggtataaa

SEQ ID NO: 107299 - DNA, 1132 bp, Homo sapiens
taaagcattcaaaatacattatgagagccttttgggtgtgttatttccactttatttaaaacttatttatttaaaacggtaattgtgtttcgggaggaacaaaatactcccataattgtgaattgggtggctatgcctcaaataaataatcaaaacaggaaatgtgatttcagtatggttttcagtggcacttacctgtaataaagatcttcagatgaaagcccaaggtaaatggacttaacattttcagcacctgtgtaagatgtggtcttacatctttgtagagggaaaaggctctcatttaaaaccagctttaaacagctgggactggcagcttcaccttttccactgtcttttgttctgtggcttggagcttaattttagttatttgaaaatgagaatccaatttttatgacagttattcttagcgttctacaatgtacctgcttctttggttggtatttcccatcctgatgtctttaaacatgactaaatttcagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaagtaagtatgtcaagcatagtgtctacttagtggtgttttgggtgctttgaactttccttagggcccatatgggttctgagccatctcacaacagcagctatctatctacagatagagatagacagaaatataattaaaaattatataatattattattataaaaacacttttctttctagcatgtatctgttacttctctggtaactcagggttttactgccaggagtctaccctgcttttactcaaggtcctatatgatcttctcaaaaggactccgattgaatccagtggctgaccgtgtttgaatagaggcaataacttgaaaattattgtgtagctcaacatgcagatgttctagtgcagggaagtttttaatttataaacagatacttttaggggtgcccaaagagtgaattttttcaaggatttttctgcttgtctaggaagatgcccatttggagggcttcttgttggagcctgta

SEQ ID NO: 107300 - DNA, 1053 bp, Homo sapiens
tgacataaccagatgaaaatggtattgaggcagatttatttgagagctctgtggcaagatggctttggagacagggaataactctgaggcctataaacaaacaccagacatgagagagccacactatgtttatatgccttagagttgctagccagaagagaatgttagagtggtgagaaacatcagaaatcatgcagcatagcccctttcatttcacagttaaggaaagcaaaccccagagaagtggagtgactttctgagctttcagtttggtcatagagaatataaaattaggtattaagaatcagttaattggaaatgaaacagtcccatttggccatgaatttagtttggctttctgtagttacattgtacccatttgatgctgctgaccatctttgcaataattttatatttacccttgtgtttttcatcatttctagatgtcactgctgtgtgtatattagaagggttccaaaatcaacaaagcatgctgttagccgataaagttcttaaactccttggaaaagagaaagccaaagaaaaatataaggtaaattgatctgatttggggaatgggggagtactgtgtacattgtgaagggtattttctaatttatgctgcttaagcttaggcatagtggtaatggcaacaactgcaattagaactgggttatatttcttcttcctgttatctttggcttttatggcttgtccttcttcagtaagaatatatgctctgtccattactctacctggagaatattggaattcatctgtgttagggattgccacactgtggcccataggccaaatccagtctgctacctgtttttataaataatgttcagtcacatgttgttttcagctgcctttgagatacaacagcggagttgagtggttgtgacaaactgtatagactccaaagcctaaaatatttactatctggcctttcacagaaaaatatttttctatattattaaagtttttaaaggtatactgagtaagttggcattagttttaggctattattaacaggtagtttaattcaac

SEQ ID NO: 107301 - DNA, 1571 bp, Homo sapiens
tcgggactgcaggcgtgtgccaccatacccagctattttttgtatttttaatagagacggggttccgacacgttgcccaggctggtctcaaactcctggcctcaagtgatccacccgcctcagcctcccaaagtgttgagattataggcatgagctgccatgcctggccaagatatgctttttgactcaacaatcctactagttagaatctattccatgaagatatttgtatgaagcaacttacattgtaaacagccattctgtcttcctgtttttatcaatttattgtttaattactgtggtctgagtctgtgaatgttgattagtgtttgataattgtttcctctcatttcagaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttggtatgtactctaggttgtttcttctgttccttttctttctctttatttgcttaaagtttcagttaaagctactcaaataaacctaatacattttttgaagttgtttcaaaattatgggatgttgttcttatttccattaattgcaaaactttttaaagaacaaattctatagttttgctgactacagatatactccaaagttaagtatatttcacattttataaaattagatagtatagaaagtttctggtgaccctattctcctcaacagtttgaggctatttctttaactttttgatatttatatgagcttttgtaatatattgcagatattaactctttgtattaggaatacttttttattctaggacttttaatactcaacctatcaagtttaaactgatttctattgaacagtactttctttagtgtgactttttttaaatactttcaattacagcaaaaatggaaagaagtggcacaagactgtacaaaagctgttgaacttaatcccaaatatgtgaaagctctctttagacgtgcaaaagcccatgagaagctagacaataagaaggaatgtttagaaggtgagggtaattttgtgtttacatatgaaaattacttaatattttgtagtcattggtaaatgtatatgaaactgccttgtgagtgcaagaatcagttgtttttaaaagttggattcctttgcacttaagattgtgtcttctagtttaaagtaagattgctgatacttaagtattgtctctgttctcaactatggaattaaatgactattaagattaggagtttatgtactacacattttaaacttagcagctaatgagcattagtataattctctgaataaggaaatcagaaaagaagttttagcaagtgatagtgtttctaaggttctacatatttcatttaatatgtataaatatagctttgagagctgtgtttataatatgtataaacatagctttgagatgaatcattaaagaaaacattgttttgtgcccttggtattttcaaacattat

SEQ ID NO: 107302 - DNA, 1082 bp, Homo sapiens
tcattgtggtttcagccaccccacctcatcccaggggatctgtaccattggtatttgataaaacctagccatctccttttcacattttagatgtcctaattcctcttttccacgttgtctggatcaacactgatgattttttaatttcatgatatttcagagttttttagttttacaaataactttttttttttgatacggagtctcactctgtcacccaggctggagtgcaatggcgaggtctcggctcactgcaacctctgcctcctgggctcaagagattgtcctgcctcagcctcccaagtagctgggattacaggcacgcaccaccacgcctggctaatttttgtatttttagtagagacagggtttcaccatgttcgccaggctggtctcaaactcctgacctcgtgattcacccgccttggcctcccaaagtgctgggattacaggcatgagccactgcccctgaccacaaataactttttattcacctgactgctgttaaaaattagaatttaagattggactctttgtgtaacttaaactgctttaaaatgatttatttttggccccaaataaaataaggcaaaacatttgcacttaccattgtccatcttgtggaatatgtaggcctacacctgtaatctttgaattactagattgttctttggtaaagcaacaataggaaggtctttgtgatttttttaaactggaaatttatatcttaactgttggtgaccagtaaatattgaaagactacttttgtcttcttttaatagtctggtccttagagttattattagactatctaaatgtaattaattgatcagtaattgtaatttcttatctgtggttggataaactgctgtacatttgaatagcacctctaaattggcatcctcggtggatttcgcaaccagaagcatttgctttcactgatggaaacctggcagaatcctgatgccctaactgtcctttctccacctgagcaatagctacagtttttaaaggaatgaataaatagacaaatattgtctgtttagggtttgatatcagaaaatagaatggaaaatctgtat

SEQ ID NO: 107303 - DNA, 1900 bp, Homo sapiens
caaaaacaaaaacgattagatggctttctacatagaaaaagaaagactacacaggttctaaagagtgaaatggtgttcagtggcatttgttttacagcctctgaactgtaagcagaactgtcaagctcccaaggctcgtcctctctcagcaaccccgaagcccccttggctgcaagcactcagcgcccgtaacctctcctgccatgccccagccccaaggtgtccttttgcactccggaccccttggcctttgtcagaaaacgctctgcactgcactgtcccctcttgctgcacaagagtagcggccacagcaatgctcaccaggcttggttgcacacagccccctgccccaggtccaggcctacacacacatacaaaaaaaaaaaaaaaaaaaatgggagtgacttcttaaactttttgattggaagcatcttaaattcagtttttccatttcacctggaaatgtacatgaccaagcctaatatgcatgatacagtttctctgatgtgaggccaagcattggattatttagtgaactgctttgtatggttttggtgaactgactgttaaatccttttggtatctgacagctgtgcagagaattagtctggctgcatttgacaatactgggattgggtgtggtggattttctctgggtctggagttgttcaatggtagtaccagagtaagtcgaggtcagagaaacgtttggtcaaatatctcccagttttatacataagtatatacagttggtcaagtaacttctaattgtatccaagtgtatacacttaaatatgtatgcaagtcatttccatattatactattcaggttgaattttttttttttttttgagatggagtctcactttgttgcccaggctggagtgcagtggtgcgatctcagctcaccaccacctccgcctcctgggttcaagcagttctgcctcagcctccggaatagctgggactacaggcgcgcgccaccatgccccgctaatttttgtatttttagtagagacggggtttcactgtgttggccaggctggtcttgaactcctgacctcaggtgatctgcccatcttggcctcccaaagtgctgggattacaggcgtgagccaccgcgcccgggcgaagatatttttactaggatgtcaaattagctttaaaggaagttttggtgtaggaatgaacaaactagtatctgcagtgtgtgaggcattgtgctaggccatgagaaagccatatgatctttcctatgggagagtgaagcattacctattttctaaaaggtttatgactggatagtagaagaacttatggactgtgttagaactaggatttgtaagctttatagtgggctctccagcattgtcactttgggaaagtcattttgtctccttgaccttagcgtcatccctgtagaataagaggattaaaatattagatctcttctgtttctttcagtactaaaaattgatgattctcattatgatcatttataatagctcactgctgctattaaaagtagttatcaagaggattatttgaattaattatcacttgtcttacatcaattttggatgtctgaaattctccagtcattttctatttcgtttgttaatttagttttaatcatggaagaatagtaggtaaaataaaagatccaaaaagttctcagttctgtaaacattaaaaataaagatagtttctatacatgaaactaaatttttttttttttttttttttgagacagcgtctaaccctgtcacccaggctggagtgcagtggcacgatcttggctcactgcaacctctgcctcctgagttcaagcagttctcctgcctcagcctcctgagtagctgggattacaggcatgcgccaccatgcctggctaattttt

SEQ ID NO: 107304 - DNA, 1193 bp, Homo sapiens
tgtcctctgccaccgcctccctgtctgtcgcgagcgccacaatcaccaaacagcgtgcgaaggaagaccgagggagggaaggaaagcaatgagcgagcgagcacgctaggcagagagagcggacgacagaaaagggccagaggtcaccggaagcccagggcatgccgggccagacctggccgtccttctcctccagtatcaaccgaagagggagaggaggggcggaaatcacttccgggttaagggaaagcgtgggtgtgagtaggagtcttcggaaaccctttttctttcttttcgccccgctgctgttcgggagatggacttctggagtccccgtcgtagctggtgttgtcccctctaccttcaggaaagaagggcagatggccctcttgcctactgaagccgaggaggggcgcgtatacagcgggctaagggcgctcaagagatccgagtggaagaaaaagcagcggcacagcactggaatgggcgggagtggcagaagagttgtgaaggctattggctagcaagggtggtgggcggggcgtagaccgagctacccagtttactggtcgatttcggatccagttttccagttatagccacgttggcacctcttgaacctctgtggccgttagcacggttttctgcccgcgtgcccgagaaaccaacggattagaaggacttttaaagatgtgtgaggaaagagctcaccgctgaagaaggctgctgcatcactgaacttcttatcactaacatagcgagattttagtttggacgaatttgaggttataggggagatagcgatggcagaagactaggtggaaatggcacatctaggttggctgcagtcgaaacggtttgagcgtggtcgctgtggctcatcgtcggcaccaattaacgaagcgatgacatctgcgttgttaggggtttcttaaactgagttggtagaaatgcgaagcgtcagggttcccgccggcttcgagcctttcttggcgtatttgtatcttgagctgatttctgcgtcagcccacatctcgctctgatccgcacgccccccgggttgttttgcagtagcagtctcagccctcttctcgtctcattcccaaatcgtaatttcagttcacagctttttatctataatagctttatcaactctttttccgatgctctgcaccagatctcttaaaatataa

SEQ ID NO: 107305 - DNA, 1029 bp, Homo sapiens
tctctttgtaatgtgttgagacttcctttggaatacggcccagtgtcagtggttgtaaatgatccatgtagtcaaaggaaagtatatcctctgtttggtttaggagtcctcatatatttactagatcaagtttgttaaaaagcgaaatattcaaataaagaaaggcaggacaagaggggaaaccccaagagagcggaattataaacataagagcagaattaatgaaattaattagtgttcagttaataatgactaattaatgtctaggatctgaaggaggaagctgtgggttatacctcaactgggaataggttggcttagtgttgccccttttggcagataaatgttttcatatttcccccaaaagcttttctaaggaagagattaatgtctttgggcataaatccgtgattatttagaaaatttttcatctaccaatatgtctagactagactgtttccttcttcctggtggtcagcctaaataatgtccgcagctttaaagaaaaatgaacatttaataccagcgcaaacacacacactggcaggaaatgaaggtttagccatagtgacattcccactactgcacccctctgaaacaaaactgtctagaaacttaggtgaatatattatgcttccagtcggtaagtgtggcatatgaatgtttacagcaaaacgctgtcttaagctaacaatattatgtcgtgacttgcttttcaccatattaccatatttttttctcactacttctccataaatggttaatatgttaatacttgtgcatgaactgtgtatagagggattagataaaacatccacctagactcttggaaccgtaagtatggagatgtgaattgaaggaaaccaatactcagattggccacttttttatcacacacatataaatgattgggtaatacgtaaatggagagggaatttcccttccaacttattagcaatgctttctttcctgaaccacatcacagtcaaaaatgctttctcaataacctagccacatcatgcaatttaa

SEQ ID NO: 107306 - DNA, 1069 bp, Homo sapiens
ctgcggagaggcggcggccgcggcctccgcaagccggtatggccactggagacgggggttgcgggcgctctgtccgaggaggccgggagactaggaggcgctgggagggcctcgttcgaaccgcgcggcagctggggtcggaggcactgtgggaaggggctggagggaggagggggtgggagggaggagggggtgggagggaggacgaggccgggggggagggcgggcggggccttgcatggggggaggggaagggaggtcgcggagggggaggggagagaggcaacccctggctgcggtggccaggaggcgcgcctggggggctccgggaggggagtgcgccagctaatgccttggtgcagcctgcctccaagcgtttggattgagaggagaggggctttgggaggtttggggcggccggcgcccaatacccgaaggagctcggaagggtgtggagtggcgcctacgggaataagttgattggggtcatagaatcggagcctagttccttggctaagtcagcgcttaatcaagcgccggctggaggcccagcctggtttatagtgatgattctagctaactttaagagtttgctttgctggacactacagtaagtattttggatgcactgtctcatttaatcatcacaaggattcctccaaattcagatatggttgttttcatttcgaatgtgatgaaagtgagccttggaggacttaagatcacatagctagtagtgagaatctttaccgtcttgctgcactgcctttgaggcagggtttgaggcctcttggcattctttagaataattacaggttgacttggcttagtatttcttgaaggaaactgctcccctcaggaggtgcttaagccacagcctctgaaattgagcagggtcttacccttagaggtagtagaaccagaagtttgtccgccgaacctagaacctggttcaggaggcaggctttttatatgaccttgggcgtgtcagattattcccagtgctgagaaaagtgtacctggtagagggttatattatacaagttagaagccgagtcatttctggact

SEQ ID NO: 107307 - DNA, 1225 bp, Homo sapiens
tcatttaggcaagtgatgatggtggcttgaatcaagttgatagcagtgaaggtgctgaagtggttggaccccagagttattttaaaggcagtggcaaccatattttcttggcagtttggatgtaaggtttgagagagagagatcaaccaagatttttttgtcttatacaactcgaaggaagataaagaagcctctaggagaggcaggttttaggtggaagatcaggaatttatttttagatatattaagaaaaatctaaatggtcatgtcagatgaacagttaaatatgagaaaaaataatagtagacgtaaaataaaagcttattttattatccctacagtaaaataatgttgcctccagaccattttaacataaatatggtaacatggggataatgaatcttttggaggctagagtttcttagcatctaatagtagctttgctctcaacttttacggtatgttttgttgtttaattatcaaaaccacttttatcagtctttctctagagttgtatatatagaacatcctggagtccaccatgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaaggtaagagtgtttttaaagctattttttaaagtctttttaaaaaaaaaaaaaaaaagacagagcctctgttgcccaggctggagtacagtggtgtgatcatagctcagtgtcacctcaaactcctgggctcaagcaatcctgcctcggcctcccaaagtgctgggattacaggcatgaactgccatgcctgaccttaaagtcttaagtattgtatgtgttattttgcccatttttattggactctttcccatcctctcttcacggtagttgagacctcactttcttgtattgaatgtgatgttcctatagttactataattctctcatcagttaaaattagctaagtggggccgggcgcagcagctcatgcctgtaatcccagcactttgggagaccgaggtaggcggatcatttgaggtcaggagttcaagatcagcctggccaacatggcgaaaccctgtctctactaaaaataccaaaaattagctgggcgtggtggt

SEQ ID NO: 107308 - DNA, 1018 bp, Homo sapiens
atgtttcggcaaacacactgagtagaattatagtagtagactgtatttcctattcttcaacctgccttctttgttaatatctctgctgaaattttctctttaggtggttaccagtgttttttactgtggaacttacttgcagtgtatttaatcttgacctcactgtttagcactgctacccacaccatccttgtttttaaatacttttacctcttaacatctctgacactgcttaacctagttttcttatcactaacagttttttctctgtctgtgttagggttgggcttaaagtaatgccagcagatataatagaaatcttaaaatctgagtggtttaatagttgagaaatctttcagggatccaggttgaaagaagctgttaccttcaacacatggcttataagctcaccataggcattgacattggcaagcagatgagtgaagacagagtatgaagaatcatatgggagattttactcactaggcctgatggtgttgtatgtcatttctgcccttatgacattggtcagtacccagttacatggctttgctaagatgcaaatgggttgggaagtatagtccctggctgagcagccacttagcacaacttatactgtggaggagaagtgtaaatcactggtgatcagttaaattgaccatctagctaaaggtataattctcctttgtttttgtgatgtgtagtctaagaatacccaaaacaaatttttgagagttgcccatgttaagaaacaataaaggatagtacttttttcctgttttcttatgcttatcatacattgatttgcacctctgtgactttgaaatgtgtgtcttaatttgatcagtgaattttttttttttttgagacagggtctcactctcatccaggctacagtgcagtggcatgattatagctcatcataacctttaactcctgtccccaggcaatactgccaacccggcctcccaaaggcataagccaccatgcccagcctacaattcagatttttaacttt

SEQ ID NO: 107309 - DNA, 2099 bp, Homo sapiens
gtccgttggtcacagttcatggacccttagcttgaggtgtcctcgttgtagtttgtcttccacatttagttacaactttgtatttcatggttttttttttttttttttttttttttgagacaaagtcttgctttgtcgtttaggctggagtacagtggggtgatcttggctcactgcagcctccacatcccaggttcaagtgattctcctgcctcggcctcccaagtagctggaattataggcacacaccaccacactcggctgatttttgtatttttagtagagacggagtttctccatgttggccaggctggtctcgaactcctgacctcaggtgatccgcccacctcagcctcccaaactgctgggattacaggtgtgagccaccgcacttggccaaaaagtttttgattgttttgatttgtgtccgttagattctgttagtagagtggagggatggcttaggtaaagttcctgccatcagagatactctgtttctgttgtaggattcagaaaagaaaaaaagaacaggaagttttcttcttttacatacatactttattttctttaaaaaatgtgtttatgaaaattgaacattaaacaagtatgttatgggaagtgggtctggctataaggagctaaaaacagttataaaattctcagttttgtcatctttgcccaaaataaatccaactaattagtgttaaagtaggtgcagcagagcatcccagaagtagtcttgtggcctccccaggacagaactcctccccacccaactgtttgtgaagacaccctgcagaggtccctgatgaactccttgtctctggctgcttttctgttcttgctttctttagagaatgtatttttcccttagccctttgaaagcttttgagacacacagttggtatgccaattatagcattctttatccctgagatctgggggatttcacggtcataaatacacactgttttgaatatataaatatttttctggggagagttgattgttttcatcttaatatcaaaatggtcagtgacctgaaagaatttactgtctatccattcattaaagcagttttgcaacagtagtgttttactctacctatgattaagatttgaactttgggaaacttttttatttcttggtaaaagatgtaaattttttggaatgaaaagatttcagtctaaaccaacaatttatgatattgctctctatgaatctcttactagtgactaataaatattaaggcacttaatggattcactttagctgtattttttcatgtggatatgtgtaaataccttgccataagagtaataagcaaaattgatttagtatatttttgaacaaatgcatttttgctagacctttaaagtttaaggtttctatgggagagtccaactatgttctacaatctacattttggatttttaatttttactagtttactgcttatacaaatctgaaaatttaaaaaattaaaaaacaaccttttttttttttaaattccagatggagatcttataacaatttttgatagttctgacctttcctttgcaattcagtgcagtaggatactgaaactgacattatttggtgagtagtaaactttctaatgaatttactattttattcattgtattttaaagatgtttggcttttttccttttaaagactcaggtaagcaataacttattcaaatattattacatttatttgtgttcaggtagttgttttagattacttgaagcttatggctgtgtatgtttttaagaaaatgatagaagtttaattcagtaagaacagagtgttaagtatgttttttttgaaatcaggtataacttaggtatccctggtgcagtattatagttttaatttagctgtattagaatttttaaattgtaattatcttccttcacattacagtatgttgttacttattatcagggcttaacatgtaagtctgatacttgaaaccagtagtcgccaacctttttgcactggaaactggtttcgtgtaagacagttcttctatggaagggggcaggagaaggtttggggatgaaactcttccactttgcatgtgcaattcacaa

SEQ ID NO: 107310 - DNA, 1087 bp, Homo sapiens
agagggataacagacctatcagtcatgttatatctttaaacatgtatagagtaaggtatttttgtattattttaagaatagcgtgaaataaaatgagctttttaagttatataatttttattaaatttaataatttctattaaatttaataaatatttaagaacagcatgaaataaagtgagcttttgaagttatgatttttattaaatttaatcatttctattaaaaagtagagctcggattttcctaccaaacctttttaccagtaaggtcataggctataggtatggcatcaagaaagactgataattctgctttttttccaaaataagttattagccatagagaattctttttttttaaaaaaaaagttactccattacattgatatcttgtttttgtttttttaaaggaattgtatttatttttccttgttgcatattattagtatacttattcatgaacttctaattttaagcaaataaatgtttttatttcagttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatggtaaaccctgaatccattgtattctgacttattgttcttacgtctttttggaggttttaaaaaactctttttaagtaggagaaggatggcatccccaatgtcactcttgtttcttcctctgcctctctactagtatttatgtctgtgttcctaaactttgctgttcatcagaattactaggaggtttcattataccaatttctggatctcatcatagacctactggagcgtagcacctggaaatcccatttttaaagtgttttttgggtgattctttcgcaactagtcttagacttttggatttgttacacaggtcagttttcaaatccttttgacacatgaaccctttttagtataatagataagtaatgaaccttgggaattgaaaatcatttcatgaataattacatagtgttggaagtattttcaactaaaaatca

SEQ ID NO: 107311 - DNA, 1067 bp, Homo sapiens
gagccaggaggatcacttgagcccaggagtttgagactaggctgggtgacatagtgagaccctgtccctacaaaataaaaaaagatttaaaaaaattagccaggtgctatggcatgtgcctatagttccagctacttgggaagctgaagtgggaggattgtttgcattgttgaattgaagtgggtggtctaggctgcagtgagctgtatcactccactgcactccagcctgggcaacagaacgagaccctgtctcaaaaacaaacaaagccaaaaaaaaaaaaatccacagagttgtctgttggatgaacaccagtcattatggactagcaggtgacattttgctgatgaatcagtggtttgcgaagaatttcttattgcttaagccttttctcaaccaactttaattaactcctcctctgcaccaaaatgctactgccaaaactagaacaaactagaactaaagcagatgtcagctgaaatggacaaaagcagagtataggtatgatgagagtttaatgcctacatcaagcgaactaaagatttgtttttaaataaatcccattttaagcagtgtatactgtgatacaatgacagttggaaggatcattgtaccaaataatgtttgctgtttatgtataaataaatgggaattaaggcgctactagcaatatctaaacattctatgaagtgtttaattgagcattttcaaataagtaaaattttaaaaatgcgaaaggacatacagtgaaaattctctctcccacctctgtccacagcaaccaaattccttttttcagaggtagcagattaacactgtttatatgcatttaatttttagagtagtattgtatgccttgctgcaattaactgttagcttacattaaaacatacagtatgaaaattgtacaattaatatgtgacatcatttaaactattaataactgatctaattctagatcagtgctgtccaaaagaattacgatagaagccacatgtagtttttctatttagcagcattagaaaaatgtttaagaaaaggtaaaattaattttatttagcctaatg

SEQ ID NO: 107312 - DNA, 1119 bp, Homo sapiens
agaaggtaactttgtgcagcatctaccattttccaggaattgtagtcccacattcataccactgaacataattgatttgggtgtgaccacctatttctccaaattggacaggttcctggcgaactgctctgaaataacctgagagagaaaatagtttcattttaatagctgctgtattatatttttgccctcacagctcatagattgaaggatgtcgttgactagctgaaggctaatcttagtgaagcgaggtaatttagaaaactgagagcaagaagttctggtgttttttcctgaggtgtagtcatggttggctaaaatgggcacctgaaaaattgttgacatttgccgtgtcaagttaggaggggatggttggtagtgagtttcactgcccattatgtgttcaaagaacttagtaggtcatctttcagtattgttggtatttttaagtgcccgtgaacaaaatgtgttactgaaaaatcgaatcaaatagtttatttagagaacctccaggtgattctggactaataggaacaattaatttacccccttctgcactgcttagacaaggattaattttcagtcttattcagtcctcattacacagcttggtgccaatgggtctttagcaatttacagaggttattcatttcccacagaattattctaattatatttatacagttacttgcaaggtaagtactattttttccatttatgatagcagtagttaaaaaattttttttcttaaggaaataaaaataacgcaagtacactcagtatgacaaaacccataacattaataaatgagtgatttaagtttgggaaactgcttttttatagctgtttttgcaagtttagagtttcttgaagtagaatgcatttatattatgtctgtaatttcccttggctccaggtttctaagctgagaaacttacattgaagtcttcattttttcctagatatgtggagcagtagtactatagaattctttttaaattgcttgctttcctcagcttgatttctttctgagttaatctgtaaaactctgttcttatgaggaggatcagaaaacataccttctttgattggtaactggtcagaagtgagttgctgccc

SEQ ID NO: 107313 - DNA, 1042 bp, Homo sapiens
tttgagaactactagactaagctatagttagtctgtttaactgtagactaagctatgggaatagatacacataaatgtttctttgcaaggacttcctagttgtatcgcctggaacttgggtcttctgtggatcacaggattctatgatgtctccagaaaagaggcatggtaatgttgccttacaaagagcaggaacacaaacacaggcatttctctccctccataccccaaattcatatcggccagtcccttaaccttttgttaaacaaaacccccaaacaaccctaggtcccttggaattataagttccgttgattgtatccttaagaattattcttcaaattattgtgcagtattagcaatttttattcataaaatatgtaagcaaagcaaatcttttaaagaaatgtaaacagtaaagcaatttgccatttgcctgaaattaagatttcccttcagcagcaagtggacttggcagtgaaagaacattgaattcaaaagtcaacctgagtcagctaataatattttgagagtttcagatttgctcaaggcttttgggagataaatttcgtctttgagaagtttataattaaataagaatgcagaatgcacaaaagatagatattttataaacaagtgaaaaatggatgacagctgtcagtttggtacggatggtactaaatgagcaggaaaaaaaatttgagtcagtttcttgatcactgaggtattgtgttaacattgctagtatctaagaacagattctagtgctacaacaatggcaaccattttctgaatgcttactatgtatcagatgcattagacattctacatatataaagcaatacaacacatgtaaaccctgatgagataaatcttatcctaattttcagctgagagcaatgaggctcaaaacacttgtactgttactatttttgcttttcaaaactttaaaactggccaggtgcggtggctcgtgcctgtaatcccagcacttcgggaggccgaggcaggcagatcacatgaggtcctgagtttgagacca

SEQ ID NO: 107314 - DNA, 1061 bp, Homo sapiens
acttcctgccatttagtaaacattgaaagacaagaactacggaaggaagaagcggtagaggtttgcagcaagaatgggggaatcggcaagctgtagggaaaagagagccagcaagggaatgactaagaaggaaaatcgctgccagagtggtgtctgaggacagcagtatcgtgctgaggccacaccagccaaaacagtgtgggagcctgcggggctgtcactgcctccttcccatttccaggccccacactgtctacatctgtgactctgatgtacattaatagctgttcgtaataacaagcctagaaaaagtaaggaaaggtcagcaaggaaatgtttttttaaaacattgtacgtaaaacagttctattaagattggattgtaattggttaaacactgtatcttggaaattatcacagtacttcattttgcagtgagtctggttaacaaacttttccctgcccttttatttgataagacataggagaggattcacattgtgaatttctgaatggaaattgtagaggtgttggcagagacatattgagccacaggactttcctgatgccctttaaaaacctacctgtagagacgcagctatttgctcattagtagagtccttatgcatctttggattgtggattaagcaggagagcatttctaggcctagaaaaaaaattgcattcttcagctaaatgattttttaatttttggcagcacatattgtacatatgttcttgtcactttaactggacactggtctgtaactggacactggtctgtactggagtcagaactcagaacagaaacgttgttccattcatgtgaagagcagaatattttccatttgtccttgtcaaaaaatggtttgtttgaaacaaatcattacaacaaggaaaattaaactggtataatgcaattcagcagcatagcaacatgtaggcttttctgctctaatgtgttaagtatcttggaaagacttcgcattcaacaaaacgtgcgctaagtacaaaatgtgcactaagtgacaggagatgtagggcaaatagaggacaggcca

SEQ ID NO: 107315 - DNA, 1068 bp, Homo sapiens
agaaaacatttttgaaaaatatatttattagtcttactggtttttgtaaatgagcatattgagaattaaattacttacatggggttcttaaaatttccataaaactaagtctttgtagtgaaatattttattggtttattgataaaaaggcttgagcacttataatgtagactttgaatatgtacttgtgatttgaaaaaaaaaatttgaatagtaacacattttgagtggtaactcattgtttgctttttaattttttcttcagatcacaaaaaaatatattaagatcccatttcaaggtaagttatcattctcttatgaacttgtctttttactatagtttttagtataaatttaagtaaaactaagtttaataatgtttcaccttaatattttttagcaattccaaatggagtaaaaatgttttataatggacttgttctgaaaatcgtatgctattgttttaatgactataaatcaaacagtgttaaaggattcatggtgatttcttaggattaacagaaacacagttctgatagatagcaacaatattttggtatatataaaaatggataacaatagtaactataagaaaagaagcataaggaaaatgtttaatattgcacacaaacatgtaaaatgtttttgcatagagggtaagagaatgttatacaattgcatatcttagtaagggaaagtagactggaaaatgtacctgtaacttatagagactcacaccattttctcattctcttcccaactgaaaacctttcagaataaattatgacactaagaaaaccaatatacaatagaggataatctatttatataatgaattctaaaaagaacaaggaagaaaaacacacaaatggcatagataggaattagagaagaagaggcttctgttccaagattggagatgctatcaaagtagctttagttggattagttggatttagttggattccacagatactttatgtacagaatccaaaactatgttatgataattgttctaataatttgattgcttactgtatcttaattaagtattaagaatataaaggg

SEQ ID NO: 107316 - DNA, 1027 bp, Homo sapiens
taaatttgcttagatgcccttattcttcaagaatgattcttgagggttgaggagtggaatgatttgactcagtcagaacctctttgcaagtgaaattggctcacccttacgattttgattattttggccttttaatttccaatctgaaaataaagaaaattttaccaaagtaaatatgaaaatgagcagtgtaatagcagcaataaccctttctttaactatgacactacactggtgatgtttggatactgtagctttttttaatttataagtcatttttagccttccaaataattctctcaaaacaaggaagcattacgtgtaattggtctttatagtccttgtttttgacttatactagttgccttagttgtaaataatttatatattttaaaattatgaaatacttcaaatatgtacataagtatagagaataatatgccaatacatatcactcagatttaaccaatataattcctattttttcagatttaaatttgtttttaaagaagtattatagaaagttgaaaacttatttattttatattccctgattctaatactctccctctttagagttatctactacccaaataggcttgaatccttccagtctaagtttttatattttgtttcatatgtatgcacttatacattatagtatgttttatatttctaaattttccttagtagtaacattgtgactatcattccaaaatttgttattttaccagtaccttagactttaaattattttctctgtaggtaaaatttattaccacatactactgaaaatttgttaccatacttttggtatatgaaccacgcttgaaatatattaacattcagctttggcttataattgtttgcctatacataggtttaattattgaggtacttgtgtccttggaattttactttttaaacctaatttaatacttgtatagtattactcttttgctcattttgcatgtacacaatcctccaatgttgatatctcattttttttccccctaaacacacatgg

SEQ ID NO: 107317 - DNA, 1038 bp, Homo sapiens
caaattgtaatctgtacgcttctgcctttatgccattctggggctaaggtttaataatattaataggtataatatttctggtcattccccaaaactattcagtgggaacactagctctcctttaaatcctttctaaatagatgtggaatttccaggtggttttgatgtggaccttgaaaattcattcccttagtgacaattttatttgattcatgtatttggaataagcatgaactttggagccagacatctggattaagatattagctatactgctaatacactgacttaccttggacaggtttcttaccgtgtctttaaagcagggataataatacacaccttattgggttagtgtgcagatataaggagatgatccatgtaaagtcccaagtataatgccaggaagttagtaggtgattattaaaagttagtcattatttttgtgtctctcttattggtgctgatatcagaagtattataaaaggatattactatagttgatgttactgaaatcttctacaatgagggtgccaacatgtgttcctgagtccacttatcgtcatcaccattgctgccaaagcaattgttatggctttgttagcctccccatttaatttagcaaatactgaactccttaaaccaagctttagttctttcttcccttaagatgaatttgttaatcttaaccctaagatcatatggaattaaaaaagagcccaaatagccaaagcagtcctgagtgaaaagaataaaactggaggcattacactacctgacttcaaaatatattacaaggctatagtaaccaaaacagcatggtataaaaacagacccataggccaacggaacagaacagagaacctataaataaatccatatatttacagccagctgattttcagcaaaaggtgccaagaacatacactggggaaaggacaccctcttcagtagtgatcctgggaaaatatgcagaagagtgaaactagacccctgtctctcaccacatataaaaaatcaacccaagataaattaaat

SEQ ID NO: 107318 - DNA, 1051 bp, Homo sapiens
tatgttaatagctctttctagttcctcagagttttccctgcattattaagttatttgaatatgacagtttccttgctatttaaacaaggaaggaacctgtagtttgcaattgagaaaactaagagtcagagagaataatcatgcagagacacagtcagaaaatgatactacttctcaggccagtatactttctgctacctctcactgcatttcaaaatttgtttctgctttggtttagtgtatttatgatatttcgaagtgggatttcatagtattagtaaataaaattaaataaataataccttacgtactgatactgtttacatacttaggaaaaaattgggtaaatgtgtgaaatgacaactttagttcttccttccagattcagatagtatgaaagatgaagtatacacctttatatacttcaattccttgcagaaattcagaacttctgaaatgctggctagccctggaatgtccttgactgtgctaatttataaacctgtactgcaaaagacagctaggtattgttaatttagctctcagtttatagatttgtgttcttcaagcctatcacacaaagttccttgtttcctcagggtacccaaactggataagttttcaatagttgatgaaaggtgtttgggctgtggctgtgtgctatgaagagctatgtgtactgtagtcattgctaactgtttaattatatactttaattgtatattgaaaattgcaaacatctaataagattttttatcaagattgcagagcatagtaaattataagtattatttgaaagggtagtttatagctttgagcaagactacaataatatgaaaattattacagaaatatgaaaattaagtgatattccatttattgtgtatttactatgtgccaggaattatgctaactgctttccatctattatctcattgaatcttaacaactttgtaagggagatattattcttcccattttagagatgagaagatcaatgtgtagaggtagaaattatggtaattaacttgcccaaggatttatagttata

SEQ ID NO: 107319 - DNA, 1029 bp, Homo sapiens
acaacataaagaataaaacaagaagaaaaagactacgtaaaggaaacctaatcaagttactaccatagtaataaaggcacgaagttattagggcttgaactgatgcactggcaataaagatggagaacagatcctttaaaagacagatttaggggttaaaaataactatatatggccgcacagcatggggcagtgtggggtcaccataacagctacagcagctgcaggtgacgagtggtagaatcgatggtgaagagtctggagagagagaacatccggaagatgcagggtctcatgttccggtgcagcaccagctgctgtgaggacagccaggcctccctgcagcaggtgcaccagtgcatcaagcactgccatgtgcttctggctcaagcccaggctttggtcaccagtgagttggagaagttccaggaccacctggcccagtgtaccacgcaatgcaacaacaaagccaaagattcaatagctgctgggagtaaggagcttcaggtgaagcagcagctggacggttgtgtgaccaagtgtgtggatgaccacatgcacctcatcccaactatgaccaagaagatgaaggaagctctcttagccattgggaaataaaagtctttgccagtggccatgggggctgagggcaagaatatattttttataaggcatttgggaactttagtattttaagcaaagtttatgaatgaagaaattaaggatggccacaagtgtaatgcatatgtcacttgcctctagacactggttctttcatgtttcagtcctaaaacatgaaatggaaaaaagtggtgttaaattgggtcagagatttacaggagagttttagatcttatatttcctgtggccagtgcttgtcctggcagtaaggatctcccctgtaacaggccagagccctccaacacaccagactcttcttactacacaggtaccaataggctggcaggttagagttggtggagtttgaagaaagatattttctctttgttgccaacatcctgtttacca

SEQ ID NO: 107320 - DNA, 1040 bp, Homo sapiens
ctgtatcttaagactgtatagccttaagaatgtaagtgatgcagtagtggacccttagttttaataatgttttctgaatcaacaaatgctaaaacaaaaacacatttttagcacaaacagtggttacatctgtgatgagatctgcaaatgaacactgtccttcaactaacattgttaataaacatgaatgcattgccaggagtctagcagctgtacatgtgtaatgatagttgtagtaaacttgacagaattctgaagaaaatcccaacttaagtgaaatagattttactttttaaggtatctttgataatagttaggcattttttcttttttcttagggtatttactatagttgcttgaggaactgaagtttacagtttctggagatattagtttgtgatgaattcatgtattctacaatgtgtagtaccatatatactaattatttatgtgtataacaggcaactcaaagttatgttgacgaatgtcctatggacggatttaggacgaaaattcagaaagaccctacctagaaacgatgctaatttatgtgatgccaacaaggtgcaatcagactcattgccttcgacatctgttgacagcctagagacatgtcaaaaattagaacctcttcgccaaagccttaatttatctgaaaggtatgttgttcagtattgattttgttcaacttaccacatttgaaataatatgaatcccgtactcctaatgataaaattgttgaaatgacctgaaaggagatttgcatatataggcataccacactctaaagcaaatcttaaagctgcctatcttaatttacagagttagctgatgtttctgtacttcattaagcagattgacatggaattatatttaaaaacgagtatcattagtacatttaacttatttaaatttgatacatgtacacatctttttagggattattttatgattaaaatgaagatacatatatatacgtgtgtgtatatgtattatatgcatataaatgtgtgtgtatatatgtgcattaatattttctt

SEQ ID NO: 107321 - DNA, 1080 bp, Homo sapiens
agaaaatattaatgcacatatatacacacacatttatatgcatataatacatatacacacacgtatatatatgtatcttcattttaatcataaaataatccctaaaaagatgtgtacatgtatcaaatttaaataagttaaatgtactaatgatactcgtttttaaatataattccatgtcaatctgcttaatgaagtacagaaacatcagctaactctgtaaattaagataggcagctttaagatttgctttagagtgtggtatgcctatatatgcaaatctcctttcaggtcatttcaacaattttatcattaggagtacgggattcatattatttcaaatgtggtaagttgaacaaaatcaatactgaacaacatacctttcagataaattaaggctttggcgaagaggttctaatttttgacatgtctctaggctgtcaacagatgtcgaaggcaatgagtctgattgcaccttgttggcatcacataaattagcatcgtttctaggtagggtctttctgaattttcgtcctaaatccgtccataggacattcgtcaacataactttgagttgcctgttatacacataaataattagtatatatggtactacacattgtagaatacatgaattcatcacaaactaatatctccagaaactgtaaacttcagttcctcaagcaactatagtaaataccctaagaaaaaagaaaaaatgcctaactattatcaaagataccttaaaaagtaaaatctatttcacttaagttgggattttcttcagaattctgtcaagtttactacaactatcattacacatgtacagctgctagactcctggcaatgcattcatgtttattaacaatgttagttgaaggacagtgttcatttgcagatctcatcacagatgtaaccactgtttgtgctaaaaatgtgtttttgttttagcatttgttgattcagaaaacattattaaaactaagggtccactactgcatcacttacattcttaaggctatacagtcttaagatacagatttaattttatcttatttctaaaataggtcaacttaaaaa

SEQ ID NO: 107322 - DNA, 1997 bp, Homo sapiens
tttgtgcatttggaacatcttgataagctttcgctgataatgcaagagttatacatagactgataatgatgattgaatcattgtttgcgatcagcagtgagaaagggtgttccatttctgctgcttcttcttttttattttttaaaggctagtcaaatgaagcagtgggagtggggcagaaacagacatctgcaacttgtaatcaactggttgtaaacacctctgtacttgggccagccaaaaatgctctgtttagcaactatggtcctatagtcatagtgttaaattatttgtataggggaattaaatatctggaggattcaaattacagttgttactggaaataatttagagcatttcagaattggacataaatcaattattagaaagttattttaaaaagagtattgaattttctttttaacatagtgaatgaaaaaatgacaatagcaaattataattattggaaagtcacacaaatttagaagactcattggggtccttgaatttatgtcaaagtacttctataaactacttagtctaattctcccttttcaggtaaattgtgtgtaggaaatataaacatatattggtgactccatagcagtttatgagccttttgacattattaccataccatggataaattgtcaaggtgaataaggcaggtctattgatgcaatgatgatgctttcatccttagaacaagcacacactcagttttcagacttggtttcccaaaaagatttacataaataattatacttggtttgagagatggaatgctagaagtaaaggaatggtaatttttaattaataaaaaccaagccacattttcggaaaggtttgcacatacaaagttgttttatcttatgggagacatatcctgaagactttgcatgcttcacaacatacatcattcccctttagctgccgtcttgcatctccgcatgtgtgcgcctaatctcagctggtccacccaggaccctcttagcaccaaccctagttctctgcatggccccttatctgctctgataggatgaaagaaacaatcatgaatcaggaaaaacttgccaaactgcaggcacaagtgtgcattggtgggaaaggaactgctcgtagaaggaagaaggtggttcatagaacagccacagcagatgataaaaaacttcagttctccttaaagaagttaggggtaaacaatatctttggtattgaagaggtgcatatgtttacaaaccaaggaacagtgatccactttaacaaccctaaagttcaggcatctctggcagcaaacactttcaccattacaggccatgccgagacaaagcagctgacagaaatgctacccaacatcttaaaccagcttggtgtagacagtctgaacagtttaagcagactggctgaagctttgcccaaacaatccatggatggaaaagcaccacttgctactggggaggatgatgatgatgaagttcctgatcttgtggagaattttgatgaggcttccaagaatgaggcaaactgaattgagtcaacttctgaagataaaacttgaagaagttactgggagctgctattttatattatgactactttttaagaatttttgtttatggatctgataaaatctagatctctaatatttttaagcccaagccctttggacactgcagctcttttcaggttttgcttatacacaattcattctttgcagctaataaagccgaagaagcctgagaataaactttgaaacaaaggttaataaagttctttgcctagtaaaacaaaacaaaacaaaacaaaacaaaacaaaacaaaacaaaaagcttatatcattaaggccaggcgcagtggctcacacctgtagtcccagcactttgggagaccaaggcaggtggatcacttgagtgcaggagttcaagtacggcttaggcaacatggcgaaacaccatctctacaaaaaactaataaaagtaaaatttaaaaaatactta

SEQ ID NO: 107323 - DNA, 1050 bp, Homo sapiens
aaattttacttttattagttttttgtagagatggtgtttcgccatgttgcctaagccgtacttgaactcctgcactcaagtgatccacctgccttggtctcccaaagtgctgggactacaggtgtgagccactgcgcctggccttaatgatataagctttttgttttgttttgttttgttttgttttgttttgttttgttttactaggcaaagaactttattaacctttgtttcaaagtttattctcaggcttcttcggctttattagctgcaaagaatgaattgtgtataagcaaaacctgaaaagagctgcagtgtccaaagggcttgggcttaaaaatattagagatctagattttatcagatccataaacaaaaattcttaaaaagtagtcataatataaaatagcagctcccagtaacttcttcaagttttatcttcagaagttgactcaattcagtttgcctcattcttggaagcctcatcaaaattctccacaagatcaggaacttcatcatcatcatcctccccagtagcaagtggtgcttttccatccatggattgtttgggcaaagcttcagccagtctgcttaaactgttcagactgtctacaccaagctggtttaagatgttgggtagcatttctgtcagctgctttgtctcggcatggcctgtaatggtgaaagtgtttgctgccagagatgcctgaactttagggttgttaaagtggatcactgttccttggtttgtaaacatatgcacctcttcaataccaaagatattgtttacccctaacttctttaaggagaactgaagttttttatcatctgctgtggctgttctatgaaccaccttcttccttctacgagcagttcctttcccaccaatgcacacttgtgcctgcagtttggcaagtttttcctgattcatgattgtttctttcatcctatcagagcagataaggggccatgcagagaactagggttggtgctaagagggtcctgggtggaccagctgagattaggcgcacacatgcggagatgcaagac

SEQ ID NO: 107324 - DNA, 1045 bp, Homo sapiens
agcggaggccctgattccgaggagaagggagatgggcgccagaaagggagaccgaactcggggtgggaccaggagcggcggtgcaggagccgctaccgccacaccggagacgcacatcacacaaaacacacacaccggagacgctcatgagacataacatacacacagtgcgagccaccgagtagttgccgcgggaactggccgcaggctgagtttctgacggtgccggcctctcagttacacgcaggagttaattacgcttgctgctcccttttcactgaggaggtggacaactccggcctgctctctttcctttacttccaagtttaatattgaccctgtgacaggatgggccgaggtgatggaggggaagaggaatgcctttgcctgccctctggtttaagctgcggggtctagggctaaggtttggttgcttttctttgaagtatctcccttaggctgttgccagctgaccgcttgccagatacttaggcgactaaatagtctagcgtgactcttcctgtattttgttacgacgttaaactcaggttacagctatccttattctgtccattccactccctaaattcgggtcttgtgcgtgaaggaaaagaaacgtaatctctccagctccctctttgcacataacaagacaagtgacttaacacgtgcgagctgtttaaaatgtttttagaacattttaaacattattctctattctgaccaccttagttatcattcccgaaattatttaatatgagaaaatagaaacgattaatagcatatgaaggccactagtagacctactaacataatgtttcatgttaattgccttgggaacaaaaattattgaaaagattaagtgtaatgttaattactttggacccaggatttcctttttaaaaaacacgtacaattctgttagttaagctggaactccatctctctcttccctccccaccccctgtctttttttttttttataactagtaaaataccttatgaaagaacaatttaaatttaaaccatctactactttctcact

SEQ ID NO: 107325 - DNA, 1396 bp, Homo sapiens
tgtctgacataataaatgtcaacttcattgacgcagttcttggtataaccaaaaaagcttgagatggccatgattatgtatgactagctcttctttaacatttttcttaacattatttctcctaacattatttcaaacagctacaaagatttaaccaaagggaggagaaaaaaaaactaccaattttaccctattatttaaagcaggtagttcaaataagtagcttctctcatagacagaaattaatgttggccgggcgcggtggctgacgcctgtaatcccagcacttcgggaggccgaggcgggcggatcacgaggtcaagagattgagaccattctagccaacatggtgaaatctcgtctctactaaaaatacaaaaattgctcctccacaggaggcctacacgccgccgcttgtgctgccgccatgtcgctagtgatccctgaaaagttccagcatattttgcgagtactcaacaccaacatcgatgggcagcggaaaatagcctttgccatcactgccattaagggtgtgggccgaagatatgctcatgtggtgttgaggaaagcagacactgacctcaccaagagggcgggagaactcactgatgatgaggtggaacgtgtgatcaccgttatgcagaatccacgccagtacaagatcccagactggttcttgaacagacagaaggatgtaaaggatggaaaatatagccaggtcctagccaatggtctggacaacaagctccgtgaagacctggagcgactgaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatatacctatgaaaaaaataaaaaataaaaaaaataaaaaataaaaatacaaaaattagctgggcgtggtggcccgcgcctgtagtcccagctacttgggaggctgaggcaggaaaatcacttgaatcggggagacggagtttgcagtgcgcccaggtcacgccactgcattccagcctggcgacagagctccatctcaaaaaaaaaaaaaaggaaaccattcataaaaaaaaaaaacttatacttccaacttagtagactgctcgacaggaattaaaattcagaatattctctagttaagcccctaagacaaacttgacagtgttttcaaaaaagtgactatctgccacaaaattaccaattttgcaatatccatggtatgacatattttaactatgattcctatgcacaatttcattaaaaatatctgacattcaaaaatggcttaaacttaacagcactactttcttgtaacggc

SEQ ID NO: 107326 - DNA, 1441 bp, Homo sapiens
ttttgatttcatgttaattacatattttatttgctcagagtacaaattagataaaattccttttattaaaatattccttagtaaagaatctagtaatttgctattttatccatgttttatgttctaaattgataagttattttctcatttttaaaaaaactgatcatgtatttagtcattctttagtgtatagattgtttctacatataaagccagcaggttttctgtttgtttctctgttccattgtgtagagccaaagaggtttttattttaactgtgtgtcagtcacaggaaagtagttattgtttgggctccactatgaaatgtcatacttgattagagctacaaatagaatacagaataaaattagcgtaagtgcttttagttataaacagactctgaaaaaactgtttgcatcatactctttcagagatattctgtgcttcataaattgagttccgtttttcagtgattgaatagcaatcttgattctttaattcttcaggtgcttttgtgattttatatataagtaagagaatggcacctcaagcagccatttcagtgctatctttgtctcttagggaaatcccaaaacataatcctgcttaatttccctgccctatactgtcattacaacttttactccttgtccaaagggaataaagagtttcttttatttttcatctaaacagaatcaaatgttttgttcaaagtgcttattaatctagagaccccattattccaaaactgtatagatctatatctatagcctctgatcttttaatcctttacttgtcagtctgtgttcgactttttttctccccattctagctctgtgtcctgctttcttaactgttaatcaaggccatctcttggagcatcttctttttctccataaataaactcttgatccagtgtagcataatacattccatatggtgaacgggcaaactggggaaagaaaataaaagttttaatcatcagccagccttcttctgtcttaccgcctgatatgttcttagtctcatataacagacccaagaaagtcagaatgtgaactaatttcatcattgacttcatacaaacagaagcaaaattagcaagacattttgccttccaaacctacatatgtatgccttctactgtttgaaattatgattagctcatctttcatgaaaaaaactaacatataaaccaaagtatgatttttttttttaaatagctcttatgggtagcttaaaacaggtaataaccaaattgtcagagtagaattaaatttctcaagagggaatgaccttgaagttccttttcaactcctaagattgtgtgagatgtacgtgaggaacacatcactcaaggaaataactgggctgtattaacactgtcatttgggtaataatgggcctgtttataactaggtactttgtatgattattacat

SEQ ID NO: 107327 - DNA, 1032 bp, Homo sapiens
aattcatgggagcctcttctactgccacacaatctcagttcctgctgtatactctaacaaacagtggaagagactgttgggtcagtaggtgacaactgcagaggtatcttccttataacgatgctttttgaggttgctgctcccatcaatctgctcagtaaaaatagctcatcttggtaagttgtttcgacttcaccaggacctgaagaagaagcagaaaaacctgtgaaaactaagactgtttcttccagtaatggaggggaaagttccagtcgcagcgctgagaagcgatcagctgaagaagaagctgccgacctcccaacaaagcctacaaagatctccaagtttggatttgccataggtagtcagacgacaaagaaagcatcagccatatccatcaaacttggatcaagtgtgagttgttatttcatatatgatgtttgtaatgggtcttaaggatttgctttggaaacgtggcgtttactaggttatggtaaattaagggtgaaaaggtacattgtttgagaagtaatctttgacgtatgaacttagatgattagcaccctgtttaagaagggtctgaatgaattttatctcaataaagctgttaagaaacaaagatttggaatattaggaacaactattatagggaatatgatttataaaataataaacttagaatttttctgcgttggctgggcacagtggctcacacctgtaatctgaagacttggggaggccaaagtgggaggaccagttgagcccaggaatttcagaccagtctgggcaacatagcaagatctatctctacaaaaaataaaaatataattaaaaaaaaaatcttttttctaagttgagcaagtcctctgaaaaatattgtcagaaagattttccaaagttttttttttatctttcagtgcctgtagtattaaaaataatattgagcaatcagttatttgtatcttaaaagatgaatattagtaaggtattgcttgataagatctacctaattatcttactttggaacgacaa

SEQ ID NO: 107328 - DNA, 1052 bp, Homo sapiens
ccactgcactccatcctgggtgacagagtaagaccttgtctcaaaaaagaaagaaaggtcaggagatttttttgttttgttttttggattttgagacagagactcactctgtcacccaggctggagtacaaaggtgtgatcttggctcactgcaacctctgccttctgggttcaaccaattctcctgcctcagcctcctgagtagctgagattacaggtgtgcatcaccaccatatccagctaatttttttttttttttttttttttttagtagagagagggtttcaccatgttggccaggctggtctcggaactcctgacctcaagtgatccacttgccttagcctcccaaagtgctgggattacaagcatgagcccctgtgcccggctaggtgatgtatttctgacagtagtccaggcaggtaatgctaaggaccttaagttggtaatgtgatagcatgattgaaaaggcagagggagaattaagtttacttaataggtgtctaatcaacaggaccttacaagttgaagaaaagattttctggtttgagtacttatgaacactgtgaaactaaagtacctaggggagctcctaagtggagctgcccagtaggcagatgatagcccatttaggggtagacataggattaggtagttaaaactaggaatgaatgaaatcgaccagagaaggaaaagtcattgacaacaaaattctggttgtctgctaatttaaaaaaaaatttttttagagatgggggacttgctgtgttgaccaggctggcctggaactcctggtctcaagcagccctcctgactcagcttcccaaagtgttgagattgcacatgtgaggcactgtgcctgcctgggtatctatatcttctaaatggggagtagcaggaaagggacagaacaaaaggtgggagaattgggagaataaccagtaaaaagcattgttacagaagccaaggaaagggtgtttttattttttattttttttatttttattttttgagacagtctcactctgttacccaggctggaatgcagtggc

SEQ ID NO: 107329 - DNA, 1287 bp, Homo sapiens
ttttttgtgtttttagtagagagcaccttgggaggctgaggcgggtagatcacgaggtcaggagttcaagaccagcctggccaacatggcgaaacctcgtctctactaaatatacaaaataaattctctgggcatggtggcacacacctgtaatcccagctattcaggacgccaagtcatgagaatcatttgaacccaggaggcataggctgcaatgagccaagattatgccgctgcactccagcctgggcgacagagcaagactctgttctcaaaaagaaaaacaaaaaacatagtgagaagagatggtttggattaattatgtttataggcctagaggcagaaagccccttttatgctttcaaggcacattgtatttaatgttactgtgggaaggtattactaatcattttctcttgcctgtaccaagtaccccttaggtaagtgatattgtagatcctaactagaaaatcttttataggagggcaacaaatggatgccacaagttagtaaagtaaaacatacccactgataatccacatttttgaaaagagagaatggatttgtccaaagtattgggttcgttactatacaaatttctgtggaaatatagttaaatcattcaagataaattattcatatcattaaacaagcttgtataaatgttatctacatgatattctttttaatatgtttcttcttcagaagcctaaagaaactgttccaactcttgctccaaaaactctttcagtagcagcagcttttaatgaagatgaagatgtaagttgatatcgagttttgtttttttactttaaccagttatttaaggaaggtattagtggcaaattataggttataatagtattagtgaattttctttataatagtttttgtgtctgtgtgtgacatccataaaaactggatactctatttttgcattttatttggttgtaagattattttagagtattgttgactttggggacaagaagcttaaggatgaaatcagcaaatgtttattatgagtagtttgtgctaggaagtatgtaggatccaaaaaaagaaaaatctaatactgttgccttaataatttttatagttggggtcttcagtaatgatacattatgcatgcattcaattttaaaaagccaactattggctaggcgcggtgtctcatgcctgtaagcctagctctttgggaggctgaggcaggtggatcacttgaggtcagcggttcaagaccagcctggccaatatggtgaaaccccatctctactaaaaatacaa

SEQ ID NO: 107330 - DNA, 1080 bp, Homo sapiens
acattttagatactgaaattgaaggaaagaaaatgcatcttcaaacattttttggaatctcaccacatatactttgttagatttgtgtattgtagggtgtttgttttgtatttttgtattgtatatgaactttttttaaatgtgacagttaaacacatctttaaaagcatagtcacagacaaaagcatacagtataaaaatttccttgaaaactcctacaatattatatttggaggcagcttcagactgttttattggtggtagctgcttgctgaggtcttttagttggtaataactccagagaagcagcctgtgtatattcctaacactttgttcactagcatttaagtttagaataagcccaagtaagacaatggaaatgtatatagaactcttagttcttacatgatttaattatatcgatacatgaatttaacttactttaatgtaggcaaactatcaattttttgtccattttcctgtttgttaaaataacatacctctcctacgtattattttcttgacccaaatgaaatattaacctaaggtcaagctgggagagagaaatgactgagatgaatgtctttactaaagtaccaataaatttgtcaaactcaatagtgtttttattttctattccatttaattgttgcttactggtttttgtttttaaagttgagacaaatgtcaagtgttgctcttgttcattttgttgaccaaagtaatgggggatttaaaattctgaattactagtgtctacctagctcagcacctagttctatagcattacagaatctcagactcaaaaagacttaatcctcctccagtgccaaaggattgtctgtccagttctttagaaaatcttgccaaagcttttctttgacaatcactaaatattagaaagtattcttttttttttttgagacagagtctcactctgttgcccaggctggagtgcagtggcacgatctcggctcactgcaacctctgcctcccgggttcaggcagttctcatgtctcagcctcccaagtagctgggactacaggtgcatgccaccatgcccagctaatttttgtatt

SEQ ID NO: 107331 - DNA, 2333 bp, Homo sapiens
atatttgcctttgaattatattttatattgtcataattctgtattgtttcattgataattgacttttttgtctttaccttctttgtattcatacaggtttttgtaaggccagcttccttcctttactggaatttgcctatacttctgtactaagttttgatttctgtagcatggctgatgtagccatcttagctcgtcatcttttcatgtcagaagtcttagagatttgtgaaagtgtacataagctaatggaagagaagcagctaacagtatataagaagggcgaagtacaaacagttgcatccacccaggacttacgagtacagaatggaggtacagcacctcctgttgctagcagtgagggaaccacaacaagtttacctactgaacttggggattgtgaaattgtactactggtaaatggagaattgccagaagctgagcagaatggagaggtaggacgacagcctgagccccaggtttcttcagaggctgaatctgccctgtcatcagtaggatgtatagctgattcccatcctgaaatggagtctgttgatttaataacaaaaaacaaccagacagaactagaaacttcaaacaacagagaaaataacacagtttctaatatacaccctaaactttcaaaagagaatgtaattagtagctcgccagaggatagtggtatgggaaatgatatatcagctgaggatatttgtgccgaagacattccaaaacataggcagaaagttgaccaacctttaaaagatcaggaaaatctagttgcatcaacagcaaagacagactttggccctgatgatgatacttatagaagcaggcttcgacaacgttctgttaatgaaggggcatatattcgactacacaagggaatggagaaaaagctgcagaaacggaaagccgttcccaagtcagcagttcaacaggtatgatgtaagaagggttgacctttgtagttttagctttaggttgaaagcattgtattgatgaacttatggctataatgaaaattatttgggaggtgagatgggtacaaggtagcaacttaatgttttaaatgccagtattaataagataatgtgaatttgaaatctttttgttagaaatttacaacatgactttaaaaattaaaattgagtagatttacttagattgtgatttctatcccttactaggtggctcagaagttagttcaaagaggaaaaaagatgaaacagccaaaaagagatgctaaagagaacacagaagaagcatctcataaatgtggggaatgtggaatggtttttcagagacgatacgcccttataatgcacaaactgaaacatgaaagagctagagattacaaatgtccagtaagtatttggaaagctaattgaaggtaactctaattcataatatatagaatccaacttactgcatggttatcttttcgcttgtattctatgtcttatatggctataagagtcatcttcttatttaaatgtgcatgtcatttacttgcctcccaaaaatattcagtgacttagccttatctctgcttcctcttgataccgtagtaagacaatagtaaaaagatcattttaaaaatgtaactcatgaaaaggcagaacaggaaatcttgaaacaactaaattctggatacaaataaatagatggagtaacttattcagcagagttgaaagggttcacttccaggttttcagtggggaaagctaagaatcaacccaaattgaattgtagaaccaccaaaatgtctcaggaattagtagtgctagctaccttgaaagcagaagcaattaaatcactacccctgtccctttagccaaagatccatcttctactctctggaaaggataaaaccataactccactggggagtactgtgtacagtgaagctaaatgtactgtactcaaaacagggaagagtgtactgtactcaaaacagggaagagtaaaagcttactgaatattaagtttttgttttgttttgttttgtttttgagatggagtcttgttctgtcacccaggctagagtgcagtggcgcaatcttggctcactgcatcctccatctcccaggttcaggtgattctcctgcctcagcctcctgagtagctgggactacaggcacgagccaccatgcctggctaatttttttgtatttttatatgcagggtttcaccatgttggccaggctggtctcaaactcctgagctcaaatgatccacctgtctctgcctccccaaggtatgggataccaggtgtgagctaccacacccggcccaaggtctttctttactcaagtcccaggatatagcca

SEQ ID NO: 107332 - DNA, 2000 bp, Homo sapiens
tccggcctcagcctccagagtagctgggattacaggcgtgcgccatcatgccctaaattgttaatttgtgtaggtcaaaaaaaggtgaatattggcagtttcatatagttcctcttgcatgaaaacattgcaactcacatgaaaatgggtggagctatatagtcatcttatgattagagaaacaaataactgggaataaataaaaaaaattacctcagcaggagaacatcatttataactttatattttttgggaaaaaagtatattttacattctaataaactctacatattttatgggacatgaatgtctgcacatatgtactgaaatgtgttaatgtgcacagactaaataatatattctgttttcagttaacagtattaaatttgacttgttaatattttcattgtaggtatattgaagcaagtcaaagattacattaaacagtgtagcaaatgccaggagaaactagatcgatcccgtccaatatcagatgtttcagaaatgttggaagaattgggactagaccttgaatctggagaagaaagtaatgaatcggaagatgacctgagcaactttacttcatctccaactacagcatccaagcctgcaaaaaagaagccagtatccaaacatgaacttgtgtttgtaagtggtactctccagtcagctttaagatttgtaactagtgtactagtatttgcagccttggtgacttatttttctcaaaccactaagactgcttattgaataagacaaaatggcagtgtactgtgttatataagctgaactgcctcttcatttatcataaatgttcctgttattttttcagaatgaacttaataattacctgttggtttgttgttaattatcctccctcccttcttttgtgatgatatattggtacaagtagacagatttacatttctggaagcagtctctgagtttacgccccaaggtaaaattaatctggccaggtctttgtttttcacctgcatcagtttcatacatcatcatatttctgattagtaagaagaggcagccagaagtgagatacagattttcattaggtgaggtagaatgaacatggcagaaaataggataggacaacatatctttttatttaaatacataggtaacaaagaaaatatcaaattattcatacctggtaaaaggtaatatgtaatgtgtcttgttttaaagcttgttaagggtaaaaaatacaggtaatatgttactcttgctctcaaacttattttgacaggttgacaccaaaggagtggtaaaacgttcttctccaaaacattgtcaggctgtcttaaaacagctgaacgaacagagactttccaaccagttctgtgatgttactttgttaattgaaggagaagagtacaaagctcataaatctgttttgtcagcaaatagcgagtattttcgagatctttttattgagaaaggagctgtttccagtcatgaggctgtggtggatctttctggtaagggttttgtattactcttgctttttgtttgtaatgacattctagaagagggggatatgtatgtcttccacacacggactttatgccaaagtaagagaagcccactaacaacagtagactaagctgtactgaaaaggttctttttagcaagatttctgtggtagagttatggaaaagggtgtcatttcctttcactacgtcttaagtgagacaattatagcagaaaaagaatttctaggatttaaactgttaaaaacagtttgagtgaaatccataagtgcaacaaaattattacattaaatgaatatgttatttaaaaattgattgtttaagctaggtgtggtggtgcccgcctgtagtcccacctacttgggaggctgggatgtgaggatctgcttaaggtcaggagttccaggctgtggtgtgtcattgtacctgtgaatacccactgctctccagacggggcaatataacaagaccctgcctctaaaaataaaaagc

SEQ ID NO: 107333 - DNA, 1052 bp, Homo sapiens
actctgtagcccagctggagtgcagtggcacaatcacggcttgctgcagcctcaacctcctgggctcaagtgatcctcctgactcaggcccctaagtagctgggactacaggcaagcactaccaaacccagctaataggtattttagttgagatggtttcgccatgttgcccaggctggcctcaaactcctgagctcaagcgatccacctgctttagcaccccgaagtgttgggatgagcccctgcaccatgcctggttttgaaagttactatggttatctacattgataacattgagaaaagctgagtaaacactgtactgttactgagatcttttctgtgagtttctgttaggatgcatttcaggatcctacactgcacttggttgtgtctcatttcatccagtctgtgagggtatcttagtctttgtctttcattgtaaagatgggctttaaatatttaagggtagtcacattaaaagattggcattaggaatgcagttaaattactaagaaagtgatctaagctacataaacaatctggatgtgagagatgggtaataatagggtaacaaaagttttgtggagtaatattgtgttatctttttacaggcacctacaaaggcagcacctaagcaaaagattgtgaagcctgtgaaagtttcagctccccgagttggtggaaaacgctaaactggcagattagatttttaaataaagattggattataactctaggttgtgctggattttttttttttcttgtaacaggcatgttggactttacacggtcataggtgacctaacaaagaatgtaagacgtaggtattttattaaaaagtctattgctcaggaataatgcatcctataaagttttaacttctttgttggagagaggttaagcaaaataatgtaagatgggtaaggtcagatgctatcttggcttggctggggtgtatagggcacattagaaaaacttaattgccttaactttttggttacattgctgtaagtattaggatgttgctggtgcagtggctcacgcctgtaatc

SEQ ID NO: 107334 - DNA, 2062 bp, Homo sapiens
ttccggcccccatccccgcagcgaccttataaggtctcttcccatgattctctctttcttttcgccatcttttgtctttccgtggagctgtcgccatgaagtaagcacgacccgtggttcccaatccgcttacatcctcgggcagaactcctctctgtcgtccctggcatggctgtagacaccctccctgatggactttcactttttgttgcagggtcgagctgtgcagttttagcgggtacaagatctaccccggacacgggaggcgctacgccaggaccgacgggaaggtaaaaagccgcgtcggcttcacctaccttcttgtactccgaggaggaaaggctggtttaattcggtttaggcgggtttattccccacatcaccactggcctctggaagtcttcgtggacgctctgtggactggtcgttaggaccagaaacctctaagtgaaccagtgttgattatttattgtgagccaggtcggacatcaggaggggtttatgtaactgatgtcccggtgtaagggaaataactgaggtacggaggtaccctttggaatcctgggacggacaagagcagaatgcttcccagaaggacgcaccaccctgtcctttgctatgagcctagatttcctgctctcgagaaaagactaaacgcaaggaccttcatagtgtgacacagttacctgccagttatgtgacagccttttggtccttgtgggcctcagttttgtaaaatgataagccagaactagcatattgatcttctaaggattccaagcttactcagcctcttgtactttgtatagttaaatagtaattcctttgcatttgtcactctaggttttccagtttcttaatgcgaaatgcgagtcggctttcctttccaagaggaatcctcggcagataaactggactgtcctctacagaaggaagcacaaaaagggacagtcggtaagtggaatacgccttgatgttgggggctatctcttaagttgtcaaagctctctgaacgttggttttctgctctgtaaaattaaatcagactgtatgcgaaagagctcttaaactgtaaagcgtcagcaaaatgaaaaagatattataaactgtctctatatattttaggctagtagcaataccgagttgaaattttaaagtcagataaattacgttaagcacctttgcgttatagggcagggtggaagggcttagttttccagtgggaggaaattgagaagttaccataatttggttttgattgcaatatttacaggattagtcctaacatagccagtggaccatgaaccagtccaccatacactagttcattcactagaaaaacagtggtttttctggtccttgttaagtgtccttttagctgggttatacatgagaaaaagtttgagtgccatggtaggactagtattcaggaggcttgggaatacttactgaacaccttctggatgaaggacttttctaggtattgtgagaaataaatgccatcagacataaaatatgttgaaagttcagaggaaggagaaacttaaaagtggatatgacacacctattagggtgactattcaggaaaaaaaaaaacaggaattacaggtgttggtgaggatggggagaaattggaacctttgtgcattgctaaatatgcaacagctgtgaaaaatcatttggtgttttctcaaaagggtaaacataaaaattatcccagcagttccacttctaagttataccctaaaacagttgaaagcagggactctataacttgtatatcagtgtcatagcaaatccgggcttggtggcagcggctgtactctagctcctccggaggccaaggtgggaggattgtttgaggcaacataggagacctttaaaaaaaaaaaaagttatttagatggataatggtgatagctacacagcgctatgaatgtacataaggccactatacctttttttttttttttttttttttttttttttttttttggggagacaggtcctctgttgctcaggctggagagcagtggcaggatcacagctcactccacctcaa

SEQ ID NO: 107335 - DNA, 1014 bp, Homo sapiens
ttgctctgttgcccaggctggagtgcagtggcgcaatctcggctcactgcaacctctgcctcccaggttcaagcgattctcctgcctcagcctcctgagtagctgggactacaggtgcatgccaccacgcccagctaatttttgtatttttagtagagatggcatttcatcatgttggccaggctggtctcgaactcctgaccttgtgatccacccgcctcggcctcccaaagtgttgggattacaggcatgagccactgcgctgggtcccaagtctggatttttttttttttttttgacattcagaattgctgtttttaaagtaataggtattagctaattgtcaaaattaatttcacttagaaaaaaacatgtagcatgtagcactttttatggaggggaatgtatcatgcagtcaaataagtaacagttgaaatcacagtcttgaaaaacatgtagaacattttaaatattgttgcctcattggatattattaccatcagatatgttcattaagccctagaagcagtatcttagttcactttttcccagatctttagcagaaatcatttttagcaataattattctaaacattttgatgtagccagatgttgtcctaatagatgctaagagaattcaaatgaaccaaagatgattgaatttttttttttttttttgctggaatagaagcctatttatctgatcagaatcctgggtgttcagttttgggtttattcttggttgttgctgacttaatgtgagtcagctttatctgcaagtaacacattctacctccctttattttttagttacctagagaatacagttgcaattatggatgtaggttatcactctcttttttggaaaatttgctttatatgtggttgttttaatgacttttttttttttttttttttaatttgagacatcagagtcttgctgtcacccaggctcgagtgcagtggtgcagtcatggcttactatagcctcgacctcctgggctcaagtgatcc

SEQ ID NO: 107336 - DNA, 1019 bp, Homo sapiens
tattcttatatgtaccattttggtgttgtcacaataggccaatttatttgtaatcttttcatttgtaattcatactgtttttactttcaagaccctgcttttacatggaaacatcatcacctctcttagaatggcacctgcttacctacccagaagtcttgctatactttctttggcagaaaatgaaatccgagacttaaatgaggtaaaatttgagggtattttgtgagattcaggaagctggaaatcctaggaaagacacaggagagggttgtgagcttacttttagactgtgagcatcttggaagaaactgccattcatatgaaatgcttggctctagatctttccacttttccttagtgtcagtgggtcattaaggtctaatttcctttgtaaagctgtaattatcattccactgggaggcgattggtggtagagggacatctacgttataagggtttataagactccctgtccacctttcctggctgctgtgatgttttcaaaatagggttatttctgctaggaaacagtgctgatatttgccaggggattttgtgcagcagggacagatggctatattgttgaaactttggaagtcaatggacacttgtcacttttcagaacaagagggaaattatcacattctcaaatgctgccaaagatatgtaatcagtggaaattttgtgcttgacactgaatagtccttttgttcaacaaagatatcttttgttccagatctcttttttggcatccttaactgaattggaacagttgtcgattatgaacaatccttgtgtgatggcaacaccatccatcccaggatttgactatcggccgtacatcgtcagctggtgcctaaacctcagagtcctagatggatatgtgatttctcagaaggaaaggtaaacatgtgctctttaacatcacaaatgttactgaaaagaccatttctagtttactacagattaatagagtatttcttaaaatgtgcatttagataacaagagtattagtg

SEQ ID NO: 107337 - DNA, 1117 bp, Homo sapiens
ggcatttcagtgtgacagaatgaatggggagaatactcattgcttccttgaaaatgatttaaaaatatttggcaccattagtccaagctcaatggaagtgcccctaagcaagaaaaagggtttgaaacattattagaatggtgaatatgagtcagaatgatagattttttaaaaaaattgagtgaattttatttatgaaaaacatacaatggtgctataaaggtaagttaacaaggaagatcattgttgcctgacaatgtgtgttgactattctcatgccatctcctcttttttatgttccccaattccagtttgaaagctgaatggctctatagtcaaggcaaggggagagcatatcggcctggccagcacatccagcttgtccaatatctggctacagtctgccccctcacttctacactaggtcttcaaactgcagaggatgccaaactagagaagattttgagcaaacagaggtaagcccatttatttctaacaactgatgaattcacaagttaaaatacctctgagtctttgctatggtgatagtaagcctgaggcaagtgctgcggcccacatttctggacactcagtccccttgtcactgcaacagttcctgcagggaagctgaatcgtgcactgcaaacagccaaacaatatggtatggaggaatagaggggtttttttgttttaaagacagggtcttggtctcttggtctgtgagtacagcagtgcagtcataggtcactgcagttgcaactacaggtgcatgccaccatggttggctaattttttgtagagatgaggtctcactttgttcctcagtctgattttaaactcttggcttcaagcagttctcctgcttcggcctcctaaagtgctaggataataggtatgagctactacaccaggaaacgggataggatttttaaaaaatatatttgttctttttttttttttaagacataatatcactctgttgcccaggctggagtgctgtggtgtgatctcagctcattgcaacctccatctcccagttcaaatgattctcgggtctaagcctcctgagtagctgggattacaggcatgcgccaccacacctagctaatattttatt

SEQ ID NO: 107338 - DNA, 2073 bp, Homo sapiens
caggaaagtggtaagaaatgaatttatctctgatcccttttctccaagttgtttaatttgtcgggtatcataaagcagaaaaaggtgcatattttcataattttttgttagtttactaacttcagtaatcatttagatcttatacatatctatgtataaacacacctatatatgtatgtatattataactgctatatttctaattttaagaaacatttcaaggactactaccttttatatagacctgatgctttgattattcttatgattatcacaagaattcattttcttaaaaatgtttggtttgatgttttcggcatattggaagaagtcactgaggggatttttttgcattttactctatttcaaggaatagatttcattaaagggacataactaaaatgtaaacatttagtggtttaaatgatactctgttgattcttctagaacccgtcattcaagtgaattcttgggttgggataaacagtaatgatgatcagttatttgcggttaagaataattttccagcctctgtacacactacgagatattctcgaaatgatctgcacctggaagacatacagacggatgaggacaagttaaactgtagtcttctctcttcagagtctacttttatgccagttgcatcaggactgtctccactatcacctacagttgagctgaggctgcagggcattaacttgggcctagaagatgatggtgttgcagatgaatctgtgaaagggctggaaagccaggtgttggataaggaagaggaacagcctttatgggctgcaaatgagaattctgttcaaatgatgagaagtgaaatcaatacagaggtaaatgagaaagctggactattaccttgtcctgagccaacaataatcagtgctatcttgaaggatgataaccacagtcttacattttttcctgagtcaactgagcagaaacaatcagacataaagaaaccagaaaatacacaaccagaaaataaagaaaccatatctcaagcaacttcagagaaacttcccatgattttaacccagagatctgttgctttgggacaagacaaagttgcccttcagaaattaaatgatgcagccaccaagcttcaggcctgttggcggggattttatgccaggaactacaaccctcaagccaaagatgtgcgttacgaaatccggctacgcagaatgcaagagcacattgtctgcttaactgatgaaataaggaggtgggtcagaagtccttttgatgcactgttttgttggtttgagggtgttagattcttatagttgattcagaacactgtgcttctgtgattataacacttttcacacaatgtagccactgttgctttggttgtctcctacagtgtaccgaaagcatctggagagcagacactatctgctctatctcctcatctccatccccagcaaagcacttgatacatagatgcagtgtagtaataaatgttcaatgaacgtgagctttatagggatctataattctaaacatagaaaggtacagaaaacattgaaaaaccaagtataaaaatgagaagatgatgaagtctacatggaattcagtacatgacataagaaataaagaaaatagcagggattcagaaggggctaaaattctatatgactacaataggaattattccttaatcccatggctcgtatgttttactgactgctagcccaggaaagttaggatttcattaatattgcaactagtaatatttactggtattatcaggtagaagagaaagaggcagcaaaggatactgagaagggacagccagagtggtaggaaaactaggagagttccaccttcaacaggagcaagtgtttcaggagagatgagaggtgccacagagaggacacaggcattaaacttggcagttggaggctattggtgactgtgttggtgattctccagactatcctcaggttggatgatttgctaaaaggactcacagaacttgggaaaatactattctgttcgtcattatggttcattacagcaaaaggatacagattagaatcagtaaagaaaaaaggt

SEQ ID NO: 107339 - DNA, 1034 bp, Homo sapiens
acagaatagtgaagtttgatgggattagtctttagcagagggtgtttcaagctggatcacgagtacttaaatgtgacccttaattgttttggaggctttggatagccactccttttttgcactttctgttcctttggtttgtttggctgagaaattgaagccagacaaagagccatttaacattttattttatttcttattactggaaatactttgtagaactaatacctgtatttcagtcatatctcctttggcttctactttgagtcacagttcaaaattaaggtttatgatgtcacttataaaactgttccattttgattctgaggttaaaaaaataaaaataaaataaggttttaatttagatattctaaaagtgggaaagacaactattagattattaatctctttacaatgcatgtgtttatgagttgtaacaggaagtctgagtcaaagcacccttccttatgtcaataatgtgttttgaattattgtagattacgaaaagaaagagatgaagaacgtattaaaaaatttgtacaagaagaagctttcagattcctttggaaccaggtaaactccctcctgctgatttacctcatatatgatcaaatacagattctatattcattgagataatcatagagtactcaggtgtattaagcactcttgttcaaggttaagggtatggcttgtgttcttcgccactaactgtgaactaggacagtgaattttcttgcattttatttaatctgaagaaaaatattctgacaattttgacaagaaaaacaaaatagtataaagcaggaggaaagtggcttaactgaaggctgttagagctttccaatagatacaacaaccccaatttgaaatttcatgtagctatcgatctgtcttttgggaatatttgaatgaattgtgattaagatggtatatgactacaatatgcatgtcctaaaaagtattcataactgtataggagagtatttgaatcctataatagcacactttagggacagtttaggcagttggtt

SEQ ID NO: 107340 - DNA, 1041 bp, Homo sapiens
aatttcaaaaagatctggacttaatatgatgacttataaggagcttagaaaatgcaggttacatttatatctacctataggattttatccaatgttgacttagccatggtagaactcttaactgcatctacacactatattgctcttgtaaccaaagatgctaatgagtgtatttgaattagcttctcctaggaggggtgactactttgctaaagagtatgaaaaatgttttgatggaagggacaagtttggttggtagtagagtgtttgtagcttatctggtaaaggaaattgagtgcatctgcatgcatagcacaagtaatccatcttctggcggttaactagagaaagcttatagtcagaggctcttgtgaatgcactgaagactgctgtgtctcaggagtttctcttgatgatctaccttttctgaattacttgaaaaggccaatgtgcttggttcgagttttttagtgaatatttacaatttcctgcttttatctagaaaagaagcaaaagggaaatatgaaagcagtatatataaaatctgtgctttggaattgatatttgcatttggtgattgttttttatttgattcagctaaattttatgtgttgaatacttactctagaataactacttttggaactggaagggggaaatctgtaaatggaaatttatttttatgttctgaaatttgagggtttaggaattgacttttgtgtaaagaatgctacgatattataaagctgtggaagttttttccactagtttcaggtgtttttttttttgttgttgttgttgttattttgaactacttaccaaaattagaagttaaaatctaattagaaattaataagatactaaaattcatgacagttttttgtttgtttgtttgtttgttttttggtatttcttgatttgggcataaaaggcacacccattctctcatgcttggaagaagctgctattcctactggctatctaagaagaatggaattattaattttatttgacttattaattttaaacgagtttaatttg

SEQ ID NO: 107341 - DNA, 1018 bp, Homo sapiens
agcagaaaagacaaattatgctttgtaatgtttcatttgagtgtaccaatatataaaaagggggctaaaggaagatttttttttttttttcaaaagaacaacttagtgaaatcagaagtgattcacccgctttcctttccatgttccccaggttccttcatattgctgttgcccaagggagaagggcactttcctatgttcttgcaagaaagatgaatgcacttcacatgctggatattaaagagcacaatggacaggtgaggaccttgacagagtctgaaatggcaaagagggggtcatggtgaagtgaatgatgaccagccttatgtgtagatcatcttagagctcaagatcaagagagtttagttaatattaactttgagatgttgactttttgctaccatcaaccttgaagttattaatgttaactttgtagctgtttgaccaaacactgagagtaataaagccacaccctaggcttactttagtttccttgtcttacagtatctgattgcttattcaaaggatttattttctctctgtgggtttttccctcagtcatagtttagtttcatattccttgttatgataacattgtatgtttaaaatatcttttttcctctggatatccacagagtgcctttcaggtggcagtggctgccaatcagcatctcattgtgcaggatctggtgaacatcggggcacaggtgaacaccacagactgctggggaagaacacctctgcatgtgtgtgctgagaagggccactcccaggtgcttcaggtaagaggcagcaaaccaggcttccatcattgcaaggccagagagatagagttggatattagaagtcggatataggttgcctgttgcaatgatctattttgagttaacttattcatttcttggggattctaataggtatatgcgcagcttatgtagctaacagatgtctgtttttaaaatctgcaggcgattcagaagggagcagtgggaagtaatcagtttgtggatcttgaggc

SEQ ID NO: 107342 - DNA, 1045 bp, Homo sapiens
caggctggtcttgaactcctgagctcatgccatctgcctgccttagtctcccaaaatgctgggattacaggagtgagccaccatgcccggctggcagttgcatggaagagaacacctctttatggcttaccctctagaatttctaatttatgtgttctgttgaaatttttgtttttttacctttattgaaacaacaaaaagtcagtattgaaacatatcttcctgttttctgttgtcaaatgatgataatgtgccatgatgttttatatatatcattcagaaaaagttttattttttaataacattctattaacattattttgcttgccgctggcatgcctgaggaatgtatttggctttgattacacactaagtttttgtaataaatttgactcattaaaaaccttttttttttaaaaaaaaaaaaaaagaaaatctcattagtgaacttatctttgcagctgagtacttaaattctttttaaaaagataccctttggattgatcacattgtttgacccagtatgtcttgtagacacgttagttataatcaccttgtatctctaaatatggtgtgatatgaaccagtccattcacattggaaaaactgatggttttaaataaactaattcactaatattatttgtcttacatgcattttcttttcctagtgccttatttccctagatagaaaaagtactattgatgattttaaatacctttgagttagttaatttatgttaatttgggttttttggagaacatgtttcctgaaagtatacaagatttaacatcaaaatctatttgctaagtttactaggagaagtctgttaggttttgaaattatcatggaagtttaatagatgctgtcgatcattcacatgtttagatgcttaaaaaaaaaaaaaaaagctaagtgggagcagtgaatcataggaataacagtttggagattaccaggatcatccttagagagatgtaaacctgggaaaggttcttccctttgccagcaagccattttgacgtgtgagaacaaacacatcaat

SEQ ID NO: 107343 - DNA, 1049 bp, Homo sapiens
ccatgcctgcctaatttttttttttttttgtatttttagtagagacgggtttcaccctgttagctaggatggtctctatctcctgacctcgtgatccacctgccttggcctcccaaagtgctgggattacaggcatgagctaccgcgcccggcctctgcatgatatttttgagattaatccacattggtgcattgatcactaaagtatatttctattgctgagtagaattccattgcactaataacacaatttgttaaccattcacatattagtgggcatttcgattgtttccagtttgggactattattgaataaagttgatatgaacagtatttgtgtggacatatgttctcatttaattttaaattcttaggagtgaagtacctggttcatataagtgtatgtttagccttaaaagaaatggccaaactctgttttaaagtggttgtgtcatttttctcttctaatagcaatgcgggagagatttctcaatcttccctcaaacttggtattgccagtctttttaatagtagcccttctaatgcatgtgtagtattatcttatagatttaatttccggggtgactaatgacgttgagcatctcttcttgtgcttacttaccattcatatatcttgttagtgaagcatctgttcaagcttttgtctgttaaaataattagccccttattgagttgtaacagttttttaaaatatatattctagatataaatgtatttcagatatatgtattataagaatttctcccagtcagtggcttgcctttttatcacttcttaaaaaattattttgccccattttcattttcttcttctgggtctctaattatacttatttataccattgtctattgtcctgaaggtctctgaggatctgtttatttttcttgaatctattttctctccatccattagcctgaatattttctattggcctgttttcctgtgttcaacttcactgcctttcttctaccatctctgatctactgtgatttctttttgtcattgaacttttcagtttcagtatttct

SEQ ID NO: 107344 - DNA, 1022 bp, Homo sapiens
tttcctacaatatgcttaaagaatcttgattttaattagagattgccaattagaatagtcattagactcagacaattttaataagctgctgaggtgagttagtgaaaaggaagttgactctagaagtcagtgtcagagggacactaaggaaaaaatggacttttgcaagatggaaagtccaggccctttgttgggagaggaggagagcctctgttactgagactcagccaattttaagaatgtgacacattgacagatgttccaataatttcaagagaagattcagaattatgtaaacacccatttttttaaagccactcttaggttactttgtgagttgtcagtttctgccctttgctactcatgtgaagtggcacttaaaaacatatgcagatactacttagcccagggcctagtggctaagctggttctctcctttccagttggaggcctctgccacaaacatactctgccagatcattagtcaggtcaagaagcatccaagcttgatgcccctctttgtatttattggagttggagatactggagcagcactgtatctcttgtttctggcattgttcaatccagatgttaattgggacagaaagaataactcagagccctggaacaaactggatcccaatgatcagtacaagttctactcagtgaatgtggattacagcaaactaaagaaagaaggtccagatttctaaatgaaatgtttcactataaagctactttagaatgaaggtcttccagaagccatctgcacaattttcaacttaacaaggaaatatttctcctctaaatgcatgaaatcatgttgatgtaatctattggagattatactgattaataaataactgaaacttgaaaataaaacaggtgccataaaatcttttcatttactaatgagctactaaattaactgccccattctgaagagagatcaggcttatttctgagaatgtagagagcatggtgcttctacacttgtcttatgatgcacagctttgatcttg

SEQ ID NO: 107345 - DNA, 1138 bp, Homo sapiens
cactacatacctacattgttaaatatagttgcttcacaaacaatacaataagaaagaatttaagaaaacagattctatgtaaatagtctgcgtcactaactctattatttagtgattaaacggaaaaatatttagtattgagtgttggttcatcattgttgaatcagtaacggttaccaggatcattgtcaagttaataattgagaccaggaacttccttcttgctgagggcttttagtagtgatcagtggcagagggatatgaaaggctggagaagaaaacaggagacccagtcctgcctttaccagcagccctgagattttggttaatcacttcatatttctgttctgcttctttgcttatacaatgacattaggctacagctgagtgggctcccttccgtgtggttgtgagactttattctactgccaaataaaaataatatttgcattatctctttttttaatatttgcacttttttgttctcatcagtatccataatgaagcactaagcatgtaacattttgcagattgagatttcccagtcaccatgcaccataaataaaataattgagacataggaataaaaatgcattacagtataaacaagcagtaacagagtgtggaaaataaaaagacaaggaagtacaacctctcctctgtttaacactgaacaaaatttttgggagagtataatgttatatttataaatagagcaattagatttggttcagagaaaagaaaatgattaaacctatagaatacagttgttgtaaagaagggaaaagacctggagaaggaagaagtaaaaggtgaattaatagctgtgatgagaacactgatccatgattcttcatctccacagacgactgtcccacaacaaaaacaaaacagcatgcaattgctgaaggaaaaagctagttcctcaaatttgaaatgctacttttgaggaagactcagggacttctacctcttagagtattacaaaatgttatacatataccatactccaagcagagatgttctgctgtctctttaaacttagtttagtataaaaggatggtaaatttggtgataaatttagtaataaatgcaacatttttcttatctgtaacttaataggaataaactaatttaa

SEQ ID NO: 107346 - DNA, 1097 bp, Homo sapiens
aggaaggaaataatgatattcacagcaacctgtatagaattggagactatcattcgaagttaagtaactcaagaatggaaaaccaagcatcatatattttcactcatatgtgggagctaagctataagggtgcaaaggcataagaatgacgcattggactttggtgactcaggagaaaggctggggaatggcaagggataaaggatgacacattaggtacagtgtacactgctcaggtgatgggcacagcaaactctcagaaatcaccactgaacaacttactcatgtaaccaaacaccacctgttccccaaaacctatagaaattaaaaaaaaattaaaaagaaaagaaatttcctgtcctaacaatcaatgaattattttatcatatattgccaataggagctaaacaacgagtttgggccagattgatctgtattttctaatatactttattttttagagatgttttatattcacaccaaaattcaacaaaaggtacaaaaatttcctatatatccccttttgcaacatgtgcatagccttctccattatcaacatgctccatgagagaggtactttgttacaactgatgaccccagcgttgacacattattatcacccatgatccatagcttacattagggttcacgcttgctgttgtacattctgtgagtttgggaaaatgtgtcatgacatttattcctatctttaaaaataggagtaccaaccggaacttgaatttggcccttgtatctttacagtgctggttttattttactctcatagtcatcttttgatgctgtaacagaaccacctgactacccatactatttgtaggttgtctccaagattgccaatatgggtcacccagaattagcacaatgggaaaggcaggttggctaggccaccttaataaccacaaagacaaattgtcttaaattagaggaaaaaaggtagtgtctaccaagacatctaccgtaaaatctatctgaaaattagaattggtttaaggtgaagtaagtcagaagagttaatgtccatttcttgttcatgtacgtgtgtatgtttgagtctttatgtagtaccactctgagtg

SEQ ID NO: 107347 - DNA, 1038 bp, Homo sapiens
tttgcaaaattgccttctaccttcccttctgattagattgtaagcccttgaagatcagggagttattactcatgtgatacctagaaaaatgcttagcatgtagtaagtactcaatccataattactgaattgaattgaaagtactccaacaaatttccttgtagtttgtttgaacttctaaaatgatgacatcattgctgtgtgattaataaagacatttaaagaaggaattacaaaacttcctagggaaatcatttctcctcttagttcccgctctcttctggtttcttacccactctaatagactaattagacttgcatagagatgggacagcaggctgtggaagggaaagctgtataatgcagtagaagtaccatagaaataaaaaaataaattggattttttgatgacaaaaaagtatagaaaaaattgctggaaacattaattcaagaagcatctaggtgagaggaagcagaatcagaactgtgtttggggaaggaagcagtcaaagtgaggcagttttgacagtatgtggtggatagtctctctggtatgactaattgagaattgattgtgcatgcagaaaggttatgttttattaagggaaaccttttttcccttttgtcgttatgaaatccactcttctgcagatgttattcccttcccatactaaaccctcattaatttataattcaccgcattgctttaaaagtgctgcacagatttcctgtttctctcacatgcagtgcttctaatagagaaagtcaactcaggatataggttgaaatgctgcttgtcttgagggctgcatgccagacttgatggtgccaaaacatttcaccaattgtctcttagatcattgtaaaggtttcaaagtgctatttcataggctttaagaaagtgaatttacactctaaaacaactctttcactattgactgtaaattgactctggtgtttggaatctggagtcaaagtcaaatggtttcctggtgggattctcttaatttcaaggacaagaactcacagagagaaggg

SEQ ID NO: 107348 - DNA, 1051 bp, Homo sapiens
catttccctaaagaaccattccaatgtaagatgcaaagtatccttgcagaaaattaaacctaaccacaagtgcctaggccctaggctatttagacatgaatcaaaaacagcagtaccaaggcacttatttgtatagatgtttaatcaagagtgatgcttaatgtctatctggaatttcttgcaaaaaaagagaggatagatggtctaaaacaagactaatatatctctactgggcattttaatcagtgctaacataattaaatatttatacagcactttgggtttgggaacattttctgtttgattttcaaagttgcatttctcaaaattcttgtaaagtaggtccattacacttgataccttctctttgcacatagaatttataaatcagagaacataactttccctgagtcactcaacaattgacaagcactagaattatgatcgtatcaattagtcccacctcatgcattagatattaaaaatagacctaaaaacagttaggcaagatctaagcaatccttctgtgggcaagaaagagaatttaaaataagtatgtgactttcacctcctgctattatcacatattgcaggaggtatcacccagaaagataagtacatgttgacatgatttggctgttctccacccaaatctcatcttgaaatatagttcatgtaatccccacatgttgtgagagggacccagtgggaggtaattgaatcacaggggcagttaaccctcatgttctcgtgatagtgagtaagtctcacgagatctgatggttttataaggggctcttccccccgtggctgggcacttctctttgttgccgccatgtataagaggacgtgtttgcttccccttatgccatgattgtaagtttcctgaggcatctccagccatgctggactgtgtgtcaattaaaactctttcctttatgaatacccagtctcaggtatgtctttattagtgtgagaactgactcctacatgttaaacatgactaatacatgtaaacatgttacttattgactagttggggtgtttaaaa

SEQ ID NO: 107349 - DNA, 1044 bp, Homo sapiens
tgggaaattaatggagaaatgagataaaatcatctctgtgtaaatgcttgaacccacagaaagttttctaaatatggactaattgtgggtttgtgcatatttctgtgtctcctcttttcacttcacacccaccatgatataaaaagatgcatcagagagtgagcctgccttcaggacctgaaaggacatgactgaacatctagtagatctggtggaaattaatgttatacaaaagacacgtagactaagttgaccctgggagaggagttaatacattcctttgcaaagtgacatgtgccctttttttgacagtctggctttcatggtatgagatgaggactcacaggccttgggtaatttctgcttttgtatgaattttttcagatggttctgagctggttatgtccctggaggggaatttttcatttgccttagatgttcttcccatgagtaggtacatgagtgaagtttcttacacttttaaaattgcattggcaaattttcttttgctttatgaacccctgttttgtcattatgatttttcacttgttttaacagtttcagatgtcaccttggaatagcactgtttattttggcctttttatgattgctgatgataggtacagtctaaaggccaaaagttgccacttcattgtgataacattgttgcaacattcctaatatattagagaatgatgtaaaataagaatgttagagaacatagcacattctcattcagtttataaacaatatttgaaaatttccagtgagaattaaaaaaggactagtgatgatatagcaaacctggacctgaaatttgggggtggggggtggggggatatctgttttgcagagaaaatttaccagcctccagcaaaatctctgcatcttgtactcaatagcaaccattagtattgtcatttaaaaagaatgaatcaaaaattcatacgtaatggaatgaaaagaggaaaactttctattaaacactgtcaagaaagacccattgctatctatcacctatgaaattaaacctaaaaaaatttt

SEQ ID NO: 107350 - DNA, 1004 bp, Homo sapiens
ggcagaggttgcagtgagtcaagattgaaccactccactccagcctgggtgacagaacaagacgctctctcaaaaaaaaaaaaaaaaaaatccatacttcctcctcctaatcattgataggtatccttcctttttttttgttgtttttttgtttagttttgttttgttttttgcctacgagtatgtaagttcacatttatgtaaaatttatttctcatagtatatgctatttataaccattttccagttaatatgtcatgagcaatgtatatagttgttaaatatttgtacacaatataatttttattgatgtatatttcctcatttcttttttaagtagcaaaccatttcctcccagtcttcccttagttttttataatctctcaaataagtactaaattttcagttttgcagtgctgtactataaatcacaggcagtagtactttgctttttacaacagattagtctctgtatgtgtatccatttatttctcaaacacttatataagtgataaattggctgtgatcatttcagtttgttttaatcctgtggatataatatttttctttagtttttgaagaatttattttagaaaagctttattactttacaaagttttcttatcaggggacaattggtaattattatactctgtgtagcaattgtgttatatctaatctctttccctttaaagcctgaatgcttccaactttataatttgctttagagagcccagtttaccctatggctgacaaatagcaaacttaggatatgatgcaagatagaacatgataatgattcaaaacagaaccataagcaggtatttttgctatttataataatattttgagtgtatctagtaccttttaaataatatagtttaatggaagaatatagtacagtggtatattttatagtctatgtatggctctgaagtgtatccagagtttactttttaaccttaaataaatagatgattagaaatagcattaagtgtatttga

SEQ ID NO: 107351 - DNA, 1003 bp, Homo sapiens
tttaagtcctgctcataaccataactaggtgtctttgtgcagtgcacaaaatacagtgtttttgtcagtctttatgctacctttattttgctgtttctctaacctgtaatctcacttgaagatcttatctaatcttaaagtcacagttcaactctgaaagctagccaaattgactttattaaagataaatggaagttttattcttggatccagaaatgcaactgcataagtaaaatatgaagaaaatccagatcattagcaacaattgttgaaaaggttttaggggttttgttgactacaatctttataaagcatcatcatgatgagaaagcgcatgccatttggggcttgaactcacagaattcaaatctgaggagtgaagtcctccacagtactcagcctttgtggagaccactgtgttcagatgttgaagcattaatgggctagagcagcaattctcaaattgtgttctccggattcacaacattagcatctcctggggatttgctttaaaatgaaaattcaagacttaataaatcagaaaccctgggaatgggactcagtggtcacaagccttcctggtgattctgatgcatgttcaagtttgaaatatactgggctggggtattctcaaaaaagtgcaaccaggatgataaagtaaactagagtggattaaaggaactgagaattggctcagagaagagaagaccttggatgtagacgagagttgtcttcagttacagtatttgggaaagaaggattatattttttccatgtcacttcagaaggtaggagtaagatcaatgggaaatgttaagaatgaaaattgcattcatcctacaaagaagtttcctaaatcattacgaattgttctaccttgagtgtagtgagttatctgacactggaggatttaaaccaatggtagatcattacatagtagagatatgaacatgagctaaagcatgagggcagcaaagaggggagaactttgtttcacctaaat

SEQ ID NO: 107352 - DNA, 1114 bp, Homo sapiens
cccctgcctcagcctcccgagtagccaggattacagtcacgtaccaccatgcccggctaattttttgtattttagcagacatggggtttcaccatgttggccaggatggtctagatctcctgacctcatgatccacccaccttggcctcccaaaatgctgggattacagacatgagccaccacgtcaagcctcatttttctttaaatatgccattatgtttaaatcattcaacttaaaagtgtgaatttttattattagaatatgtgtttatgtataccctgtctcattcctaaagtattttgagatagcttaccaaacatgtgctttttttttttttttttttttttttaaagactcaaggtaatgaaaactatgagtagaatagtaaggtgtgacaggggacaaataagtagatataaaactatgctgcaatattctagttattaaagctgggaaatatgcaaatgtaagtagtgcttggaaccagagaaggttctatatttagctgttcttctgtagctaaatctgacaaattgaaaaatatcatattctctgctctaggtacattttatgtatattttgacagcatatcaaatatatgaaacattaggttaaataaattaaaatccagtggaataaactatatgggataatctaaactattctttgacattaaattatatgtatttgaggtgattttccagttaaaggctgtgaactctttttgctacacagaaaatcctgttttcatagtgtgactgataataatttttagttcaaactctgagtcctaatattataaaggttacaagtgaactatgagctgtttcataagttacaatgctgctttttataaaaaggcctgatagaaaaagtttgcatgggtgtgtttgtacgtatgtatgtatgtatatgtgtgcatgtgtgtgtttctctccagactctcccacaaaataattagatcccattatcaaagttggtgaactgctggataaaccctgcgagtgaaattctttataagcagcaagagaaaatcaattattacttttgttagatgctgtgtattttgattaatgaagttctgctgctgatatcgacctttctttaaatgca

SEQ ID NO: 107353 - DNA, 1143 bp, Homo sapiens
taagttacagaagcaaaaatatgatattaaatactatcaacaaataataaagtcattgagactgctatatgtttttgccttggcacatacatctttttttacttcaaaaacttgaccaggttctattgaattcttccacagagataagttaattttacatagtgtttaggatatcaacaatttttgtggcccttgtaattcttggttatagtttaaaaaaagagagactgtgttacttgagatatttacttctacattttaaaataagggatgagtatcttgatgttattactggtaattttgagaaaagaaaaatatatgttcaaactttattaaataaacaggaatactagttccctctacctctcaagttacttttaattggaaagtattctccttatataattttactctgaactgtcctttaggtcttgtgataatggtcactgtatgctgaatggaacacatggtccatcttcagagaagaaatcaaacatccctgacttaagcatatatttaaagggtacgtatagaatataatttcctttgtgatgtacatcttaatggtcagaatttaaaggcaaaatttcatgccattgtactgaaaatacattaaggttttgtgttatcctctaggagatgtttttgattcagcctctgatcccgtgccattaccacctgccaggcctccaactcgggacaatccaaagcatggttcttcactcaacaggacgccctctgattatgatcttctcatccctccattaggttgaaacctttaaaaaagttttgaacaacccacccctccttcttttaatttcagaattttcagaattcagagttcagtataacacagactcactgggttgtgaatttgcctgaaatttgaatgggttctccaggtgccggtgactcccaagttcacgagaccattactccatgtagatgattaaggtagtagtgtagtagttgggcatcagtcaggttttaagcaagttgttttgtccatactaaatgtagtctaaaaacacatgagagctttgtgctctagtagttttgaagtgatgacttgaagtgttgagattttctttaagtataataattcttaataaatatgaacttgcttttcttgcagcatgagca

SEQ ID NO: 107354 - DNA, 1033 bp, Homo sapiens
ttaatacgttaaattttaattgttacatcatattggatgtgattttttgtggcagagctcccaaatcttgaaaataaatttgaattataaccatcattaccatttttctattgttacagaaaagtaataaacgttgataatccctaaatgtaattggagtgaattctttatctaatttgttcttgaaagctgatggatgaagtatcttcttttgtgctctccaaagagctctttaagcttaacactttctttccctgtgtgtatttttccccctttggaacatcaggagaagtgaattgtcaatatgtagaaaaagtgacccagtaaatgagtaattcaatttaatttcagtaaaaatccatcattattatgaagattcaatacatgataactatttttaaatgaactatatctggccccttaaagagaagtggccaccagagagaatagaaatgaatttcagatgaagcattcttgcattatctattcaaatatccgtctcttccattacatacgcacttttactttgctctaaaaattcagagtaaatcagagaaaagtaaaatgtaaactctgatttctatagctctttgtcagttgattgttatagagctatatgctgaaggcaaaatatgctccttatcttctcttcctgctgctatcttcccatggctcaattttaaccattgtgttcatagtatgattccgaagaattaataccaataatttggctgggttcggtggctcatgcctgttatcccagcactttgggagggtgaggtaggcagatcacttgcggccaggagtttgagaccagcctgggcaacatggcaaaaccctactaaaaaataaaaaaaattggctgggcgtggtggtgcacgcttgtaatcccagctacttgggaggctaaggcatgggaattgcttgaacctggtaggcggaggttgcggtgagccaagatcatgccactgcactccagcctttgcaacacacagatacacacacaacaaaacaaaaaaagccccaacaactc

SEQ ID NO: 107355 - DNA, 1040 bp, Homo sapiens
tctcctaattcagagtaattgaacactggctttggatggtcccatatgagcaagttagaaattgtggtttgtgtgttcacaaactgaaaattttgtttaaatttgcctgcacttggaaagccagaacaggtctctagttatcattagcacagaagcttcaaccatgaaagaacaaaggcacttctgattatattaatgtactgtttcatcagaaagtttaagaatgttccgttcaccatggagaaatataatttagagcactttaatttggaaggaattaaaaaaagaataacatcagtgctgcttttttctttaccccttatagagaatgctaacttttcaataaaaactgatcatagttggtgaattttactgtctacctatttagccattaatatctgtatctggtgtatataaattatagtattccctctcagtgtttaagaatcatggtgtaacatttttattttttgtgtaagcttgaacccctttgggcagtggtgaatcatcagtgtggtgctactgactcctgaataaattgtatgacatttcacttatttaaatatactgaacttacatattgtcttcagaatggtagagcagctatggctttaaggtccttcagaagttaaattcttggaaactaacaatttgatttactttcaggtcttttccaatggtcaccttggaagtgaagaatatgatgttcctccccggctttctcctcctcctccagttaccaccctcctccctagcataaagtgagttttgttgaatttggagatcacttgtctatgcatcaagatatggtagagtggttttgagaggttctcagtacagacactacatgatgaatagaaagtcattgatagtaaacagccagctgtatttacaaactaaattaccataaattaagatccttccctatactttgctggtaaccacaacatctgtgagacttacctaaactcttgaggttacatagagcaacagggagagaaagctacgcattccttgcatcaaagagggtagagtagcac

SEQ ID NO: 107356 - DNA, 1770 bp, Homo sapiens
taagtatagttattttgtaaaatagatttaaaaggtcattatatgcattaaaataatttgcatgctgttatcaaatgatattttacgctcatttttatagtgccatgacaagaaaaatgtgatgggagtatatttgcaaagggcttaaggtatgacaaattatcacccttgtttcaaggcgactcagaagagggaattatatgtagtttttaaacctggagaaattaattacaatgaattgcaatatttgcagagtaattatattactgtttaatattaaagacataatttttactctacagttaaacctacagtttattttactgtgtggattttttcctcgaatttgataagtataagattttaaaaattaattttatttggtaacatgctctgttgtctaaaatttgttggaagcacaatatatttagtagtgtttgattttcctgtattaccagttaacctggttttaagatcacacattattagaatatcatttagaattatgtaaacacaacagattccttttttctctgctattttctaacattaaaattacaaatcaatcatcagattaaccatgtaaataaaagtcaaaagctacgaaaagcatactcattcaattcattgatctatacctttatatttctatgtaagaatcagcctgatcttttaaaatactgtaagaattcataaaattgaagtaattccatatgtagtgctgctctgttacttgtgatcttttactattctggtaataaccgataaagaagcagagcacatttgcccccatatcagttttgctgtatcacagtgatgaaaacaaaaataaagaaaaagcttttaatcttctaaaaatattacaaatattacaaatcaagttactctttaaaaaaactgaaaccatgacaacttttctcctctctcctaaatcatagagatgtgcaaataaattattgacatattcttttaatgtcaaagtcattgtatgattttgatcttctacttgtttctgtatcatttctataacttaacatttggatttatgtactcatttctactttttcctaatgaaatgtatttatgagttttttattctcatttaaatttcattaactagtaataaaagcaacttattaaaagatggcacaggaatctagtaaaactccttgtttggcttagaaaattaaagcaataatacactagtttggaagttctgtcagtgcatggtacaacctttagtttttttttttttttttttttttctcttctgtttctttagtcttctccttgcatggtgagaaaacaagataaaccactcccagcaccacctcctcccttaagagatcctcctccaccgccacctgaaagacctccaccaatcccaccagacaatagactgagtagacacatccatcatgtggaaagcgtgccttccagagacccgccaatgcctcttgaagcatggtgccctcgggatgtgtttgggactaatcagcttgtgggatgtcgactcctaggggagggctctccaaaacctggaatcacagcgagttcaaatgtcaatggaaggcacagtagagtgggctctgacccagtgcttatgcggaaacacagacgccatgatttgcctttagaaggagctaaggtaagaaatacgcaaagcagaagctagagaatctgcttataaatgcttctgatggtcagtagcataaaaggttgggaagtgtttttttttgcctagcatggcacttccctgtaagtctttaa

SEQ ID NO: 107357 - DNA, 1605 bp, Homo sapiens
gcaattgcttgttccaaccagctttagctggcatttggagagcaataagggttttcacatgaaagcattttttcagtgaccaaaatttattcctttaattctcagaatgttcttgtttcttggccatttttatggaaatatttctgaattatatgtcacccttccctgccttctcaaaattggttatgcagctgagcgaaccaaagggcataagaagccactgtagtcaacatgacacatttctaaaagcttacattttgctacaagatttgagggtagcttgcataaagagaagagaaccataaatttaaattaaaatcacacatatatttggatcaggatataaaatttgtgtaaatgtttaaagtaaaatacaaaactttaaagaaatttcaaggttatggaggctgatcataggccaggagatcaagtccctctcataagaaggtacttcaaggagaagcagtatcatcacttgtgttaacagtgtttaatatttcagtagagcagtgcccttaaggttatccccaagtgtgagactgcactactttaaaggagacctgtcggcaactttattgaccacttctctgccagacctcaaagagaaatcagctcttattccatttggtgtttcttaatatataggtttctgttttcctccgcttctttattgcttctaatttgaaaatttccagaagttactagtggaacatagacagtaattcagcctttgaattagtgaacttcattttacacagaaatcaaatgtccatattcttaggaaggtagcagggtgcctacattctgtttctgtattaagaagtagaaaaaaaaatgttcctcctacttcagaggactttcctgtttcattctgggtttctccccaaattattgtaggttgagacttctggaagtatgaccatgggtaaccaggaaatgattgtattgctctaacacaatattcttcatataagcttttgtttattatctgtggaggtactctaaaatagataacacaagtcatttacttaagctataatgccatatgaatatgtgagtatgtgtgtaagcatttttgtagcatataccctctctgaataatattctgtataggctactattttaaatactcttgatttttgttttgttcacaaaataaagtgaaaaaactgagaatagtagcaagtaaaatatgcttagactattttatcatgtgataaaagttttatcaatgtcttcattaattttcacgcatttatagaaaaacattgactctctgagtccttctcatcatccttattatagtaactgtatatacctttttcagatatggaaattcattaagtaaaaatcttgttaaaagtattataaaattgactttgattatctctgggactgtcagaactctcatcttattagtaattggagaggttttctcttgtcctgtttttataataagcctgactgtgcttgaagtttcttaccaaatgttttgccatttccataataatggatcttattaacgtttttataaaatggctctttaaaggtgtggataaaatgaagagtgactaaaatagaatgagttcccaattattattggta

SEQ ID NO: 107358 - DNA, 2035 bp, Homo sapiens
ctcaacctgctttccattgaattaagttgaagcttgagcctcttttcagtagtggcactaacaatcgaaaggaaatgctgggaacataacatgagaagcagaatgttccaaggtgactctagtgtttctccttgatcttatcacccgctcccaagaccattcatatttcattctctctggcacactggtgagctttctgtcaagggagctgagacattttcaaattgatcctttctgttttttaccccacaaagagtagaatgatgatctcaagcattattgtcctagaagtcacacttcagtagcttatttggcagtcagcagtgtcatttaataaagctttacttcactacaatcttgttatactttcttatgggagttagatagtttagaaatttatatcacttgtaattatttgtttttaagttgaagaggtatatttcagttaaatgtctttatgtctactaatctgcctctagtcaattaaactgattgtgacttttatagcatttcataaatgtgtaccacttaattttcaataaaacctaaatttttatatagatacaagcataattctttctgaataatttggaagaatattgctatgatgttatgttcttatagtattttatatgtacttctatatcaggagttacactaaattgttatttaaaggactgtctttaaggccagggacaatgccttgtatttgtgttcccaggcacctaaatgcactcaataaatatttactaagtgaactaataaatgcacactcctgcacacatgttcctttagggcaatgacctaatcttatgcatattttaaactttgttccaacctgaatactaaatatatatatacacagagcatcaaactgatagattttatccagttttttcttataggagtggttataaacaaatgtcacatggtcattttgacacagtagttcttctacctgaatgttcttcctctgttttttaaatcattcttttgtcattcattcatgcattttcattcattcactcattcatttattcatttattttttaattaactgatgaattaatttagagctggagtctcgctttgttgcccaggctggactgcagtggcactatcttggttcactgcaacctctgcctccctggttcaagtgatttttctgtctcagcctcccgagtagctgggattgcagacgcctgccaccacgcctggctaatttttgtatttttagtagagacagggttttaccacattggtcagcctagtctcgaactcctgacctcaagtgatccagccgcctcagcctcccaaagtgctgggattacaggcatgagccaccgtgcctggtgcctggacttactcatttatttttaaaacattttattctctcagttaaaagagtgactgccagtgattgtccaacagaatggttccattgtttctatctgccattttgaatactcatctttttcttcttttatgagcgggccaatgataatattgtgaaattgtttcttcctgtcttcagcatattacattctttaaatgagtaatgctgccatcgtagcatggaaacctgctttgattgtatattcctgttaccatggtgatatcccacagctggagttcataaatagtagcatactaaacatatagtgtatttctattatttcttttatagttaaatgtgtttaataatgctaatccttacagaagcaatagaacctaaaagtctataatacatactttttgattccctctctgatagaaagtattttgtgatactaactagaatatgttttagattttgcccaagtctgtatcgttgcctgagttttcaagctgtcagaatcctgggataattagatctgatgtgagccctcagacaaagtccaggatgtgactggtaagatcacagccttctctctgacttcattcagatcagagctaaaaaacagtatctgttgctacccagtgatttgcttcattttgccagaggattaagaggaatcttaacagtttttcacag

SEQ ID NO: 107359 - DNA, 1050 bp, Homo sapiens
tttctcccttccaatgttccatgctgaccaaatacattcccttaggatattttacatacaaatttttacataggaagatatgttaacatcaccaacatggctactctcaaattttgcatttttctggaatgatttttattatttatcttattggtttttcataaatgttataatttaacactcagagaaactacacgatttcactctttaatcctgaaagatacagtttttattaatagtttgaattatgtgattttttttgacctaagaaatggaagaaagtagttattcctcagaaatcctgaaggatgaacaagaaaaaataatcttagattgaaacagacttgagacttgagtctcaaaacaaagttaacttaaggaagacgtggaataaagcaccagttctgctacagagtagtaatggcatgctaggcaagttatataacctctttcttcctcagtttaccccttcgtaaaacagaaaaataatagtagcttctctgttgggtgttgtgatgatcaaacgggatcaaggacctaagaacctagaagaacgtcaggtcaccaaagtcataaatgctcactatattattaccaatgttaattaataatactatgtaatacatattctaggatatactccataatctgagttagtagaaatcatttcatcactatgcatgtgagagagctacatatgcggagctggtgatattgatgtactgttccccagaagacataagtttgaatactggctctacaatgtacaaatacaaacaaatcacatgactagtctgagcctgatttcctcttctgaaaaatgagaagaataatacctccctaaattgttgaaagaatgacatatgttattaatgctggttttattgatttgtgaccctttttactgcaagttaaaaatgattttacattttaagtggtgtatatttaaattcctatataagtacctacaaaatgtccttgattttacatcttgtcctaaaatattcactacctggccctttaagaaaaagtttgcagccccaggtctag

SEQ ID NO: 107360 - DNA, 1036 bp, Homo sapiens
caatgttgtctgtagggcaagaaaacagtctttatttccctgcaaattgtgaatttttaatgtagttagttttgagaaatgaatgtaggaaactttgagcaaaacatccaataatgaccagtaaatacatttccagcccaaaagtatttgcacaaatctttttgtatcatattgtttaaaagcaagataagggcaaaacttagtatctcacagagaactttatatttgagctgtgtgtcaggatgacaggctttcaggacagatgatggcttttgaatataaatgtacacattttaatttttcctaattgtgtataaagattttaaaatacacaggcagttaaaacaaatatttagccacagttagatgcacaagtattgtatttttctcaccgatactactgctttattatgaatttttaccaaaatatacttttttatggaatgtttggttagtactgcactcttttcataaggagagatacgattcaatttccagttttcttcaggactctaatgccttgatacattagaataataagtgaacagtcaggaaaataaagaggtttcttctcttgggaaaatcaaactttcttaaaactttatttttccttcggaaactgaagatactgaccatttattatacattttgttggctccctgttctatacccactaccacttcaagagaaatcttcccccacctcctaccccaaaaagtctttttgggggtgtgacttttatagttgtagaacattattagcatttctcggtactgtttattttgaacaaaaccaatccatgcattttctatttgtttaggagtcggatggtcagggctgccctttctgtcgttgtgaaataaaaggaactgagcccataatcgtggacccctttgatccaagagatgaaggctccaggtgttgcagcatcattgacccctttggcatgccgatgctagacttggacgacgatgatgatcgtgaggagtccttgatgatgaatcggttggcaaacgtccgaaaggtaaaactagaa

SEQ ID NO: 107361 - DNA, 1044 bp, Homo sapiens
acacctttccagatttatttccctgcatctgattaatcccattgtctttgaaaagatactgtttttccaccgcatattctcactcataggtgggaattgaacaatgagatcacatggacacaggaaggggaatatcacactctggggactgtggtggggtcaggggaggggggagagatagcattgggagatatacctaatgctagatgacacattagtgggtgcagcgcaccagcatggcacatgtatacatatgtaactaacctgcacaatgtgcacatacatgtaccctaaaacttagagtataataaaaaaaaaaaaaaaaaaaagaaaagatactgtttttcaagactttaaagaggattactattgttttttggtagacagactagaactcattatctaataacaggattataacatagtcttatttatcatgttcttatctctcatgatattatatgaacagaactatcactttaacaaaaagtcattaatagatttctgtgtaatagataggtggtagtaagccatcaataaatggcagttcttactcttatttgaaataaaaagatcctgaaattatattattattacaggtgcatggctatccattggtcatgtattctattctttgtagattgacagttacttatacttgttcactgtattttaaaagcgattcagcctgcaacttaagtggtttataattgtaagggtcaatagaatatattgaaagatttttggattagtgaaaacttggagtttagttggcctttttattttctctctctctctctctctctctctctctctctctctgtctctctctctctctctctctctctctcttcccttttcttcttcccaggtctctgccagcaccctgaaatttctacatttgtaaaacaatttgctattgatattttctctcatttgcttcatctctaaaggaagaggtagtagaaaccaccactgtctttttgcagaagtttaaatggaggtgtgaaaattcatgctttctgggttcacttcctctcatat

SEQ ID NO: 107362 - DNA, 1054 bp, Homo sapiens
tctactctcaatttccaatgacttcattatatataaattgatctctttttaaatgatcagttcctacatttctattccttagatgcctctcttccctctttcttttcatctgtctcagaattttgacacctttctttaagttcagttcataagtccacttttctgagtttttctcattcatatacacccttctacgtgatctatgttaattactctatactttggttgctgttgtattttagacacatttatattgtaaaatgtgtttactatgtaggtctttcttgcttgattgcaagagtcttcaatgactttctatgcaaaagttggtgaaaacagacacatttattagagttattgtatgtcagattttgtgttcagtgctttcacatatgctagcctcattttcaatataatctttaaactactttgtaaatggttgttgaatgagtcttttacgtaccatatacattgtagacatttagtagttattagttgaatgtatgagtataggatgcaacttttctgccatttaagctctctcttcctttacttatgttctgttcttcagtcaaattggcttatttggctctttctggacacatcagcaattataggtttctatgtctttgcttatattgctccttctacttgaagatttttataatctctggcataacaattcttactaatccctcaaagataatattgctcataatttttcccattagtgttattactagatctcttcttaaacttcgctaagctctggcttatcttctgcatttactatttttatggttttattacaagtatttgtctagttgtcatacttccccctagactatatgctccatgaaatcaagcttatttattcatctttgtatttctaaagtagctcagcacaatgttttatatacaggctttcaggaaccattgtacatttaattcagatgagttgagaagtagaggaatgtgcattagcatgtgtatgtgtgagatggagcctgcttgcttgattgattgggagacagcatacttagggtttggcatg

SEQ ID NO: 107363 - DNA, 1072 bp, Homo sapiens
attctgttttcctaagttcctgtgttggttctttgggaaaaaattcacactgaatctctgcacattattctgtccttccaagtgggagaagcatgctgacactgcctccagtctgccatcttgaaaaaaaaaaaaaaacaaaaattagcattgagaagatttagacataaatttccaaacaaattataattcaattagaaacacagattctaactcttgaatcttcttacatagcctctcctctccatacataaaattctcttcttcaaatttaaattcatgctctgcattaccccaacaaccttctgattagtctccctatctccaataacaacctatcctattgttcttaggggaccagtgagctgtctaaaaagcagagctaatcattccagtctttcgcttgaagtgtttgcatgaatattaattctaggttaaagtctaaaatcacattaaacatcacaagctttagaaactttttcgctggcttctttttttctacttatcatttcggtatacttaactcatctgcaaagaaacaactcaatactgttcatatttcccaatgtgtgtctcattttttactcctcattgtctttgttttcgtatgttgcattcactgcttggataggcagtcacccatgctctatccagtgttgccactttgaaagctttactttagtaccctaatggatatccctactctgtgctgccaggtacctgagctcacatctgtcaaaatatattacagtgaactgctgacatgcccccatttctcaattgagaggtttccaatagactggaaagtttatttggaagcagagactgcatcttacttatttttgtgtttttgagcctgacacgtttcctggaatgtttaggcaataataattttttttttttaggtggagttttgctcttgttgcccaggctagagtgcaatggcgccatctcggctcactgcaacctctgcctcctgggttcaagcgattctccctcctcagcctcccaagtagctgggattacaggcatgcaccaccacgcccggcaatgttttttttgtatgtttagt

SEQ ID NO: 107364 - DNA, 1522 bp, Homo sapiens
tacagaactttcattgtgttttatcgtaaaggaatgaaagaatggattattttttcttttttgtctcaatggagtggtctacattttaaaggtttattttacaaaaggatacttgttacatattaggtttcatcaaaagaagttcaatactaaagataaagagttttccttattgaaatatatattgttaagcttttaaaccaaatgaaagtatgagtggtcatatttatactgtagtaggttttcataatagattttccggattaaaaccatttgttgaaatcatcaaagagatgttaatcctgctttagcattaatgcaaagttaaaataactgacattaaaaaaatcatttgggaagctttattgaatatattgagataaggtttattgtagtccttctcttcatgcatactgctgttacaattccaggaggtttcaaaatccatgtgaatgaccccattcaaccctcaaactgtccaattcctggcctaattcaccttcactctgctgtagctaccagttgcaggactagctgcattttggccagaactgcatcaccctggaaattttaaacacactctctctcttctgattgccctctttttctggttccatctcagctttattcccactgcattgttctttatctttggagctctctaaatcccttaaattcattgggtataggattctgtcatcttcatctttgtaatatcagtgcctagactaagcctggcgtataataggcactcagagatttgaagaataaatgactaaatgactgtatcaaatacttgcccattgtttgctgtttctgaattgtacaaggccatcatgataattgatgatcttaataatgtgagaatatgattctcttaccttagtaagagagccatcagtttattggatgatagttatatggaaaaagaagaaatgctactgtgataaatatttataattttaaacaagtggtaagtagaattaatgataaataacttacttattgaaggttttcaaaaaattagatgcatcagggtcttacctacatgtcttatgtatttttattcaaaatttttagaaatgaggaaacaggttaagtaaccttttctttatctttaaacaggctaaggatattaagccagtactaacaaacttaaggaccaaactcgtcaatatgtaagatactagaaaaattaatcagaatatattttgaatatcttgtggaagcttctcaaaggatattacattgagcatcataggctggcatgttatttcatgttttaagtaaggcatttgtaagttgtccatttaaatatatttattttagaaagcaaatatatttgtcctgtgaagagcatccttattttgagggatagcttcttgctgttaataaaacttcgtagataacatgttggaaagaataccacaggccgggctcagttggctcacgcctgtaatcccagcactttgggaggccgaggtgggcagatcacttgaggtcaggagttccaaaccagcct

SEQ ID NO: 107365 - DNA, 1127 bp, Homo sapiens
gaggattgtattcctcgtccagaggtttcatttcagtggtaaatacggttaagtttgttacaaggtatttacatgagtatgtacagaagtgtattcatttatgcattaattcaacacatactatatgtaatgacgtcttaaagtgagaattaaaaatctctctgaatttctgagtttttaaacccagaatcaatttcattcacattgttctttcttgagcaaaatgtcattttaaagtgagaattaaaaatcccactgaatttctgagtttttaaacccagaatcaatttcattcatcttgttctttctttagcaaacttttcttctgtagagttccccatatgtagaccatgggaggaataggcactgtgggaacatagtggtttatgtgactggcttcctatccttaagagtaatttttttctgttttttttttttttctttcccttttctccctccctctctttcattctttcattcttatttcttaagaatcatgcagtggagatacgtgaatataattcaaggtaataaaagaattaatgtcctactactgatggtggcaaagtggtatgcggcttcagagaatagagtgattaattccaatttcggggactggagatagtttcactaggagatgaatggattttgataaacacccatgtgagggaaggctcttgcagcctgaagccgtaagacatgtaaagggtttttaatgaacctggcagttgagggaataaaatatagtagtataagaatttgagtcatcggctgggtggggtggctcatgcctgtaatcccagcactttgcgaggccaaggcaggcagattgcttgaggctagcagtttgagaccagcctgggcaacatggcaaaaccccgtctctactaaacatacaaaaaattagctgagtgtgatggcacatgcctgtaatcccaactatttgggaagctgaggcacaggaatcgcttgaacctggaaggcagaggttgcagtgagctgagatcatgccactgggcatcccagcctgggtgacagggtgagactccctctcaaaaaaaaaaaaaaaaaattgggggccatatgttttgaggagagatgtaataagaaatgtggctgggattttc

SEQ ID NO: 107366 - DNA, 1644 bp, Homo sapiens
gctaaggatggaagtggagagactgtactgtgtgagacacaggggcaggagatacagggtgtgtggcattagagggtggggggtgggtacaaaatttggctctggagataagtgggaccatatctgggaggtgactgaatcttagactatggattttcttctcatattcattggacatgagggataattgaagagaattttcatgaccagaggtgtgtttatgaaaatttgtcagcactgttgagtataaattggagcatcatgaaattggtaatgaggacggtcctaaacaagacgttgtagtagtataagtaagaaataattgaagcctaaactgaagataatggcagtaggaatggcagtaggcaaaagaaggaatggacacaagagtgatttcaagagactcagcataacttgctgccatattcatttatatttccatgaatcctttttgtcattccttaagtacatattgtacatgtacgctattttccttcaatatattcagtggtggaagttaattgattaaacaattttagttttgtagcatcaaagtctgtttactcttgtgacaaataactgagttcaggtttgttacagaatttaaaagagttaaatataccatttgcataaacaaaacaaaagggaatcaacagtctcagtaatactgattaatgatttaggtatattgataaatcctcttatctgggttctatgttgttagttttattttccgtcacattttgtttttcttatctctgatgcacgtataaacataaagcacacaaaagctttagttgggagaatttaattctttctgaaattctattcggattttgagtctcactctttgatttctcaagttctgagtcatgagtgtttgggcataaaaacctgatgatctttttttaaattttcattagaaagaattaaacaagcaaacaatcagaattgcttaattgaactacatttgaaaccaaattatagaggtagttataattttatcaactttttctgtcctacgatctttcttattagacaagtctgataggctttgtaagcagtatatatgacaggttttcattgaaatgctgccagtgttgaagaggagaaaagctgattttccagaagtgagaaagacaaggaaacagtcacaattttttaagattagttgaggaataccacacttggcttcttgttattgaagttttttggtgtaggtctaacaataaaaatcttgtaatattggttccatatgtatagctgcttacttgtttcatgtaatactttcatcacaaaaaatatatatctaatatttctgtgataaattataaatacagtattggttttggtccttggaggaataaccttacaaacctttaaagacttttaattttaatttttattttctttccagctttattgaagtataattgacaactgaaagactagttggtaattgaaattaggactcatttttatagtcagacaatgttaatatttaggaggagaaatgatgatttattaataactttactcaaaataccattgcataaaaattatacatataataaagtgattaaggggcacccactttttatttactaataacttagaatattcagtaactattgtttgtaaaat

SEQ ID NO: 107367 - DNA, 1026 bp, Homo sapiens
aaaatagtttgtgatatgaaaatgtatatgctcaattgctgtgaccactaagggagacaggtatagcaagagaaataatggttcagtctggaggggaagccatcccttctcgcccttcccctacgttgtgtggatggaaggtctccaagagaagcatctatgagattaggccagggagccttctgtttcagggccaccccattctgtgtggttttatttgtcagagacgctgatcctaacagaaacagctgtttcagtgaagttcaagcttgccatctattttcagtagaagcaggaagaatgtcagagacaatgtttgcattttagggcctttttataggagcctaagataaagctgtttaaaccttctgtcctctgtcatttaacttatcaaattcaagcagagccttttaatttcaacacacttaacttctagggatgaatagggcattgaacggattctataaacaagtacttttctgagcgataaacaggaacaaaagcagcacaaagatagcatgtcaacaaggtagggtgtattgtgagaagggcaaggcttgagagcctaatctatgctattctggggaagcaactatgtttgtttgtttgatttaaggagcagtgaagttacagagagcagaaaatgctgatgtacctgaaggccattattcacttctgtagacagtgctactgggtgagaagtgaataatattagtaatatatgttcattaattaaatgtagcttttaaaagaaaacacaagatggaaaagtgaaacaaaatggatagagttgtttgggtactaagagtagtagagtagattgaagaccatttaaatgggaggcagattttcccatgcatatctaaaaaggtcctagtgttatcccttcactccattttagatttgtttgtttagtttggccctgagtatgctagaacagataataacctcccagcaaatgtaactgagtgggaacattattttagttcactttcaaaagaagagggagatccaattcataatacc

SEQ ID NO: 107368 - DNA, 1290 bp, Homo sapiens
aaattgaaaggagcgccatattatattacaggaacaattcatgtcctactcttggtttcctttcaaagccctgtatttgtggctgtgctaataaattccatcacattcattatgcatagctgtaagtgtatgtaaataccacgcatcttgcattttgaagaaaaccagggagtgaacacacatagtctttcttgcctgggattcatttattttttaaaattcattttatatatgaatgagaaagttgagggaacatttcctttcataccaacatagaaaatcctctaataccacatcccctgtctcctggtcctgggagcagtaatgggattttctgggtgcatttgcatcatgtgtatcattgcttttctgtttatgttcagaagccttttctgccaaggcttccacaatcttctgaccccagcagcaggtacatccttgtagatgtcagtgtaagtctttatattatgaagagtatttgagagaatggtacaagaggatgaaagggtgaatggaagttgggggcaaaataatggagggctaaagaatatagatttgatcttacaaaagctgtcgagaaaccattgtgcattcttaagcagtgaagtggcaccatttaaaatgcacatgaatgattagtctaatatagtttgtctgacggcaaagactggagagtggagtaagaaatttgttggattttataccaaaaagctaaagtgtttctaggatagcatgtcttgtttaatattttatcttttttcaaaatggagatcatgttttatactgccttgttatatggttttattacttctttatgaatgacttaatagagcattttgtgtatgtggtaaatatttgtatgttcgtttctctgatcaagaagctaatggattattttgaagtatctactattttgtagcactacatgagttgtacaattaacttgagtccccataaacaaaattggggacatgctggatccatgtcatgctgtcatgctggagccgtgtcatgctggagccatttcaaactccagtgtgcttgacgttaaatttcaaaagtcaaggaaattgttgttaaggagcttagttgaagctatcttttcaagaatttaatctactaattcattttgtttaatttttaggaatttgtatgtcattaaaatactctcaaaaatgctgttctgatttgaaatgaaatacgagtataaaaattggggtcgatctttggtacattgtttattgtactggaaaatgaatgcttaacattagtctgtgatagtgatatcat

SEQ ID NO: 107369 - DNA, 1042 bp, Homo sapiens
tgattctacatattttcaggggagggataaagatctaagcataaatatcacctccttagatgggtcttttttgaccatcctatcaaataggttgtcacagttagtattgtgaatattttctgatgatttattttctcccccaacaaattttaactgtctttcaaagtataattgaagttctcattcttgaagcattttctgaataatcaagtgctagaacttgagcattttttagcttttactttttgtcagaacattgtagttggtggtgtagagacagttctatcttgatgcttcaggttctcatttctacttgagggaagctcacaattttcaggaatcacggaggatggcatttgagcccgcctggcggtctgagcccacctggagatccccatcctttcaatggggaaatgtatttgagctattccccaagctaatgctcaggtaggagatacaggcaggaaaagatgtcatggaagatattttaaaggaatgggagtatacgcctagcttagaatacaatatgtgaaagcatattgtattgtggttctttggtgctggatatctcaggagtggaggaattgaaggattgtgttttcatttttacactttttctcttctgctcttctgatttttcaaccatgaacatggttatgtgtatggtctggtttgggggaagtatatatcagaaaaaataaaacaagaaaggaagttactctggttaccatgcaatttcgtatttaaatgacaaggttttgcattttggatatttcatgtcagccgtgtctcctcagctaagttctagtcacttagaagtttggtgtcactgaattataattttggtgcttcccatgttttatatttacactagactacatgctatatggacaatgtgcaatcagttaatatctgaatgaatgaattgaccaacttttgagaacagagtttgacataaatttggtggtttttggttcattgtgctttaattgaaggagaagtagacattgtacttcacattaggctactctttagataagct

SEQ ID NO: 107370 - DNA, 1050 bp, Homo sapiens
tcttgaggcagtgcattaatacgcgtgcacaatgttttttaagtcttattgtgggaattgtcttgtgtccttgttgacggaattccttaatacggatgaagatttccaaacttgaaaactagtttttaaattttagctaaggctattttgtatttatgtattgcttaactgctatctctttttctttccttttaaagtaaaggtcggagggttggatctaatattcttgctataaatgatttttttttttttttggtcttgttttgttttgatgtgagcatatcagctttgagggacatctgagatattttgaatatgtaggcagggcttttaaagaaaggaattgctgttttcttacatccaccatgcagacttagacttgacaggaaaacagaggcatgtgtgttctcactgtgtattatcgttgcgccccctcacatagctgttagggtttgtcagcagtttgttttgactcactagaccaagggtgggggtggttttgtgtgtttttgtaagttaactagtgtgggatgtcagtaatctcagctttaccattttagttggccatgatcccttcatgtaagaaaccgtcatatttgccctatttctcaggccatactgtggttccgaaacttgcccgtaaatatttgtgaaatagtttttcttttcttataactctggaggtcaaaacccagccctaagataaactcctgtttcatattgcctctgcggggtgctcatggtatgtccccagactaatttgggaacctccttgaattactttttaaaatttatctggatagttcttacacaattaaatttaatttttatttattatagcaagattgaggacactcccaaatccacacttcatttcctgggagatcatgttagacacagataactatgctaaattattttgatccaggtaagcgtgttagaaagagaggatggggctgctggacttcattgagaggatcttttgatttcagaaaccattagtgaaggaaaggtgtactagacagagctgtcataacctttttactattt

SEQ ID NO: 107371 - DNA, 1089 bp, Homo sapiens
ctcccaggttcaagcgattcttctgcctcagcttcccaagtagctgggactacagatgcacgtcaccatgcagagctaattgtttttgtatttttgtagagatagggtttcaccatgttggccagactggtctcaaactcctgaccttaggtgatctgcccacctcggcctcccaaagtgctgggcttacaggcatgagccactgtgcttggcctacattttttattcttgtttgcatattagaaaaaaaactttaataattaaagaaggaacagttttacaaagacttttcatttcaagctcattatcctttaaaagagaagacgattatattttcttctttttttttttttcttgagtaatacttcattcacttttcaactttgactactgtaactttaggtttagacccaaataattggtttcagtaggtaaggaaggttgaaattatgtgatataagaatgatattgtttatctttgttatcagtgtctaaacctcagagatgagcaccaggtagtccaattccattttcctgtgtggagaagctaaatagattggaggttacatgacttgacacactggggtgtgcatgtaatattcatgtgtgatatatttctaaatgaagtttcgttaccagttggcatgtctgagcctacagctgttggcatatgaagggtatcagaattataatgcctttttcaactttgtttcgggaggactcatttgaacaattagcacattttatggttgtgaaaatgaactgttgttttttctcttcattaaaccagaattaatattgtatgtcatctggtcagtcgatgcaacttttttttttttctaacacgatgcttgtattcattaaattcagaaagactatttaaagctttatttttcaagtatacctttttctgtaaatatctcttcctttctcactctgtttatgtatatacatgtgtgaaatattacttgtaactttttaagcatttaatttgtcttgatgggcacagatttttaaaaaggaagtaagaaagattacctagttttttctgaactatattaatgataaagcatctcagctcattttaca

SEQ ID NO: 107372 - DNA, 1032 bp, Homo sapiens
gtaattcatttccttagcatgttgggttttatcttcattctgttcccttcacagttgtggaattcctgttgcagcttcattttttaaggacacaaggcaggaaaggggaagggcaactccacacgtgtctgtcttcttatcttgaattgcaaagctgtcccagtaccttaccacctacttgcttctctagcagattctcttccatattatttaagccactgggtcactccaggttacaaaggtagcggtatattgaaactttgaaatttcagcctccatagtaaagaagggcaagggagaaacggtgtttgtttagtcagtctaaattgtcaaaggagatagccagatatctctttttgagagataaacagacactcttcatttaaacatggtataacttggctttaaggcatatttctttaaaaatatattgtcaaggactgcgaagagcctgaagctactttgccatactttcagggctagcagaagacaggagaatatttggtcggggaaaatgaaccatttattagtcacagagggacagcattaggcaaggggtcatcacttgtgccaggtcaccaaccctcagtttctataggacagtataaagggcaggagacacctgcatgtgcagtggctggcattacagatgaatcccaagcctaaggaccctgaatttttataatggacagtaaacctgcctgactcttgctctggaaggagacattatctttattgaactggactgtaaccctctttttttttttttctccagaggaaaacactgtccctattatctaaggctgtttgatacacaaatgttcctgaaaggataatttgaaaggctggcagtatctggttgcaagacatgaaaaaatgtgggagacctatagatacttctccccaaaatatttatgttctgttctttcttaaaaaccataatgtatctcatgttctcagttttgaatgctacttaagagtaaggatatttactctattttggattattggtaagcttaaaatcttgggttc

SEQ ID NO: 107373 - DNA, 1003 bp, Homo sapiens
gggaaactagaggaatgaaaatatgaatttttgatacttcaaaataataatttttatcttggattcagaagacaaatagtaatcaatctcttatgtagaagtatgtctgccagataggaagtagaatttgctttagaaagcttgaaaaatcttctgagattgatttattgtaaatgaataaaaagtttattttatcttgatgagaatgtttttatgcatatttcaagcatctgagtggtgtgaatagacttttctaaagtttggaaatgaaggggctcatttctttaacacaccatgaaagtagaggccacaagaaagttatttagacaaatgttttcaaagttaaacaaagggagtctgttaggggaggcaggtgagagcttgcagaatctttgactgttaaggactttatggccctgtgtatttggctaactgcacccctgctgcttagctagctagatacaatgtaattttcttgttgatttttcaatgaaaagtgaaagttttttttttttaatagcagtttcctctctagggtatattttacaaaatacaaaagaaaacgaaattattcagatgtaattaaaatgaattccaccattagctttttaaattttaataaaatgcttacttgtaatacatttatttgctatttatttcatttatttagtttagtttttttttttttttctaagccccatgttaatactgttcagcccccaactcctggtttcttagtaactaaaacttattgcaagtattttaatttcttctaaatcagattatatattatgcacatatgatatttggatattaaaattgaggacttttttcccccacagatgagcatttgttaaatgtttatatattcctgagaatgataccaattattatatatattaagcaaactcacaagactcaagtgaacttggctttgcagtggaataccgtttatgtttttcagtcttaggtagcttattaaaattgatgttttcctttcagt

SEQ ID NO: 107374 - DNA, 1049 bp, Homo sapiens
cattttctaactcagtagatgttttataatttccatttgataattttgatagttttgcttatgtggaaacatttcatgggagacatttaagttttgtttgataatgtatagattcccatagattttgatagctctcataatgctgactattcacaatgaggtcactcattctgtgtattcttgcctgcattttaagtgtccaagtgaattttgttcactgtcctaaatgcaaccctaagacaaaatttattggtttctatgctgatatagcatatccttaattggatattactgttatccttgttctgtttactgacaatgttctgtggccagctgtgtttatgcagaatttacatttgataaatgtttcataacaattcataataatgtaccattcttggtacaccataacaggcacataaactttcgaactgtgtttctttttctagtaatatatttggacacattcacttctaggttcccttaggattccaaatgcaaactgagtctaaaatgtgccattgcacatggagctctgaggcattttgctctacagaacacagaagagtcttcttagcatgttttcatttacagagtggcctcattctgaatagtcagcattatgagatctattgatctatgaaaatctgtacattaccaatcagaacctaaaagtctcccatgaaatgtttctacataagcaaaacaatcaaaggtagttaggcaacaaagtatatggtttagtagaatgactccacctaatcggtatgacaacgctggttactgggaatattataaattcactacagaattgtttctttgattctgtaagtagctcactagggacattactataattgagctaaaaatgaaggacagtaatagtagaaacagtaatttggagttaattgacttaatcagtattacttcatgtgattctgcccgctttattgaagaaattgtgctggatgagtacatgaatcaaaatgcatattttaatgttcctgcacctctgttgtgtcaacaataaatgcggattgttatacatt

SEQ ID NO: 107375 - DNA, 1023 bp, Homo sapiens
attgtgggcacctcaggtatttctaaaaccatcttttaaaaaaagttctattacagatttaaaaaatattgtatttatttaaggtgtataacatgatgctttgatatatatacacatagtgaaatggttactacatcaaataaattaacatatccttcaccttccataattacctttctgtggtaagaccatttaaactctgttctcttagcaaattttcagaatacagtattattagctataggcctcatgctgtacattagatctccagtattaattatcctacataacttcaaatttgtactctttgaccttcttctctccatttcttcccctccccatccctggggcccacccactgttctactctctgtttctttgttgcttaactccttcttttaagattttgcatgtgaaaatgagatcatatattaatagtatattctttctttgcctgccttatttcagtttcattgggattgctgacagtaattaaaccattttacaggagtgactgtatgcctcacatataccttccattaaacccaaagtaaatgtgtcttcaattcaaatttccattagccagattccaaaaatacccacagccactccagtgccacccaacaggaggctttagccaattatgtttaagatattatactcttaggccgggtacggtggcgcacacctgtaatcccagcactttgggaggccgaggcgggtggatcacaaggtcaggagttcgagaccagcctgacaaagatggtgaaatcccgtctctactaaaaatataaaaattagccaggtgcggtggcaggcacctgtaatcccagctacttgggaggctgaggcaggagaatcacttgaacccgggaggcagaggttgcagtgagctgagatcgtgtcactacactccagcctgggtgacagaatgagactccgtcttaaaaaaacaataaaataaaataagatatactcttgacaatttgacaaaaaaaaaaaatacaacgagggccttagaag

SEQ ID NO: 107376 - DNA, 1329 bp, Homo sapiens
tatgtttatttttactgtaagatacagtaaatagaaaggcattgataattactaattggcagtatataagtgtgtagtacagaaacatccccctcttttgtttatcttttcttatttgttagtggtgaaggaagtggctcataatatcaacattgtcctgatgattacatcaggaactttattattagttctgaagttaatcccttgacacattacctttttaaaaaaataactgcaatagcatgaatttagtttgtgaataacagaaaatagcaattttcaagtctaattggtaggtatgtaaaaggcagagttaagtgtatagttaatatttttttcttatgaagcctctttgcaagggtagatcttggaagtataaatatgaacacaagcttcaatttcagtgtgtttcagctaccaataaagtaaaataactatttttacagggaataatgaagcagtcttgggttgtaggggaaatatctagtgagtatgtagttttaccatttcttggcctctggaatttaaaatggtcaattgaaattctttccaattaatgttctgttttcagagggcaggcttttgctctaaggtcactgagaataggagagcgtaattgctcagttgtgttccttataagatgtagagtgttttgtaacagaaaatcagtagcacagagttagcatagtctatgttttgaggaaaagaatagtagatagtagcatatcccaaaacatcccattacagattttctggccttagctctgtgtatgtgtaatttgatagccgacccagaagccctcacatcagtggatgcttatttgatacagtgatagaagtattaatcatgaatacatatctaggttcaagtgcgccagaatgaaatgtggagtctgttctgaagctactcaagagacaaggtttcttaaacacttaataaacattttttgagggcctactgtgtttccactgagtgctcgttactggggatatgaagctagacaagacataatcccgcctttgacctgtcaaggaactcagagaacagtatcagagccaaacacataaatggataattgccatgtagtatggaaagggctatattacaaaccccaagtacagtgggaacagagtagagaacatcctccttgtttttctggccagtgttgagacagttttctgtctggattctgctggccattgccttttaggaacagcattattgtgttcttgttggaaatgctgaggtgagagtaaggaaatgattactaatcagtatggttggaatgataatttattaatgtgaggttcctgagcatggttttcata

SEQ ID NO: 107377 - DNA, 1994 bp, Homo sapiens
catttaaagaccagaacccgcaggccggggaggagggagagggcgtccaggcagacggcggtgaggactgcagcaggcggccgggaggcgcgtccacccaggcgccgagcccacagtgtccctcccgcgccctagacggacggtgctgcgggcacgggagggacactttgtcccctcccagtccaccttcctcctgcagctcagacccgaggggccgggaaggggcctgagcagggaagggacacaggcgtcctgaaacaaagctttgggttgagggcagaggcgaggagccagagaagtgaactcctcctttccgtggccgctcttgtcatttttctcttttctcttttcaaatgggctatttgtgtgttaatttcatttggttcttgggaataacgactcaccgcgttgatttaaagaaaggtgttcgtgtgtccgtacttggtggttttagtgtgggacatgccctgcgcttttgttgacaacagagctgtcccttacgtttgtgtaggataatctttatgtttatgtaacttggagaaatctaacagagtgaaagtgaagtttctgcgtaaggctcccaaaatgtatgataggaccttcagttgttctggtattttgaattggaattaaggcaggaggggaagaacattctgtttttatctaggtgggggaaacctgtttaagttttgtttgttcttttttttttttttatgagttgagtattagttcagccttagctacttgaaacgtgagcaggatgcatctttaactcttagtattgtaaaagcaaatctaggatcactgctcttaaaactactgtgtgtaaagattgagagtgtaaattcacaagcttattgataaagatgaatccggaacttttggttttgctctaatcgatggaggaagatgcagtggtacaagttagtctctagttttctggtgggtaaatattttcaaaaccaactaacttttctttttttaaatctgccttttaaagaactaaaattccagatggcaaactcaatgaatggcagaaaccctggtggtcgaggaggaaatccccgaaaaggtcgaattttgggtattattgatgctattcaggatgcagttggaccccctaagcaagctgccgcagatcgcaggaccgtggagaagacttggaagctcatggacaaagtggtaagttctgtctgacgttgcctgtgcgaaacactattcactttgtctgtggtttctccagatttatttatactgttaattaataccaaccattgttatggcaacaatcttttgatttcaattcatcatttttcttcaactctgtgttttttgaaaagttggattcaaagacttttttgttttttaacctttcatcctttctactctttaaggttcagagttcctctacatgactcagtatgtaaagttttaccattggctgctttttgttggtgtatggccatagaatgcttggaagtgtttgttctgtcttctgtgaggttgtgttgctcttagataacaaaagagtaccagcaggttatttaagtctttgaccactcatgacaatcatctggtatgatactgaaaatatttactggggaaagaaacagattagttcttaagtgaagaagcagtagttgagggagtttccattttcatctttgagaattcatcttcattaagaaactttttttgttgttaatgggagagttaacagtttctttcatctactattccattttgaaacaggaaacctttcgatggcacattgtttattgtgaaaggaaaatttatgttgggggtggtgaggctgagagtatcagaaacctctgtggtttctgcatgttgctttcagacaaactataatttcacaagaagaaatcatgatgggtgtcagtatccagagaagtcaatctgaataccttacagagatttactcagaaactgtagctgtcagtatcctaccttactaagtatgattataaaataaa

SEQ ID NO: 107378 - DNA, 1030 bp, Homo sapiens
aataggtttcttattttagcaccaaaggcaattctttccttgtagactgaagagaagccctaaccagtcagttaaggaatagaacacagtagctaccattttattctctctcccacaggactctggaacctattttattttgatgaacagctatatattgaatgccattttactagtgttagttcatttcatcctcataacaaccttgtgacgtagttactattgttatctcaatgtacagaggagaaaatgagacactgagtgggactcagggattgctccaggccacacagtcagcaggaggcaaagcccagattcaaatgcagattactcagctccacaatccacatcctcacaggaggctgcactccttgcccaagcgtcagacaggagcaaagagaaagaaggcaaccagctggctactttcttcccttcttggatgcctccaacagggtgagaaggactaaacaaatgaccaagtgtcatcccattttggacatacttaaaacaccccatggaatttttattctgactttcttctgcctgtgtggcatttatgtttaaataaaagagaattcaactcgtatgtctgatatcttcatgactagtttgccagggatagtccccatgtacactttgttgtatcgttgacctgttcagtttagcatttgctcagggatttccatttttaacctagtgctattagcaacagttgtgttaaacatgctaagatgggtctggtgaactttgacttttcgagcttcagtctggtctcagcaaggagtaactgagattttgtgcagtgagcagagttccgactttaacacatggttaaatctgattgacttccaaccctctctaaacacaaagtaactaacagcaacttcccaagtacattgctacaagctgaatatttatgttccctccaacattcagatgctgaactccttaccccagtgtgagggtatttggaggtgggacctttgggagattcggtcttcataaatgggattagtgcccttataaaaga

SEQ ID NO: 107379 - DNA, 1014 bp, Homo sapiens
atcataaagtgtaaaaaattggagaatgctagtattcccatttctaattattatactgtgtagtttgcagtggtgtcgtctctgggtatgttactatgttagtatagccttaattttaagaaaaactctgtttttctgtttggctttttagttgtcctaatgctttgtagtactttggagtacaaaatccaaggagctatcttctttcttattccaacattttaaaggtgataaagtgaaatattgcactggcttttcctaatagtgctcaccttgagagacatgtattatgatggcattttatgtttctaatggaatttgcacccatatctctgtgaagtgaatgtgtatttatcccttgactgtattttgctttctgttattagtgtcctctctatcttgggtgtattatttttccgtttcattccatctatacaatgagaacagcagtaaagccatatgttgacattgaagggggtcacagaattaacatgaaaatgtttattatatctaattttaaattttatattatatctcttatttaagaactgtaaacgtcttattatgcatggttttggcagtgttttttcttcagcagtttgattttggaatcatttcctttctctgtttaaagctacaggcatcctttttcctgcatgggtttggattacaaagatcttatttaacttcccaaatgtattccttctgcttgtgcgctatgattacacacaaaatggaaaatgtccaaaaggcaatcataaaatgaagtggatttttttttcttccttctctacctaggtttttataactataactatgataatctgaggagaaaatatttattcatttttttaaatatttattgaaggctcccccagtagaaatgtgtactgttgctgcagctgtttctattatgccaaaagccagctagaatacaaaaggtgtttaggaatgtttaactgtaagattgagaattttatttttttgggggagatgggtacttctctttctgga

SEQ ID NO: 107380 - DNA, 1123 bp, Homo sapiens
gttttctaacctgcccctggggtttctgctgtggtaaattccaattctctgtatttgcttgttgctctcttcaagtttggggcagtggtttgccctgtgacctcacttctctgacagcgctaagtgctgttgatttttcaggttgttcagctttttgcctcttgttaggaagtgtgacaacttctaagttcttcacaggccagactagaaacggaaagtctccagttctttactttttaatcacagatgtgagcctgctatgcagaaaaattgaggcaatgtccatatattcatctgatttttgtacctaatgctttggaaaccttttggataaaaatattaatgaaatataatttttacattctcctgaaatagagcagaataagcatgaaagaagtacagagtaattctagcttcatgttggtatgtaaaacctgagataagcaaaattctaatttttaaatcactcactatttgtgtatggtttcaaaggcattatgaaatgtttatgtagacataataccaaacatgaacaaaattcactcctacctcatttatcccctgactcttctctagagcccttactgttagtggcactgaacccagtttggtggtagaaggaagacaagcacaagttgactacattttaaaaaaaattttctttgtttgaatagtcacaaagaggttttgttctgaagctatcaaagtacaaaatgttcctaaactattaaatatttcaccaatatggttaacttttccacatggattataattcctgaaagctcagaaaatattttttggagagactcttgttctctgagacagctctgattgttggcattcagtaagcaatgcatgctattttcccaattttggctccccagaaaaataggtccctaataccttataagtattgtttccacacttttatgcatagaataatataactcaatggacataaggatcaaagatgctatgaaaactcataggtgagtaaaattagttttgattgaggaatgaagacaaagatcataaaagctaatggcattaaacattttaagaccagtagtatgcaccaacagctttaaaaatctccatgcccatttgtctaggtattccactt

SEQ ID NO: 107381 - DNA, 1040 bp, Homo sapiens
tcccaagtagctgggactacaggcatgtaccaccatgctcagctaattaaaaaaaaaaaattgtatggtctgggtttcaccatgttgcctaggctagtctggaatgcctgggctcaagtgatctgcccacctcagactcccaaagtgatgggattacaggcgtgagccaacatgcctgggcttatttagctttcttaatatgtgtctagtagaagaagatctcatttttagctccaaattttcattgcatccttagtatcatatagccttatgatagcatttttcaaagtgtggttcactagaatcatggaggtgacttgttaaaagctctaattcctggccgtgatgtggcaagtatctgaattttaaataaatgcccaatccagctgatttttatgaacatctaagcttcagaatgactagaccacacaaattatggtgttccacaaataagctatactcctgaagctcggtcaggttgtgcttattacttaaatagtaacttgggtgatatatttatgtggcataccctgacaccttcacagaacataaacttttttgtactttatgccttaacaaccccttccaaatcacttgattaataatgattaactttctcttctagccttgagaaacaattgtctttctctgctttttctggtaacagctaaattgttaagcttatcctttttactaaagagcaggactcggctgtgcacctggctcacgcctataatcacagcactttgggaggtcaagtcacttcagcctgggcaacagagcaagattctgttcaaaaacaaaacaaaaacaaacaaacaaacaaacaaacaaatacagtagggctggacggccgagtgcagtggctcacacctgtaatcccaataatttgggaggctgaagtgggagaatcacttgagctcaggggttcaagactatcctgggcaacatgatggaacttcatctctacaaaaaatacagtacaattagccaggcgtggtggtgtgcacctgtagtcttagctacttgggaggctgaga

SEQ ID NO: 107382 - DNA, 1123 bp, Homo sapiens
agagggcgagggagaaggggagagagaagagggagggaaggggggggagagagggagacagagagagagggagagagagaacgggagggaagagaggagggggaagaggaggagggaggctgtgtcaggattttgcttgaatgtgggattatgttgtgtcaataagtttaaggtggagagagcgaggctgagggtggtggtggaggggaggaggaaggccttggccgtttaaagtcttatttctgaaggtaagttacggctttgcctggtcgcgatgacagaaaacttgcagatcctttatccggggatggggtcgatgcctctagaaagagctccctagccctcttaagccacactcgtgttacactgttatttgctgcgatccgggtcgctagtaaattacagaaatcagactcgaggtttcttttcctcctccacctcgtctcgctcactcaccctctgaaatttattatcatattttatttattttttggtattgtatgaaacttaacataactgagaccgaacccgagtcctgtaatttacaaggaccctgaatcccagaatctggaacacgtttatgtgtgaaatagccgcgatcatttctgctaaatgaggaaggtaaaacgaaacgatgcaaaaagctaagacacaacatgtacgacagagggggggggggggagagggagagacagagagagaagctattttttgctttcctttctgtaggaaggaaaataaagcgtgcattccccttccttcccagtgtgtagggtctagtcaatattttaactgtctgtggacaaattagtccaggtggatcttgttgaaaagtttcgcgaggtggggtggaggtgggggggggggcgaaggggaaggtgggtggaggttgtgggggatggggacggagcgagctctgcctctgctaatggtcattggcctggggctttgaaaccattgcctgtcctgctaatgacacgtccagttctcttctcccggccgcggacgccgggctgccgttcccggggtggctgactgggactggggtactttccccgcgcggggaggggcgttcttcgccatctcctggggttgcccactggcggcgtgggggcccccacgc

SEQ ID NO: 107383 - DNA, 1613 bp, Homo sapiens
gtacagggaagcaggatgacaattagtaatgacataagggtctttattgttcacagaggaagatgctttattggggttacagcaccccagaaaccttgtctcactgagtttcccacagcataagtcagtttatgattcttagtgtttagaattcagctgtgggttattattaagatagtaaatattcattttgtgtttatctacaagtaattgtcgtttcaaaacttattctcaaatagacattttaatttataatgaaattttacatggcattgaaggtctagtaaatttaatgctagacaatactataggaagagtgcagtgtatgagtggagagaattattaaaaacccaaggaagcattgtgcagaagtcctctaattatagtgactgacatttgcttactctctctcaagttctctttcttgagtaacctgtggtgtttgtaacagttacttttggggtggggaaaggtgggattggcagtgtggtaaatctagcgtttagtgcactaatttgattcaaaattgatcataatttcttttaaaacttacatgtttggagaaattaggaacaattcggtagcctgtaaatttaataaacaaagactttgagatctgttgttaagtgcctttttcagatatatgactcccaagtggaaaaatctgcaaaatatgtgtgggacagtaagtgtgtggaaaatttgtgagaggtaacagtgtgggtaagaactgagggtttacagagcatttgaaagcagcacagtgagcctaatctgcagaaaaccaccttgtaagtttgcccctccattgtaaaggaacaccccaggtactcttgagttgttgatgtttggaaactagtactaaattgtgtaaatcagctgtagtgctttgtaatattaccatagtgaatttagagattgtattttgtgaatgaaaatgaacttgaacttacttttctgtgaaagaaaatttagagacctcatctgtggtgtttcctggattgctgacataatgtgtacattaacaaaattattgtctttgtattaagaatataaaactgttgtcttagtattgagttagaggactagacctttctggtagtgtccatttggtaacaaaatatactttcatgttattgaagactttagataatctatgtaagttttgcattgaacatttagaaaatctagagaactttagataatctgtatatgttttgcatcgaacattttctatggaatataaatattgcattactgctgataattaggtggtttgttcactaagagctcagaatacatcacatacatagcaggccaatcggagtgtcaaaatgagaaggttctataagttgaatttagtgcacactaaaatacatggatttcattgtctttgagtttttttaaagcttgtttgaaaagtttcattttgggcaagagtattcaaaatgcattcttgattactaaagaacaccacatttatactgttaggcacattattttgttcattgcaacaaactgttaatattccttccccatggaaatgtgtttgaccaattcagaaattaatatgataggttagtaatgttgagaataaaagtctgataagtgct

SEQ ID NO: 107384 - DNA, 2053 bp, Homo sapiens
tccatcattaaaagctaattgtcacataatataagtgcaacttgatgggatttttaacgtaccaaaaattggcaatctgtgatgaggaaagtgggctctgtgaggactcaagttaagagaatgaaagaaaaaatgaagcttttataaatcttaagtggtagctaaatggaaataaaagcttttaatttttgtaggagagtagtgatagcagatcagtaccttatgttttgctggaaaccgaagttttcagaatgtgcttgtatgactgctagggtggtggtttgggccactgaagactgtacagggttaattccttatgtttggaaaaatggtaatgccttctttatctttgtgctatccatggagttattttcttaacaagagcaataatgacctttcttgctcctctttagggaatggcaattggtgggatattcagtaggaaatccattaccctgtctgtgtcttgggtagtttgtggtgctcccctggtccagtttgggtcttgctcagtaggtagtgatgatgcattaagtggataaaaccacagtcatgctggggctttcatttggctcagtgacatggttgtaaaacacagggtttcaaacaaagatttttgaaatggtgctctcttactaatcctcctcacagtttggtagaaagggcactaaaatgttgctggtttgtaaaaagtagagtgcttgtttatcgtagctcaaaggtgctaattgtttctagcaggagtattacacatgaaacctcaaggtcatgcttaacccactggctactgaacagtttgactgcactgtaatacacaacctgtcccaagctttcatgcagcttcctagctcggactcattagataacgttagtttgtttgaatcagcacactcttctgtgccttctgaagatctaagacctgggagctactgaccatccatattttcattccttaactcctaagactgtgccaagatgttacgtcttctctagtcattcctgcctataaattatttgcaattttgttttacctttactactgtcataaatctaggaaattttagtttgggcaacttaaggaccatagtttttatagcccattgtcagaacactagttatttacttactttttgtgacataaaacccagattttttagattccatgatacacagaaccatatgattaaatcagttgttattatgtgcttttagtgacaaatctttttagggctacatcatcttatcttacatgagacagataatttctgtaagaaacttgtatcagaaacatgtagcctgtcgtgaatttttattactttctttgttgtttattgaaagggttgggacttctgagttaaataatttaaaaagttacattttactgttataaaaatccatgttaatccaagaagaaaatttctgttaaatgcctttttgatttaaagtgtgtgaattagatatttgatcatgatttgggacctgaaaaactatcttatttctttataaatgtaatatagttactgtatctgaaagtaatatatggttcctttatcctctctactactgctgtattttcagaaggagaagcaattatattgatttgctgagtaacttcttactcaaccagtttctgttatagtatattaacataactgttctgttagtttatttattctgacttgtgggcatgaatattttaggtaaactttataatgttcaagatagtttgaaagattaatcaatgcttatttccttgctttacaaatgtataagagctattcaagtaacagttatctaaacaagttgttttataatgaggtagtataagagaagtatttccctagacaacatgaaataaagctcaaacatcctcaattttttttgtttgtgaatatttatagctttgaatctcagctgtagtcgggatgatggcataaattgtaattatactgcagaactgaaagaaaaatttgaaagaactgataatggctctaaaacagtatctttaataagctaatggtattggtgaccattcagtaagtatctgctcagt

SEQ ID NO: 107385 - DNA, 1018 bp, Homo sapiens
aacaactttcctatgagaccttaatgagataacacaaggggaataatctagcacatacctgggcatagtagatgctcaataccaagagtcaactgttgactcttggataaagtgattagtcactctggagaggtacagacaatatggtcagatgagggatcggtaacttttgacgctattgttggggaagtcctcatggaaacttgaaatgggccttggagttgaatgggatttgggcacatccccctgagcgtggggagatcaccttatttggctttgtatttttagcaggtggtacagcataggttggaaataatttttttagatgaataaatgaggggaaaggacagttttggtgaggggtaaaccgcaagcaatggcatgccagagattgggaagtacaacagagtttaggggctccagcagtgattcagttcagctgaagaaagagtaactacaagggaaatgtatcttctaagtaagatcagggtcagatcctggggaggtcatagttgccaggccaaccatgtaggatctaaagcaggcttggtagccaacactggtgacattggagcagggtatgggtggcaggagcctcagatgaggagactattacagcatcagagctggaagtaattactcatctagggtggccatagggactatagagacctggatagaggtaagtgatattttagaggcggaattgacagcacactaaagtaagtacttcaactgtagctcagtggaatgattttgaatgcctccttttgctataggaactctttttgagaaaatgaaaacctcaaatcaaatttcctggaacaacttttttggagagtttagcgctatctaagtcattctcctaggagctcttataaaacattatgaaggcaaaaaaaatgttaaataaagttattatatcaacaggtaatttacagcacagttcaatatttatacactgtaaatatatttttatagttcttttggaccctttgtatattctgtgttatacata

SEQ ID NO: 107386 - DNA, 1033 bp, Homo sapiens
caacaaaaaacagggggctatcttcatactccatattaatcaggtatgggctgtcaggggctgtcctagttgacagacagtgagagaggagcataatttcccagattctttgggcaagttggctctcaagcagctgtgagctgatagcatccaacaatcacagcatctgggcagtgggtatgccaattaggtaaagggggtctagatgggacattacactgagttacaggaagttatttaactagcttaaagttccacagctagtagtgggatttgaattcaagcagcctagcaccggagtccatctttctaaccattagctataccatgtgcagtagtcagaacaacagtagcaataatagcaggggcataactgaacaagggatgattcagagaaaggagttgcttctgaccggggggaaaacaaagaaattatcatggaagagatgtcatttgattttgctttgaagtagtagttcatgtaaaaatttatgtgagaggctttttaggcagaaggaatagcctgagaaaaggcatagtggcatgcaaatgtggtttgtgtgtaagaaagttggttattctgtttggcttcgatttggcttatcaaagagagttctgggagaaaagttgttcaacattggtttgaggccaaataatggatatccctagatgccagacaagtgaagatttttaaactgggaaatgacgtaatcagagtatactttagaaatattaatgtgacaacagatgaataggggaaattttaggaaaagaaactggatcagataagtaggagggagacaagtctggaagcaatcaatgtgtaggataaactgggacctgctctcagctgaggcaattaaactggaaaagaaatagattgaaaagatactacagaagaagcagtacagaagttgggggactgaaggagagggagccactgcaggtgctagctgcttaaggggataccagtccttttacagatataatagatacagcttctgaggtggagggtgataggagtgtgtagaga

SEQ ID NO: 107387 - DNA, 1021 bp, Homo sapiens
ggcatgtgttgtatggctgtggtcccagctacttgggaggctgagagttgggaggataacttgagcctgggaggtcgaggctgcagtgagctgagatcataccacttcactccagccagggtgacagagcgagaatctgtttaaagaaaaaacaaaacagaattctaatcctaataacactgactccctcttactatttccatccttggcaattttattatcagcccttttagctttcaatgactgcctctacaatgaagttctctaaatctacatatccatccctgagttttagttcagcattttccagtacttgcttgacatcttcacatgggatgcctcttgcctaactgcatgctccagttctgaactgcaatttctctacacactcctatcaccctccacctcagaagctgtatctattatatctgtaaaaggactggtatccccttaagcagctagcacctgcagtggctccctctccttcagtcccccaacttctgtactgcttcttctgtagtatcttttcaatctatttcttttccagtttaattgcctcagctgagagcaggtcccagtttatcctacacattgattgcttccagacttgtctccctcctacttatctgatccagtttcttttcctaaaatttcccctattcatctgttgtcacattaatatttctaaagtatactctgattacgtcatttcccagtttaaaaatcttcacttgtctggcatctagggatatccattatttggcctcaaaccaatgttgaacaacttttctcccagaactctctttgataagccaaatcgaagccaaacagaataaccaactttcttacacacaaaccacatttgcatgccactatgccttttctcaggctattccttctgcctaaaaagcctctcacataaatttttacatgaactactacttcaaagcaaaatcaaatgacatctcttccatgataatttctttgttttccccccggtcagaagcaactcctttctctg

SEQ ID NO: 107388 - DNA, 1195 bp, Homo sapiens
gagcatagttgctattttcctatacctttgaaaaacttagtattatcagactttttttttttccagtctgatttgcagaaaatagtatcttgttttaatttgaattttccatgataactggggtgatttcatctgtttattggccagtgtttttccccctgaaatgacctgcttatatgtcttgcccatttcactattgggctctcctttcttttctaccttttcttgatactatttttgaatgagctttacatatatagtctgtatattatttgactatatgtatgtatgtgttagacatatatttatatggcaaatattttttacagtttatttttttaactttgtagtgtcatgtctcatggggatgttgacagtttgcaggtagtcaactttatcaatttttccctttttatgtctttttgaactataagaaactctttcgtataccagtgtcattgatataggttgattcacacatttaagccctttaaaaaatctatctgcaatttattgttaatgttgtgagatgtagatgaatctttttgtccctcccatcatctcaatcctccacacagggggtggacagttgttccagccccgtctgtagtctagtgggcgttttctcttaatttgaatgcttttatcacgtacaaatgtttttgagatgtttttttgaatttacatgttatattctatcaatttattattgtatttctttggaaataagtgattgacttatagctttataatcctcttgctatcagatagagcaaattctcttatttcttttcacaattttttggctattcttgaatattcattcttccaaatgaatttagaatcgcctcttgattctgaatgttgcatttggatttttatctgaattgcatgcaactaatagattcatgtggggaaagttatcataaaatactgattatccatctgggaacattcactccatttattcaagctttttcttccatctttcaggaaatgttagtttttttcctacaaatctcacacatttttttcttgggtttattctcagatactttatagtttttgttgccatgataaaggggatttgttttcagcagttgattgttgctggtgtatggaaactatttgatttttttaaaaaattgatcatatatgtggccaccttgtaaaaccttttattagttttactagt

SEQ ID NO: 107389 - DNA, 1084 bp, Homo sapiens
attttaaaggaaataaacagctttggtttcctgtgacagtcctaatttaaaatctctctctctttttttttgaggtaaggtttcgctcttgttgcccaggctggagtgcaatggcacgatctcagctcaccgcaacctctgcctgctgggttcaaacaattctcctgcctcagcctcccgagtagctgggattacaggcatgtgacaccacacctggctaattttgtattagccgggagaccgggtttctccatgttggtcaggctgctctcaaactcctgatctcgggtgatccacccgcctcagcctcccaaagtgctgggattacaggcgtgagccaccactcccagcaaatctttttctttataagtattcttatgtttgttcagaccatgtatctctatttttggtttgaaaaatataaatagatagtaaaaatagtttaacagctatcatttcttgaatactcactctgaagcaggcaatatggttaagacctttggaagattatatcatttattcttctgaaaaaaaagttaagatttgtaaacatctccattttataaacgagaaatttgagacctggaaaggttaggtaggtaatccaatatcacacacctaatagggggctccaaacttaaacctggcatcgtcttactgcaagattaacattgtgttatatttgggtacaggttatttcactctttgcaatttagcgactttaggttgatcttttgagaaatgtaatttcagggaaatatatatcttagataagtatctattaaagtttaggctgatctttgaatgttatgaagaagagggatcatgttatttatattttggtactctcaacatgtagctcagtgtcacatatgataataaacactcaattcgttgaaatgaagtaaaggaaattcttcattgggagcttaaggaataaaatgggtgaaaaggtatggagcaatattgtaaaatccaccttttacatcaccattattaaagatattactaattttaattacaaattataacttttaaaaaatgtaattatgaatgagatgcaactgaatgctgaagaatatct

SEQ ID NO: 107390 - DNA, 1006 bp, Homo sapiens
tgtaactatgcaaacaaatgttaaaatatggaagacctaaaatctacctaatatctggtctgagtgtaatctttaaattgttattcataaatgaattcttgaatgagttttgcttaaagacaatcttgtatttaactaggagcaaatttaaaccaagcttttaatttttcatatccaagctgatgattttgccttaaaatgtctttgatcatatttttacttactaaacatctgtaaaatagttacattcattattatacacttatatatatattattattacacacttgttggcagtgtagggtggataaaagagaaatttaagacgttttccctgtgtcctaggaaggaaatggccttttcccatctcctttgaatctcttttggttatgcaggccagtctcttttatgattcttaaacttggaaattccccttctgtgatctttcatttgtgtcatgttcctaccaggtttgaagtgaagagactatattttcttctaggggcttagcagtactttgcatatactagatagctaaaaattgtggaattaagcatagatttttaaaaactagctttgataatataagtatatgccaaattataattagtggtttggtaactggtcttctgtgctgtgggcatcagctgatttattcagtttttatacactgcttcatactccgtcgttagtgtccttgaattggctgtttcttttactttgcaaccaggaacttaagaatttgagttacacatgaagaatttatttatcaacagcagggcagaatttatagaatttgttaaatctcattctttatcatgtactatgtcctctagggaatagttggctgatatttttagaaaagaattatgttattatcattaccattagaatgctttttttaaaattagaatctagattacctttatcaatttgtacacagtattattacatctgtagtggcatatttgtaaaatatttactttagtatataatgtgtatatat

SEQ ID NO: 107391 - DNA, 1101 bp, Homo sapiens
ctttatatatattatatataaagtataaagtataaattatactttatatataatatatatattatatatattattatattatatatattatatatattattatattattatatattattatattattatatatattatacatattattatatatattaattatatatattatatatattatatatatcatatattatatatattatatatatcatatattatatatattatatattatatataatatatatattattatatatattatatataatatatgatatatatattattatatatattatatataatatatgatatatatattattatatatattatatataatatgtataaagtataaagtataaattatactttatatataatatctctaatttattagttcttctgaacttagttcaactaactttgcagttggtttgtttttaacacctgaatcaaattgaaacaatactattttttctttagttttgcacacattttagaattaaaaatagtagttgtcaatttagtttgtgaaatttgtccattcaaatcttcatgtctggaaaactatatggtgggcaccggggatgatagcccctaacgttacactgtaatgatggtaattattaccaaataattaataatgtcattattttaattcagattgtcataaatgcttaacacagaacaatggaatatcaagaggattggatgatgggtgcagaattgatcaaaactttatggggtggggaaggcttctttaaaaagtgatttttccgttgaaatcttttttttttttttttttttttttttttttttttttgaggtggagtctcactcttgttgcccaggctggagtgcagtggcacgatctcagctcattgcaacctccgccttccgggttcaagcagttctcctgcttcagcctctggagtagctgggattacaggcatgcgcaaccacacccagtggttttaatagagacagggtttcactatgttggctgggctggtctcgaactcctgacctcagatgatctgcccacctcgtcctcccaaagtgattacaggtgtgagccaccacccccggcct

SEQ ID NO: 107392 - DNA, 1070 bp, Homo sapiens
catggttggagaattcaggggaggagtgtaagtccattaaaagaagcttataaagacttggtttaagatctataaacagtcagtaaactgctaaaaggggttagaaaggaaagggggagatattttatgttgtgttattttatttttttgagacacttctcactctgtgacccacactggagtgcggtaacgctatcagggctcactgcagcctcaacctgcctgcctcaactgatcctcctgcctcatactcccgagtagctgggaccacaggcatgcgccagtacgcctggctaatttttgtattttttgtacagatgaagtcttgctttgttgcctaggcgggtcttgaactcctgggcttaagcagtcctcccaccttggcctcccaagtgctggtattacaggacatgagctgcccggccagtaaatgttacatctactaaacacttttaaaagaaaggtccaaaccccacactgaaatattttattgaggcagagtattataggtgattgaaatgttcttagtacaatttcatggaagtaaagggaagatatttgaaagtatgtggtgaggagattctgaaactttccagtgtctttatgctggttagcatttgtaatcattaaggtgcaaaaaatgttatttttgaatatttttggcattgtatatgtaatttgtagttagctatgactgtggcttcatattagagattaaccccatcaagaagttaacagtctcccagtttagtatgactttcatatttgagaaaacttgtaagcttgtctgtttacaaaatgtaatctacttactgttcctatatttttcttaatgttttgggttaaaaatggtgtattaaacagctgggtttagtggtgcgcacgtgtggttccagctactcaggcgggaggattgacacttgagcctggggtgtgaaggttgcagtgagccgagattgcaccagtgcactccagtctaggtgatagagcgagaccctgtctcaaaaaaaaaaaaaaaaaaaaaaaggtgtattaagatgactgtatgttctttgtgagattactgattt

SEQ ID NO: 107393 - DNA, 1007 bp, Homo sapiens
tttggtcccctaccccaagcaatgccccagagtgagaaactgatgatgggtgagctgtgtgcctgattttgtaaaatgggagaatgaggggtttgggaaagggaaggtaagatagggtaatctactcccctggagcactctcagacaggtcagttttaggagagggtacttggaaaagttgacatggaaattgatttactacctgtgtgcctgcatatcctttggaaaaccatgtgcttccagaagtttgcttatcccagtttgaagactattgtgatagtcattggcgtattttggcatcttaattttttaataagaatttctagggggtgtgtgtgtatgtgtcccttaaacttagaacactgctgaccaaggtaaattgtttatgctgtctagggtaatgtcttaggtctttggtcttgattgcatctatgcatctgtttataaattgtcttttcctgcgcatgagtctttgcaatcctaattctctgtaagttttccagatcaggagtgacacttgaactacctgtagcttatccccctttatatcttgtgctagtcttactcacattgactagtactttggcaaagcagatctaaaatagcttaatatagggaactacttgcaattttgagtaaacaacaaacaattggccacagtaagattactttctgcttcccggcttatttattttgggtgtcagtttataaaattacaatagtacaaaagactgcagatataatttatattaattctttagttttacagaaaatgaaactagagaggttatgccaattgcctgaagtcacataggtggtaggaaaaaagtagaacctatgtcccttaactcccagtattataacctttgctacatcacaccttctgctgccttttggcagattgcattcctcacctcaatcctatttaatactatttctcttgaggactgattagcttttagtgatgcagcattattttttaaatggaaaggcatttactctctcat

SEQ ID NO: 107394 - DNA, 1049 bp, Homo sapiens
gggggaggaaggggatattaacaggtcagagtagaggtggattggcagagcgggggctggtgggaggtgggaagcttacatcatttccctgcaactgggctctggcggggctgtaaggccttactttcccctgtgtaatagtttaccagattgacagagattcatacaaggaaggaaaggtatggcaggatggatgttcacgctgtttataaatccttgctattagatgaaactgtcaataagtaactagaagcagccagtactgtctgtgcttcgctctctcccccagctgagttcctttctgctccgccccatccctgctctctgctgctcagatcagcttcctgcttctcatgaaagctgttcccctataaagctggtctgctttcactgaaagaattatattcataagtctgaggctggttttgtggaagtattgttggtttggtttcctttgggggatgaaggaggaggaaacaattttttttaaaaaaaaagtgggggcaggctgaaagagcaaaatcatcttgaattttgttgtcacatcgtgccggtgttataaccagctctgtagactgccgcactgaaaacatttctgtgagaggtatgtgcttgaaaaatggaaaggtgttggctgtggaacaaactgcccgtccagcagctgcttagatggctgtaaggtcgtaattctatctagtgttttgatatggaaagggtaatccttacttgaaacgtagtacagttaaccagcttaatggtaaaaaaggttaaatatgtgcttcgtccccacatcaggactcctgaaatgctggttcaggctgaaaacgtctagtcaaatccacagtgttattccaggctcttttggtggcggttgtctgtaaacaagatgatgatttttaatacgtctctcattatttatgaaccacatgacaaagattaatgagagactccaagtagcctagaagcttcagattcatgaggagctttttgcactgacagatggcaaaagtaaaaggaaatgggtgatgatttattgtaaactaaagtga

SEQ ID NO: 107395 - DNA, 1037 bp, Homo sapiens
agtttttagagggtgtgttacatttaagtggaaaaatctggaggagccactaaaatttagaagcatagcctaaaaccattgatgcctgacctatattaaggccagaagccttttgaacacacatgcatgtatattttcaaaggaaattaagaaatctttatacatgtttttattcagtagtcagagaaaagtattaagaacaagactataaccaatacctaaggaagcatggagaactgtatattggttactaagaagccacattgttctgttatagaaagttttagaaatgtttgaagtaggaaaatatataacattttatcatgtgcgttagatgagctactagtggtagagaccattcaagctacaaagtagtttctgcttgatttgaattattttatcatggaagatactggagaacatttgaatgttagtatgttttaaatttattttacaaaacttgggaaattaaattgtttaagttaatttacatacaaaggtgctggcactgttcttttccacaaagacagtagtgcttaaatctttgaaaccttttattcatgaatagaatacactggctgttataacccaagctattacaaattcttgagagtgcgccatttaaatttcgtttcttctcaaatatttgtaaacaggagttaatcttcatgatcatagaggataatgttgggcctaacaagttaaaaatattaaaagttctagagaagacggaatctgggaagtaaacctaatacaggcctctgaggaggactcacctctacaccacagagagacaggtggccatcctgactgtccatgtgtaccttgctttactgtgcttcactttattgcacatcacagatactgtattttttacaaattgaagatctgtggcaactctgcctcaagcaagtctatcagcaccactttgccagcagtatgccctcacttcctgtttctgtgttacaatttggtcattcttgtaacatttcaaatattttcattattatcatatctgctatggtgatctgtgagga

SEQ ID NO: 107396 - DNA, 1118 bp, Homo sapiens
gattaacaacagaaggaaatattttgcaaatgagcaggtgatttgtgtacagttcactactgtcaagcctagaaccccaatctaactctgctggtccccacttcattactctttgtatcaaaccacagtagctgatgcaatttgtcatttaggataagacttcaaagaaaactaaaaggaaacaaaagcttccatggattcttcactttctatttttttttttgggggggggatttaatattaaaccccacagcattttaacatatagcccagtcatggatttgttattcactcagtgttctgcccaaagcaataaaaagaggagtaaaataactaaagtcaacattcctaaggttactgcagagaatagttttcttaggaatttgggcatccaaatttttactttccttggagagttagatatcccttccttctcctaccaccctctcaccacccaaacacacacacagttgatggtagagtaatatcgttttgttcttaataaatcacagtatgagaacttttgcatataaagggacaggcatgtatgtcccatctcctcattttgcagatgaagaaatggaagcacaggaagtgaaggcttgctgtagacatagtgcttagccagggtacttagtacataagacatactagtatgtaagacatgcttaataattacctggatgctgagcagctttcttcagtactattttcttgtccccaagctttttggattttacctttcttgtccccaagctttgctgttggatactcattgccttaactgttgaaaatggaacagatttttcaagaatacctattactttcgaaaagctccaatgatatagtaaaagttcagataaccaggtttatttttcctgctcttgacttttaggaaaataagctctttttctcccctttaaaaattgattttaaatagttgtagttaaaaaaagaggagtttccaaagaatgaatagcctagggtcagtttgtatatgtatctaacccaaatgttcacatctttgtttgggtccagtgagaaataatgttcacaacaatgcttatcctaatatatggtaagacccacggtcagcagtgggagatttaattatgttc

SEQ ID NO: 107397 - DNA, 1192 bp, Homo sapiens
gtggataggaaaatctgaagatcctcaggcccctgatattaaatggtgtagtattttcatataacatactcatgtcctcctatattcttgaaatcattctagattacttctgatacttaatacaatgtaaatgccatgtaaatcattgttatactgtattttttattgttatcttttatttttaatatattcaggctatggttggttaaatctgtggatgtgaaacccccagatctggcagactgactgtatattaggtagattggtctgggagtggtaggaggaaagtgcaaaggccctgcagggagaatatcagaataccttggagaaactagaaaaatcttattatggctggagtttagaaatgaatgtgaagagtggcatgatgtgggtggaaaccggactttgtgggattttgtgtgctttgataaggatttctataagcacagtagtagcagtgaaaagttttaagctaaggagtgaggtgtttggatttgcattttgtaaagatcagtctgtttgccaggaggaatgcttttgaggaggggacaagtagagctacagaaatcagctaggagactggtatattggtgtttcaacaagctggctgtgttgaggatgggaagaagtggactcattgaccatgtatttaagaacttgagttaatggtgttttataatttactagtatatatgagaataagaatgagtaaaccagacaccagcttgagcatctgggtgcattggatggtaatactgacgtcctaagtccgttcaggctgttagaacaaaataccatacactgggtagcttataaacaacagaaattaatttctcatacttctggaggctcagaagtccaggatccgggcatataaggtgtctggttcatagatgggattttttttgatgagtccttacattgtagaaagagcaaggctgctctctggggcctcttttataagggcacttaatcccattcatgagtactctaccatcacgatctaatcactacctcaaaggttcaactccaaaaaccataaccttggggcctaggttttcaacctggcaattttgaaggaacacattcagaccatagcaagtgacaactactgaaacagggaaagatccaagggaagcagatttgggagctgtaggggaaaatactatgtttcaatgatcgagcttgaaat

SEQ ID NO: 107398 - DNA, 1292 bp, Homo sapiens
ggcgatatggcacttttatcatgatacagtgtttctgtctgtgatcattgttttttgctctgaagtctactttttcctattaatatagcactcctactttattttgattaatatttgcatgatataccgtttttcttcttttactttcagcctacctatgtcattatatttgaagtaagtttcttgtagatagcatatagttagatcatttttttaaccactgccagtctgacttttaattggtgcataaccccataacccctttatgtctctttacttcctccattggtaatataatcgtcttaaaagctttctttaacacatttagatccacagcagatagtattctaatttgtttcagtcatcaaacataactgtaaaattcaagagaaggaaaacttattatatttacccatatttttgtttaccattttttttttgtcctttctgatgaatatcaggttttttctttcactttttcttctccgtttattgaatgtttttagctgctcttttagggtagtcttttggggaaaaatatccatgtttttcttcattggagagtgtctttattccctttccattgctgaagggtattttcactgggtataggatcctggatcgacagtccttttcttttagcactgcagaatgtgtcattccttctgacctctgtggtttctaatgaggaatctgtcatttgaatgttattcccatataagtaaggtgtcttttttctcttattgttttcaagatttgagagggaggggagatgattaatttccagaagtttgactatgttgtgtcttggtatatatgtttctttgccacagttgggaagttttcagccattatttgagtactttttcagccctgctctctttcttctctcctttctggattacagtgacatggattttagttcttttgttactgtttcataggtccctgaggctctgtttatttttttcaatatattttctttctttggctcagattgggtaatttcttttgttttattttctcctttactgatctttttgcctctgtcccctccattctactgttgagcccatttgttaaattttttattttggttattgaggcttttagttccaaaatttccatttggttctactaatatatcttctgtttctttggggagacattttatgttttcatttgtttcaggcacggttgcttattaaaacatttttatgatggctgctataaaatctttgtcagataatctaacaacactttcatctttgttttgttgtctgttgattgta

SEQ ID NO: 107399 - DNA, 1019 bp, Homo sapiens
ttactgcactagcatatttggcgcagatcaaagggatagagctgtcatctctgggcatcatgcctgcggacatgattgatttcaggcatcatggtttccagctctcatttcttttgttttttgaaagataaagaatcttgaaatgttagaatcttagactctaaggcctcagtgccctgcacaaacatccaagaggaactcacttcatttttagacagatctgatggttagaaagaatttcctcatacggaacccccaaaactgcctgttagaaacatctgcttattgatttcagttttaacctctgaaaccaccatacaaaattatgtctgatgtctcttccttaagaccataaaaggatgtgaaaagagcacttcttcttttccagagtaacattttcatttccttcaactattgtgcccccaacagggtttcttagcccctcttcataacctctccatagtccttatgttcttaccagatgtagacagatagcaccagatagagtgggctttcatctcttcttgctagccagctacttcacagtgttggctcatattacaatatgtcacttcacatgcttttcagttaaggtaggcatcccctctctattctctacttttggacttctattcattccacttgatgctactaagtttagactataggtgatacctttcagttatataaacagataaagatgacaatgcttacttatgtctgtgggtatgcttacatgccacctcgtcttattactctaccattggatttttaacttagacagatgtctgttagtatgcattgagttctcatgctagaacttcaaaagagaaacctagagtttccctcttagtcctctcctctacctctgttatctgttgtaccattctcagctctatgtagaattagtaccatacaaaatattcagtaagtatattaaaatagctttggagagaggactggagtatggagacaaagcgcgacctaattaattaaaattattttctagcaacagtgtt

SEQ ID NO: 107400 - DNA, 1204 bp, Homo sapiens
cttcagtcaatatataattttaatatagttagaatgtaataaactggcattaactttttaaaaaataatagacctttttttagaagttttaagcttacagcaaaattgagtggaaactacagagaattcctctatactgtctacactgacattaactttttattctaaggtatttataggaatatttaagaacacaaagaaatattttacatgctcacttctacagctaacaggctgtagaaggcatctttctttgccttcagactagaaaggagaaaatgttttagagccaagaaacattctctgactgagcattgacagtaaaaacttaggccctggttttaccatacttttccaactgaacgcttctgtagaggaacacaggaagagtagggatgcattgtaatctggtctggagcttcctgctagtctgtggatgacaaactgcagatcaaacggattgatcatattccagaagggcagtgtgatacagggcaagtgtactgaccatggcagtagccctgggttctggcctacctctgcctctgtcttggttgtgtggtcgatgggttgaactgagtggcttcaaactcttatctgcctccaacattctgtaatcctgtgatttcacaggatgtgtgatagggagaaacatcaactcctacaagggcagcagtgtgaagtcatgagaaaagcaatgtgaagacctgggatgttgtcacagctctatcataaaccagctgatggccttttgtgtagtcacttaaactttctgggtcctacttggcgtcagctatggaaatgtgattggacttccctgatggactctaaggaaagtttcttggattccttctttccctcccttctttcctccttccctttactttcttctttcctttcctttatttccttccttttctttcttgagacagggtcttgctctgttacccaagtggaatgcagtggtgcaatcatggctcccggcagccttgaactcccaggctcaagccatcctcccacctcagccttccaagtaactggtactaactacaggcacaaactaccaagcctgactaattaaaaaaaaatctgtacaggcaggtctcactgtattgcctaggctggtctcgaactgctggaatcaagcaatccttccacctcagcctcccaagtagctgagactataggtgtacatcactatgcc

SEQ ID NO: 107401 - DNA, 1019 bp, Homo sapiens
tataccagtttatttacttgacgtttatttacagttatttacttcatgatatttactcatctgtttcataatatttaatgcttcttctgtatactttcatagatgtatatgaaaagtatgtgaatgtgatagtattatgagattttctttaaaaatgtttttgatatttatatgttgcctattttataataatagactttgatattatttatttcatcagtgtttggaattggcatgctgctttcctaaactgtagtaaaagcgtagacgtttgacttgaaagtattcatatgtgtcctttatagtttgcttcaaagatctggatttattcttttatctatgcccttgttttaaaaaatatggatgaatgagtagtatcttgcctgaagccacatgagaccaattaatactttattcattctttccagcttttgtttttgttaatagcacggggtggcaactgagtcatctaattctagataggattactcagatgaatcattacatatttttgatatttaatgtgaagagccagttcttccatatcatagtggcttattagaaaaaaaaacttaagctaagccataaaatgactgatattatattgatagagccataagccagaaagtgatatccagtttctacagtgtgtagcttacagatttagaagaaatatattgtcataatctgcctagagcagggaattgcttcttttagttgagtgtggatttagtttcaccactgaagcagcctaaatttgtcttacaaagaaacataaatgataacttttgaattcttagaaatgatatggtttagggatatatatttgcagtgttattaaaataaaatattccatttaatttacatgtacaccatttcactgattttgatcttataattacttcatcctttatccttaaaaaataaaaattattttctatttgtccccctcaccccaggctgctttcttgtttgttcgtttttactatcttgccctattaactttaaaatatttaaaa

SEQ ID NO: 107402 - DNA, 1582 bp, Homo sapiens
ctgaaattggattgcagtgtagactttaggtgagacatttgagagaacaagtagttttgagcaccggttctttactagtgcttagctctaagaattcattgaaatgcagaacatcagtttatctttccagtcagctgaaatgtgttgaatcattaagactgaaattacaaagttgtagaagcaaataaactaattctagccctttttaaaaatttttgtcaagtgactgttcacttaatttcatttctgttcttaatttttttatcattctgatatttttatgcagatttttttatggtatatcttaaaaatatcctagtgagtagtgtgagtaattcagtgtcccataagatagaaaaattttatccttaattatgtttatttgaattttattttacaaaaccagtttggatttctttaatattctactagggacaatataggataccagaaaaagcagtggattttggaatcagaaaatttgggggcctcgattatcattcatttgcttgtgtcttgggcaagtcacattacctctctgaccttcattttctaaactgggaaaaatacttccttatttatagctgggttgtttggaggattgtgtgtgtagatgtatctccaaagatgaaaccctgtgaagatgaattttaataggtaaagttacaagctcagaaaaaccatggcaataacttcaaaatggttgacggtatcacagatttagtaacatgagagcacctattacatgagtaaatagaaccagaaatgtggtttcaaaaccaaaacccaagttcagattgccagcttcctccctgtctgtgatttctctggctgcttaatctctccattaacttctgactcttttgctcctctcaactctttatttctgtcctctgtttatttccatgtttcctctctctgtgtttctcctgactgtctctggtctctgtgtttttcttgtcccaggcaccctcaggaagaccccaagcctctagcagtacctggtatcatctccagcatgttatagatgtggaggattcactgggatattgagaaataccagaggcgaattgttccactgtagtaagtcattcagcatttgttaagtgactactgttcacgcagcatagttggtggtccttttggggaagaagaatttgttaggacacaggacagaagaaataaatttgtaaactcttgtcagtggttcttgcaggctagacaaacatgcaaatgaaaaaaacaatgacaaattaaaaagctgacagataatcatataaacgaattgtgttttatgtgtgctgatggggcctagggttaatggagtagagaaagccaagtggtattaatcagatttcctgcatgagtttaaaattaggttttgaagtacatttggaagagagatgaggaaagagagagtggaagtgagtaatttctgtggggcttggcaagcctttttgcttccctgtgagtgaatccctgacggtggcgggtaatgaaatgaaagtgctaagtttcagtctcccaacagctaactttacttccagtcttagagaaattccagttatgaaaagaagtacag

SEQ ID NO: 107403 - DNA, 1909 bp, Homo sapiens
taagaatgctatatatacaagaatgtttgtatatacagaaaatgctatagatacaagaatatttattgtgcatggatattaatgaccctttgtaccttctgctaataaaacattagaaaactgtgtttcacagtaataacaggtataatgtcacaatactgaattaaatattagaaatggtgaattagactctctgtatgtccctatggtctgcaagctgaatatgtgcctttaaacaaaaaattttattaacttgagaaataagtttgtggctatagtcagcaccctattatgctaccttctctaccattgtctgtgtttataattctgcagtcatatctttagaatcatgatgaatctaaactatgataattttttttgctaccctacacaaaaatatttatactatgtagataaggtacaaagaataacattaacacgaataactgagaacctaccactagtttaagaatagaacattaccagtttctttgtagcccacagtgtgccccacccagattccattgcctctctttaccccctcatcacaatccttaatgttgagtttattacttctgtgtttttcttggtcgtttttctcatacttatgtaccccctacattaaattttgcctgtttttaaattttatataaataatacatactacatgttttcttctgcaacaactatttttcctgctcaacatcgtatttgactcattcctgcttgtctttgtaattcatttattgtcatatatgtataatcttttattgtatgaaaataccatagtttatttactttcttttaatggctatttagctgtttttctttctttctcttttttttccttttttttttttgagatggagcctcacgctctcgcccaggctggagtgcagtgatgccatctcggctcactgcaagctctgcctcccgggttcacgccatcctcctgcctcagtctcccaagtagttgggactacaggcacctgccactgtgcccagctaattttttgtatttttagtagagacgaggtttcaccgtgttagccaggatggtctcgatctcctgaccttgtgatccaccggcctcggcctcccaaaatgctgggcttacaagtgtgagccactgcgcctggcctctttctttttctttttcttttcttttatttttgtcattggaaataaagcagcagaggaaaagttcttgagtcctgtatatgccctctttatgtacatattacttcttcaggatatatgttcaggagttgaattgttaggtgataggatatgcccaacctgaaattccacaagataatgccacgtggatttccatagaacttgttacattttatgctcccactaacagaatgtaagtattctctctctctggctcctatagttctttaaaattactagatttttgtttaatatgttcaccatatctttaggaatgatactttgcatgaatgtgactatatccgagcagaagtttaaaaatggaaaagattttttagtttgcctgtaaacatcatcttaacaaaaaccctgatgaccctcattttttaaaagttagttttactctttgtggaagctgcttttatttttgtttcccaattgtcactcataccttttctcaaactcatttaaatctagacatcctgaaatagctggatatgtgtgctcactaaatgttttgcctccagaaaaccttatcataagaataaatgttctcttgcaataaatgaaaactgtcagctgtttctgacttctaagaaatacagtttttgcagagaatgtacatttcttttcttttccccctaattcttgttgagatagagaaagagtgacccacagaggactatttgcaagctgcagcgctttgatcaacccatcttttgttctgtat

SEQ ID NO: 107404 - DNA, 1287 bp, Homo sapiens
ccctgcacaagacattctggaaggctggtgtttgtttttaattgatgctagctttttataatttgttgttttttcctaaaaacaattttaaaaaatatatggctagttgaggaatgtctgttagttgtgttctgagatttacgtagatcagattgctgttttatccttaaacatgttaaatggatccttcctgttgagcattttaaaaaaattttttggagtattctgatttttttttttttcattgtacaacctgcgcttccttcagtgaaaatagttttgggttcacaaacaagaagcagctgtcttaaatatgttcattgactcagccgagtgtctgcagttgcccaacaaaagttatttgattttgggtagtgcaaagaaatcaaaattagcattcagattatattttggctgctgtaataagagcttctgtctgtaacttgaagttctgaaatccacatgtagtgtatttttgtcttaaaatttgtagagatttgagcctaaacaccactgagactattaagagaacttaactgatagagctcagtatttcttttgaattatttttctgatcctcagaggaaaacattgagtcttcatttcaagattgacctaacaagggctacatctcaatgttattcacaagctgagaaaaaaaagtcataattttgtgtgtattatttggtgaaattaagtgaatgctttagttcactgaagaaagtcaattcgaagaatgacatggacaaggccagaaacatacagagaaacatatctcaaaaagacttttcagaattgtaaaattgagcgctgcagaataaaacaattcacacattttattagatccgtatagcactgcaaactcattgcctccttgagagaccattgctgtaaatatgtagggagcaaaagagtgttgatgagtctctgacataactaaatattcataatggaatagcatgctacaagaataatgaccacacgaatgcagcctagttttacgattctgttttctcagatcctttttgaaaaatcttacatcttcaaagtctctacttgtgattctttatctcagacaactacagaaagatcaacatggtttagaaaagtcctaaacaccaaattttaatcgttgataaaatgaatttttgaagttttgatatccacatgtagtgtattttatttgaaacttggaggcaaattggaaaaggatatcttctgtttcataactttctaatgaggcataatcttatgtctggactgttaaattgagaattagagcagatg

SEQ ID NO: 107405 - DNA, 1024 bp, Homo sapiens
tcacttcaataactgatgagtctgttctgttgtctctcagtccccttgtcaaaaccactgatctggattgctctacagaagctgctttgcccctctcttctcatgatcatggaggagctcagttttaataccgtcgtttgtgtctgatacacttaggcagcagttccctcatggaccttttagatcaaaaatgaaactatagtaccttaagaagcttttaaaggagacattctgttactatttggggaagaataaaaaggcagtatgatatagcggaaagagttctgattttgtggtcaagagacccagagcttaactctgccactaattggtttggtgaacttgagctaacctttaactcctgtgggtctttttattgtcatctgtgaattgggggacaagatgatctccaggggctggatttgcagtccctatcaagtctatattgaagggtttcatttttagaagagtagctctttaaactatcctataaattaaatatgacaccagaaatagcagtgacaaatggagaattttcctagggaagccagttatgataggctacagaaaactttttaaaataaaaactttttattatcacacagtaggaatgccctccaaataaattgataatttctgttttacaatgtgggaatctgaaaatatctagaaaattagaagcttttaaaaaaaattatagaatctgcttccaaagatcaaaagaaaacaaaacaatgagtctataactaaggtaatttagatagatgtggatttcatctgattaagtttaattataaattgtatctgaattatcatagactaatactataaataaacatttggttggatatcagtcttccattttgccttatgtatttatgctacattaattggtttcattaataccatttaattgatcataacttgtgttactgccaccctgatggtaaaaggagcctttacagctgtgtacatgtagggacatggtaccactttcacagctttgctggaaacactatactga

SEQ ID NO: 107406 - DNA, 1326 bp, Homo sapiens
gtattttaagttaaagaaaagctagaaaatagaattaccaaaaagaagaaaacctcatccataattttatcacagagaaataatgtcgtaaacaatttagcattcattctttcaggcttttttggtttatgtgtatataagcacatatttattatgtatttttttaaaggaatcaggctcttatattctatgcaaccttttttcccacttatcttcagtgtctttttatgccaataaatgcattttcatggaattcttagtcactataaattgttacattttaaccaagctcctgctgtttatattttgccccccacccccattttttctctacccacagatttttgacatgcagagatatttctttacctaagggtatttagtgaggagagcactggattaaagcagcataggtcaacctagcacaacatctggttaatagtaggttctcaataatattgaatgaattttttactttttttggttacatgagtttaatggttagaagttattatgggcctagcatggtggctcaagcctataatcccagcactttgggaggcaagccgaagcaggaggattgtttgagcccaggagtttgagataagcctaggcaacacagtgagacctcgcttctgcaaaaatttgaaacattagctgggtgtggtggtgcacgcctgtagtctcagctactctagagactgaggtgggaagatcacttgagcccagaaggtcaagctacagcagtgagctgtatttgcactactgcacttcagcctcggcaagaagggcaagaccgtttctcaagaagaaaaaaaaagttgttaattgtagtttatttcaagttgacttgaatgtttatagtccatgattaattatgatgataatgatagcaaatcttcatttgcacttactgcaaagcactattccaagcagtgtatgtgtatataaaaatggcttaatcctcacaatgaaatagatactgttattatccttccttttacaaatgaggatgccaaggcacagggaggttaggtttcttgcccaagattacacagtttgcagctaataatttatagatgcgggtttacaaattcaggaaaaaagagagttcacagttaacatttgtgtcaaatcgcatgagatatgaagcatagacaaagtgaaattaagcaggatggtctaggatttctttcaaagtcatatttaagggcttcattaaaaaaaaaaaaagccaaagatttgtgtagttcttttgaaatggcgtctgtgccattttcttattgaatataagatcgcaagttgtaaagtttgtagtctagataa

SEQ ID NO: 107407 - DNA, 2821 bp, Homo sapiens
taaaattccttcatgaagactcattaaaaattactcttccccaaagccatattttaaaatgagttttaatttattatgttacttaacccttgttgtctcattgggaaagcccagcctatgacaacctggaaggactcagaactggcattttaaaacagaaagtctatcagcaatgaacagcttcagtaagaaagcagggtctgagtccctgggatcagggaaggctgggaggaacaagtgttcagtgtgaatgtaattcaggatttcagatacttcctgctgagcccataagtgttactgtggccagaaggctgtcagactttgacaagtgagccctatttttggatgatggagaagcaagccaaaccttccttactggccacatggggctttttggttcttaggaatgtctggaaaagctcctcacagaccaaagtcgaaggatggcataaatgaacacatctggcttccctgttttacctagagctactcctgagttggacttctttatcaccgcttacgagtacctctttacaaagccaatattccaaaatccaaataggatttcagaagccccatatttctaagaggaggccaaggggtgtaagtggtagtagacatgcagaaagtaagggtgaagtggtttccaagtaaaatgaggttgttgattgacttgaagaggtgacagagccaaatttatgaaagcattagggtttcccatacctgacagtatggcttgttggaaaaaggagcagaaagaggctgagttttctgtcagaaaccactgaaaccactatttatgtaatatttatgggagaccatgtgtgattcaattgaattgctctgtctcgctatagcagtttttaaaagcttcttcgattgttgaccggtccgttaagacatgctgcccatgtagataaggaagacactcaagtttcaacatccacactaagtgatcatgaagttcttatggtttaaaaaagttcagatttacaattccatgtaacctttcattaattaaacagattggatctttgttactcttctgaaagttttagaattgcacttcatgttttagaaatgactcatcagctttgcattgctctgctgactggaaagcctaaacttgcagaagtagtgtttttcactggattttggagtgtgcctctttacgtgtgttgtaccatggtggcccagcatagagggtatagcgattgactcccttcctgtaatgcttttcaaaatgacacctgaatggtggaagccctgatggtagtgctgataaataatgctttagaaacctgttttaacaaaattaagccaatttggatagcttataagtaatcaacacaaatagacacagaaatattaatggaaggtttatgatatcaggattgttagcaaccagaggtcacgtagaaaatatttacgtccaccaaggatgccttaagcatatagtagatgagtcttgtatgttcctggaaatagatggggaaaggtttagttaataatggtgttatgaaacgtcttttttaaggagtcttaaattatttttaaaattcaaatttatatagtgcagtgattttcaactagggatcaatttagagcagtgattttcaactagggatcccacaaccctacaaggagtgtttagaaattcgtgggacattatttggggaaatgccacagtctgggagtgggtgtaggggtcaaagggcagggaagagcctagatatatgttaactcagcaggaagtgaaacagccttgccaagtaaggaactatctcactcaagatgccaaaagcttcctcactgagaaatgctgattttagagtaccggatattactgtaagttaagcctaaccagagaagtaattggaagtgtccgccctttggactctgaagatgcatatcatatactgagagaataaagtagaatttcctgtagaaattctggagatttccacacttactattttattaaggtgaactaccttgtggatagttttactcagttgcttaactgagggtaaattttatttctccctgtcagtaaagctagcaacaggggggctataaatataaatttccagaatcttacacctgctgaccataaaagtcagtctagatcactggggaagctgcaccaaaagcatgttttcagcagctactgataaagctaacatgaaataaaatcacacacattcaacgtgcttcataacagtgcagtgtaatgaaatccagaggccaattgatagtaaaaatcaggtgttgtaaaagtgtacttcacataaaactaatttgattactctttttaatagcagatgtagaataaattcatgaagatgttaggaacatgggtagggtgagtgaggttcgaggaaggaaagacgacttaagttgttgggaacttttcttatggaaagaacatttaatagtttttccagtgttattgaggttatggatgattcactatgatttcttaagctgtctctgacattttccccaagttatttctaagacagttcactcgttcattcatcactaagaatttgttctttgtagtaggtatgcttctattaagtgtggaagacaaacctgcaaacaataaaacccctgtcgaaggtgataatgtcacagtagctgtgtagataaaatactgtgggaccgaagggtctactccagcaaaccaactccagcttctgatcataatggggcaatcacttaagatacctagaaatgagataaaacagtatttctgctctcccactagattccataacattggttaataagctaggatgactctggtataaacaaa

SEQ ID NO: 107408 - DNA, 1022 bp, Homo sapiens
aagcagcagtggcggagcaaaggcagccacttctagcctggcaactaaaagctgaaaactcacatgactgaatttcagggaacagttttcccatagttgagagtggggtgcctaactgaatcatcaatgtcagctatgaacagtaagaaaaatgcctttgtaagatcaaagatagatactgtatttggaatttgttcaggaagagtaactttgcaattgcaaatatacttttaactgcagtatttgttatctgtcttcgaaggagagctgcatgttgataggccacttcctgcctttcatcttttttttctgattgtaggcaaagtgggtgcggggaagcagcaccgtagaagtgccagtccttttttaagagctgttttaaaacatggacaactgaattacatattttagaaagtagagttggttctgaagaaatgcaattttgtggtaattttgtggtagggtcactatgaatggcttccaagagacttctgccaaataatagcagaggtcaacagtataatctatagagaaactagagaacagaaaataagaatgtattagttttaggagccagggtgttatatagactgacaggaggctgccaggatcaagaaacaagttttaagagaataggaagcccatctgataggagacagtatccatgagagtagacactgatttgtcagtttgacaggttcttgttcgtggaatcagcataaagttaccttgatccactttaacttgagggtgtttaatcaggtgtttggtataacgaatgttgagggtagtaatttggggccacattaggctatttgcaaagtcacacttgaatagccttaaccaagatgatttttctaaatgaaattgaaggaagcaaaggggaggaaactcatcaaaggttgctgaaaattacatgtagaagatacgctattccctttccttctcagccttcatttttcttcatcagctctcgccagtgatgcatctgtgagaggataatgcaggctatcctgccatga

SEQ ID NO: 107409 - DNA, 1037 bp, Homo sapiens
cccttgtctttcccactttttttcatctttttaaaatgattctctcttgctttctcattacttctgaatcataatcaggaacatcatttcccttcactgttttgccttctttcaataatttgaacatagatccataaggaattaagaaagaattagataactataaattattaaagtgcacagtttatactttgaggtatttcatagttattagatcaattacagtacatttttcttgatttttcatctgaggtataccatttccaattcacttactgttttattcatcttctgtacctgctaaaaatgtacctactttgttccaggccctgtactaggggttgccagccttatttctccccaagcctgtgcatctggtggttctcagacatcacatgccaccttggtctgtgtgtctgagctgtgcacagttttcaattccctttgtttcccacttagaaaagaatatctgaattcaggaaagtgtaagaaattgtagttaatcttgaagctatcctggagaatataaatagtgaatcatcatcacaatttggcacaggagtttgtgtcattgtttgtgacaatcctcacaactaactgatcttaatgatctgatgtgccaggatgtttctgagtatagtcttggaccattaagaaaaaggcctagcaatggaggtatgatgtatctaaataattataattgaagggaaaatgtggtaagtgccattagcaatgtagagtctttctaatgtatttctgggtgagaaagattaatttctggagtatcagaaaagacattttctccaaagtggtatgtgagctacgtgggaagaattagaaatgagggaggactgaatgcgattattttgaacccagaaagaagccacatataaccctcattaatttgattcttgagaccctgtttttctctttgaatattgaaattacatgtatatacacaaaggtgcacacatatccacacatatatatacattcacacatagttaaataataatttaattcaaaattttgggggc

SEQ ID NO: 107410 - DNA, 1070 bp, Homo sapiens
cccaataataattcctaacatatttccaaattagatggctatgacctcaagattttttctgtactctttgtgtttgaagataattaatggttaattgattgcatttgaaatacttaacggcaaaagactttttttttttgagacggagtcttgctctgtcaccaggctggagtgtagtggtgtgatcttggcttactgcaacctccgcctcctgggttcaagcaattctcctgcctcagtctcccaagtagctgggactacaggcacgcgccaccatgcccagctaatttttgtatttttagtagagacagggcttcaccatgttcaccaggatcgtctcaatctcttgacctcatgatcctcccaccttggcctcccaaagtgctgggattacaggcatgagccacccgcctggccaagactttttaaaaataccagttggattaagcaggtgattagtcctaaagtatctgcttgtaacaattgcccaataaacattgtaataaaagaacatggttgccttaaagttgtggttctcagagagtgatcctcaaaccagtaatatcagcatcacctgggaacttgttagagatacaaattctcaggacccactccatacctcagaattggaaactctgggaatgggatttagaacctgtgttttaacagaacctccagggattccaatgcatactcaagtttaagaattaaccactctgctgcataatgcagactaatggttacaagttgagtatccctaatccaaaaattcgaaacacttctggtcccaagcattttagataagggatacttaacctgcaatttgtccttcttgattttaattttgaaaccagaaattaaggaaatgggtttagtaaacattgtggacttctgtttatagttacattgtttctaagaaacattatagaatcattttttccttagaaaatattttacaatcataatatgttctgagattctgtaatcagagatgggctttaagaaagttaacctggcagccatgtgcaagaagtattgtaaagaagatgaaaaacgggaagactaggcgt

SEQ ID NO: 107411 - DNA, 1044 bp, Homo sapiens
aaaaggcacttttcaaagcagagaaagacaaaggtactattcatatattttatgtggatgttgttaatcttgatgcccattaaccatagaatgggtttattcattcattccacaattaattaagtactaatattatatcagacattgagctaggcactatggttgtaaaggtgaataagagcttttgtcctcaaagagctcactgtttagtgagagagaaaaaaatgtaagcaattataacacaatgtaatatatgctgtaatagagacatgcacaggttgctatagaaactaagcagaaggatacatcataagttagttaccaaccatgaacagtggttgttgattttttaaaattatatttttttcaatgtgtaagttgtttaaatggagctaagaaaaaaatacaatttgcaaaccaagactaactgttaaatcaaaattatccaaaatatgttaaagatctggctttgtttttggtggtaataggttcaacttcttggggccgatggcctagagcaagatgttggtgaaactgaagatgatgaatcaccagagcagcgagcccggagaccaatgaatgcatttcttttattttgcaaacgccatcgctctcttgtacgtcaggaacaccccaggcttgataaccgaggtgctaccaagatactagctgattggtgggctgttcttgatccaaaggaaaagcagaaatacacagacatggccaaggaggtaggttacaatgacaaggtattctgatagctaaaagcaaccagtcctgaaactcccagtcaacaaatatgaagcacctgttgaaggtctagcaatgagaaggtgaatcataaatgagatgttaagtaaaaacataaccgctttctttgtatgacttgttcctgttcctgtgttccaagtccatgtagaaatgctggtggaggtgccaagaacaatatattaacaaaaagttttttctcattgtctataccccactgattgatataagggattgatttattgtgaaggtttattatgaatggtttacagtgaa

SEQ ID NO: 107412 - DNA, 1032 bp, Homo sapiens
aaatttgcagaaataaattggaagccatgaggtgaattttcatttaatgggagaattttgaaaatcagtatttttaacaaaaatgttgttatctgagagagtcttccattgaaatcttaggagcaatagcttttctgatgttttcggaggataagtgagcttctcctcccaccatcagtatgaacagtctggccttggatatctggggcctgtctcttaggccttttcagtcctgtaatgagggattttgcctacatgattgaacggcatgctaataagttcactcagctgttcgcttcagaggagtatacagagtcttcccccatttgtcccttacccagccttctcctaataatctcatcacaacaaatgattaagcctttctactattgtcttttagctaaatcagagcgagtgattgatgaagtgccaacttccgagaacagatagacatcctcataccctgaggctcttcccacctccaccctcccttgatgctcatatactgcttgtgttaacttgtgtttttacatgaattgatggcatctctatctaaactttaaactccttaaggacaaagactgtgtgttattctgttctctatctctcacgttcttaactcttccactcaatttatacttgatggaactaatgaacgtggttttgaacatctacattgagtttaagaatctgcaagaataatattgtgatacagttacagagtgttgaccctcatagtaaattctgttattgttttccataaaaccccacgtattcccggcctttctcttgctctctgttactccactcatataggtagttagcccttttgcagatccattgtgaaagcatttttcctgcccgagccaggggaagccatggtccagctttatggaccatgtgtaaaaagaaataatgtatttatgtagtaaactgtggactgtaagcaatatgaagacagggactctatctaattcatactcttctctctccccaatgtctggcaagtttctgtcatctagtcagtgctca

SEQ ID NO: 107413 - DNA, 1052 bp, Homo sapiens
cacattggtatataaattatcacgtaatcatgttcctattttactttgtaatttgaactaacacatttttatctttagaaagctatcatccaatcctcctgatctctaggatgacagctgcaaaagtatttctctttgaaagaaccaaactaaacttttactttctactaaattcatttccctctcttgatttttaagtagatttaagtatctatttcaacagccatagtatttcttaaacttagcatttagttgaagttggagtctcaaaacaataccaaagagctttgtttcatcaaattagctactgtttgtctgtgtattctctgtgtatgtcttcctatgtggctgccttccaatgttgagctattttttgaccccctgatcttttggtaacatagtttttcctctaataacctcttcccccaacccctgccccttttttttactacctcagaactttttttgcaattttttttttaaaactgtcgataacatatagtcaaagttgctttatgagttcctaagacaggttgtatacaaagatgtacttaaggacatatcttcaacccgaaaaagaaaagaaacaactgaatttctttgtgcaacattttgactgatcctcattttcaattgtagattcctgaaattaaatatacgttgaggaccttatatgtactaggagagatgccgagttaggcatttttacatatgttctttcattacacttctgaattttaattcaagatagacttacaggacacaggtgccttttctttgataacttctttgtttttatttattttctatttgttcatttaattttttagagacagggtcccactctgtcatccaggcctggggtgcagtgttgcgatcttagctcactgtagcctcaaactcctgacattaagagatcctcctgccttggcctcccaaagtgctgggattacaggcatgagccactgttcccaattctgctttctttatttagatacaacctgggttatagatctaccactttgctgtttttattttctctgtttatattg

SEQ ID NO: 107414 - DNA, 1037 bp, Homo sapiens
tcaaaaacacatcagttaatataaatttatttttaaaactgtaaagaaagattatttgaataaaacctaccagattttacaggcctgatttgaaaacttctctctgttctctagttctctgatagcctattattttaaaactagtcctgatttcacatggcagaattaataatttgagaataacaatctaaaatttctcagaagacaaacagaaacattcttttgtttaaaaaatcttatctaaactccctaagcagtaaggaaagaaacattgcattaggagataaattaatgttacaaacagcaatggtattgaagaaagtgttgttggaatggtgagacaagagtggtattcaagaggctcacaaagtatgagcactaagcacatatatgccaggttactgttgcataaagagtttttaaaagtttttataaaaagttatatgtggttctgttggatttctgattgctagtctttatgagtattctttttgactctgtggattgtatgtactttatgcttataagttggtgatttgtttttgacttatttagatcctactcaaatgggaggcctgagtatgctgctgttagctggagaacatgctcttggcacaccagaggtaagccagtccttttccgtctccactctgctcatactgtgggttgggaacacagttatagtctgtttacgttgttcattctgcattttcactgtttacagctcatgaacaaactttataatctttctctttaagatctttctgtgtgtcttgtgtgttgagtgtaaaaaaaaagtggtgtaaataaggccatgaggatgtaaacacaggtgttgttttctgaacctacaagtaaggttgtagtaatgcaatatatagatcactggtgtttgcatgactctgtcatggttatgtcagttgggtgctgtaattcatttattcgaaacattctctgcttgggtgatgttcacatgctagtgaaaagatgatagctaaaaatttgcagctgtcagtctctctggtacctgaataatt

SEQ ID NO: 107415 - DNA, 1021 bp, Homo sapiens
agttattggactgctttggctaaacatttttaggtatgattttgacgggcaggtagtggcagttaaccatgcacagtctgcatttgtagaattcccctatttcccagagacatttaacagaggccaattgaattaacctacaggtcatgttattttaccacactcaggtttttgagatggaaatttttcaatccccaaccagaattgttgtttagggccaaatagcaatgactcaattttattttgggtcatattttttactttttgttttttagttgtgattatgtcatacatattatacttgaaggctattcaaatagtggttttgtagacatataattagataataacctatttacattataaaaggtttttattttttatagtttacatttgggatccacaattgttgactatatattcaatttaacagaattattttgattctgttcacttcattgtagcaagaaatgtataaatgtgtaaaaaatgcactggtagttactttgtgctaatcttcagctggaaaaacatacatgttactttgtgcctttgcatattcattattcatcatgtttgtagtttctaacataatagcattgtcaggcatcatttcactttctaacacattgctgctacctcttaacaaatcaaactctcacttaggtgtagagtatcccaagcgtgttccaaaggtgaatgttggactaataatatgcacttgacctttcaacatgtctgactcaatatgattcccaagaatacattgaattgtgaaagccagcatcatctttcttaactatttaaattatcatagtgtttcattcgcaacatctatttagtgttctttttaaccttcaagtacaaatgtaaacaaatcaacgtctgtagaactcatggatgctagtcaaagaaaagcatggtttctttttcccctttttgcttaaagtttgccttttgggctcttttcaatgagaagttctcctactccttcttaagaaggcagagttttgacacatgc

SEQ ID NO: 107416 - DNA, 1050 bp, Homo sapiens
tcaaatctcaaggctacagtgaagattaattaaataaaagctgtaaggcacttttaactctcctgcaaataattcttgtaggtatatattattgccattagttattctaggcatttcatattcaacttgcaagtttaaattatatcagacatttctcccacaggctgatacgctttaccagcaacatgcatacatacacacagagagagagagagagagagagagagagttcttgtctattgaaaacttagcagaaattaccgttgtaatttactatctttatcatcaggtgctcaagaaggagacaattttttaatatctgggaaaaatcagtataggaagtccaaagtcagcagagtagctgagttagtgtcagattagtggagaagatgctaatagatgatggcacacctccataaaaggactgtaaaggtcgtgttctctgagaattgaacagtgctgaactgtgtgccatcttttcttatatttaattacatgacaagtgtttattgaatgccttgtatgtgtaaggcatgtcagggaacaaaccagacagcctgaagctgatattgtcttaaggttcaagtttttagatatagcaaattcttcacatgatacttctagcttaaaaggaaatcacattgattttcgtttgttcaccatgatctgcctattttaaaatgtttacagcttatgcatcaagatttcttaaaatccaaaaatataggttaaatattgcttattcaaaacgcttgggaccagaagtacttcagagttccagttttttttttttttttttttttttttttttaactatttgtatgatccttaccttttgggcatcccaaatccaaaaaattgagatctgaaatgctctagtgagcatttccctttagcattatgttggcactcagaaggtttcagatttttttgagcatttcagatttttggattggggatactgaacctgtaataaatatattttgccttgtaagtttgtaatatcaatctgtcacctcctccaggaagtccttcatgatttcttgagcc

SEQ ID NO: 107417 - DNA, 1052 bp, Homo sapiens
gcaagcaactaaggcttaggcacatttcctttggtcatcattttattccctaacacatactagatacaagtagaatacaagcttcttgaaagtagcagtctttgtgtctggcatgtcataggtgcctattaaatatttgttgaatgagtgagtaatcaataaatgtttgaattagcaagggtaggaacgtatggctcagatactaccagtgcaatactccttttgttgaccgtgtgttcatgccggcagtgcatggttgtggtcctgtgttttgcaaagtaaggacaggctcatgataacaacctagctttccacactactcacaatgcatgtaactggcttgatcttgttttatatcaggaggccagttcacttttttatgtattcaatttcactatgtgaattgctcctgtgaaaaaaactgcattattgtaattcttaattatactaatcactccccttccatggttattgagaattataactaaatcaaagagaggattgaatttggggaaatcaaatgaatatgtacttaacaaaaatcccgttagctatttttgtttttgggcatatagcaacacctagtggctttatcgattatttcagagactatttctagaaacagcttcttgggtttttttctcccttattaaataaccactacttatttaatattttttctttcctcttaattaacgaacaaatatctttgactattttgtatttagaaagtaaactggctctagcataggaatagatattacagaattgatgtttatccataaaaagtgtggcccacctaataaaaataagtgaagtactttaaatgcagacatcacaatgatatggcacaatattttaaacatttcacaacatctagaaccttctgaataatgacattactcaaatgggagccttttgtgggaagtattctctcccttttatatagatagaatttcttatttctttatcaaattcatgtgtagatcagtgtatccacagatatatacattttatgggttgccttacttatcaagtactcaataatgaat

SEQ ID NO: 107418 - DNA, 1052 bp, Homo sapiens
atagggtaatttacctcctcataaatggtcactatttcttgtgaattgtgggatctgaaataagcatgtatgtcatatagactttatgcagtggagcaactctaaataataatacgtttaattccaaatatattttatagatttctgtcttatgcacacctgttttattaaagttttatgaagacattttataattttcaaaaagtcctaagcttgaatgtaagtaaaattttgattatttaccaaataatctaggagccaaaaatatattttttgataaagcagagaagttgatttttttaaaatacctctaaattataaagatatattttgttctggtattcctaccaataaaggagttctcaattttttgtggctacgaatttcaggatttgttggcctttttaattcattttgtgtctccttggtgggacatttggcacagcatatcaaatagtgacaataagagagtcaggctttgcagccaaaccacaggtggcaaattaataaaagcttctgcaccttcactaatgtgcttatctctgggagaaggtgaccattactctttaaaatccaaaggtgacaattaaaatttcaaatgtttgctcctgcccagtggcctgtgacattgttagagaaacacgtcctcaatgtcttaagagggtcagtgagaaactgtttttaggagcataatctgggtaactagtagctctttccataggatttatccatcaaatataatcacatgcagctattaaaattacactagagaagacttagtgatgcagaaaaattaatattaaagtttttttaaaaaagaacattctgtaactgtggtagaatattctatttttgttaaaaaattacacaactggaagaatatataagagtattaacagtacttatctttgggaggtaacattgtaggtgatttttcttctttgttttagtggtttttttttttttttttttttttttcagatttttaacagtgaacttggattattttgtaatcagaaaacaagttattaaaaagtatttgtaactttcat

SEQ ID NO: 107419 - DNA, 1018 bp, Homo sapiens
cacccccaatttcagcctgtctcccattccaaggtgagactcatatttcatccagagtcagcttggcccatccaaagtgccatctactctgtgtttccaggctccgatccattaagttggtcagaatgaatttcctatctgtgtcttctgttgtttacaggtagagtgacacatcagttactttttaggtctggtttaccaaagactaatgaccagatataatgtcagaagggaactgttgtctttaattatttaacaggcctaaaagccatgaccaatccacatattctctgatctgctctgtggctcactcttacacctagagtatatctttgcattgaaaaattatatttaccttgaagacacagctaatctgggtgatttagatagatttggactttaaaacttcccttagaagatatttgctttgcctatataaatataactataatctcaccaaaattaaaatattgtcaccattggatataagcaataggtacaaatttaatgcatttattttcatgagggaatgctcagtttgttacactatattacagttgattaaaaacaccatatacttacactgtaactaatcagtggatgtattttgtgttttattggaagcactaatatttctttttagataagaaaggtaaggtaaagaaggccttatttgttctttgactcatttattcattcaacaattatcagtcattttctcccaagctacaatatttacaataccgtcataattgcaagacttccaccattacctaatttgattctcatctttaccacctgtttgctcacccacctcagacagccataaaattagcaatttaacatccagggtgatcatttttcttagcactttagctgtacctcatgtactgttgcacccaccctgtagctagactttatggatgaatactgtttatccaaacattacataatagtcaagagagactacagtggaattaacttattggcaagccctatccaatttgaggaaaataag

SEQ ID NO: 107420 - DNA, 1045 bp, Homo sapiens
gtttgcaaaatattattaagtttgctaagatgaacctgtgcaaatgcaaactgtcagcataccactaaaaactagcgccggtaaggtaaatgttcctgaagtgacctattaaaagccaccagagtgacagtggctgaaaaatcataaaatttaccttgagaatgcctttctagccttttttccagaactagtataatttctctccccccacatgggatagttattcacgaagggctatagaagttgagaaaggaaaataaaaattatttcaaaattgatataaaaatagtacattctcccataagagtaaaacatgcagggaatattaaaggtttcagtgattcagaattaagataacattttgctttgagcttatttctggttatgtttaataaagagaagttcatagtcttcatagccacttgctgaggtctaaaggttagcttacctgaattcctgaaaaagacagctctgttgtgaatccttaatatttcatgtcttccctgtgaatgatccgaagggctgtgtgctcttgtcatgttcactttttttaattgcagtgtctgcctctctccaccctttctttaatttcttcccagacttactaatcataacataattctcacaggaagattggtgatgcattgaaaatactaagagaaaaatgaggtaaaaaagcatctggtatttaattcaatgtattatccacctaaaaatgaattttacagatggtaatgatctctgacaacttgccatttaataaaatgatggtttttaaaaacagatcagtttcctactcatgtgcttgattttgcattgactcagcaacccccaatactctttcccttctaagttgctaatacaaagtagataaaataaattatgactaagacttccttgctgcccttgaccaaatcggcatcatcaatctctttataagttcctcaaaggcagacagacctgaccttattgatttttgtatcattagtgtcctccatgggggctggcattttgggagccttgcagttaagtgtgtataaatgaa

SEQ ID NO: 107421 - DNA, 1029 bp, Homo sapiens
gccagtagcaagataataattagtgatgttcccagtagaaaggatcatatgtgccatcctcatggaattatgatcattgaggatcccgcagcattaaacaagccagaaaagctaaaaaagaaaaagaagaaaagcaaaatggatcgacatggaaatgataaatccacacccaagaagacttgcaaaaagaggcagtcttcggaatctgacattgagagcgtcatatataccattgaagccgtcgcaaaaggagactggggcatagagaaacttggagatacccctcgcaagaaggtccgcacatcctcaagtggcaagggaagcattttggatgccaagccaccaaagaaaaaagtgaaatcaagagagaagaaaatgtcaaaggagaaatcctcagacaccaccaaagagtcaagacctccagatttcattagtatttctgctagcaagaacatttctggtgagacaccagagggtataaaagcagaaccattgacccctatggaagatgcactaccacccagcctatcaggacaggccaagcctgaggacagtgactgtcacagaaaaatagaaacttgtggttccaggaaatccgagaggtcttgcaaaggtgctctttataaaaccctggtgtctgagggcatgctcacctctctgcgagctaatgttgacagaggtaagtaacttctacaaacctgaaaagaattcaaaaaccaaacagaatttcacctttagacctattgaaaacaactgccataaaaaacaatatggtatcaaaataataccttacatttgtatatttctttatggtttatagatcataattatttgttactttacttacatgttttctagcaccattaagggaagtgtattcattttgtaggtagttctcaggatgtaattaaagtaattttaatctcttctttccccccactggtatgggctggctgtttgttttgaaagattattattaaatattcagagctttaggtttggttttgaaaactggtggaatttcgagaa

SEQ ID NO: 107422 - DNA, 1067 bp, Homo sapiens
gcacctttgcaggtataaaacgtatacctgatacaattttgagttccttaacaatgcatgcatgtccagcccaatgaagtggctcctccctctgaatgaatcttaacttgattgtgactgattgactcagagaacttattcaagtcagtaaatgcacatgccctgcaggtgggagcacattgctataaattattgcataggaatatattttttcattgggtactcattacttacaagtccaatacagaaatggtagcctagtcttagaagaaaacccttgctctttatatatatacacatatatatagtttaaaaacatgaaactatagaacctgggcaaaagccaccaccaccagagttacgcctgacatttgtttctcacaacaggtgtaaagagcaggttcacttaattcaccttactcactgaccttgagaaagtatcgtgctaggctcatgctgaagtggctcctgtgtcactgcaacttctcacccccaaaacattcatttttcagcaaaccttgaacaagaatgttctggaaaggttattgtcagtgtccttctggcacccctcctaatctctcggcttgtcatttggcccttttgttttctgcccagctgtgaagttgaggtgcaaaggagattgataccttcagaatacgggtcatctgcccaaaaacttaagtggagacctaagccagtttgcataccagcaatgagtgatttttttttcataaggaagctgaagctgatgcagatattccctcaagaaatttggtagggaaagagatgggacggaagcttgagatatcatagtagagtgaagaacagttgtgaatatttgttttctgaatgattccttctaaaagcccttctgcattttactttctaccattcttcctcctccatggatacttctacattaatataataattgactaaggaaaagatgtaatagtaaatttccttatatttgctatttattacagattttgactttattttctgtagacaaaatacccaacatatacactatgctgattggcagaaatcaaatttttcacttcttg

SEQ ID NO: 107423 - DNA, 1089 bp, Homo sapiens
tatgctaagtcaaaaatcacattatatgatactatttatatgaaatttccagaataggcaaacctatagagacagaaaggagattagaggttgcttagggagagggggaatacaggtataggagtagtagtattaaaaaggtttggaatttatttttgaggtgatgaaatgttcaaaaattggtgccggttgcaaatatctgaatataaacacaagttttatactttaaatgggtgaattgtatggtatgttaattatatttcaacaaagctgtttttaaaaatcagttaaaacaataggtttgtgagggaacgggagatcaagtgatgggcatggggttggcttgcagttttatatagagtggtctgaagatagttaagtaaagccttgaaggaggtgaggaagttagccgtgcggacatcttggagaagaacattttctaggccatcttggagaagaacattttctaggcaaggtaatggctggttcagagatcctaaagtcaggaacactgagactacatgtgcagaggactgccaggaggcccatgcagctagagagactcaaaggaaaggagtggcaggatatgaggttatggaggtaatggagctctggatctcttaagtcctcgtaagatagtataagattgctgacttttcatatacacccaatataagaggtctggctggggtgatgcatttttgagtcttcaacctatagctggtatttattttattttattttatttcattttattttaaagccctgacagtagaggtaatcaccagatgagtgagaatagagacaaggacaagggccaagcccagagctttccaaaattaagaggtcagggaaaataataagcaaaggagagagagggaaatatcagtgatggagaagagaaaagaagagaaggtggtatcctagaagcccaatgaaggaggcattcaaggcagagggtgtggctctagtggtcagaagctacaggaacagcctggtgcaataaggacccacaattggccttcacagcatgggggtactggatgaccccttgaagagcagttttccatgagtggcagggcagaaacc

SEQ ID NO: 107424 - DNA, 1049 bp, Homo sapiens
cctgccactaatcagcatttttcagtatgacaaattgtttaacctcactaggattactctccacattggtattaagtacatatataatttgtgtgtttagagattgggtgaatgatgagatgtagtagtacacagactgtaaattctgtttcccctctaacacttgataatgattttattgctctgatatcttgagtaagtattgtgttactagaagtactatattctgtagccctaattttctgcttttgggggcagaaaagtaaatcacttttgagtcttacaggcagtcccaggctttagcagaaatatagttataattggtgatatttaattatatttattattaatgtatatgaaacaacttttggagaatatgcactgaaaaatgcatgtccattgtttagtgtagagtacaaactcattttatgtggccaggaaaaacaggaatcaatttgagcatcagaaattactagtaatttaaagtaaccatttttggtttttcattttcttactatctccaacatttacttgtttgtgtagtgactatgtgctttgtgagttttctaggcctttaatcctctctctcgtctatgactatatcactgcttattgaaacttcaccttggagagggtataaatatatgacagaaaatatagcaataatatagaataatttaaacatgtctaaaattaaaatcctgctcaaatgttagacaggcattgtttgtagctgatgtctttaatagaaatattgagtcaactgatgctatataactgttcagctattctgatttcttctaaagtagatgacttcaagttcactgtgttttctttatactgccctgtgtacaggcaccttgcaatctttcttttttttcaaaatatcagaaatatttagatgcttagtaatatgtttaaatgctaagtttataatgtgtcttaaaccctgggcttttacaattcaaaattgttaaaccactttttgaaatttcggtatatatgtattaaaaaaaattgtccacaggctagaattaaaggtaggattt

SEQ ID NO: 107425 - DNA, 1049 bp, Homo sapiens
tttgcagtgtataaatctaattacaggcaggaaaattctggtttatagttagattttcacacacgatccacagtgcccaatctaactcgatctcttttcttaagtttgaaatagttgctatataacttcagcaaagtctcccaggatgttggataaggctcattcgtttctttttcctgtgttctattcagcatctgactgctgtttcagctcatgggagacctaccaaaggcaattagattccagatctggctataataatttcagtgcaagtttgaaaccccagttggaatgtgaattcatgactctggagcactctagtggcctcatggggtacaatacaagagcaatgctgctttcccaaaaaacctactccacattttgggatcagattttggaaaacaagacggtctcttattgctacattcctgatgtggctccaggagtgagcttgcatcatcactctcagatgatacgcaccaagtgtgttatggttattgtttgggtgtaaaaactagcccagtggatttgttctgaagtgttcgggtagttttgtgtgctcaattaaaagctggaaaagaaatgactaatttgttttggagccacaaagcctttcttttcttacatttccattaggttgcgggttgtcgggaggaactagcttgctatctttgtactcaacttttgtgcttgtttccctctctgaacttttttcatctcatgtccctcaccaccaagcttttgtctgctttgccaatgtcgttggactcagatctactgttttgttccagaaaattacttctcggatacagtcccatctgccttccctaattcttctgtcttaggggaagggtctccctgagggctgatcctgaaggctgtcctcagtctaaaccaccaaacaagaccatacgttctggggttaacccttgggtcagaacattagtctggacccttatcctctttcaaactctaggaaggtcacattacataccttttgcaaatgtgcatcatctgcagggcccatcattgcattttgatgtaatagt

SEQ ID NO: 107426 - DNA, 2803 bp, Homo sapiens
tttgttaaaatctaaaatccagcatcagtgcttgttttcttcctctaaacactctctgtccatgtgcatgtgagttcagagggttttattgtttcttcattcctttttttttttttggagtcacagtccatctctgtttctcttccagagtcattgcttttattatcactaaattacctgaaggttaccaattactataggagaactttcccttcaggcaagtcaagaaaaggaatgtgtcatttttaataccaatggatcaacaggaaaattattgtccaagaaccccagtccttgattgaaattttcccacttcttaaagagttgccccaaatctgttggtacttaaaatttcatctcttcaaaatggaagtggttagttgtttgaggccagagggtatgctgttgagttgtatgaggggaattcagatataaaatcttaggaagggagacagaatgggaaggaggaaggggaaaaaaaggataaggaaggggacagaagagaaaaaactctaaagcaaaaacagttttcattaaatgatgtaagtaacagcagtaactgttaaacaagatattggaacacacttgttattcatcgtcctctcctgtctctaataacatatgctgaataagtgactttttcttccttttattttacagaggtcagaggtcaactccgctcacccatgatggacagccaaaagaaatgccgcaggctcctgtacttatttcctgcgctgaccagtgaagcgccctttcattgtaaaacattgtgctttacctactaccctagccttgtctttaccgagggatgctagtgagtccaagtggtggaaaatatagactgcaaacaagtgcttgttgccccacacggcccagattcacttgaagcagaagttagcatcctgggccagtttgttctctcagaacccagaatctttgagggtaaggttatctgtctgatactgagcagaaacagaatgatcctggagctttgctttctattgaaggcttttgacggtaataggtggtaacttggtaaaaggctgcctttactgtagctcacccagcatctcttttaccaaccagagagtgtgaaactagtttcatatattacctagttattctttcaaaacaaaacaaaaaaaaaacaaaaactgacgcactgcactagttattattagatattcttagtcttttttgtacatggagatttaagtttaagatggtttatataataggttatacctacatttatattgtagaataaatattaaaaagcctgttccagagactcccaagcagcctgggcaggcagatgtaccattgttagtggtgtatgctcggcctcgtggtccatatattctgcacttttatatttgccaccagaatggtagtttgctggcaaaaaaaaaaaaaaaagagagagagaaaaaattacaactcttacaatctgaatttttttcttagccttgagtgaccaagaagaatttgcttgaggcaaattgtggcaaatattttcccagacaggggaagagtcctgcagattacagattactggtgttttcatgccttgaggattcttttatttttacataggggtctaagtgaccaatggattgttcatacaaacaaaaaaaaagacaaaaatattattcagaagtgaccttagtattacttcactattctaaacacattgaagacactcacttcatgtggacttggagctacagaccttttacatccatcacagattggctggacgggttgcaattgctatgcacagcctgattggcactgcaggtttttagagccattttgagtttgtgttgtttaggaggtactgagtcaatgatgagggaggtatgcctgaccagagtgggactctcagtcatagatccacctgcaagtctctgtttcctttttgtgttttgttgcttttgaacataaaaccaaccatacataagcagcgccaagtggattaactggcttagaacattcaacatattgacttaaccacctgacattcacagtgtcttgtttcctagcaacagatgcaaagtgataaatcaaaattagtctgaggctacagattttacagggtatttgttctatagcacaaagtatttccccactcttgcgtcacagcacaaactaccaaattttaattattggattccagcaataatttttaatggttttcaaactggcggaattttgacagtgctagttcgagtttgaagcttttgaattagatctctaaatggtgacagtttacatggttttatctagctttcttatttatacttgactgaattgtaatgattttttttctaattgtaatttgacgtaatagccatacaaaaaatgactctattcatactaggtttagcttctcatggttgtagatattacttcagttccggtgctggaaaatatgtacaacatactaacaggattgaaaaaaaaatagaggtttttcttcttgtttttttttccaaagcaggtaaagagggtagcaaagcatcggaatgatgtgctcaaaaatgcatattcctggtggggatggaggaagaaggcattagtaaaaggttaatcaaacgttacaacttaaccccattcatgtaggaataaatcaagtgagcagttccagacttttgcataatatttttactatgatgctgttttattaatattttctaaatttcaaaacaaaaagtgaatgtttgaaattgctgggtcccgatgttggtggctgttggagttttggaccactcgctagcagtgatttgaagattataat

SEQ ID NO: 107427 - DNA, 1151 bp, Homo sapiens
gcctgtatataaatcttttgaaaaaaaattgtcctagcccttctctgcgatgctggaagtagaagattgcgtctcagatggagacgcagtactgttccagttttctttagccttttatttatttagttattctgggtatttcctatgtaattttgaagtgtgtagagtatattatagtaactgaagctgcagctgtaagaagctgagtgaaagaaaaaatactgtaagacatccttaaagtttttatttgtttgggtactgtatatgagatcaggaaaaagaaaaatgtcccacagccacattggaaatacaggttcttgtccccaaattaggttagttcccagattttagatcaaaactgttaattcattaaaaccccttttaaaaggtaaattctactgttgtaattccgatagtctttttcccacaaatatcagaaatatatttatttaattctgtcagatgagctttctaccgatgccatgtcccaaagccatgttaaaataattcccacgttatcattgtgattctacttcctgccactaaaattgctggagaaacaaaataatgatggaacactatgaacaaaaaggagcatctgaactggtctggttatttagaatccaatgtgttcaaatccttttgttttcttattaagtcagatgctactgtaagtcagataaaattttgtttgcactctgcagtctttggctcaatgtatggaaatgtttgcacctatgtaaagtcacaagctaattacaaattgctacagaacaggagtaagctgaaaactgaatgccatgttttgtttataaggtggggaggggagggaaaataccaaaaaactctgttccaagtttggcatttgacattaatgtgaagcagtgggaccatgctgcctgctaaactactgtatgaatcgtaaatgttctgaagacgagcagctggaggctggaggatggcattccatacagcaaaggagaagcacccaccacttcatctgggaaaaggaaggaaattgcaggaggcctggagccatcatttgtaaaggggatgttgcggggtgtgatgctgttgaggagattcaccttcaattgcactgctccacagagccctcatataaggccaatcctaatgggctacctcggctt

SEQ ID NO: 107428 - DNA, 1031 bp, Homo sapiens
cttgggacactgaaattggaatcagaccaagatattttcttttacatatgggcatttatccatgtaaattacttttttggcttcctctttcactcccctgcccacacatccaatattccatatgtcttcttttatttttattttttatttatttttatttttttatttttttgagacggagtcttgctctgttgccaggctggagtgcagtggcgtgatctcggctcactgcaacctccaattcccgggttcaagcgattctccagcctcagcctcctgatagctgggactacaggcgcgtgccaccacgcccagctagtttttctatttttagtagaaacggggtttcaccatgttggccaggatagtctcgatctcttgacctcgtgatctgcccccacctaggcctcccaaagtgctgggattacaggcgtgagccaccataccctgcccatatgtctccttttaaaacacagttttctggtccaggtgtaggcttttccttttccgagttgcctttgtgtgacattctagcctgccaccaccactgcctgctcctcagccaaagatctattttagatagaatccgtctcagcttttgagcctactgcagagagcagcaacaccagtaattagtggtggcaagatgaagcaagtcataaattaactgatgaataatattttccggggaatagcagggcttcacccacattcaaaaggagggcagaaccaaccaagcggcaaaattccacagcaggcgggatgctgaaagatactccagtcactcagcagagaacagtttttccccgacagttcaccttgccctgctgaggagcactgtctgctgtcataattctccaagttttggaacagagccggagtttccaggattacactgctgcagatgagcagcactattcacacttcctagtacctcattttttttcctagtcaattttattttgaggttaaaactttttcattcgaatgttaaactcaaattagcttttcttaattttaccttctaaacg

SEQ ID NO: 107429 - DNA, 1171 bp, Homo sapiens
taagtgaccaccaaattgttatttgcactaacaaagctcaaaacacgataagtttactcctccatctcagtaataaaaattaagctgtaatcaaccttctaggtttctcttgtcttaaaatgggtattcaaaaatggggatctgtggtgtatgtatggaaacacatactccttaatttacctgttgttggaaactggagaaatgattgtcgggcaaccgtttattttttattgtattttatttggttgagggatttttttataaacagttttacttgtgtcatattttaaaattactaactgccatcacctgctggggtcctttgttaggtcattttcagtgactaatagggataatccaggtaactttgaagagatgagcagtgagtgaccaggcagtttttctgcctttagctttgacagttcttaattaagatcattgaagaccagctttctcataaatttctctttttgaaaaaaagaaagcatttgtactaagctcctctgtaagacaacatcttaaatcttaaaagtgttgttatcatgactggtgagagaagaaaacattttgtttttattaaatggagcattatttacaaaaagccattgttgagaattagatcccacatcgtataaatatctattaaccattctaaataaagagaactccagtgttgctatgtgcaagatcctctcttggagcttttttgcatagcaattaaaggtgtgctatttgtcagtagccatttttttgcagtgatttgaagaccaaagttgttttacagctgtgttaccgttaaaggtttttttttttatatgtattaaatcaatttatcactgtttaaagctttgaatatctgcaatctttgccaaggtacttttttatttaaaaaaaaacataactttgtaaatattaccctgtaatattatatatacttaataaaacattttaagctattttgttgggctatttctattgctgctacagcagaccacaagcacatttctgaaaaatttaatttattaatgtatttttaagttgcttatattctaggtaacaatgtaaagaatgatttaaaatattaattatgaattttttgagtataatacccaataagcttttaattagagcagagttttaattaaaagttttaaatcagtccaatgtgttt

SEQ ID NO: 107430 - DNA, 1611 bp, Homo sapiens
gtgatggactccgatttggagagtagtaagacgtgaaaggaatacacttgtgtttaagcaccatggccttgatgattcactgttggggagaagaaacaagaaaagtaactggttgtcacctatgagacccttacgtgattgttagttaagtttttattcaaagcagctgtaatttagttaataaaataattatgatctatgttgtttgcccaattgagatccagttttttgttgttatttttaatcaattaggggcaatagtagaatggacaatttccaagaatgatgcctttcaggtcctagggcctctggcctctaggtaaccagtttaaattggttcagggtgataactacttagcactgccctggtgattacccagagatatctatgaaaaccagtggcttccatcaaacctttgccaactcaggttcacagcagctttgggcagttatggcagtatggcattagctgagaggtgtctgccacttctgggtcaatggaataataaattaagtacaggcaggaatttggttgggagcatcttgtatgatctccgtatgatgtgatattgatggagatagtggtcctcattcttgggggttgccattcccacattcccccttcaacaaacagtgtaacaggtccttcccagatttagggtacttttattgatggatatgttttccttttattcacataaccccttgaaaccctgtcttgtcctcctgttacttgcttctgctgtacaagatgtagcaccttttctcctctttgaacatggtctagtgacacggtagcaccagttgcaggaaggagccagacttgttctcagagcactgtgttcacacttttcagcaaaaatagctatggttgtaacatatgtattcccttcctctgatttgaaggcaaaaatctacagtgtttcttcacttcttttctgatctggggcatgaaaaaagcaagattgaaatttgaactatgagtctcctgcatggcaacaaaatgtgtgtcaccatcaggccaacaggccagcccttgaatggggatttattactgttgtatctatgttgcatgataaacattcatcaccttcctcctgtagtcctgcctcgtactccccttcccctatgattgaaaagtaaacaaaacccacatttcctatcctggttagaagaaaattaatgttctgacagttgtgatcgcctggagtacttttagacttttagcattcgttttttacctgtttgtggatgtgtgtttgtatgtgcatacgtatgagataggcacatgcatcttctgtatggacaaaggtggggtacctacaggagagcaaaggttaattttgtgcttttagtaaaaacatttaaatacaaagttctttattgggtggaattatatttgatgcaaatatttgatcacttaaaacttttaaaacttctaggtaatttgccacgctttttgactgctcaccaataccctgtaaaaatacgtaattcttcctgtttgtgtaataagatattcatatttgtagttgcattaataatagttatttcttagtccatcagatgttcccgtgtgcctcttttatgccaaattgattgtcatatttc

SEQ ID NO: 107431 - DNA, 3039 bp, Homo sapiens
agaatattcagcatgtttgaatagactgtcagagctggaactctttcattaacatctctggcacctttagttttagccctgaacattttatcttaaaattaaacattaccaaatgccttagtttatttcatttattaaatttatattcttatttgttatttatatcagcttccaatcagaagactatacaacctcctagggtaagttaaagtttattaaatgaattgtgaatgatcatttgagggattagactgaggaacttggtaattgagatattttgctatctgttttgtctcacgtcaaattaagagaatgttgaagtcattgcatgacctttgcatgaatgggtccagttctattttaaaacctgtgtttggtcattttagtgtcaatgggatggaataaatgatttcttaagattgtactgacttctcacacccaaaactggaaagtaggaataatggctatattatctctgcaatcagaaggaagctgattccaatatatcacctcacctgttggattcattggatgtgcatacacagaatgacaatttcaggcttaaaaatgaggagaaatctatactaagttgacatcactgataattataatctataaaataaatgtaaatattgctgaaaacatctgttcggagttatgattcgatcctctcccatacaaatgttttataaacattttttcccttaaaactgtgcttaaggtttcattgtaccttagataccttattaagccatctgaggaaattgcaagaaaggagtaattttaggagggcataaatgaagagaaaagcatatttataaacatagacttatcacagtgacaggcccaagaggtatgttgtggacataagctctggaaaggattatattgtacttagcttcctataacggagtgatgatagatgtatctggaatgccaaagagagtcttctgtctgtggccggaggtagaggtcacatatgcttctaagtctgacaagcctcattgtgcctaaagggcaggtggggcgggtatgtgtgtctaccacaggggtatattctagaaagattggtgccatagctatgttggtcacaagaggccagcaacttaactggacctgtgaatcctaacacattttctttcccagttactgagttcaatttgcgatacttaaagatgattctgttttgcttccacctcttcactgtgttatttattctgttgttgctatttatgcttgcactttcatatttttagaagttagaatttcttgagctgagagtggtgaagtgggaaattctgtttagaaaaataatattaagagaataatacagttattattaaactattaacccgacttggcaagctttgctttaacatttacaggcttatttcgttgttttgttttttcttttttttttgactgtaggatttactgcttactacgtaatttaaatattagcatatataagttttactataaaatgacatgacataaattatatttttatgtaaatatattttaaatatttttcagaaagctgtagaggaaccccttaatggtatgtggttatttcactcttaatcctttaccagatcataatttgatctggcccgcaaaacagttagaatgccctgtctatgccttaggaagaatctaggtttttttcctctttttttctttccttggcatctctactcttgattattcatcaagaattatgggctgggtgcggtggctcacgcttgcgatcccggcaccttgggaggccaaggcgggcagatcacgaggtcaagagattgagaccatcctggccaacatgttgaaaccctgtctctactgaaaatacaaaaattacctgggcatggtggtgtgtatctgcagtcccagctactcgggaggctgaggcaggagaattgcttgaacccggaaggcagatgttgcagtgagttgagatcatgccaccgcactccagcctggtgacagagtgagactctgtctcaaaaaaaataaaaaagaattatgaatattacttttataatattctcaccactgggaaaaatgcactattctgtgtctaagtagctgcttaccttaaccaagtgatatttgggcaaggggatcgttgccttttgctactggttgagacgaagcatggcaccccctagtagagaaggatcccaattacttccaatttgtgatgtacacattttagaaagatacaggctattgccacagagatagaccaaaacatctcattttctttctttgtaaacctagatctgatttcccaactaagtctgtttcctttgtgaatgctgtgggtatgatccacagaaaggctacataatgaaatgatagctttacaattaatttggctgtagagttgtagactagttagcatatcattgcatatttgtttatttagaaatgatttccaattgtggaacctcactaactgcctgcttggcttgttactaatcctagcattcaaagaatcaaaaggaatgatgaatgatggtaagtataaaatgcacttaataattatagatcagttaaaacatggacattggaaaacaaaaaagcttcttgaaaatgtggctcttttttagtaaaagggacactgtcagatgataaaggttcacatttcttgatgtatacaacttaaatctactttgctaaaaattgcaaaactactactgtaaaaactgtagggtgtcacgaatcagactccagtcatatggctcccagcaaagagaaattaccactttttgtaaaatgtttttcagattccgtgtctggtgactgtaactttaagatgccttttataaggcacataaataatctggcacaaatctttatcattttgacagagtttcttttatgcttgtgttggtgattttgttgcatttaacccatggggacttaacatctctgcttttccaatcaggagcttggttctaaccttttgggagatgattaaagagagaggttgagagagagagagagagagagagagagagagagagagagagagag

SEQ ID NO: 107432 - DNA, 1020 bp, Homo sapiens
tgcagtatccatacaactctggtgaagtagtatgagatacctttggctgacgggcagcacgctcttattttttcctcactatctgggttgtcctcccttttactcccatgccaccccatgccttccatatctagcatagaatgatcttcagtacagttgccagcaggtctggtgacaatgtctcaagtggaactaagcattgtctatctgccacctccttaacttcactctcctgccttctccatcacttacgttcctccaagcctgtgaaaccactgtactgtacctgtcactgttctgacattaaaattaaaatgacttaaatcttgacaagtaccccaaattattttttctttgtcataggttagcatataagtatactatatgctaaaatttatgctatatgtttaaaatttagtgcaattttattgatagtgtcctaattttattgatagtatcctaaattaactttttaaatcaacttgtctgatgccagggttcagagggacacctacagtcagttgaaaggcaagaagagacaaggtacaggaaagttgctctttagataacatggtagactaggaggaacattaatatggtttgcttatataatctgactgtgtaaatctgaatctatgtaacattaaggttgcaaatttgagcgtttatattaggaagttaaaattttaagtgtctccaaaataatttttactcattgcacgtgttctgttttagaaaagcctaatgattgtgttttgatttaaatgcaataaaatcctcaaatagttaaaaatccaagctttctcttcaagaagaagttaatgtcgctatgagatttttaacttttataatttttattatttccaactttaaatttgtagccttaatttgctattttaaagagtaggcctttcactttctacaactttctgtgaaagtgactttcactttctattttttaactttttaaactgtgttgtattttttttcttttattggaagcattttaattttataaga

SEQ ID NO: 107433 - DNA, 1027 bp, Homo sapiens
tttaaaaagtatgtaggaaaatattttaaatgtttttatttattgacaggtgaatattcattaaagaatgctactggccttggtttaattgtgacttctacagggatattaatattacttcactactatgtgtttagtacaggtgagttttcattgttacagtatgattttgtctacctttttcatttacaaaacagcagttttggtgaaaatgctcatataaattttttacaactcaataagagtaggtttattaaaagatttttcatgctattcttagtgacattttcccattcatattaattttaaggttattctaggttagctgttttgtaaaaagtgactttcatatgtatttgatgccaatcagcataattttaaattatgccatataacttcttaatgattattttcatattctaatttcagttttttgaagttataagtggatgttaaacgcagtctttctcttcttttgctaagcttctgcttctgcattaagaagactggttctataaaatggaattatgaatcacaaatagtagaaacatatttgttttaattattagcaaaccttaatactgtagttttaagagatggtatggaaatccaaactataatcagtatcattttcactgcattttgaaagtagatcactaccatatttagttattactattaaagagtcacatttaacacttggtcttagagcctatctctggctcgttgtacattggaaaggtattagtttgttataaaatgacatctagagatagagagcatgatgtttacagtcaggtatttgcataatggttccctcagcaagagcaattccatgtgcatgtggagaagacattcataatagccattcatattgtaaaatgcacaagtgtggtaaaagcagcattgttctaagatttagggtaaaaacttccagtccagcttagctgactgtgaaaattaaaggctgccgaatgtgtgaatttggagctgactacttgtgtggaagggttagatcactgagtta

SEQ ID NO: 107434 - DNA, 1039 bp, Homo sapiens
agtgtgttgaagttgagactgaataaaatatttggtttggttttctgttcaaaattttaccttgataaggacaatatttttctacatatatcagtaggcagtaatgattacttcaaagcttccaaagccagatactacacctgcatgttccaacatagttgctgaatttattcccaagatgcatgtaatgtatactttgtattattgagaatgaataaagaaaagtcataatgatgccttccagctgtgcaagttaatattaaaatataatttgtttgcatatttcacctaataggtcttcttcattgctatactgtttacttaagtgaacaatggaaatgttgctgtttatcttaaggatttgtaacatgcctaagatcttacagtacagacttctataattaatgaaacatttttctttttcctttccaggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttggtaagacttctatgaaagcttctttttttatttgtcctggtgcaacctgatcctctttcgagaggaggccaaatggggataggtactcctttgaatcaaaaagcaggctgttattaataaatgttgatgtaatgtttagcaagtttaagattgtgatttctatcctatttgttaatctactcttcatggtaaaacacatttactatttaatttgtattacttgttaatttgtatattgtgtggttctcaaact

SEQ ID NO: 107435 - DNA, 1040 bp, Homo sapiens
ttcttttcataaaattaaaagtcactattattgtgattctggttataatgatgtgttaaaataattgtatagttggaaactctcaagtacagcttaatcccacaaggaagcaagtttaatttgtttactttcaagctaagtaaactctggaagtcagacatctcatttaaagtctaatagggattttttagattgcggttattgatttttgcattaataggagtaacttaagaatataaatgtaactgctaacacacactcttttacaaaactatgtgcaggtcaaattctataacagaccagtattgccatcatcaaaatcctgagtttttaaatcatcagtgtcctcctgatttggggaaaaattaatgagttgaaagttagacccttattctcatgccattctgtaggccttaatcttatgaggatataccctgtcaaattaattataaaattaagttttatggccagcattccaaaatatcagataaaggtttttttcattattttttagaatatgtagatatcattttgaatttagatctttgtggtaaaaactactgaccaaagtcatattcgattgcttttttagaattcttctttagatagtttgatctttgtgtctagtattttacaaacttctctttcttttaagtctttcagatatggcaattgggaaatacacctttagggtcaggtgaattctttatttagcttatttaaaaataaatgtatatactggcttgagaaaataaggagctaatgaaaagtttctcatgcctcagaaataaaaataaaccatctggttacatatgagctctcttctcacagactcattctcctccagaagaggtggactccagcatcgtggtcgaccctttccttctccactcctcactctatcaaaatcaaatagacacttggacacaggaaggggaacatcacacactggggcctgttgtggggtgggaggaggggggaaggatagcattaggagatatacctaatgtaaacgacgagttagtgggtgcagcaaacca

SEQ ID NO: 107436 - DNA, 2106 bp, Homo sapiens
ccatttctcatttgcagtaaaataaaaaagtctgttgtgaaaagggtgaatatggataaaggaatgtactgtttcttcagcaaattttttagaagatattaggatctcaaagcagcttgagtatcatttgttatgaggttttcataatgtattttctaaaatagttaagcagttattaaacagatactttgtgtcagcacctggtattttcaagtgtgcaaagaatacagaaaggggttaccagtacttgatgtcatatataggtagctgtataattttcactttaacaaatattatataatgtgttaataaatattttcaacttacaactgaagaaactgagtctgaggttacttactaaagtcacacagctaataagtgaatcaataggtatatattctgaatctgagtccggggttctttctatattaccatggttgcatagcttgagtggtagctatgaattgtactttctggcccgtttactaccaggaagatgagaacagactaggattaaagactgatctactactactactgagtaacagaagaggcataaaatttagtaccacatttacagtttttctggttctgctttaatgtgattatcttattagtaattttaatatgtagtgtgtagtattttctgcaaaatttcagctgctggcattaacttaagacaagttgaaagtgtattctcaatttgtattatattgtttaatgattattcattttaaacttaccatgtaattgaattaactgaagtataatatttatagtatgtcttgaaatggttgttgtacaataaaaaataaaagcatcttaaaatatatgtatagagaaaacattaaagttatttttcttctcaattcttcctcctcccccaaccccaattccttaggcttcctccctagaggttcaaaaggcacaattagaaggtcgtttggaagagaaagagtccttggtgaaacttcagcaagaggaattgaacaaacactcccacatgatagcaatgatccacagtttaagtggtggaaaaataaatccagaaactgtgaatctcagtatatagacattatggcattttggaatttgtaatctcatgatatttttgatgtatttatctattggagggggggtgggtaggggagttaatttgtgacttcgtaacaataagaagttattatctaatttagtaaagaccctgatctgttgcatgttttttatttgatagtttgaatagaaatttaattttctaagttttactttttgtttctggcttttatggcttaaggttttctttggttcttacattagaaaatcatttttaacctccattatcatttttctaaggttctttcctttttcttagttgctttctattctgttttgcctgtcttatttattctcatttgtgattatttagatcttaagaccaaactttcttggtataacagtcctaaagattacaaaataaaaatatagagagagtaaaagtaaaaagtaaagtaaaaagagagaaggtatgattttactgctagagaagtttgtctctgaagaagcacaaaagaaaatattagtgaatttaaaataatttttatactgctgtagcataatttctaaatttgaaaaaaatgcaatggtaataaaatgtataaaaattagaaaactgtcattgtgttaaactattacatttaaatgattacatttaacacaatagctgtctcataaaaaatctaagaacttgtagaattatttgtaaggtatatttagtgtttttttctcttttttcaaatgttgcatagtggtccagatcatctataattaattataagtttcttatgatttacataaggataatttggattctactcttgctgcatattcagaaaaatattatttactgttaattctgatatgaattgtatttaatttgttgtcctaatagtttttaattggttcatttaattttaaagcataggttaaatatctttattttttttaaaatacaagggtccttctgtacttttcatttgaatcatatcctctaactactctgtaagaaacgtttttacatcaatattttgattgattttattgctatac

SEQ ID NO: 107437 - DNA, 1026 bp, Homo sapiens
tgctttttaaaaatctttgtgcttagtgaaataaaaaagacattttatgcttatggtagttgagtatcaaagtattactttagaaaggatttttttctgtgtttaccttgcaggtaaaatacttaggactattagatgcagagttttaaagagacaaatgtagaaccctaaacttatttatagcaaattatgtaatgcaatatcatctgtaaaataaggctttatatccataaatatgagattaatgccccacacatttctatttcatagtaatttttaccacatcagtcaaccaaaacatgtatttactgccttttagagtagatgaaattctgtttatgtcctgcttgttcataacattccttctcttccagcatatgcaatttggttagaagagatagtaaagaaaacactgtgagcttcttttctccttcatatgttttcctccataatgatgccaactcattttcttgtcttttcagaaatgaaagtactgaaaagaagaataaagatttacagatcacatgtgattctctgaataaacaaattgagacagtgaaaaagttgaatgagtcactcaaggaacaaaatgaaaagtaaaatctctagttctatattctgaatatgtgggatttttcaaaaacaaaatgattccctttatatagaacattgttttttattgataaaattaatagaattgtcacttattttagatataagatatgtatttggtggaagttacaggcaattgctgttcttagaaattttgttttaaaggctgggcatggtagctcacgcctataatcccagcactttgggaggctgaggtgggtggagcgcatgaggtcaggagtttgagaccagcgtggccaacatggcgaaactctgtaaatactgaaaatacaaaaattagctgggtgttgtggcgggtgcctgtaatctccgctacccagaaggctgaggcaggagaatcacttgagcccgggaggcagaggttgcagtgagcacaagatcatgccactgcac

SEQ ID NO: 107438 - DNA, 1075 bp, Homo sapiens
agattttgttcttaattctcacctgaaatgagaatgctgatggtgtgcacacttagcagtttagtgttaatggctacctctgaggaccatacctttttaattgaatactgtatgtagcgcgaccttcatgttgctgcagttgtatccatttccattaatttgatcatagtgagattgtttttatcagataatgtattaagttaaaaaaatataacagtatccaacttattagaagtaaagtcctaagtatatgtgactaatacagctttgcatgacccaacagataccagcttattagatacttagtaaacttttaaattgtaggtatgtgttgagcatatgatatagatgatagtggtaaagtctatcttctttttttttttgaggcacggacacttgctagtatgttgagagaagttgagagaaaaaatgaagagcttagtgtgttgctgaaggcgcagcaagttgaatcagaaagagcgcagagtgatattgagcatctctttcaacataataggaagttagagtctgtggctgaagaacatgaaatactgacaaaatcctacatggaacttcttcagaggtaaataaagtaaaatcttctgtgtaaggttagaacctagaatgaacatgcagcatttcttttctgagacccgaaaatccttttgtaagcatttcatatattctgataacacatgaggtaagtaattagcaagaaacttaagtcattgtgaaatgaagtgttgcttcctcaaactcagtatcaatgttggaaacaaaatacaggtctttccagttgacttcttttatgtattcataacagtcagcagtcatttgggagataagctccacaaggacaagtttgtctgttttgatcactgacagatccctagggcctgtaggagtgcttgctgcatagttaggcacttcattaataatttttaaataaacttagttgtcaaattagtattaggttgaatggtcatttctgcagatcaaaagtagttgaatattggcaatttcatatcattctgcctaatagaatggaaatttaggtgtaagtgtttaactcatc

SEQ ID NO: 107439 - DNA, 1898 bp, Homo sapiens
aggaaaaggactaaggacgtaaaggccaggtgatatcacccatgataagaacattattctgaccagtaccaataactttgtacttattacagataatccacactcataaactagtcttacaatgcctccaaaccagaggtgaagctgtcattataaaaggttagaaacagaaaagtgggtgctctggaaaattcagaatatttcccaagacttcatttcatcatggtctccaagattatttgaagacttctattcaaaaaaaggacccattcttaaaaattccctaattctgcactaagtctgccttttcttctattttcgtataatttttttttcctttctttgactcccattcagacttggagaaagtatagcagcaaacaatgcctatagacaacaggaaacagaacatatacccagaaaaatgccctggcaatcatcaaatcacagttttccaacatcaataaagtgtttaactcctcatttgaaagatggtgttcctggattgaatattgaagaattaatagagaaacttcagtctggaatggtggtgagtgaaaaaatagcaattataacctggtacatattagctatatgtcagtcccaattataacgtgtatctaaacactgtcaggtacagatttcactattgaaaccttaatataagaaataacaatattctggaaaatttggaaataagaaaaatcagtcaaaatttcaacattttgccgggtgcggtggcttacgcctgtaatcccagcattttgggaggccaaggagggtagattgccagagctgaggagttcaagaccagcttgggcaatatggcgaaaccccgtctctattaaaaatacaaaaaattagctggacgtgttggctcatgcctgttgtctcagctactctgaaggctgaggcaggagaatcacttgaacccaggaggcagaggttgcagtgagccaagatcataccacttcactccaacctgggtgacagtgagacccatctcaaaaaaaaaaaagaaatatttgtgacttacctgatgtagcatttgtttttattttgttactcatcattaagttttaatgatttagttttgaagtaggcatttattttgtcattgtgtcaaaatattttattaaaattttaagtttttttactcttaaaatgtaggtaaaggatcagatttgtgatgtgagaatatctgacataatggatgtatatgaaatgaaactatccacattagctgtgagtataagcttattttaacaatgtgtaataagctttaatagatgtattcctaaaatgaaaattaatgatatgttttcttgtagtccaaagaaagcaggctacaagatcttttggaaacaaaagctctagcccttgcacaggctgatagactgattgctcagcatcgctgtcaaagaactcaagctgaaacagaggtgtgtagaatataaagacacatctgatttgtagaaaaattaataagtaaaacatgcaaaatattagttatgtatttgttactctaattgaagtaaattctccttagcatttgacatgcctccttccttcttcctgaaattctgtcctctttaattttggttacatcgttacctgatttttttttgctaccttgtattattttcctatgttatttattttgtacctttaagtgttggggactctgggacttatattctaaacctttttcctttagttatgtgttctgtggtttcaatggttaccaaaatagtaatgttcctaattttatatgtcaagcacagatcattttcctgagcactatgtgcctatgttgctccatttaaatatacagcaaataccacaaactcagcataaccaataatgaactaatcacccttccctttttaaaattattc

SEQ ID NO: 107440 - DNA, 2010 bp, Homo sapiens
tcgatctttaaatttaaatgttctaatttaatttgaattttactttttattttatagccttaatttggaagtgattggccatttttttcttttaaatgatagcttggaaaaaaacattaattctacacatcagtcagttgtgggttttttaatccacgaaaatatataaggcataatttttataggcacatttgaaagcattcaaaacctttgccagatttttttaaactgttcatattgattgcattgcagtgtaaacagctataacaaggtataatatattcaaactatatagactataatatattcaaacattagaaacattttagaatttgcctagaattaagatttacatatatttactcacctcctatctaaaagagctgacattgtttattctttctgctgcttcttttttggtttctgatttatttaggacccacgtttgattactcctttggcttttgctttaacgtcagataatagagaacaagtacagtctggactgagaatattattggaggctgctccactgccagattttcctgctttagtgtgagttgtaatcatttgcagtgtatctcttgtggtgttggaataccctgctatgtctctttagtcctcagtatagatacacaagcaaattagtgaattgaagacttcattgtaatagtaatttttcaagtgatttctaaaaatgtttgattcttataaatgaaaagttcagatgtatactcactcagggaaaagctagatccaggcagttaaatgttcttcaggtactatccctctatgtctctagccacttctttttaatgataacttctggacactcttaagcctacatcctcccagtttagttcctccatagaaagagcttttccttcctgactgtttaaggaaaaggtctaagcattagtcattgaccaggcctgggttatccatgagaacgatgtggactaaaagttagttgggataggagaataggagagttcctaaagaaaaaaatctgaacttttatcagaaagtggaaaaatgacaaccaggcaaaattttctactatactcgttactttcaagcaataagaatatttgcaattatgtttgaaaaaaaattcagatttcagggctctctgaactaaatgtctattaggagtctggtttaaaatttttttaagtcatttatatgtatgaatttgtaaaaatggtttgaataatttgaagtagttgataaacaggtaagatattccctgtataccgggatcagcaaactggccagtggacaggcatctgtttttgtaaatagttttattggaatatggccacacccactcatttttatactctgtctatgttgctttcactctataaaagcagaattgagtaattgtgacagagaccagataggtccttgagtctaaaatacttactatcttgacctataagaaaaagtgctggtccatgctatatgctattcactgatttagcgattccacttttcagaattagcaatttaggtcatcataccttaagagttaaagtatgggatgtaagacctagagaacatataaccaaaattcccttaattttataataaatatttttttaacagcaacaacaaaaatacacaggaagcttttcaagttacaagttaaaagtggtctgtaaagctgctctattttgtgatggcctgcttgcataaactggtaatctgacatgaaacaaaaccttaagagcttcaaaggggaatctgcagcctcactgaacatggaagtcttatcctctgcctctgtgtgtgaggccttcccaccattttgactgtgtcttggcattccctgtcttatttgtgttgtaaataattttctctttgggcattatctcagatgtccattttatgcttactatttaatgcccttatttgacattatcttgggcgtttaataaactgaatgtatattatggatgcattggtaggtagggtttttgtgtgtgtgtatttacttgtttgttt

SEQ ID NO: 107441 - DNA, 2571 bp, Homo sapiens
atgttggcttttttgtttgtgattgtttaaactacctggttgattctaacatgcagctaaagttgagaaccactgcagtagggatacatgattgcttgaccttggagatatttataattaataaagtggggccttctcattgaattggaccacaacttttaaaataatagctatttacattaatttataatatacaaatatgacaaaacaacttacccttattcaataaatatttattgaaccattgagattcttgctaacaaaaaacagacatccaatggaaagatatcctcgctgttttaaccattgagtcagaaacctttggtgccagtccatctcttaccacttgctagtcatttaaattgtgtgagtttcagtttccttgtttgtcattgagctaatttaacaataattatactggatgacagtgatgatataatttgtatgaaatcatcctgaatgttatcttttacacataaagtgagaatttttttgttgtatatcttaacaaaacttaacctctctgtggagatgatacactaaaaatgcatattgcaaaaatcttgacaactgtcaagtgtaccactcttatagaacaacaatttacatatggcaagattgacctgggatttggaacaaaggttgcagattctgaattatggtgagtatataaactctaatgacaaaatggcaaggcagtaaaaaatcgaaagatgtggtgattctcatccttttggaggaccatcctttggttataacttaagatataacagattaacaaacatattttcataatgaattttttgtaaattcattcaatttgtagattgtgtgctttttgaagaaaggtattaacatttgttgttttttattgtttaggtttgttttgtcttgttttaacttactataattatctaagggttctgaacatttctggagctcctttttgacattgcctcagtaatcaattttacttttttaaatgaaaagcatgaaaaaacagaagagtagttttattacaaggaaatcagtcactgctaaaggctttttaataacagacaactctccttccttggcaggtcaggaattatggttaaaggtggattttcactgatggtaataagatattactttataccccttccctcctcatgaattaagtccatctaatctttactgaggacctgctgagtggtagacactatgatttgtttctgtttccacagatgtcacaattgtcagtaattgtggacctttagagtaagaattatctgtttttatatttgtatactactttcaggtacaaaactcagaacatgacctagtgtaattcattcattacgtattagatattctatattgcctaaggttaccgtctgttgttgatattctagtgacaaagctaagaattaaatgaactgtgtttcgaaactactacttacttgaaacagaaagttgaagcaggttggtagtaaaagaaacactgtctaaactaaggctattaatgccagtttgttctctttggatcttgagttataagaatgttgattgagatttttacttctcaatagaaacaggactttatcatcttgaatttaaaaaacacaagtgttggtttttttcattttctttagaattttggacagaaacaagctctaagaaatttttcagttatctaatttaaatgtgatttatctttaaagcaaacttgctgctgatgtaattttgaaaactcttgatttgattaacaaacttaaaccattggttcctggtatggaagtaagcttctacaaaatacttcaggtgagtttaaactcttcaaacattgaagtttattcatacataaatggtcctaatataagtttctgttttaatattcttaatctttagaagataattctcttagaattggcaatgagaagaaagtttaaagttgttgtcttaagcagttataatagtctcactgcacagttattttatatactttcacaggaattgaacataagtgctcatgacactaatgtagagaatgttcacaatagtgctgcttcctcagccttttcctttcttgtgttgtatttgtatatttcttcatttgtttctgttggcattggaggaagagtgatatttgttttagggtttttgtttttggttagggttgatgtagggtattaaggggatagggagacagctggaagaaaaggattgtgataattagaagggctgtgcagaaaatagctaactcacaaatttcaatgataatagtagctgaatatgatctctagctgttatcaaaaggcaaagtacaacaaatttagttcaaagttctaactggcttttatttatgattctagaatttggcagcctcattctataaaatagaatgaatcattcccctgggctaagcagagaaggttgactttatagaccagaaaagggctgaagaaagcacaaatagggaactaaaagcagattggtcatttcaaagttacttttcctatagaattataataaagggggcttccttattatactaactcaggttgactgaaatctcctggttttttggaa

SEQ ID NO: 107442 - DNA, 1050 bp, Homo sapiens
tcacaaaattttctattttatcttggtcttgattatttaacaatcagttttaacatttaaaaagccctttgagggtcttgagggaaattatttgtggtcataaactattaagaccaatgtctattatttaattattgttattacttttagcagattcaggatatttgttttcagtagatacttttagtttagaataatttttaaatcacaaagtctgtttaaaaaagtcttatttgtaaaaccttactgtctaatttgagaaaaaagccatagccctcaaaactggttagaagtataaattttaaataaaaatttaaatattcacaggagacttaggtcaatggcatattgaaggaaatataaaaaatttaaagagagtgttacaattcagtgatgactttttctgtattgtatattccatctttgcttttaatcatttgtgatggataattctccaggatgtcatagatgctgctaactgttcctcggctgatcgttttgtgacccttctgctgcctacaatccttgatcaacttcagttcacagaacaaaatctagatgaggctttaacaagaaaaaaatgtgaaaggattgccaaggccattgaagttttgttaaatatcctttactgtcattaacgtgaaaactgtataactaaccattcttttttttctagtattgcattcactgcattttgtctttatttgtaatttgtcactttatgctcatatttatctagaattactgaactaaaatttgaactgtagaaaaaattctcaatgagtgaaaaagatccatgattttttttccttatttttctgtgtgaaacttttaagttaaagtacattttttaaaatgctgtttaagcttgattttgacacttgtatcacaatttgacatttggtggtaaattctaaaatgactattctgttactccatgttactgttttctgcttgatgctaattatttcccctggacggacgatcagtagtgccattttttggtgatgtgtattcgtggataaagaaatgctgatagagttgtcatga

SEQ ID NO: 107443 - DNA, 1077 bp, Homo sapiens
cagtgtggaaataaccatcctgaaggttttatattctatgctacagtatcctttatagcggttattgaattttaggattataacaagtattactaattctaattttattttttagggtttttttggtcatttataaacaaaacaggtttctgtttaaaaataatttaagtactatggaaggagtgggaggagtttaacgttggctgaagttgaccttccctctgaggttctcacagtcctgcttatcaggagtaaccaccattaataagtttattttataatcttctagaacctattcacacatttgaaaaataatattgaaagaaaaaacttaagttttgttttagaatattttctttaaaatatgtagcattttcagcttcatcatacacttgctttgtatattaaagttctgtgaaattgatgtttaatgaacactttatattgcacaggttttagaattacttcttgccttctgttcagtgactcagctgcgccatatgctcactcagatgatgtttgaacagtctccacctggcagcgccactctgggaagccatactaaatgtttagaacctactgtggctctactgcgctggttaagccaacctttggacggatcagaaaactgttctgttttagcattggagttgttcaaggaaatatttgaggtaataggatgactgacagattgacttttctacttttgtgactctcagttaacaatttgtcttcaaaaacattctttgtaaacttacagttcatacacttgaggaaaacatctcaattactaacagtcatactagactcgctaggtttttttctgccagtcatatatattagtgttttccttttttttcactgagtagtgtgtatgtatatatatatatagtgctcatttcagtgtaataagtaaagatattaaaaagatttatataatttgttgcctgactactggggatagttacattgtctctccattgcaatagatgccatctaccaagtttagtaggccattgaatggacaatagaggcatattggattcagtcagtgaaatggagtagagcatgccagat

SEQ ID NO: 107444 - DNA, 1050 bp, Homo sapiens
gctgaattttttttgcttccaccacaattatgagagttcctcattacagttcttttgttaacacaaatgctaacaaatgctacagttcttttgttaacacaaatcctgcagtatttaaggtagctcttttgtttccactctgcatgtgtccctttattagaattgacaccctgatttaccatcattgaattatttattctaaggtgacaaaactttggaaatatttatctccaactcgtttgcacgcatttaccaaattatttttttctgtaggtactctctttataacaatttttgaatttaaatttatctctgatctaaatttctcctgtagaacatttatcttttaaatgcaacaatcatttaatagagttgataatgatgtttaataaaagtttgcccactctgtgcaagatatactttttaaaccaaaacataaaatttataattctaatttattttttaacttttttttcctcagagtaatgtgaaatctttttatcgaactcttatcaccttgttggcccatagtagtttaactgtggttgtgtttgcactttcaatattatccagtttgacattaaatgaagaggtgggggaaaaggtaaatacaatttttcaaatttattctgaagtttatagtctgatattttaaaagtcattgagacttttttatttttaccttttaggatggtgtcaacttaattttttgtctaatatgctttttctaatttgtccttaagctattccatgctcgaaacattcatcagacttttcaactaatatttaatattctcataaacggtgatggcactctaactagaaagtattcagttgacctactgatggatctccttaagaatcctaaaattgctgattatctcaccaggtatgactcacttcagtcaattttagaacttttttatttttaaaccaagatgtgttggttataaacagaattgtcttcttaaaatataataaacttggattctactgattcacagtagactaaaatgttttgatgtgctttactcacactcttttttcttt

SEQ ID NO: 107445 - DNA, 1632 bp, Homo sapiens
gattttaatttgatactaaaataattagtatcaaagaaaaagcttgctacaaatgtgtaaacaagttttttctttgatactagtttattttacatagagaaatcatttgaatttctgaattggagggttatcataaagaaaataagaaaatagccatatcataccttttttaataataaattcatatgaaataaattctgtatgaattatctgcaaaaccttgtaagaaaatgatatattttgtgcttttattttaacttatagcagtagacattgaaaccagagattgtcttcagaatacatataatctgaatagtgtgctggcgggagtggtttgtcggagcagccacactgattcggtgtttttgcaggtatacagacccacacagtgtattcccctttccttactgtcagatcaaaattgatagtttctgtcataaactgctgacttacagtgtatatatgctatataataaatactacatgattaggcacagttcatctcattaaaagctggttgcacacatacaatttaaatgtttctagagaagagaagcttatccatttctatcaccactattgaagaaaaacaaatctacattataactgctttgacttataaacacagatgtctgtgttttgagacataagctatttatattaaaattgtaacgtgagttggcatctagtctcaatctgtggaggaaacgttctacaaaaattaaagctgtagatagagtctatttaatatagattcaaagctcttcatatttcattgactctaaaatgtcatcaattgtaagaaagaaaaacatcacaaattaaattgacatgcagttttagaggtgataaaatgtgaagaagggtatcttctaattgatggactacatgtgtgtttcaaactgcattcaagtttaagatgactaagtgaacaaggttgataaccatgctctgagacagaatacgtagaaatgtgtgaattgagagaagagccctaaggttcttacattactttacatgtgttttttaaaaaaattgttttaggaaatggaaaaggacatgctcagaatgtgcctgagagtccattattttaagcaggcaatgtttttatatctttatatttataactattttcttattctcagtgcattcaacttctacagaagttaacatataatgtcaaaattttctattctggtgccaatatagatgaattaattacgttcctgatagatcacatgtgagtatgcaatcaaacataaaaccaaatagtttatttgtttatttttaaattacaaccatgtggtagattaatttttcttagataacattttctaacatataaactgagtgagactccgattcttatttgttctgcccagatgattttaaggatcaaaagttgtaaaagtatgtgacctcattcattggtgaaaaaatgtaaaaaggaaaaaaaaattgtaaagcaactttaattttcataagaaaaatttatggactgaattgatttggccagaaaaaaattactgaaattgaaaattgtgtagttattcttgtaggaaaatatactgatgaaacagcacatggtccacgctgacagttacttccatgttttcatgatggaattgaata

SEQ ID NO: 107446 - DNA, 1103 bp, Homo sapiens
ccataactaccctctgggcttcatttttcattctcctccctcaaagtaagtagaatgtattagaatttatttgcatagtaaatatattggtactagagtgcagatttgtaggctatgccttcatcgcatgttcaatgtagtgtgaaggagaaatattgctaggaactcaaaagtttgctaacttaggaaatagaaatataatgtactataggatagcataataggccgaccgaactgagatggtataagaaactaagaaaagcttcctggtggaaattattttaaactgagatccaaatgattactttagctagggagggagggattaggtaattgatgggtactctaggcaggggtgaatttttcacagcatgtgtgaattttttaaattgggaaggtagcagtggcactttgagggaactgagttttttatttgaaatggagaagagatgaaaattgccatcgcttaaccaacacattttgattactattttataggtaatttctggacagaaactcacacgactatttacatcaaatcagatattaacaagtgaatgcttgagttgccttgtagagctacttgaagaccccaacataagtgcttcactgatcttaagtattatcggtttgctgtctcaactaggtaatgcatttaatttctcctttttagtttttggaagatgtatgaacaatattttaaagtgcaggcttagttatagaatctcttaaagaatgattcaccttcaaagacttctcagtctagtgtgcattgtgaatcttttgacactgaggaagtcatagctaccgatcaaagaatgatccttctgtaatagattacactgaatttagaactaaagggtaaaagtactgatgttgctttttctatcttttcccccatttctttagttcttaaatgttcatttagtggtcactactccaatttggggcagggcggtggggatatttctttgtgtgattataatagtaatatatgcatagtttaaaaaattctagtgatccagaagtattaacacagagcagcattgtccaataaaactttcttcagtgacagaatggttttaaaactgtgttatccaatg

SEQ ID NO: 107447 - DNA, 1034 bp, Homo sapiens
ggggcaagcgaccatttctcaggtagaggatgacgcacaaacgaaaaactggccatccaacatgaaggacgaggaagcgcacgaaatcagagcgcacagctgagtgaggaatcccccttctcctaaccgattcctctcccgagaaatcgcgagatttctcgccttcacgggatctcaggccgaaacctcgcggcctctcagacgagggtgggttagcgggggcagctcccaacccccgtcctggacccacaaatcacctcgacccctggcccaccccggccgtcaccgagaacggtcccctagggtgcctagggacttccggagcccgaccggatccggaagcttctgagagcgagggggtggggccgaaaatcaaaaaaagcgcggcgaaagctaaaggccggcgcacgctgggcggtggtggtccctaagccgggccgcggccggtgcaatggactccactgcctgcttgaagtccttgctcctgactgtcagtcagtacaaagccgtgaagtcagaggcgaacgccactcagcttttgcggcacttggaggtgagaggctctggggtagaggacagatggggcttcccctagcaattcttatttcacagtgaggccgaggagtggcggccccagcctgggaaagaaaggacagtccttcgatccctctgttgtcttttcgtactggtaaaggctagtgagtgtcggggttccgctggccgcagcgagaggcaagagcgctcactgaaggctctaggaaaagcgggagtggggcaaaaggttgggaagttcaggttgtttcgagtaggtaacggaaaaagctcggaactttatcttttcctttgcttctagttttggtttttctacgaaaccaagccctcaatacacaactattctcagtgacggaaagtcatgattaaaacttggttttgcccttcggtaatctataattgaatttgttgcttactgctcttacttgaactcgggttgaactcaaacttgaaaaacattatttcaacattaagaagcactt

SEQ ID NO: 107448 - DNA, 1054 bp, Homo sapiens
cgggggttgggagctgcccccgctaacccaccctcgtctgagaggccgcgaggtttcggcctgagatcccgtgaaggcgagaaatctcgcgatttctcgggagaggaatcggttaggagaagggggattcctcactcagctgtgcgctctgatttcgtgcgcttcctcgtccttcatgttggatggccagtttttcgtttgtgcgtcatcctctacctgagaaatggtcgcttgcccctagtctagacacggtgaggagctctgaggagaagaatcttgggccctagattttgaggcggcctgggaggggcctcgtttttaaatctctcctacacccgccccttctgcccggggatggtagtttctcagagtcaacctattggcattatgtggcaaattagtcatgccctgaccaaagtatttgtcacatttattcgagaagactacctcctgctgaccctgggccaggtattgctccggagggtgttactcgttagcgtcagtttttgtaagtgaaggtgtctgtttctctctggcatgattgattgttttataattctcgatgtctacgaaaatggcactattatttgcgttttttaaatcggagatagcttaatattattgcatgtgtatgtaatgaagcgagtcagttactggttttggagctttttgcttaatatttcctaacgtcgaataaagctttaaaaaccaggatgtagaaattgtaagaatagggtacatttccatttaattaaatcgtttatcagaaatcatgttttttcacttcaaaagaatttttttgaattactagatttttgaagacaggtttggtgttttggttttgttttttataaaagtttaaatctgaaagataaaaatgatttaaccagttgggacattcatgtaaaaatctttgggtagcttgtgtgttcatttatgctttcattcattccgtaaacaattatagagcgtgtaacatgggttagaaactgccagtcagggaacagagatgaagtagtatcccctgctgcgagggaactgtctagtaagggaa

SEQ ID NO: 107449 - DNA, 1048 bp, Homo sapiens
tgtagtcaggggatggaggaagggatggtataggcaacttaagactgtctttcctaccctcttcagtgcctctttccttaatatgatgttcaaaccaggtaatgtgatcactcacctgatttttgtttctatgaaggggcttttctatggggtatttgttcagtgtggtgttcctgtgttggtgacgattgttggagcttctatttggccatctttcttccatatcctttcctttgattaaattttaatgttttattttgagattattgactatcctctttcttcctgggtcaaattatcaaatatatctaaaatacattatcgttattattagatgactgataatgttttgataatttttacttgttttaataattattaattaagcttaggatatttaattaagcttgttgtactgaaaagtagcttagtctaaataaccaattaacatatttttttctttgtaggcacaccagattaatattggttattatttgacattactgtttttatatggagtagcactcactgaaagaggaaagaaagaggtatgtaacatgttatttgccctttataaatctttttacatcttggaataatcaggccaaagattataatatgaaactaaaaatattaaaaaaggaaacttaatattagcttataacttcatttcttttatttatcttttgaatgcttaccattcatgtaaaataaaaaattatttagcttctttcacttacataatacattttaatccattttctagtatagcttaatccctctggttttaatcgtatcccttttgtaaaatatgaattgtacctcaaattatttgtcaaacttaagtgcaaataagtacaaatctgggaattaactagataatttctaagggttctgttgaatttaacatttccttttttttctgatttttaatgatttctcatattttcttcatagctttgatatttctcttattttttcttcccaaatctgtatttctgacttcataaattaaatatataaatatgacttgttaattagaattaac

SEQ ID NO: 107450 - DNA, 1065 bp, Homo sapiens
taggaagaatgataaagaattgtgctctaacagttatcagaaaagcccttattttggctagtagtacttgccagttagatatgtatatgtatgtatttaaaagatggcgtctcactatgttgcccaagctggacttaactcctgggctcaagcaatcctcctgcttcagcctgctaaggagctgacactatcagtgtgcaccaccatgcctaattgccagttttagatacacaaatttttgttaccatcttaatattcactttgaaatattggttaaagaaggtcttaagtttatttataaataaatattttaaacactgactacatgatctttgtaatcacatgcagagatgccaggattcagaatgtgaataaatgaccagatgattgtattatttttaaagctgccctaatttctccagtttgagaagtaattgtttattgtaaaaaaaaaaaaaatgacttttacagtagccaaacctagttttatgttactacaggattatacagaagctgagaataaatttctggtgatgaagatgatgatccaagaaaatgaaatttgtgaaaactttatgtctttagtttattttggacgtggtttactgcgatgtgctcaaaagaggtaaggattttaattaacgggtagatgttgcctgtgaagtctcagcattgtgaaatggaagtaagtgtgcacagtatatcaggcattgtgacatttgtgctctactgttttatccttttcttctttgcctatttgtatagataatttctttaatgtagttgagaatattaaatagcaaacttaacaggccatagcaataagaagcagtctagcattaacattaggagcataggctttagagtctgatagacccgggttcagctacattttttatcacttatgctaagaaacttaatgttgttaagccttatatttttttcttatctctaaaatagaactaataatagtgtagggttcacttcatgaggattttgcaggtgattaacattgcctaggacacaaaaatgctgtacttaataaataaattatggttggagtta

SEQ ID NO: 107451 - DNA, 2604 bp, Homo sapiens
tctttgtaaggttgatatcctattctctggcttgcctgtttttttactagggtatccacaagacatctcacttcttgttcactgggtctgagcagcatgtgccatcaatatagtggggctagtgtgatgctttgtagaatgtcaaaatgatccaaatcccttcagtctatactgtgacaaagtaagagaattaacatagcctgagacaagaacaaagaatatatcctgctgtccttcctcagatgtgaaaactgttttattctctttactgatgagcattggagagaattcattttccagatcattgacactagaaagtccagttgtatggcagtatcattactttcatccctggcctatagaggacaaccaccactgagctcctcaaagacactggtgcccttcttactctgtagttcttattgtattaatgaatggggtatcctctgagcctttctaggaacactgaattagtggtgggttctgtgtttttatgtagtaagtcaattctaaccttctcacttccttgactcctttaatattcctcaagaaattttcagcatttcttcttaatttactatagaccattattgtgtccaagtttcaaggagtcttctcagcaccatattaggactggattcaggtgtcctttctaggaaagtaaatcttgaattacggaagagtttttccatatcagtgtacacttccccattcagccttgtgtttacccttggttcagcactttaaagatccactcccactcatgttcctgccagtacattctagtagggttctgcaattcttatgattaacaagctttttcgtcctgggcaagggctctgttttctcacttgggctctccacctgaccttagatttattgtctgaaggcaatgaggtaagggaagttttttttttttgagacggagtctcgctctgtcgccaggctagagtgctgtggcgcgatctcggctcactgcaacctccaactccctggttcaagggattctcctgcctctgcctcccaagtagctgggattacaggcatgcgccatcatgcctggctcatttttgtatttttagtagagatggggtttcactatgttggtcaggatggtcccgatctcctgatctcgtgatccgcccacctcggcctcccagagtgctgggattacaggcatgagccaccgcacccagccagtaggggaagatcttaagaaggaagggcatcatcttttgagacatgcgtctcagctgatatttttgcatggtctctaaataaaggtaggctgctctcctgtggcaaggaggaggtctttgccagtcaagagggttcatgggggaaatttaaggattcaatatttctaagcacattcacctaaatatccccattttagatcctagggtctactcattgcatatcaaagccctaattttagtgtagttctgttgaggctgtgttttgggtctcctttgcagctgttctacccttatggttaaatcctgagcttcattttcagcatagtctgccttatgtctagaggaggttcttttgatgttgccatagaagccttctagttttcagtgtcctgagttgatggtattagtcttgttgaggctgtgcattcaatatcagtttgtttcactttatgattaaatttgggccttattttcagcacggattatggccataggggatgagagtctctttcaattgcccccatagaggccttctggctttcacagtgtatcctgagttaatagttggctgacctgtgcctgtcattctctttcttcaaggcctccaagacagtttaaagccaaccaactctacagtccctttaattaccatggcccccatactgttcaagcttgagctactacataatctagtgcctccccttccacctgtatttcatgccaatctgccacaggtgagagtgctagtatttgtatttctatggcatgccagaggttatcaccaccctatttaccacaaaaaaagggttatttgttgtctcattggtaaaccatgcatctacacagtcccgttcaaactaaccttattttaaaatgcctttcagatataatggaggactgctagaatttcataaaagcttacaagaaattggagacaaaaatgaccattggtttgacatagatcctacagaagatgaagatttacctacaacttttaaagtaagaaattatttaagagtaacattttatttgtaactaatcagaataaccaactatatcatattcttacagcaagcatgttcttttattggcacataactttttatacaagaaacaacctttattgcattacctagtgcagaacgtatgattcaacaaggagggagaagtgaggtggcagtgttaacattttcaaataatgagaagattaataatgatactaggccagtaccctgcatggttagagtcaaatgtagctgttaactttttttcctaattatctttaccattattttgctgttgatttaaattacaaagtactaaatgcttagttcagaaaacatggaaaatataaaaatgcctaaagataaagatgaaattcatctatatttcttcttcaaatgga

SEQ ID NO: 107452 - DNA, 1050 bp, Homo sapiens
tttttatttttctaattatttgtattgatgttctactagcatctttattgtttttaatcagtaggtgttaaatgagttggggtttcttggaatagttattgccaaaaatattatatggtgaagagagggccagggaggacttccagatttgctatttttttgtttgcttgcttgctttttttgtcttacaatgcaaagctttctttccttttttttctgctaccacacagcctttttgcaaggaagtttgtaatgtgatagttttagtatgaaatctggcaatactgcttacttgataattccaatgaaagtgacagtgtagggttttcattgttggtgagctctatttgttcattattttttctccttcttgaattatttctaggagaagatgaaaatactcacttagccatgctcatactagaaatcttgactgactttggtattattttatttccactataacttaatttttttccttttgcagttatagaaagttgatatctctgaaaataactgatactgatataagaccgaagatcagtttaaaatttaatacaaaaggtattattttatttttatatgccttctgttgaaaagtatgttaaaatttttgacttctctgtcaactttcatgccattaacaaccacgtctttactgtgtttgtcattcactgagcttgggtttataccagcaagcagcgcttggtgtaggctggaaatcacagacaggaagatcagcacatctatggatctcacattaccttgacatcctatagagaggcatgctaggtctggtgcatagctgtgactataccgtgggattgtgttccagcagaggttttctaccaactgttccttcccttgctgcattccttcttaatagagcaagcattagagtacccttacatgaaaggaatgaacattttgagtttgaggccaagttttgaggctaagtaatctaaactaagctgccagcttcttaggagtgtgctaggaaatgtcctgcccagaacctggaggccttaattaagggaccctgggcccata

SEQ ID NO: 107453 - DNA, 1481 bp, Homo sapiens
tgatgctgctggtctctgggctaccctttgagtagcaaggagctagatcttttggcatttcttgatatagatctgagctatctagtatagcagtccctagctgtatgtggctacttaaatttaaattaattaaaattaaatttaaaattcagttccttagtcacccaaaccgcatttccaatgctcagtgagtattagtgcaaatataaaacattttatcacatgacgttccattgggcagtgctgattaggataaagtataattgtttaagtaaagtatagttagacattgacaattagcattcttggcaaatttcagaatttttaaagacctaatactgtgatgccatgttgttgctaaaggtcatttacttgaacaaaaccttggatgactgaaagacttctgtggtgattagtctttgttattacttttgcttgggaacatgttgtttttgtttaggttttttgacaggcagaaagcagcatgctaattgagcactggctgtggcaaagcactgtactatccttcattcttttggaatagtttttatcctacaggagcttaggatacaatgtgagagaccaaatagaaaatgagcattaatgtggaatgtcttgacttctcaaaatttattttcagatgaaatgcctatcttcaagcttgattataattatttctatcatctgcttcatataattattatttctggtactgacattgttcgacaaatatttgatgaggctatgccacctcctcttttgaaaaaagagcttcttatacacaagaatgtgctggaatcctactacaaccatctttggaccaatcatcctttgggtggatcatggcatctgctttatcctcctaacaaggagttaccgcaatccaaacagtttgacttatgcctcctgttagctcttataaaacatttaaatgtgttccctgcacccaaaaaaggatggaatatggaaccgccatcttctgacatctctaaatctgcagacatcctgagactgtgcaaatacagggatatcctccttagtgagattttgatgaatggtctcactgagtcacagttcaattcaatttggaaaaaagtttcagatattcttctgcgccttgggatgatgcaagaggatattgacaaagtgaaggagaatcccattgagaatatctcccttgattaccatcagctatctgtctacctaggcataccagtaccagaaatcatacagaggatgttatcctgctatcaacaaggtactaaatgattatttacttcagccaataaacttccattgattgaatgtctgctctgtgccaggcacagtgcaaagggcaagagattcagtgagctcatggttttgggaaaatggactcatcaggaaggtaatagaaattatagtgctagagatgtttccagaataccatgggaaatcctaggctaaagaagtccaaaaaagctttctggagagtatcatag

SEQ ID NO: 107454 - DNA, 1118 bp, Homo sapiens
tagaaagtaatactgtaatactcttagtttaatatgttaaatgccattgatactacctttatttggtatgttgcctttatagttttattttaatgaacataaaatttagggcttttaagatttttttcaaattgtgatcttcttaacacttctttttctgtgagattcttaacgtatcagtctgacttctccttatatataggttttcaagaacgcttgtagtgtagaaataaattggaattatatacattgtgtctaaaggtatatgaatacgtacagacacagccccaatactcacctctatcatctgaatcagtgattttcaagtcatgtttcaagactcagtagtagataataagaccaatttagtagatcacaactgccgttttaaaaaaaggaaataggaattaaaaaaatactagagttcatcacatacaatatgagtaagttttatttcatggaacttatatttcagttttatacttaggtataaaagtatatgcataagtgcatatgacatcatgatatatatttctttagttatgatcaaaaattttttgagaaacactgacctaaatgtaattatattactagtatgttgttttgatatagttgatatagattactaattcttatgttatttttcagaataaagactcaaaagaagaccaagtgtaagtattagtttatttaatttttaaatttttcttagtatttttaaggcatactttcctaatatgacacaggcttccttcctttgggaagttttctcactaagagaagaaggatagttccttgtcttaataattaacaagttgctgcttttttatagaaagtaacaaaaagttaaatgatcatttaacatttaattatcatttgctttggaagaatagaaccccttaccatttttctgtaaggctacttgagtcattttaaaatatagtctacattgtagttacactgtattttagtctagacattgtagtctagaccaaacctcaactaagacctaattttaaaggatgcatcactcctaggtttgtagcctaggagcagtaggttatgccatatagcctaggtgtgtagtaggctataccgtctagttttgttatgtccca

SEQ ID NO: 107455 - DNA, 1138 bp, Homo sapiens
attttatgatgctgttttcaactctctatttaaacatacattggacctaatcactgaagttgcttaaaccaacctacttgtcaagaaaattaagggggaacaaagaatgttatgatggtaaaataatgtagcagatgtggaaatgcttgccaatatttctgaaagtactgttttccaaagcaactgatgtaactagttataatttgtaaagtgaactctgtagtgtcataattcttgaaaacagtggcatgaacagaattaaacaggtaccttgattgagtgctactttaaatatgctaatattcattatgaatcttcaaaagaaagactcagtatgagcactatccaaacttcctttgatcatgaacccttctaatgctgagcatcttatgaaaccagtacaatactaactttggaagcaatagcttagatgaaaattactatacaattgtaaaagctcacattgattatgtcacgactacagcccatatgtggtagaaaaggaagagcagttgaggaaagaacaagcaaatccacactcagtcagtagacttataaaagatgatgcaagtgatgttcaagaggattctgcaatggaagacaagttctatagcctggatgaattgcatattctggacatgatagagcaggtaagcatgattagagagggtgcctgccttctcttattgttatctggtttttcctgtgactctttaaacagcatcaccctttgaaaagcccagtggtttatactgtttgtgaggagaaagagaaaagcataaaaggtaaggagggatatatgaaggaaaatagaataaggaaaaaaaagaacgcctaggagctggaaacttcactttagccctcaaaccatttcctggctttaattatagggcaaagttgattacaaatgcatttcttgcaaacgtttttcgaataccacaaaggaaaaaaaaagactagcataatcctactagattacatgtcatgagaaaaatagttttgtaatataaagctgctttcatttttaaaaattaaatatgattgttaccataaaatgtctacagaaaatattgatgtataatcatttttttttctggctccattcctggtagttgtcactgcttggaatgatgtacct

SEQ ID NO: 107456 - DNA, 1003 bp, Homo sapiens
taaaaaatgatgagttcatgtcctttttagggacatggaagaagctggaaaccatcattctcagcaaactatcgcaaggacaaaaaacgaaacaccacatgttctcactcataggtgggaattgaacaatgagaacacatggacacaggaaggggaacatcacacatcggggcctgttgtgaggtggagggagggggaagagatagcattatgagatatacctaatgttaaatgacgagttaatgggtgcagcacaccaacatggcacatgtatacatatgtaacaaacctgcacattgtgcacatgtaccctaaaacttaaagtataataattaaaaaaaaagaaatggtaagcatgccggtagtggtatccagcagcagcagcaacaggcaagtaactggtactgtttattaaatgctgtaattgaggggaggtgggtttatctaaattgagtgtttgacttgagacaaaaaacgtgaaaggagttagatggcaactttaaatccctttcaaataactaaaatttttttttgaggaaaataatacatgcatatttcctgtgctcaatagggctcagctggcaaagtaactacagactatggagaaactgaaaaggaaaggcttgctcgtcaaaggcagctttataaattgcactatcagtgtgaagtaagtatttttgccattagatctgatggaagtgagaagtatttcaaatattaaacttactggtgctttctgtttgaaaagaacttagtttgcttttttctttcaatttctggtgacttgaacataattatctgaaataatattttttattgatcaggatttcaaaagacagttgagaacagtgacttttcggtggcaagaaaaccaaatgcagattaaaaagaaagacaaaattatcgcatctcttaatcaacaagttgcttttggaatcaataaggtttccaagtaagtgtaaatcttttgataaagggaaattctgcgccgtaataaacagta

SEQ ID NO: 107457 - DNA, 1904 bp, Homo sapiens
taagctgaagcatgaagagctagagacatttttccaagtcattgcactgagatgcaagataacacttctcttttgctttctaatttactgaattagaacttagttcccctttctttgggaagtcagtaaatcagacatcagaaacaagatacatttcaaaaggaccaggtataggagttcagttgtattcaggctcaagatttgtggccccaaatggacatactttatctcctccacagctgtagttagagctcttctgactgtgttaatgagaaataatttctaacatcttttgactttcttgcttgtttgcttagattacagcgtcaaatccatgctaaagataatgaaatcaagaaccttaaagagcaactttctatgaaaaggtacaaacttagctttttctttgggtgcactctctctgaaactgtatttcactcaacactttctggctggcatattgatgtaatttatcattcaaaccggggtacttttgaggctgatattgaacagtactaataatacactgggacaaaaggtgtaaactgggagtatcttaggcaaatagggaggtatggtcactttagctctgactctagaaaactgctagaagaatctgtatcagcaaagttacagtcccagagcaaactactgccagagattagaccttaagagttaccccagtcagtactattagatgtgactgctttatgaaactggccaagttttattcttattcatctgttttgcctgtgggaaatttttttaataacacctttttgaaatccatttcatacagcataaaattatctctgttaaaatatacaatttattgatttagaatattcacagaggtttacagtcatcaccactatctatttccagaacatttttatcactccaaaaaagaaacccattagatgtcattccctattctcccctcctctagcttctggcaactgctaatttattttctgtctgtatggatttgcctcttttggacatttcatataaattggatcatataatatgtagcctcttgtgagtaacatttttcacttaacatagtttcaaaattcattcatgttgtagcatgtatcattactcatacctttttatggataaataatattccattccttggctataccttattttatttttcatcagttgatggacatttggcttgtttccattgtttggctattatgaatactgttatcaatatttatatacagatttgtggacatgtttttgtatttcttgggtatgtaccaaggagtagaattgcttggtgatcagtcaactttatgtttaactttttgaggaattgccaaactgttttccaagtagctgcaccattttataatcctataaacagtgtatgagggtttcaatttctccacattctgatcaacatttgttacacttgttagattacgtctttattttacccattgtattatgtgtgaagtagtatataaatgtggttttgatttgcattttcccactgattaattatgttgagcatcttttcatgtgcttattggccagttatttatcttcttggagaaatgtctattcaaatcctttgcccattttaaaaattagattgtctttttattgttgagttttaagagttcttgtcccttatcagatacaagtcccttatcggatacatgattttcaaatactctcattctttgggttgccttttcattttcttaatgtcatttaaagcacaaaacttaatttgatgaagtccgatttgtaatttttttcttttaggcaacttttacataatatttaatggtataataattaattccttttgtgttaatatatctgcttgaagattttatttttttctcctcaaaaaagtctagccttaatgatatttataa

SEQ ID NO: 107458 - DNA, 1033 bp, Homo sapiens
agattgtgagataaacacaatgtagaatttcataagtaatctctaaaatttttccttccgtttttaaaatgaacatttgcaagtagtttaactgcttgttacaaatatattttttcctgttttttagccagtataatatttatagcttcttgaatctttagtctctttttttatttgtatcagtggttcctattttagagctgaaaattttggaagcactgaggaattatcacaagaatctgtgaattatctgtgtctctgtttcttattaaccaataacgactcctaaaaatacaactgtttacatgtggggatggtctatagaatttttttttttttttggtcagaacctgtttttatattatttctgacaggttggcaaccactcttgtatgttgtattattcaaaactacatcagatattcccatatgctgtctctttaaagttggttgttctctaaagtatttttagtcttcttctaccagacacagtacaatgaacaaataaacaaagtcaagcaaggatttgccttgagtaccttgcctccagtccagcttcctcctccaccacccagtcctgagatactggtaagaaatacaacattttgaataattgcccttttcattttgacaaaatggtaagggctgtgaaacactgaatatgcagtatgtttaacgtgtgttcaaaatggaataggcacatattgtgagtatcacttgtaattatgaccataccttcgagtcaccagatgatataattagatgggtgaggcctatacaataggttgtatcactggattttagtgaagcatttgatatacatagagtaatattttctcattcaccctatttcacctaccttgtgggagctaaataatgaatactcagacttcccagtgtcctcatgttaccactagatcagaggtccccaacctctgggccacggaccagtgcacagcaggaggtgagcagtgggtgaagaagcaaaactttatctgtatgtacagctgctccccattgctcacattaccac

SEQ ID NO: 107459 - DNA, 1046 bp, Homo sapiens
aggaagaagaagagccttgtgtgatctgtcatgagaatctgtctccagaaaatctttcagttttgccttgcgctcacaaattccatgctcaggtaacactttaaattttcccattaatcagctaaatgagattcatactgccttacttattatcatatacatgtatcattatccattgttgtctcacaagttccactggatataactctgagcttttgggtaccacacagaaacatttatgcttttcccatacatagccatggattgcattgtgctctctcagatctccatccaccctacagaagaaggggacaatgttgagagtcagatggtacacagtaggcagttccttcgaatagaactgggacaaatgtcgattgacgtggtagtttagtggcagaactagcaacagcaccacttgaaattgacatgctataaataccacatagtgtcctttgtccataattaatgacagccccctttcataaagcataagatttatcagtctcttcaggcttctatatttgcttttgaaagatactcaggcttgagttttgatgttagaaaaatgtgaggcatggtggctcacacctgtaatcccagcactttaggaggctgaggtgggtggatcatgaggtcaggagatcgagaccatcctggctaacactgtgaaaccccatctctactaaaaatacagaaacaaaattagccgggcgtggtggcgggtgcctgtagtcccagctactcaggaggctgaggcaggagaatggtgtgaacccaggaggtggtgcttgcagtgagccgagatcgggcccctgcactccagcctgggtgatagagtgagactccatctcaaaaaaagaaaaagaaaaatatgaggttggcatgtcttttgttgattcttggcatttatatagattaaattctggtgttactgccacacagttgctattggtatataattaatgatccaagtcctctgttgcagagatgtaatttgacacaggaaaaggtagtcatagtaaagaaaggcttttcagggaagt

SEQ ID NO: 107460 - DNA, 1341 bp, Homo sapiens
gatttgtttttggagagtcagcattcaagcaagtgacttaacagatagttcatagccgaaaattactgtcattatcgccaaagaaaacaatctgagaagtgtattcatgatctagggattttaactgcaaacaccataagcatttcataccaggtactagtgacttttgtatcattagttatgactttttctggattataaatgagaacagtatatagtaaaccaaagaatatagcaagtttctccaatttccttgtcaggaaggattgctagtcatcttgaaaattgaggttgaaggaagcatttctagtagaataaactggctaaaaggtattgtgcagttaccacctattttgtttagcaaaccacagggaaggtgccatggttgcagcaattggtttgacgatccacagcgtaaggctttaaagatccaccagaagacatgttggttggtaaccctgatgcatagagtgacaactgcctctgctaggctacatctgagagactgacataaatctttttgctccttagtgcattagaccatggttgatgcaacaggggacatgtccaacgtgcagactccacgttttgctaccagaagaattccctggtcaccccagccggcagttgcccaagatctgatacaaggtcggggtgtctatgcaaaggaagctcagttttcttttattatgagctgcttgtttgagtggtgtaaaactatgtgctcttcaatatagtgctaaagaagccagctaattttatcaaagcagcagccaaagaagtcaggacaaatcttcaggacttgtgaaatgaactgaaagagcttgaagcagatggaattttaatagttacactatatatgctcttagtaggtttttttcttgtagtggaaacataactgttagcatatttcttaggatgttttttcttgtctttttaaattcttatttcactcatcctttactctcccctcaagtattctacactttaatttcctgaaataaatttaaggaaaagggaaatagtaaagaagtaggaatgggtgcagcacaccagcatggcacatgaatacacatgtaactaacctgcacattgtgcacatgtaccctaaaacttaaagtataataataataaaagaaaaaaaaaagaaagtaaaaaaaaaaaaagaagtggatattcacggagagctatgaggggataaaagggtatgatctaatggtaagaaactggaagaaacatagcaagtcatttgttcagattcttctctgtgtccctgtgtctccagagataaggatgtccttttcctccaggtatacagtgggtacctctagaatgagggtc

SEQ ID NO: 107461 - DNA, 1100 bp, Homo sapiens
gtgttcccagtgtcttgcccagtagatacaagataaatattgccagaatcagatatcaggaagtagtaagaaaaggagttaatatgcaaactaaatcactcgctcaattgaataattgagatcttctgttcatttgttccttggaccttaatcatttgcattttggagaaaattttttctgctttaaaagtctgtaatttcagtttttgtgtcggggagagggaaaaactatttgtctgtagttgctttttgtgacaaagtgaatacccactgggctaagtttcatatctaaagcttgtcactaagaattttcatttttaggggtcaaaaacctattttgaaaatagtgttgtgtgaatgctgtaagtgttgtacatgtctctggtttcagaattaaaagaattcagagttaccttgtgagataaatgttctttgcttcatattcacagtttcacctccatttaaatttatggggaagaataaatgtttcctgactcagaaacaattttgcctccatatttcagtgcaaatatattttgaagttacttttaaatatttatttaaaacctctgtttctgtaactgtatgttaaacgtattcttctgtaatgagaatagactggaacatgtgagggaaaaatatttaaaaaaagatggcagtcatctagacatgtaaaatgccaagaatgtcttagaattgcacaatttagaatttatagagcctttaatcaccttgtctagcaccttgtattagtccattttcatgctgctgataaagacatacctgagattgggcaatttacaaaagaaagaggtttaacggacttacagttccacatgactaaggaggcctcacaatcatggtggaaggcaaagaggagcaagtcacatcttacatggatggcagcagacaaggagagagagcttgtgcagggaaactcccatttttaaaaccatcagatctcatgaggcttactatcacgagaacagcatgggaaagacctgcccccgtgattaaattatttcccaccaggcccctcccacaacatggaataatgggagatacaagatatttgggtggagacacagagccaaaccata

SEQ ID NO: 107462 - DNA, 1031 bp, Homo sapiens
tatgtaaatcagaaaaatttccttctgggaaaaggtgtcattgccattctgtgataaatagatgcatagtcaatgagcagacattcatcaagacacagatttgaattcacgtttctatgtaccaagtaattagcgtcgtgtctaggaagtagttttgtaaggcaggaccctcccaaatggaagacttgcagcatgtgagttgagtttgctgccaacttgaccttcaaggtgctggagcaagatggctggaaactcagctggaggtatgggagcatcagccttgagggtgaaggaggggaaggggtgcttaaaggaagcaccacagacagaagaagaaaagacatacttttaatgtgtgtgtttcagggttgctatagaacttaatattattttccttatttagtcctcaaatcatggtgcaaggtaggagttatctacatcttaaagaaagaaaactaaagtgagaactcatctaagacttcaacctaggtcagtgtgactccaaagcccatgctctttctgctacacgacaatgttttcgcaaaagcacctgcacgtcagcataagtgaattatgtccctgtgataccagttttgctgagaccagattgcaactctcagcaattgtacctgccatctgcttcctgtgcccagccttgaatctgtaaagacatgacatcagaagtgttaatgctatatatagcttaaaaggctttaaaaaaattaaagaaaaattctctttaattgatgaaatcaaagtgtcaaatattcctcattcttagctacttgtatgaaataaaatcatgggtaaatgtcaaaacttgaaataattggccacagaaataaaataaatctgatagaaatatttttattacctaaatacttgtgaagtgagttggagggagatccacaacattctcttcataggctaactgagatattatacctaagaaagagcaataacatttttttaaaaaagagcaattaacttttacaaagctttcaacatttgcacatcactttcactaatac

SEQ ID NO: 107463 - DNA, 1033 bp, Homo sapiens
gtgacagaaaactaaggggccgtctatatgtgtgccatgggtacataaagaaaggggattctgagtccaaaactactaattcagaagcagttcttctgacttttagttacagtcctggttaaaaaaaaaaaagtcagccttggccgggcgcggtggctcatgcctgtaatcccaacactttgggaggctgaggctggtggatcacctgaggtcaggagtttgagatcaacctggccaacatggtgaaaccctgtctctactaaaaatacaaaaatgagccgggcatggtggcgggcgcctgtaatcccagcgactcgggtggctgaggcaggagaatctcttgaacccgggaggcggaggttgcagtgagagcatgccactgcactcccacctgggtgacagagcaagattccgtctcaaaaaaaaaaaaaaaaaaaaaaaaagccttgaagcaagtaatatattaacagttatataaccatccatcccaccatcaaattctgccattttctacattctcaactcacctcttctattcattaaggagcaaggatccaggctcttaaaagggaaatgaaacacttgtaggagaaaggctgattgaataagggtgaagctgggttttattttatctgttgcaatatcagtttaggaagacagatgcttataagaggaagcccataatgtctacctgaggaatttccttgcaaaaggctactgtgactgtagtcctaggtctgcagtaattaactatagtattcagaagtggtcaaacttggacaattgtcttgccttccccaaacccacatgagatgacttctgattcacagtggacctgctaagctggctgcattctgggggcagatggctagggctttctgatatccagaaaacctattaataatcaagagctcatttggtaaatattatgagaagtcatttgtctcagaaccccttgaattattacagtcatggtcaagtcaagaacaacagtgtgtgatctcagatctgcataaagatcacattatataac

SEQ ID NO: 107464 - DNA, 1006 bp, Homo sapiens
ccagcaacaggagagtgcaggcagcaccttgggaagaatcagaatgtctggcctcctgtccccactctgacccttacttggggtatgtaatcttggacaagaccattaacctctctgtgtctcaaatcgttcatttccaaaactgggacaagacctatgctgcctgcattatcgttgagctcatgtgaaataatgcagttgaaaacactttgaaaaaatgtgcaatccagtccacaaatgaatggaatgtttgtctgtaaaatgcagataactctgacctcagccctcacaggtttgataacagtgcagatttaacagtacttcttatcaagcttgtatttccaaacgaaaggtgtttctacaggtgcaggagttgctttcctgccatttcttgtttttaatttttcttaatgctttggacatttattcgtgctgttttgggcaacatttgccccttgcaatggctgccaatcatggcatgaaattcattaaatgagaatcatcttagtattttgactatcgtcttactataacccaggactcatgcttgggagccccagctctacttgaaattcagaagtgacctttggttatctgctctctagcttctttgtataggagcccttaaaaattggagcaggcaacatgccttttaacttgtgtcataatcactgctgttcattaacccgtggctaccctgcaacctataacgctgtactgggttttctggcctacaaggtgaccacaattaacggtttatattcataagatacatttactggaagcaaatgatcttatattacattgtaaatcattaagttgcaatctcttaagggttcagagctactagcatggaagctctcaggaagcatttgttgtgataataaagtacatcatatttgtttggcacttcataatttacaaagaattttcatatatactatcaagcacaacattttggttaagcttctcacagaattttacctgttaaagacatcaactttac

SEQ ID NO: 107465 - DNA, 1032 bp, Homo sapiens
ctgaatcctaaatggcttcaacctttgaaacttgagagctaagaatgaactcttgattcctgcttcattttctgctacagtgacctatctcttaggcaatgaatgtctttatgaatgtggggagacctggatgacaggagagattgccaggagcaaactcacatagttaacatctgtattattatctcactgcacttgcaaatatttactaagcacctggaggcatggaggagggaaggatgccacaaagatggataataattagtctctgtcctaaattgactttacaatctagtggggaagataggcacatcctcagaaaataaaaagaagtaaataaagaatcaaagcttgagagaggtttccctcacattgtactaactctgtggttccaaggttccaaatggacccatggtgttaagggctgcttttaaacctggtaatatggtgaagggtcccctaggggaattcttcaatcccatcccagcagggcaggtaagaatagaaaaattacattcaaatattagggttgtgtggggctaggggtgtgtgaataggtagaaaacatgattttctgttccctcgaataatttataacctaggtgaggaaaaaagttatatcgagattatataaccaatgaataaagcaagacagtataagcaggactgactgtgtgatccaaggttcatttgctgggatcagaagatgcagcagaggttgagcgatggacttagttaggaaaggctttctggagaagttgaggcatttggggatcttgaaagaagtgaaaaactttgattattactcataaaggctaacactcaacacttctgtgccagtcacccttttatgcattttatgtttattatttcatagaatccttacaacaatattatagagtagatactatttttctcatccgcatttacacatgaggaacctgaggcacagagaagttaagtaacttgccagaaactacacatcaggattagaatgctgactgcacccttgaattggtgtgttattccacc

SEQ ID NO: 107466 - DNA, 1025 bp, Homo sapiens
tgatgtcatatcccatgccagccgttaggttgctagcccagtatttgtgaacgcattgtacatgtcagtggttcacatgcaagagtgggaacatgtggaaaggagtcctgggtggaagcaaggatctgctgtcagatgaagcccactgtcaaggaagcagggacaatgtccaaacaggtgtgtgtgtgtccttggtgtgagagccctctcagtgtccaccacaggaatggcccgacccatcccaggagcttaatttagatggcttggaagttctgctgctattcatcaaagagattttatgtttgcttaggaaggaagtgagcctaagcagtaatgacaaatgccacaaaaggtgtggggatctcaatataaaatcaggtggtaaaatgacaagggtaaggattgttcattatcaagtgatactaagaaatgatgtgcaattatgcacaggaaaagtcatatatttaattagatgaattgataaaactagcaactgtccagaatccccaaagatttactatttctatgcagcttctctgcagttttctttttttctttgtgtttttataagttcgactttattttttaaattttatttttaaaatgaattttattgtgtatgtctaaggtatgcaacatgatgttatgagatacatatggataggaaaaagggttactgtaatgaagcaaattaacatccatcatctcacataattacccattttttggtctttgtggcaagagcagtaaaatctactcatttagcatgagttgcgtataagtataattttattactgtagtcctcatggtgtgtgatgaatctccagacttgttcctcctacatatctgctacttttatcctctgacctacatctccccatttcctcttctcccaccccactcctcgtaaccactctatttgattttttttttagattccacatgtaaatgagatcatgcaatatttttctttttcttttatgtgctatagatggaaattattttaaaatgcatttcatacttt

SEQ ID NO: 107467 - DNA, 1222 bp, Homo sapiens
gccagtggcatgtgtagatacttgagagaccagaaaaaggtaagaacagagggtgggggagagaaaggaagaacactgccagaagacacagcccaatatgttcctttatctgactactacatctgaagttcttcttactactatttaattctctttacctatttttctctcttatacatagacttctttttaataatactcaatgtatgattttttcatgtaaaatgttatctaaatatatcttcacaatactcaggtatgaaaaggcagaaacttttattactgttttacagatgaggaaacacgagaatgtaagtaatgtttcaatatagttaataagtggtagaacaaagcatagaatctaggcttcctgattgcaactcaaagttcctgccattagacccactgtaccactcaataatgtaggcaaaatttatggctaacaatataacaaggatcaccctctctaaaatattgcgtgttcccttcacaaaaaactatgtctctgcatgactgtaagcatgttagttaccaagtgccaagtgaccttggttttaaaactgggcagataagttaatctcactggctttctattcttatttagcttgttgctgtaagaggtttagagtagctttctgagggcatatgttagccttcagttttagtgaggagtaagggactaaatccagcaaaaacttaagtgaaaacaacctgaggaaaagctgtagactgtgagtcaagatggggaatggcaaatctatagctggtgatcagaaagcagttcctacacaagagacccatgtgtggtacagaacatttatgatggaatatccatccggcctgcaaacactacatgaatttaagacacttttgggtctgcaaggtctgaatcagaaggccaataaacatattgatcaagtttataatacctttgacacgaacaaggtaagatctttcatttttcatttcatttgaaaatgctgtggttctgcactcttcccttttttttttttttcctgtaaaatagccttaagtaaaatgtgtacatcccactgaatggagaggtcttcaggcaactcacagcttgtaggtaagtgagtcattaaatacttttagtactgacggcatgaaaataattgggaactagcctctcccaccctaggaagtgttctgcatgtagggagttattttaaaaccagattaaatctcggcatggaattct

SEQ ID NO: 107468 - DNA, 1405 bp, Homo sapiens
ggtttcaccatgttggtcaggctgctctcaaactcctgacctcaggtgatccgcccacctcggcctcccaaagtgctgggattacaggtgtgagccactgcgcttggccaattttctttaaagtagaatttatatgaagaaacagtttctggatctcaggtccttatattcttgatccatccaaagttttccttcctcaaaggattttcctgcctccttgaaaacttttactaccttcctctgccatcatctgtatccattttttctttaatttaaaaattagtgattaataaatgttaatggtgataaaaagtcagcacctctgagcatcctctggcagacatttagaaacagtcttaaaggggacttccccaaagaatgctttttgaaaattctagcaggatatttctctaattcctagctgaataatcccgaggctgagtcctcactgtctcccctttgtcctttttactgtccaaaaaagagtatcattcactttaatggtttcaagtaattctttcaaatgggttcaaatgggtgagttttacattctatgaccttattttcacctttttttttttttttttttttttttttttttttttttttttagacagagtctcactgtcgcccaggctggagtgcagtggcacaatctcagttcacttgcaacctctgcctccaggattcaactgattctcttgcctcagcctcccgagtagctgggattacaggcgtgcaccactatgcccggctaatttttgtatttttagtagaaatgggatttcaccagttgcccaagctggtctcgaactcctgacctcaagggatccacccaccttggcctcccaaagtgctgagatttcaggcatgagccactgtgcccagcccttttatttaactctaattatgacatcgaaatgtcccattgagagtctacattgatatgtttgaaacaaaattaaccatattcactgtaaccaccaccacttctggtcaaggcagttcatttaggccatgatggctacttcttaggaatcaagggtttcataataaacaggtaatcagtcaggactaaggaatagggacaaagacagagaccagatatatgagctgggccaaaatgaaaataaaagaaagaattgagtgaggttagaaaagagaactgtaggccaggtgtggtgacttgtgcctgtaatcccagcactttgggaggctgaggcggatcatgaggtcaggagatcgagaccatcctggctaacacggtgaaaccccatgtctactaaaaatacaaaaaattagctgggcgtggtggcgggcgcctgtagtcccagctactctggaggctgaggcaggagaatggcgtgaacccaggaggtggagcttgcagtgagctgagatcatg

SEQ ID NO: 107469 - DNA, 1043 bp, Homo sapiens
ggtgggtatttttcttattgatttgtaagaactatcttcgcattagggatattatcttttttatatgatatatattacagatattttctaacaaactttttatttttgtttttatggtgttttgagtcatctgggatttttttaaagattacgatttaatttccttttgtttatggcttctatggtcatatttagagaggactctcctattctaaaattataaaacaattttgctttgttttcttatagtgatttatattgttaaacctatgattcatctaaaatttattttggtgtaagaagtaagttagaaatcctttgtgtttatgtatgtgtgtatgtgcatttccacatagccatagctttgtcccagaattattaattgataatcagttctttcctactctcttaccataccacctttattgcatattaaattcttatttgtaattgagtctagttaaaaaagaatctatttatttttcattgagtgcttcatcttttctcatgccagattcatggtgtttttggtagggctatttaataattttatttttcaaaattttttgtgtattttttgtgcttgattctcagaattacattttgtagccaccaatatccctcaaattctattttttttttagatgggggtttgtggtgataatacagattaatatagagagaactgatatggtttttaatagtaagtctttctacccaagaccaagatacgcctttgcatatcctcaagtcttcattggaaccctacagtaccattttaaaattttcttcaaatacatcttgcacattcctagttatatttattgcagttagatttattttttagcctatcatgaatgaaggctttttcccatgatcttatgactggctaatgttctatacagcaagactcctgattttttaatacaatattgtattcaatataagaattctcattttacaaataattttaaagtttttttctgcatcagcaaatgatcattatgcaggttttctttttgtttcttttctctttttttttt

SEQ ID NO: 107470 - DNA, 1553 bp, Homo sapiens
tcaaatgtaaggtggcttttgttgcagcatgagtcatagggaagactgttaggaggctgcccaaattacaggaataagctctgcagcttctttccctggtgtgactgttgcttctcttttccagggtggtccagaaggtgacctggagcagactgacacttatttagaagctttgcttaaagaagataatcttctcttccagaacaatttaaataaagtaactatagatgcaagacatagactccctttagaaaaaaatgaaaagacttcggaaaattaagtcagagatggtattaccttttaaaaaatgctaataagaaaattggaagattcttttaaaaatttttcttttttgttgttgttactgtaaagtctattctgtttaacaataagaaataagaaataatttttttcaaataagaaaattgtgtactctagaaatggagaccgatttacaatttatgtattccctaatccaattatctaaatcttccttttctttcagaaatattaataatatctagagttctctaattttcatgtgagctactgaaaaaaatgaaaatgtcactcaagcttaacttttgttattccttaaaagattgttattgtaattttgttattccttaaaaacatttaaaagcagattttttcaaaatcgatatgtgaaggactacagaatcacctcctcttgaagatattgaaaaagaaagacattatgccctttctccactatagccaacactcagtcaagcagaaaatacaaatccccccaaaactttgagacatagcttatataattttattatttagtcatagtaaaagaataaatctcctaagcataatatgtatacatattacacatatgtaaaaattgttgttttacatttacatatacgtaaagaagtatgtttttacacttttcttgataagtgttttttttttgtttagaaatgtctgaaactttagacaaaaacagtaaaacatttaatattcatttgtgaaactgtataattttaatttatgtatatgcacatagcaaaagcctggaacatgggaaatggaatatggtaaactatttcatttttgtctttagccacttaggtactcttctcaagaggcatgtttttaccagttcctcgtaaatctgtccccaatcaatatctgtaaaaccatatatatcatgatatagctatagatatggatgtaatagcatccaaaagatgctgctgttgcttttttccactcaatataccttcaagatcattccatattgagaccagtacatgtaataatacatatgtatagagagctaatgagataacctctcgttatcttcaactgctccttattattttattcaatggaaatactaaatctgtttaaccatttccttatcaatgcatgtttaggtttttattgttcttttggatttacatatgcacaacatttgaatatccttataaatttgttcatttcacacatgtacaattatgtctgtcaaatgtctcagcaaacaaattgctggatcaaagggtatatacatttattat

SEQ ID NO: 107471 - DNA, 1025 bp, Homo sapiens
atcagctaccatcagaattggaagaacctgcattaagttgtgaggtaagctggttttttttggaactgtgagggaatgatagaatagcctgaatctcagtgaagaaaaatgtaaagtgtttccaataagaggacctagagtggcttaagtgaataaagatgagcatctttataccaaatggtgattcataattaaagctatatttgaaattattgtggctgtgagttaaacaaggtggaaaatatcttacagacagatagttgcagagatgaaaagaaacaggacatagtccctgacttctctctcccccaccaaaaacagagtttctgttccttagatacatctcctcagctgcttcttatgagcagctgagctgaggattgggtaggtcaggcacattaggtatccaaagcactaatcttaccgaaatcaccaagacatcactgagatagatgaagaaaattgtgtttaccaaatctcctctcaggaacagtaccagatgtgattggaaagaaaactttgaacagctgcttggggtgcaaagagtaagcctcacatctattggctatgcttaagtaacagtgagtagtctacaaagggctcccgcagggctgtggtgaagttgagtgaggtgcacatgcctgacaagctgctcagcagaagtggagggaagagctgcctagtgcaggagggtgggaggccttttctccacctccatgctcggtgttgcctgtggagatgatggatacacttggtattggtgaaaatagcacaaattatgaatgcaacagagggactatatgagtctgatcttgggcacaatccctaattttctagtctgtaatcattgtttctgcctctttaccctctactctcacctcatcctctcccgtggggcttctgattccacagctgaactatgactgttcttgtcagggccaccagtgacctcttgataagtgcagtgtcactcttacctgacctgtcagaggccttcaacctaggtgaccactttcaccttcttg

SEQ ID NO: 107472 - DNA, 1017 bp, Homo sapiens
tgcctattatcccagtactttgggaggccaaggtgggaggattgcttgaacaagcagttcgagatcagcctgggcaacatagcaagaccctgtctccataaaaataatagtaacaataatagctataacaataatagctatcaggtttgaacctttattatatttcaggcatccacccacttactttttataaattagtttctattctcacaaattcatgagaatggtgttatttttaaatattgtgtatggatgaggagactgaaacttggaggaactaacacattacaagtctcatggacaattacacaaatatgaaggatggggctggggtttaaggcaaggctttctgatttggaatcccatgctcttaatcatatatagcatataccctctcttcacactaggagacctagagagacctgtctgagtgtgttgcagcagagtttggatgcatagctacttaaatttctttttcagatagatcaactttctttttcaaattcattattttcctgattttttttcttggctaatttttatttgtctaagtgtaacatttctattaattttagtgagttacatgtgatcaaaaaggggataatctgattgagtgtactaagactttaaattgcatccacttctatcattaggcatcactagaaaattaaaatttcccagaaactctaatgaacaggcagactctttattgcttagaatcatcatactgttaccaactgagcactctgaaagctgaatgcgttaatatatcagctctattctgtaccagcttaaattttgtatggtgattattttattaaaaatattctatgataaaaaaatttggacagaacacaggatttaactgaaacaaaatgagctccttgtcataccagttttctcttttgctttcagcaacatgtagtatgttttctcaaatttcaccagtgaaaacagatttcttgttttctttgtaaggtattttgttgtttttcttgttgttgtttttgtagtatt

SEQ ID NO: 107473 - DNA, 1132 bp, Homo sapiens
ttttttggtttgttttagtcttggatactgaacttattgagggaaattgagttttacttgttttgttctgtgtagaatgttaacatttgtggacatggtatttgaggaatttaaatgtctgggtctcatttctcaaaggatggagacaaggagaggaaaaagttcatgattcagggtttttccaaatagagactgataatagatgggggccttaaaatcaagtcaaagaagtctatatacagacttgtgctctaaaataggtgccatatgggagggtgggaggtggggctggtagcaccactaaattaatgtacctcattggttttgttgggatccacagacttttgttgggttttaagggtcttgtgtggggtgagatgctcgggccagggaaaacaaacaacatgccctacctggaatggtatttttccttaggatagctacttgattttttcgtcagtgattgacatgatcttcctgaagatgagagttctcaaacagtagaagcaggtaggaagaaagagaaaggtggaggagaacacgtacatagggactgtagcctctactaaggcccaggctgtggtcctgtttatgagaggagactgctaaccccagtagacttgaactcaattccacagatgccatgggtgtggtgaaagtctttgtagcagcatccagagtgcagggctgtgattactacatgggcatgaagaccccacctgctgtctcatgcctaacaccagtcctgccccaggagggaggaagcactcctggttacatgtggaaggaccttgtagagggatctattttcactactgacactagggatccagagacaagttgttgatggagcaatgaatacagactgctacattccagaacaccaagttctgaccaccaaatatccctttcggtctggttggcagtcttccactagcctggaaatgggacaaaagcaggccagacctcagcatggttcaggcattataaggttgaaaaaggccttggccgggcgcagtggctcatgcctgtaatcccagcactttgggaggccgaggtgggcggatcatgaggtcaggagatcgagaccatcctggctaacacggtgaaaccccatctctactaaaaatac

SEQ ID NO: 107474 - DNA, 1042 bp, Homo sapiens
gaggcagtctcctggtggctgaaagttccactctggagcttctaagcataaagttacatgaacttgccctctagggagtttctggtgaaggggaggtaaaaggttataattgtatttctaaaggactatgtaggtaagtggggaatggggaaatggagaaaagagaaaataaaaaataatagtaactcattttctttttcctagaaaaatggggctacttggttacagtatgttttaatttgttgctttttaagtatatccattgtagatttttgccatatggttaccatgaggcttacaaaaaatattgtatagttgtttaacaggtttaaaaagtctctttcatcaagtgaaagacaagtagtatatgactactgttaaaaataaattatcaccaattccatttaattgtcactacctaaaaactttgaaaaaaatatgtgactggaataaatataaattcttctaattaagaatttgtttcatgtaactacagtggtggcagttttcggcattacacgcatgttcttgttctcatttgttgtatatgaacatttcactcatttttgtatattagtgtttctgaaattattaatacctaacatgatttctactttgaaatgacaaacctcagcttgctcaatgtgccgatggaagatgtgaatctaagttctggacacatagccagagtttctgtgagtggcagttgtaaagttgcttcttcgccagcgtcttctcaaagcacacctgtcaaggaaacagtgagaaaactgaagtctaagttaaggtaaagatatttactcacatatttccacatgctttgtttaactttctaagcagtgacaactcctgttgttttccctactgagttttaatgatactgaataaattcagtagagtgacattatgacttgtctcctaactatgctgatttagatatactatgggttaaatatcccttgtaatagaactggtaactgcctgttgttacatagtctggcagtatggtggacattagtcttctcttgaatgtaataaataa

SEQ ID NO: 107475 - DNA, 1164 bp, Homo sapiens
ttgaatgccctcagcaactcatatgccagtgtcagttaccctttcatttaagtctcagttcaagtgttcccttctttagggtctccttgactctcctcaccaaactcaggtattcacagagtcactgttgcaatgatgagattatattgtaatttgttccgtagttatttgttaaattctgtgatctgacatgcagtggtgagcagtgatcacagtcaagtgaagttatctgtttgaatctctgtcttcccattgcatacaggttcctaaaggatagaggccttcttgtcttcttcataattctaagcttttgaaaggtcttctctgacaactccatctaaagtagcccatctcatttctgacaagtcacacttttatcatcctgttttatttttttcaaagcgtgtattactattttaaagtatctcctttaccacctatttctttttaccattttttaattttagcttgcttattttctctatttttcactagatgccaatgcactccatgagagtagggactgtcttgcttatccctgtgtctctgatatccagaatgacactgactcatacttggcactcagtaatatttgttgattaaataagtgatgtaactttttttccccagtgctgttgccaggtcttctcatggccaatactttgacttagaattatttatgaaaatttgctttacaatttaagaatcatccaaaaactaaaacacatttgtgtgtatgcaggtgtgtgtatgcatgtatatattatttcatgtaatactttttggtctttatgagattgttttttttttggaatcactgttgacttgtaaatacaatatgaatgttagaaacagtccacgaaaaacaatctttttttttttgcatttaaaaaaaaaccaaaactagtatattcctttatgtgaatttcacgaagaagcaaaaataatccatggagatagaaatcagaatggtgattgccaaagtgggaatgggtgaggattgactggaaaggggccttaacgactttttgggctggtgaaaatgtcccataacttgatctgggtgatcgtttctttctttcttcttcttcttctttttttttttttttatactttaagttctagggtacatgtgcacaacgtgtgggtttgttacataggtat

SEQ ID NO: 107476 - DNA, 1281 bp, Homo sapiens
tcccaatcgcacaccagcacatatccatcctctctctccaggtgccagtaaccctcctggctccaacaatcaacacactaaggctctgcagcccctttcaggcaactggcctgggattctgtcagaagatgagatatcccatcccccagtattccaggtcaactccctttccccatcttcttatctattatgctttgggactacaggccccagccccaaactcttcaaagttttcattgcagggatgctgagctcctactctgtctgctttgcagcaaccagaggtaccctaagcttcctcaaaacgatagaggctcaatggttgttgctggtgaatcaaatacttgacccatttgttgtagacattgttacatcaatgtgtaatatcaatttttaaaatatctgcacaaatattagtagaaatacaaaaatccctttaaagaaatcaaatgagtaaacatgactatgataatgcaatcatccttgagatttatgcgattatcgttttgtacatgtaccatttgttccctttataaaaagtgcatagctttactgctgctaacattatgatttcttttctgctggggacactgcttttcaaggtcttttgtcaagtttataatatgtcctatgtttttgtacagttttaaataaagagcttgtttttcaggtttcagataaaagcaacactgatgtttcattgaaacaagaaaaaaaggaaattcctcttttaaaccaaggtaaaaaaaaatcagctcatgtatatatatatattagctataatgtttgagacattttcaatatggcttgacagcctgatatatagatcagaagtttgtcagcaacttggattttaaaaaattaagtttgttgttctagaagtgagaggagtagagagagggtgagctgccaaccttgtgtgttttgacggggcagagagacactttctggctgaggacagtgtccccagcactgccacactgcctgaaatttccatagacttatgccactctctgtcttgaattctccttctaattttgattaggattgatatcaggtcaataattttcaaaatctgttttgaaaattatgatgatgacagtccccgttttttcatcttttagtaactttctgcttttcgtgattcttctgaggtccctaaaagtagttcaacaaacacatttattagttttttcatgcccaggggatgtaatgtgtctcaggtaaaagactggaacttatttaaggcatgaagtttccatctgatagtattcaatccag

SEQ ID NO: 107477 - DNA, 1011 bp, Homo sapiens
tttaataggttccttgagaagttgagagtagacagaaaaaggatgaactacccagagagagttgagacatagaaggctatgaagatcaagagaggaaagaattccaagaaatatcttcatgcttccttaactgagtaaatgataccaccattcactgctactctggccaaaacctgggaatcatcctgaatttctctcctcctttctcatcctgcactcaacccatcaggcaatcttgctgaatcaacctttaaacatagaacatattctaccacctccatagctaccaccttggccaacacactgacatctcttacctggactacagcggtactcctataaatcatcttactgtttctcttggcctctacagtgtaaaaatctgagtatatcatccagaatatgtcatattatgtcattctcctactcagaacacttccatggcttctgctcatacttagaacaaaactcagtgactttgctgtggccctcaaggccctagatgtcctggcctgatgtcttttgaggctacagaccccactgctcattccttctcttagtctactgtagccaccctgaccattgttggcctccagtaccctaaggaatattaaataaataaaagtataaatatgtaatataatatcaggtcatataaattctgtgaagaaaaataatacagttgagagagagagagagagagagagagagagaaagagagaaacataaacctaagccttttcctttgtcgttcatatacctggactccactacccacaccacccccatcaccactgtcagcagcacacatgtattttcatgacttgatttttttttactttcttttattctgtgactatcttgaacatcagttactgtcctaaacaatagggatccagcaggggtaaaaacagacgatcctccctgcctttgcagagcttccattctagttgggggatcattcaatagacaagatgaataagtaaatatggtgtatggtagataatgaca

SEQ ID NO: 107478 - DNA, 1073 bp, Homo sapiens
aatgagactgaaaaggtgacaaagtaacctaaaagcagataaaaaagaaaaacaaaaacttgcaaaattagtccctaaatcaactgcattcaccctagatacacatcatttttctgactcccaacagaatgcctttttaaaatagaaaactgtacaggtagtacaataacataatttcagattactgaagttgccttaatttcaaaagcgggtgatttctcatcagctttgatgatgctaccattcctggttgatgatgctaccattacctctttatgaatctgtataatgctatgatcattgctaataatactagacatttcacgggaagccctcttacaaaatgcaaaccagagctgccctaagggctttgaaggaaagatcatctatactcatcctccacaggattgttcatcagttctccagcaaacgtacggagagacacaaaaacaatgtgtgatatagtccctgatctaaggaaaaaccttgtggatgacttataaggaatctaaatattcaagtgctaaagtctgaactaccagcaaccacgagccaattaatcaaaacaaatttattgaacaatactatgttagacatttttgagggacaccaaaaaagtcaagtatctgattgttgtgctgaaggaacaaaaaaattggttaagacagttttacaacaccatgaggtagtattatgttatggaaaggatacaggctgtacactctgacaggctgacccaggctcaaattcagacctccatgaggtttgtcagttgtgtcaaattttgatattctgttttcttgtatataaaacgagagtaataatgccatctattctcaaggttgttatgagaattatattcatgatagaatgaaaataattatttgcattataaaaagtattttttaaagccaccttctgtaattctgaagaagacaaattcagcctttattgggtgagctaggagaatgaaaattgacaaagtaaaatttctttgtggaaaaagagagcttaaagagtgagcttatgtggaagatagaagaggagaggggcactgccaaaagtgaaaatac

SEQ ID NO: 107479 - DNA, 1454 bp, Homo sapiens
actgccaggaagtaggcaccttgagccccagctgtttgactttgctcctccttttgtaatcactccccatatgacatctccctttacctcccaccttcataactgtcccctacatgaattcaatcaccccattccacttgggtcagttgaagtacataaatacactttactcaggcatgagagtttcaaggtccaccgatatatggcactggctaacattcagcattttggcttgtgtttccaaagttttttagatgggcatctccagccaagtgtcttgaatcaattttaaaagaccaatccatcatccatgccttgcccagcctaagctctctttagcccgtttccctccatattcaccctaaatctgacctaaacaatgtattaatagttcttttcttctaagacccagcttttgtccttctagtcaagctagagtccagtcatagtcatgaggctcatcttcttggggtctccactaattcctggcttctaaaaaaagaaagtatttttcttgtccaagattatcactctagtaatatggttgtggtcataactttaccaccaaccccttccatgagctgttgttgctttacctttggcctccagaaaatcttattattttctgtcttccatgctcaaaacacatgtcctgccctgttttttaatgaatagtgggtattctgaagtgtgttctgtctcaggcatttccaaacccatgtgtaaagttcaaatttgtcccagttaatcccggatgggaaggaagtggaattttttttaaatcacaccttttataggtatgctagcctttgtcaggaggatcagtgtctgagtagatgttgctatagttctgctgttattgcaagaacagtgtcctgtggtactgctgtaattaagggtttgtttagatatagttacaaactcctgtgcactgctgtgtgataaactggcagttcaactttactccaggcaaactccataccaccctggatctgggaatggatctggtattttccatgcccctcaaaagtgatgcactctgatcaggtgttactatacaatgcttcataaaaacgataaaagtacaaatgaaacaatgagattagataatcttacatcctatcaaagaagtaaacagctcatccaaattacatcaccaggtgagaggtaagaagtaaccacacagactaaacatcctaggggatctattctgaaaggtgactgggaagaataggttggcagaccacaatagatggccaggaaagcaaatgatcaatttgaaatgagccgcaaaactgaggaacaccaggggaataaaattaccgatgccagcagttggagaagttgaatagcaataatgtgctgaggctcaagacagagcgataaaagtactgactttatttaaaaaaaggcatgtacatgcctttttttcatcttggaggaacacactctcc

SEQ ID NO: 107480 - DNA, 1047 bp, Homo sapiens
tctcacggggatgacttcacattatccaaattcatgaaactgtggtattatagcataacatcagttcagtcatttaaaagataaatacagcttcagttcaactggaaggcacatattgacttaagctatgcgttctgtcccgttatgcccatctgcatgggctggccaattataatctgacagttgctggtgagctaggtgcctgaatatttaaaaggcgtccagctaagacagcctgctgtgtccacctccccaagagacatgacagagatgatgttaccaatgcaactataatactaaaagagcactgactcagcgaacctttgccctatgcctacctgtgctcctataactgtactttttttcaggctttcgggacaataactccattctgactggcagatttgtttttgctatgttaataaaatcaataaatgtctatcagtctgccttttgaaaggatttttttttccatattaaggcactttatttttctctgttccatgtttcaggcaacatctcactctggttcttgtactaatagttatgcaatttctagtgaaatgaaaaaaaaagtatttgttactttccagattcatatttaaccctaccattgctgattattttagccatctgatcattcattctccaaaattacctcactgctgtagctcactgttatgttttatttattttcctaacttccctccctacccccactgagtccctcaattcttgattgaatgctcttattgtttttattctaaggcctgtggtctgttgaagcaattttttatttttttattttaccttttaaatttttttgagacagagtctccctgtgtcacccaggctggagtgcagtggcacaatctccactcactgtaagcgattctcttgcctcagcctcccgagtagctggaattacatgcaccaccacatccagctaatttttgtatttttaatagagacagggtttttccatcttggcaaggctggcccaaactcctggcctcaagtgatccacccaccttggcctcccaaagt

SEQ ID NO: 107481 - DNA, 1387 bp, Homo sapiens
caaattattttcttactcatcctttttggagaagctgacatcatacttcctgatggaacagcatttgtggtttactaaacagacccggacagcactaatgattaaagggcatcagaacagcctggcattgtggcatagcatggtgcagggaactcaggatattctcagctcctggcttcataagcaactttattttgccatggggttgacactgaggaatgccatccattgttgtctactcctgggtttcacagaagtgaccaaatgctgtcgtcaaaggccaagaggagtttgagtccagagggaacacatttttcctcccagaaggacagcaatagctttgacagttgcaggcagtcttgccacattacatccctctgtttgcatgctagtcagtgattcctgttcacatcagcagagatggagagaggagtagaggttcagatgtgttgcctgaaatgattttcactgcagggaatactgatttgggttttaatgcaaatacacctatttgatctctaccctacaaaaactccttaagcatctaaactctaggtacaaccagtccccagttagtgtgcatgttaatcagggactatcagaggctgtctggcgtctggggtacacctcagggcctgttccctgactgtgctcagagtaagatacaagtctttggcttccttccgcagcaggctgctcgctgctcccctgtcaaggaagtctgtgcctccacgcctgtaccctctgggcaccagcccacctgagtcttcctctctcagcttgaatcctgtttttcaatttgcttgacccaatttccttcttacttaggacctaactttacattttgaattcagtttggggaattgtgtttcatgactgttgttctgattttgaacttaaaccttgtatcttgtacccctgattcaacctcattcaatccttgtcacctgaccatatttgtgatctgaatctgctcccttcctctgtctcaattcctggaggctggagtaaaattcatacctaatcttttttttttttgagacagagtctcactgtgtcgcccaggctggagtgcagtgacgcaaactcggctcactgcaagctctgcccccgggttcacaccattctcctgcctcagcctcccgagtagctgggaccacaggcacccgccaccacacccggctaattttttgtatttttagtagagacggggtttcaccgtgttagccaggatggtctcgatctcctgacctcgtgatccacccgcctcggcctcccaaagtgctgggattacaggctcatacttaatcttaactggggtctattttttaccttgtactttaccaacatgtgatttaacctctccactccttcagttagtcttccc

SEQ ID NO: 107482 - DNA, 2082 bp, Homo sapiens
atatgccatgtaattattatttgcccacctcctgttttctcttcctccatcccactcccaatgaccacttatccattgaccagacctgtgtagtgaatataaaaatgacctaaacctgcacaccctatctcttaactctcttgcatttcagctttaatggtagcaggcatcttgatctggaaaatgaaaggttgaccaggtaaatcaaaaatctttctggattttaggttctatgggtatctaatgattagatggtaagagagttatcctaattattagatgttgtcccataggagaaaatgaagtagctagatctaaaggtatcgtttccacatggtatcttatttaattcctacaacattccagctagttatatctattttaacaaagaggaaagtgaaatccaaaaaagttaaaaataattttaatcaaagcacgtaactttaaatggtgaagttggaatttatttcctttttgcccaattccagcaccatatttctcgcagtcttataggaaaaatacagacaaaaaggacataagaacatttacagtagcaacaaacttatatattgcaaatcatatttgttaagggaaatacctaagttcagtaaacctaataggagagctcaaattcaagatctgtcacctgtggtgcattttatagactaaaggggttgtcctccatgtaattgataagctatgtcaacaagccaagatccttgttataaattgtgcttctgaatacaacccatccccatctttatccttttgaatagatgaataagtaatctgtttctaactactttcagcttcattccacattacctgctgttttctataccgagtgacaagtgccacctgctggccaagtgatgaagcttttatttctattgtttcactggattgctcagttgtaattggcatattagctggataattgttattttttggtaaacctaggcaataatttaaaaaccataatgttataaaataaatttctctgtatttcaggacctctccgttctcaaatttgcctctttctcagatttaacttaaaatttctcttctaccttctattgtgtgacaaggatgattgtgtcattatcatgcacacagaatctagttttagttacactttattcaggattttatggtaccatctaaaatccacttaataccctcaatcattaaaagacagatcatacctttctccctgaattaagctaccctatatttacccctttatacctaagtaatgttaatgagtagtgtatttgcataatcaatatatttctgcaatgtgtgatgaattgcttatgtgtcccctaggtctttctgaattaatcttttgtatttactatacatttcttggcctacagcccaggctgtctataatctgacactagttgcctttctattaatataatagcattcgtttctttcactctgtatggtgctgctactgagcttctccatatttcttacaagtgttcacttccatgtggctctgcaggcctttgtttgtgcattcttgtctggagcagcctctggtccttctccagtccttcaagatccaaaactattgccaatccctgtatgatttacctacttagaaaagtatctccttcatttcatttacctacttggaaaagtatctccttcatttacctacttagaaaagtatctttcatttacctacttagaaaagtaccttcttccttccagttccctttgtcccatgtggtttttcttagagcatgttttacttctacctggtattatagtcactttatgtctaatattatagttacttatgtgtctcatctgtctgccatatcagactatatgctttttgaaataaaggactatttctcttcatctttgcattcccaatagtacctaggcctgcagctttcatgtaataggtatttagcaaacaatgaaggatggaaagaataatttgatttatgcagaattcctgaaaggtgaatattttatatttgattggattggttgactctacataggttaggctgaccaacttctgcatatattactgaagaccaaaatgttcttatacct

SEQ ID NO: 107483 - DNA, 1040 bp, Homo sapiens
gcccgccaccatgcctggctaattttttgtatttttagtagagatggggtttcactgtgttagccaggatggtctggatctcctgacctcgcgatccgcccgcctcagcctcccaaagtgctgggattacaagtatttcccttttttttttccccaggtgcttggtttaaagaggctcctgaacaattcattagattaatttaaatattaggaatctactgaataaagtattccatacatagctggcagtaaattaacctttcagtttttttctcacagatacttcttctagaaattgagaatttaattctgtgtgcattaatcccggattatcctattaatttaatgagcttattggttcttcatacaaaagtcttaagatatgtactcttttataattttgaaaattagctgtgtgctttcagccatctactctttgtagtagtaaactgaattttttaatcgacctatcttgaggatgttaaaataatttataattttggagttaatgaatttggggttatctgcatggctctttttataggtggatagaaatattttggttaatgttttttggaagagacattattccactttcattttatttcagacaacatattaatgaggcattttgtcaagaatagcagcaacgttggttgagggcttgttaggtgcaggatgccgacctacaagttgaagacatgcagaattataaagcacacttcctcctttggaaaagtgcagtgctcatggagaagtaacttttaaagaggaaaaatacgtgacaacagcaaacttaaatttctgcagggctcttttgtgttttttttctttttttttcattatgatgaaatacatataacatgaaatttaccatcttaaccacttttaagtgtacagttgagtaatgttaaggacatttaaatgctgtacaactgtcactaccatccatctctaaaactcttttcatcttgcacaactaaaatgctatacccatgaaacaatagctcccaattccccgcttttccatcctctgacaa

SEQ ID NO: 107484 - DNA, 1054 bp, Homo sapiens
aaagccatacctctcttttcttattttttccagtaagtggttttgagccctagtgtagaatcatacatttatccctcgtaaagtttatcgccttattaggcctcattctttcaggttgtaatgaccttttttttggaatctaatgctaacttctaactaatgtgttatattcccagatttacgtaaagtctggctagtattttctctatgacttcatgtaaaccctgttgcataggacaggaaaatcagaccctggccttctatcagtgatctccactgagtaaaagtgggtaccttgggacatgttttcctgattatgctatcacctaacccttgtcaattacccagtttgtgcataattttgaaagtgagaaataatatttgttacatgaatattttccttaaaacatagacaatgctgtagtacctggatgtagctagttgctcacaacagaattttgttttccatatgatgcaatttagtctctaagatctcagaaagggactaccaggaaaatgaatataacagctttgctaaggatacacgtcgagtgatgaagcaaatattaaaaggtgagaatatgagacaagtttatttgcagatgtagtctgagaaacagttcatatctttttaattcagtttttgaagttaaagattttatgtatgtacccgttttacttaaaaatattatcaatattatattttatattacttttaaatttattatggtgttataggctgaattgtattcctttcaaattcataagttgaagccctagctcccagtagctcgggctgtatttggagatagggcctttaagaaatagttaatttaaaatggagtcgtttgggtgggccctaatgcagtctgactagtgtcctcataagaagaggaaattcatacacaaagagacataccagggataggtgcacacaaagaaaaaaacatgtgaggacacagggagaaggtgaccatctgtaagcaaagtagggaagcctcagaagaaaccaagcctgccaataccttgatcttgggcttccagcctccagaat

SEQ ID NO: 107485 - DNA, 1226 bp, Homo sapiens
aattcatgtacattaaaaatatgtctctacccttgagtcaacttaaaatcttcacttgaagttgtaattttagaatattttctttccatttgtatccatcctgccgtacctaaaactttctcaccagcaaaacggaaaagcgtaggaactcagtgggaaattatgaaaggggaaatgaggttgaggggacagatttcctgccgaagctgagttttcatgtcatggtctaaaacatactcagagtgtgttctgtgcactaatattatcaacatcacctggaacttgttagaaatgcagaatcccaggccccacctgagacccactgaattaaaatctgcatttttacaagatctccaggtgatttatattcacaatcaaatttgagaagcactgctctgaagagtatacctatgtaatttttcctgggataggcatatctttttccacatgtatttttttttcagagacatgtatgaagttatgctaaacatgagactcattacattgtttggcaaggtttgcttaaagctgtagaaaacgtgtaaggtataaatatcaacataaacatagtgaggtttaactcaaacatctactctctggtctttaactgctagtatgacatggtacaaaaggaaaacattaagcatttgaaaatcatgaacctccccatactcctcttgtcttcgctgtaatccgttccttgtcttcatccttagaagaaagaattaagtcttcagaaagaggtaggcattagatttaaaggtcataaaaattatttccatctaggtcacacttaggagagtcatactcagtcctctttgtgggtggagctctctcgaagcccctttgcttggtgtgtgggtaccctcccaacagttgtactcccaactacagggtatcatttgctagcccccactccttacctaattccctgtccttatctaattgtttctcaccttctacctaattgtttctatctacctgtttcttaaccttttcaacagatataatagggtttgaaataaatatatttgtgtttttattattattgtttgataacatattgttttcccaattccatagttatctatgaattgatagagggctagaggatactgtcacaaaagatgttcctctagaaggaaggtagagagtagaggaaggatagcaggcatgtgtatttattcacatatttcacttcatcctcaaacttcattatcaaacta

SEQ ID NO: 107486 - DNA, 1008 bp, Homo sapiens
gaatttctcaatgtccaagagtataatcatctactaaaagtcatgggacagtacttggtccagtactgtaaggacaccggcatcagtgagtattcaatagtcatagtaggagatacttacagagggattactttctgtgatttctttaagctgacatgattatctgaattcagattaccagcaactgaaaactctgaaagggagctcctgctttaaaaacaggagtgagaagggagcccatttcagaatctttcccagactgtcgtgaaaaacaaagcagcagattagaaattgcaagggaatggcaatcagagaacagagtgaggtggcagctgaccatggtggaaggaagcagaagattgctccaaatagactgagaaaccctgctctgggcactgggactccactgtgtgagagcacatagtcccatgcagaccttagtagctcttataatgttgttatgtcataccatggagtaaaaactactgaccctgggtaattgtagatatgttaaacttttttttttttttttgagatggagtcttgttctgttgcccaggctggagtgcagtgatgcaatctcggctcactgcaacctctatctccctggttcaagcaattctctgcctcagcctcccgagtggctgggattacaggcacctgccaccacgcccgcctaatttttgtatttttagtagagacagagttttaccatcttggccaggctggtcttgaactcctgacctcgtgatccaccctcctcggcctcccaaagtgctgggattacaggcctgagccaccacgcctgggcagatatgttagactttgttttgcatagttaaaaattcttgagtatgttaattccagaaagatttcaattaaaaatttctaaaataaatacatctggaaacttaaaaagataaactttagttatctgaaaaatgtgatttatttagatcacctcactcctcagagacacctgaacaatgagattatgtgctgtgtatt

SEQ ID NO: 107487 - DNA, 1015 bp, Homo sapiens
aataccctaccctctctgcatttcctgtttctcagacctcctaagctcacttctgcattgagaccttgggacatgccatttccttggccttgaatcttctgttctcagattttcttactgctggccctaacatgccattcagccatgagcctaaagtattctccacaggaaggtcttccttgactgtctaattaaaactggtccatttccttccccaccacctgtcactcttcacatatcacagcacctgcattatgttcctcaccccacttatcaccatctgaaatgatcttgtatatttatctgtttattagcttcatgcctgccacccttcggtaaaagagaaacttcaaagccagggggaacctgtatttctggttctcaccatattcttagttcctggaacagggcttggtgctgagcttgaatgaatgaatgaatgttatgttagaggtgagcatccagtgcaaaaagagcatttaggaggggcagtagagcaaactggagaagtcaatttaggccttctagaagaatgaagcccaaatttagacttagagaatgaatagtgaaaggaaagcaaggtggaagagtgaagtggtaagaaaacactataggcagggaccccaaattgtgaggctttgacacatgtgccgtgcaaaaggcagtggggagccctaaaggcttagacagtggtatgctctttgccaaagcaggttatgtcaccaaccagatttccagtgagatcctcatggataagccaactctgtgattccttcatagaattcactgagcaccccaaggacctctgcaatgaagaggagaaatccaatctgttagatgaaatgcggagaaagaaaggggttctctggccactgtcatttagaagatcatgccctttattgcagtaaggcaccatggtttttaatgtcaaaaggccttgccttcccacccaccctcactctccacgtaaggcgatagatttgtaaaacgagtcgtattaactctgtaacattgt

SEQ ID NO: 107488 - DNA, 1039 bp, Homo sapiens
gtaaacttgctttattataataacttatttaccttgtattttggaaagggttagagaggaagccagagaatatcttttggcacattccaatctatgtaggatatctggagacttgagaacatgctgaaatttagaaatcacatctactgttagaaatacctaaaatttaaaatagccaagtcatcattttgtaaaaaatgctgcaatgtacctatacgacccgttaatatttcagaactcttttagcattttctagttcttgtaaatttaaattggcagatgtgtttttgaatcagtaaatcctttgtttgactggcatagttactggcatcacgtttatgcagaatacttggctatacagagacaactgagtgtgcctaccaggttttgcaaaatatttggatatatgcctttgacgttaaccttctagtttaattattagcagtttcctaaactgtgtatgtttatttaataaacaactttttaaactttttaaatgtaactctagagaattaaaaacagcaagaacgctctccctgttctatggagtgaacgtagaaaaccgaagccaagctggaatgttcatttacagtaataaccgtttgatcaaaatgcatgaaaaagtgggctcacagttgaaactgaagtccttgtgagtatgtttttgctttcagagatataagcagagaaagggatgttacagtaagattctgtctgtggagtgagatgagtgactaatcacaatgggagcaagtgtcatagtctctgttcacccttcctgttgaagtgcaggcattaatctgcctcattgatagtatcagtgaatctgcatgcatgctctaaggaaaaagcacactttgggaaatttttttcaatgcatttattgaacaacttgatgtggggccattccttgtgccacctctttgccataaatttttaatgctttaccaatttaaaaataatacgagcttattaaatacattttagaagagaaggaaaagaaaaatccatagtcttgtaaagcaaccctacatgtatg

SEQ ID NO: 107489 - DNA, 1052 bp, Homo sapiens
ttctgaatttatatttgtatatttatgtcctgtaaattgtcatacctaaatgaaaccccaatagaaggaaaatttaacatgtgtaaaagttataagaggaacatagggttttctcagatcatggtctgtatgcctttttcactggtcatgctacatgtatagaaaatactcacttaaaattgcttgaaataattttgctgtgttataactatttggcttctacttccagctgaatccatattgaaagaagcacaaatcaaagtaaaccagtgtgacagaacctctttatcttctgccaaggtacgacatgtaaagagagtagtcttattaaatggcaaattgtgtcatttgctttttcctgtgcatagttgtctcttatcatctacttcctaaacttttaagcacagataagctcagaagattaagttgattttaactcaggtaaacagaatagatgagttcagagaaaggagaggaaactcagcaagtcggggcaaggctgaggcagagagaaaagatgaacagaacatggggtgaatttgaaatggtggggaacagcatcacaacccatttctttaaaatggaaaggaaagtaacaggagaaagggaaaaaataatgaaaagccagcagaagaaaaaactagcctatcgagtctccttgaaaatatctattcaaattagagctccctgtggacctaaataaatggggaaaggaaggaaaggtctaacaagcaatccttctttctagtgctaggaattatatactgtaattatgaatattaataagaatgcttccagcttacaaagctcttttattatgagtttctccacacagttcataaacattctttgtaattcttaacaatatgcccatgagtaagataagttaaaaagaactattattaattataatgcattgcaactaagagaaaaagaatattgctacaagacatgtaagtttgctaacttttaccaaaaatatggtatgaagctttaaatgatggtgaatgattaagcaacatatttatttgcttacatacaaagggataagt

SEQ ID NO: 107490 - DNA, 1119 bp, Homo sapiens
gtcacaaaagaaacactttcattactttgtgtagcttataacttttttaaaaaaattacctcttcgagttgacatttctcataggtttaatctaccctaatattaaatttggttacccccttcaaagttcagaatttaaactagttaaaaatctttatgcacttgtttatattcaagataatacaaaccctgttaatttcaacttcaaaaagtcttcagagattttgtaaggacttgagtaatttagaaaacaattttggttatgtaatattttcacgaataaaaatatggcacttctgagatattgcaaaagggacctaatgtagtctgcagtttagagtcattttctcaatccaggaaaagtagcccagttgttgggctagatgggggtctgttgtctgtgtgcccagtgtgaataatggaggagttgtatttctcagctcgtgtctaggtccaaacacctgtgagagactgttctcctcccctctttgtggcaacctgccttacatactaccctgtccactaggtcaggtaggcagtggtgtccaatcaaagtggcagaatcaaaggaatcacctgggtagctttaaaaacctcacgtttccagactccagccacagagaatctgaatcagcagataaggagctatggccttagccacagaacattagtttctggctccttcactgcccttaacacagtttgatgactgcaacacattgatccacccatgatgcatggcacatggagcagcatttaaaacagcagcagaatactgtggacagattgggagaagcaagaggccacacagaaagcacagccacaggtaggggctaaattagagactgttaagaatacccagtgctgagcaggggacaaaagcattgattctactccatgccctcctattatatccacagactatgaagccagtttctgccttgaaatactctcctctttccccacatctgtcctgtgactgtgtgtgtgtgtgtgtgtatgtgtgtgtgtgtgtgtgtgtgtgtgtgtgttgagggagattgttctgtctcttcctttcttcagtttcttatcgtagccagttacatagaaaatgagagagaaagatagagatatgga

SEQ ID NO: 107491 - DNA, 1038 bp, Homo sapiens
cattgctgctttcatgcttcagtggcagagctacattgtgaatagttgcaacagagaccgtatggcctgcaaagcctaaaatatttactatctggccctttatggaaaaaatttaccagcacctgctatagtgtatgaaaacaatatttcttatttgtacaatgtttaaaaacccttctttgtttttatgtgtgttaaattcagtactaccaatgagagctttacctataacacaagcttggctcaggctcttaacaaatttcataatgcaaattatgaaaagagtgccaaagtttaaaaatccacattgaaagacttgtaatgaattgaattataataagaggcaccatactgtagaaactcagcactctttggcagggagtgaaacttgctagaagacatatcttggcttagccaaagagttagccaaacatactatttactgaagtacaaaagaaaattttatagcagactcagttccatagatgaaatgatagcacaatgactagcatttagtgtatttaaaatactgacaagtcaaacatctatttttctaccaggtactttgctggttatttataacttgaagcttctgcttaatggagaaccagagttggatgttaaaactgacaaagaagatatactgatggctggagctctggaggagtatgtgtgtgtttgacagaatgtttttcaacaatggtggtgagctagagttaggagccctgcatcctggctccaggtctgaggtcactgggttttagcactgggacaattcatcttaccctagttactagtaaagttgggctaggtcagtggtttccaaactttaagcttcagagtgccctgggatgtttcttgagaagtacagggtctggggcctcatcttgacctgctgagtcagaatgtccagataccaagcctaggaatcagtctttttcaaatgttccccagatgattcagaggtgccagcatatttagggaccactggaatataagacttctaaagctttctaataccttgactcctaatttgta

SEQ ID NO: 107492 - DNA, 1065 bp, Homo sapiens
taactcctgccatcagtccctgagaattacagtgtaggaattctgaattgcaagtcaggctggctctgctttctggcttgggctttagattgcttttcttgcgtgtgctgtcatctgcttttcaacttttaaaatgctgattctgttgtttcctctgccattctacccttcaagagggagttgaagtacactccatctgttcccatattccacaatggagtattttaaaatacaatcctgtctatacacatttgttatgtgtctcttatacaactagattataggaggaaaatgaacttttaacttagtgttttgtaatttgtctagatgaagagtggaatgaaatagataagacaaaagaataatgttttttgtgtatttcatagtaaattgatgtgtttttttttaaataggttgtagttccaatgccctcatggttaataagaaccagagaatctgtcacagatgatccccagaaatttgcaatggaattatctataatttataaatactccccatttaaaactgaagcagaattgatgcagcagtttgatgtgatctatggaaaatgtggtaagatcatcaaaactctgacaatttgatggaagtatttgttttcagtgtcttatcaaagacactgtacatatgttttcattttttttgttcttataatctcatgtggattcacactggggacagtcatttattttatccatatgagctttgtcttaagagcatccaaacaaattactgtaaatccctgacactgggagaaggatgtgtacttgcatgagcttggtgaaactgggtaagaagaggatgatacaggctatgaccacagggactccacagtcgctgcactagatagcaaagttaggagacacttattgcatcatttgagatagagtgataacaggtatgtaagagagttagcaacttataaaataacgaattaatgtctctgtggcaaagagttagcaaaagtattgcagacattcttctccagattaacagatcttttccccattctttccacctccaccaactttctgttcaacacgtcga

SEQ ID NO: 107493 - DNA, 1373 bp, Homo sapiens
ttgtgttggaatctccatatacaaaactgactttttttttttgagacagattctcactctgtcaccctggctggagtgcagtggtgcgatcttggctcactgcaacctccgcctcctgggttcaagtgattctcctgcctcagcctcctgggcagctgggattacaggcatgagccaccatgctcagctaatttttgtatttttgtagagacagagtttcaccatgttggccaggctagtctcgaactcctgacctcaagtaatcagcccgcctcggcctcccaaagtactggaattacaggcatgagccaccacgcccggcccataactgacttttatctttacaacattttaggttaattctcccaaataataaaataaatcctctttcaaagattcctgaagcggtacccctgtactttagtgctttgttgcatctctatgttctgttgtttcccaaagcatattttaacctaggtgctgtgtctgcagctctttgttttagtatgctgcattgaaaggtcaggacatgaggctcacttgtacggctcctacctgagacagatgattgttcttttgagccctgaatggaccctttcccctgcagccaaacctcaagcaagagtgtggagctggcttagttcaaattcttctgctttactttgaaaaaaaaaaaattgtaccctcttgatgacgggtcagcagaacagagtgttggaaagaacatcctgttacagtacacggtgataacagtctgcctgtttcttcctttttagtatttgaggtgtaaaacatgatgttcttcatttttaatatagtgggtccatgagaattggaaaagactttattctttttacgaagaaggaagaaacgatgacctgtgtgtttttttctcagacattctgtgaagaagaaagtcttagtgaggtaagagttgaagttttccttctgttcccatagcaatgatgttgctttcatttactctctcaggaggtgaagtcttgtcatgggttctttctgatattatttagaaacttaggaatatgtttgggaaatggagagaaggtatcaagacattctggggacatcaaagacctgtcctcttgaccctttcctgagaacttcattttcattatccatgtgctcaaatctcccaaagtaagaggctcccttagacatgatgagctttttagaagaaacctgcaaaatctttccaccatatatgccataaattgattatcattttaaaaataaataaaatattggagtcaaagacttggaatacaaaatgtaaagaaattaatgcaaaatagacttaaaactgtaactctggtgaccataatttcaactccatttgctgatccagaggcatt

SEQ ID NO: 107494 - DNA, 1366 bp, Homo sapiens
tcagtcagaaatgatcttatttattagtttactttcaatctgtttctcctaccatgacatagtgttgtccaaggcaggagccatgcctggcctgttcagtggtttattcccatgctcagaaccgggtaaccatgcacgtgagttcatgtagtgtgtaatgaacacatgggatttggttcagagctataccatgtctgtaccaagacttagaactttgggttataatcctagctgtaccctctatcagctctgtgaccttgggcaggtttttaaaactccttagacttacatttgctcatctgtgacatgcaggtcatagtaataatacctttcttgttttgttataaatattaaataagctgtgcatgtaagtataaacatagtacctagcatatactaaacaatcaataagtgttagctaagattgtcattatggatatccttacctaatgcctaacccctcataggaacatatcataggaggtccagttagtttcagagaagcagaatgtttggtggcttttacacacctcataccatgtgccactgaactatagcatatctgtacccagactgacagagggtcctcaggacaattcttcagcatgtattcaggtaggccaacaagaagaacattcttggttctggagattggtattaatatattctgaagtccagaggattactgtctagaattccagaatacctggagaggtcgggagaatgatttggaacgtctgaaatggttagccttctttcccaggtagtatcagagcagaggtcatcctgcccctcttagtctcacatgggcctggttaagggctaaattcgtggggaaattactagtggtacaagtaattataacacttgtaatttggtaacacccaccaagtgccaagttttgtgttcaggatttcacaaatacatcatctcatttcatttgtttcatttatcttcatcagcaacaccgtgatataagtattacgtagttgcctcttacaccacatggaaattaaggctcagacttttaaactctacctaaggccacatggttaggtctgtctcatctctttcagtatacagttgtttcttagtatctgtagggaatggattccaggacctttctaggataccaaaagctgtggaaagaagatggcacggtatttccgtataacctatatatatcctcctgtatactttaaatcttttccaggttccttataatacccaatgcagtgtaaatgctattaaatagttgttatactttgttgtttagagaataatgacaaaaaaaaagtctgtacgtggtcagtccagacgcaatttatttttttctgaatattttcagtccaagattagttgagtc

SEQ ID NO: 107495 - DNA, 2149 bp, Homo sapiens
tgaggcacgcaagggcttcctgccagttcctttgcctgcacatggagccttatggccttttagtaggcaaggattttgatcagtattcttcagaaatatcttgtctttaaataatacaattttaatgaaaaatcctctgggaaaaacctcacttgaaaacatgcttataaagtaatattaaaaggtcaaagtttatttcaatgatagatactaaggcccttaaatttttattttattagaagtggacaggatattttggcaaaagtgtttttaaccctcgcttcataatggagggtatctagttccgaatcttgaccgtgctgagagagttgtttctagagtaacttcttaattcactagatgtctggaactggagaacgtttgtctgcaagaatcttaaagcttttacattgattacacacctggtttaactttttgttttctctttatttcttcatcagcaccactcacagtttcctttttggagcactggctgaattgctggacaatgcaaggtaaggtttatctgtaaacaacagttactgagggaatttcatgacataactcttgtctaattacatgggaagataaaaagatcatgtcatattttcccatctggaatgttttgtgacttgatttcctataaaatcaaggtgttctaggaaaaaggatagttgagagaaataattattcacctttatttaattttaatttatgatcaaacttgaagtctgtttttatgttaataaccatttaattgtacatattcatttagatattttttgaattatatgtcagtgtatacttgtcttgagaatttacacatgtatttgggcatttattgaagtctgcgtagaagcaaattgtatagttaagaaaatagctaacttattgatctcttactatatatcagacatacataagcactttatatatgagcattatgtcatgcatccttatatctacactctgagatgggaattaatatcctagttctacatgtgtggaaattgatgcatagagagattagatgatttattcaaagtcacataattcatatttggcagagctggcattcaaatttgggcagtctggctgcagaacctcactgtcgtattttactgtctctaataaatgtattaatgattaaggaacccgttaaacagtttaagttctgctcagtagtgtatttgtgggagcttgtgaggggcttcatttttttttttttcagttaaattgaataaagcatttgacgtgttttatattggtattccccataacagaagattttttcctaccttttgcttagaaagcaaagtccatccaggaagtaatgtgcagttgttagatcaaggatctcagtaggagcctaaattccctgccactggttgataacagtgttttagctttttttgcatttgttccccattttttgccttagatgggagatgacccttctgagagtgtgaccacaaagtgtagtcaattaaccagccatccagaaattcctgccctgcactaagtagaaagtcgttatctcctccttttaggaaactctctctgttgagctaatggaatcataaaaagggagggaagtagagaaaaagaataaagtcttgttcagagccatgaactcagcttggaaggagctaataaggatgaagccaagaaagataaacacttttgattagcttccctaaaggagcttagggttgctactgttgctgctgctcaaagcttggaagcaaggctcctcctatgtcatcggtcctgcctcctactgaatgggcccactttcagcaacttgacatctgcaagtctgaaagaacacatttatctatttttccaactgtcttttctcctttgaagttgtttctttcattcattcaacaaaggaggacaagtaaaatcagaatgtggaagaagtagaataaaagaaacattttatgtagtagaggttgattgggaaagaaagattgacttcagactcaggggactgagagaaatgtgatcgataaactaattcttagagcagcatttgtaagctggcagccccttgaccaggtccagcctgtcttatgtgtgtttggcttatagtgaaagtttgcacagtgtttataaagaaaaggaagggagaaaaaaggaattg

SEQ ID NO: 107496 - DNA, 1019 bp, Homo sapiens
gtaagtgctaggattacaggacagagcactcttacctctggttctatgtaacacaatggacaagcaaagagaactacccactcaccttccccgcactgtcctgccttgccgcccacgttcccccaccatcttgtgtgaatgtgtaatcatttcgaatcaaattttaataccagttttgggctccattttccagctggggagtgattgagaggagcagggtggggaacaaccgtctgaaaaagttacataaacctcaattccaggagactctaactcagatacgtcattctcaaattgtggctccaagaccaagcaacaaacctcgcgagacaactgagtcgacgacgcagtgggagcttcgcggtcccgccgcaagggggagcacgtgtttgctgaacccgccctctgcgcgtgagcgtgggcgtgggagtgggcgcgggcgcaggcgaacggctgccggtcaggtgtccttgtccccttgagttgcgcgggtcgtgttcgagggcatggacgacaggtaccctgcgcttcagcgggcccagctgcgtctggatttcatccacgccaactcgtgagtgccgaggtggggtcggggtcggggagggtctctgcgcccgccatgaagaaaggttttgcccgtcccctgaggaatactcagcaagtgaacttgatttatggatttatttatttatttgagctgtataggctttttttaaaacgatgaaagcataataaagatatattctgggccaggctgaaccctttaggtgctcttcagtgaacaccaagtggttggaaggccctacatttatcatttaacacaactgtttaattgttggtcagcagaactgtgattctaccaatcctgcctaaccttagtctgcctaacacactgacaatttaaacattaaagttgcccttcaaacagagtaatttgcatatattgatttcaaactctatggcctcctgagtcttttcaaaaatgtaacctctctaaggataggaatctcaccttttag

SEQ ID NO: 107497 - DNA, 1029 bp, Homo sapiens
ctaattttgtttccttatgtagaggcaaggtttcactatgttgttgctcaggctggtatccagttactggactcaagcaatcctcttgcctaggcctcctatagcactcagactacaggcgtgagcctacctaagcgctttttcccctcaaggcagagctgttttcttctactcttgtttgtatctgtcttttcatgtgctttcaaactggcttcctccctttttttccatcattgtttcccagtcttgtaaatgaaactgagtattaagatgatacccagaggagaatccacactgccagtggagtccagtaactgcgttggtgccttagaagtgagttatcttgaggcaggtagtgtatgtgtggtttggacactagaggaatgactgaccagctcctctgttccccagtggacctccacagagaagtcgagggaagaggatcagcaggcttctaatcaaccaaattcaattgctttgccaggaacatcagcaaagagaaccaaagaaaaaatgtctatcaaaggcagtaaaggtaagaggtcttcaaattctcaaatcccaccttctcgggtcttagaagccagaggaatttttctgaagaagaaaaaccagggaagaaatttccatcatgtattgtgcaaatcctgcacttcatggaagccaagcttaaactgttaccttcctgaagcatcttttggtcaccactgctctaactgatcccttcctatcttcagacttccacagcatatttggttctgctgatcattttttccttcacttgctacttggagttaaggatttcagtgtgcaatgatttgggaacagacagctgtaaatttgaagatccattcttgaaaccggacttcctattctaaaaataagttaggacaatatctacctttattaagcggtgggaatggagtgttaaaatttacatagagtagttaagtgaagcacttagactatgcctgagaagtaatatgtacagagtaaaccctactattagtgtcattacaggctggtttt

SEQ ID NO: 107498 - DNA, 1068 bp, Homo sapiens
tttagttaatagagttataatgatgttcatagtactgcttacaaggtttggcatgtaattaatatttgcgtggagccagttttagagttgaaaagatttttaagctttaaaaatatgactgtagctgatgatttgttgatgagaatgctttacttgttttatgacatatagatttttccttttgctgctatttttgatattttgatatgtttgatatatagcgtggccttaactttatcgtgttaatttaactgttaaaaatatccatcaaaactggtggacctgatattctgaaggctataaaaatgtttatatcagacttgctggccgtttgttttgggggtgtgcattatcttatttggagaactgaacttttaaaatgagagttttacaggttgtcaaattgccagattttttttttgtttttaagcctaagagattcctaggtataagtgtcaaggggactgggcttacgtcatcatctgacttgataaacgtcatttaattatgaaattcgaagtttctttatgatggcaataatcaattcatagatgattagatttatctcacttttacttcccaccgtttttttttcaggggacatagagaatattatcatgggtatggtaatgatgaataacaagatagactgacctttgtaaggtcccatttggctctgagattctatgcctctttccattttcagcaaggcttcatcttaagatgaatgtttaaaagagcacagaaaagaagatctgatatgatatggaacttttaaaagcactttgactacttgataggcacttggggacataacacacgcataagacagagtcctggcttcaagatgcttgtaactttgggttcgacctaaaggaaacatgattgtagaacagtttggtgtttgtgaggtattttgatttgcccggaaatgggacacctaacccattaggtaaagacttatgaatgtgcaatgaaaaaaacagtcatttttaaaacatcatttgggtcagatcttattgagatgtcttcttccttccctgtccttccctcccttcctctctttct

SEQ ID NO: 107499 - DNA, 1040 bp, Homo sapiens
gaaaaaaatattaatgaaatgctagtattggtaaactgtagtaaaatcagtttaatatagtaactgtgaattattcatgatagacatgattgctattactgaaaatcttaggccctagttttgaagattattaataaaatttctaatttagttgtagctagattcttaaagtactcagcaattatggtggctattttgaaactgtgcattgtttatcaagcttgtttttcatgtaaaaggatctgggcattgatatattttcattatatttgtagttaatagtaaaaatgtttaaatgtcctttcattatagactcagattccctactaatttgatttagagataatcattcatggctatacatttaatttaatactaagcctgacaataaactgcctagtttttaaaacctgcttagagataccatacctactttattttaaatgcaaaataaaaaagtccttctccattcctttaattttttggaagagaatcaagtggaagaaggcatatagctaacagttctatacttctctttaagggcacaggactaaaacatgatagcagcatttctcacttaatcataagcctgcttatgttaatggctactgcagtcactctaaaactctgcatttctgcttgttaaatttaaaggaagtaaaaaattactgccaacacaatctttgagaaacatgcaaataatacagttgtatttaatgtcaacttatatagtagcttccccattcctataaacacttctgaggttatatgattatcttgatgcagtttttctgcctagttcatattaaaagcagagtgaacttcaatattgaaataacagtaagggaatttctgttctttttcaaggtgttgcattgtttattgttgtatactagtacagtgccaaaggatttataatttttttcttttaaactggtatagaccctacagttgactgattttgaataacaaaaaggcatatcaagtttataattagtaatactaattagcaggaaataagactatctagattattgaca

SEQ ID NO: 107500 - DNA, 1043 bp, Homo sapiens
ctgggggtgatgggagatagtgacagatcatcaggcattagattcttgtaaggagtgcacaacatagatcccccacatgtgcagttctcagtagggttcgtgctcctgtgagaatctaatactgctgctgatctgatagcaggcagagctcaggtggtaatacaagcgatggggagcagttgtaaatacggatgagagatggggagtggctggtgaatacagatgaagcttcacttgcttgcccaccactcactttctgctgtgcggtccagttcctgacaggccacagactcgtacgggggttggagacccctgtcttcaaggattaagaaatcatgggatagtgaaggagagtagggacaactcttgggaaagaaaggaaagagaaaaaagagtaatttgtgagggaacaagactatgtcagttgttatggactgaaagtttgtgttccccttctcccccaaatccatatgttgagctcgcaaccctcaatgtgatggtgttagggggcatagggcctttgggaagtaattaggtttagatgaggtcaggagggtagagcctcatgatgtgattagtgtccttataagaagaggaagacactagagctgtttctctccatcatgcaaggatgtagcagaaaagcaggcatctgcatgccaggaagagggctgtcaccaggaacctgataatgctggcacccttgtctcagactttcatgctccagagctgtaacaaagagtgtaagccagctagtctatggtattttgttaaagcagcccaagccgagacatcagtcaaggttttattcacaaacatcagaaacttgaccccgtggttaaaagacagttttttgaaagatattggatgcttcaggcatggaaaacaagaactgaaagaaggtaggcaactagaactatatccagaaccatagctaagatactatattgaggggcagtttgttaaggtcattacctgctgtctcctggacgctggatgatatagccttgtctctgatactggctttgctgctcatagaaact

SEQ ID NO: 107501 - DNA, 1045 bp, Homo sapiens
agaatatagaaacctttaattccagaattatcatttctaattatgacatgagatgaagttagagattctttgataatatttgtttgcagtttatagtgttatttatttgcagtttatatgttatttaattcacctggctttattcttacatggttatttctgtttgagtattgtttggagattttattgaaaaacctttttgttatattttcagagttgacatgacttacctatcagtttaaaacaaatcaggttaattactgaatgtgctggtgataaatttgattcttccaaaatgtgttttgttgaagtatgatgaaatttttgaggacaactatatgctattaccttgctagtttgttaatgtatattttattagttgcctctaaattattctaaattttgaggagtctgaaaggattcatatcttagagattttcaaaggtggtgtttagttgaacacagactaaaataaatgtttcttttatagcatatttgcatacccattgtgtagatcttaacatttgaaagatcctgggaactgaaatgtccaatatgcatgccattactgtaggctgagaagtgaaatgtggtaaaagatagtatcagagttttaaaaagtgtagtgtcaaaagtttgtgatggtttctgtttcttcttggttcatttctgagagtcagggaggaaagaaagggaatggttgcaattttattcatattttaatttcaaacacttttagtgtgtgtgatctgtaatatggatctcccttcatttttttttaaaaaacccatagtagttatatacgtcattacattttcttttctgtcacaagcatcttcttgaatgtgtgtatttccaaatgttttgtatctcccaggcactctgtaaatattgactgaatgactattcaaagacacatgaagactccaaagagttgtgttttcatggttgtagtgtttttgtggagctacagataggggaataaatgctgtctctttctctgaaagaataataaattcaatttaattaattagctaatgataca

SEQ ID NO: 107502 - DNA, 1037 bp, Homo sapiens
ctatatacatatgtacaggcaataattttttacttttaggtcttcagtccatctagggtttttttttctttttctttcagtgtttagtataaaagagggatctgtatttttccaagtattttgctcatgctctttcagcatttcttgactaatatattattttcccactcaaaatcttagttttgttgtatagcacatcctattatatataggtctgtttgtgtactttcaattattttatgttcctaataccaaacttttattatttttactttaatattttccctcttcagtagtctgttagtgttttgaaatatttttggcagttatttctaccctgtttttaaaaaaattttatcagggttttcactataattgcattgcatttgtgtattaatatggggagaattgacatgtaaataagttttcctacctaggaatatggcatagcttctattttttcaagtcaggtttataagttttttacagttttattcatgagtgttttaaatattaatgtttacaaattaaacccttttctgcaataaatctgtaaagatatcaccctttgtaacatactgattatatagttcatatacattttgcatatgtttataagcaactacattattggttctaatagcccttcatttcatcttcttggattttgcaggtaatagatttttcaaataataattatttcttttccttcctaatatttatcctttcctttttcatattacactggattgaatttccagtctcagttgaacaatgatagtgcaccatcttgtcttggtctttttttaatacccatgcctctttctgtttagtgttgataatggccactgatttgagaagaatctactttattaagaatccttttcttagttagattttctttttaaatcagatagtaaatggtaagttttattaaatacctttttaacatcgaataagaaagtcatgtgagcttttaatgtgatgagcagtctaaaaatatccttttgttcttagaatagtcctacttggctgtg

SEQ ID NO: 107503 - DNA, 1099 bp, Homo sapiens
catttattttgttagagaacatatgtgagttgtagacctccaaggacttgttatacatattctgatatacttgtcaatgagcagcatcgtgcttgactatagtagtcatgaatgttagctttatatccctcaaaacattgtaagttttgctctattgcttttaggaaggaaaaacgtattatattgaagaagtttgatgtcattttaacttttgcttgtgaaattttttttcttaaccctgaaatggaaaaacaaaattattttacatttatataagcatttcttcattaacattttctgacaattgatctgtctttaatgacttttcagtagagatacttgacatagggaccctccaaaagaagatacttcagtattatatttggtttgggagatcctacatgcataagttatctattgccatgtaaaaaatttaccccaaaacataatggctttaaaacaatatccatttattatctctcagtttctgtgtgccaggaatccaggcatgatgtaactgaatcttctacctcagtctttctcacaaggctgcagtcaaagtgtcagccagagctgggaactcatgtgaaggcttgattgaggaaggattgtacttccaagtcaacttggtcctaatctagtgcttttttcactgcaacacatattggcgtattgttaatttatttgacagtcacatttggatctcatatcaagcccagaaaacacctagttcatttctttttgttactcagttgtacgttttgtgtgtggtgcgtgtgagtgcatgtgtgtgtgtgtgcatgtgtgtgtgtgtgtgtgtgtgtgtgtgtgtgtgtagctagagatagttacacagggggtcaggaagggaggagagtgttgaccacttttttctattttaaaaattgtagtacttttttttcctccataggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatg

SEQ ID NO: 107504 - DNA, 1496 bp, Homo sapiens
acatcatgggttagagctgtgtgggtccctttatacatggatttttttttcaactaactgcaaatagagaatagagtatttgtaggatgtgaaacctgcatatatgaagggccaacttttcctgtacacaggttccatagggctaacggcaggacttaagtatgcacggatttgggtatactcagggacactggaaccaaccctcaccccaccgcagaatactacgggaccactatacattaagggaaagttttcttaaccccagtattgttgaaatttgggggcagaattctttgttgtagtgagctgtactattcattgtagacagcatccgtggcctctaaacactatgccagtaaatgccaatagcattcctcagttgttaaactcataatgtctccagacactgccaagtgtcctcaagaggggagcaggagttagtggggaatcaccccctgttgagagccctgcattagtggaacactgaataagtaatttattgattgttcaaaggatttatatgaagtacaagaattaaagtttagaattatagagtaggaccacgttaaagtaacttaaatgctaggatagggaatttgagctctatattactggaaattcatatttgtattcagtagttgtgctgcctctcacctgtcttctattctcagccccttgctgtttaaaatatagttcttggaccagcagcattggcatcacttgggaacttgttagaaatacagaatttcagatccctcttaggcttattgaatgatagtctgcattttagcaagattcccaagtgacttatgtacacagtaaagtttgagaaacactgctttgatcacatcacatagaggaatgcctaactcacggctgacctgatttagagagtactgtgatgacacttgtgattaggaagatgggtctggtgtttttgatcaattgaaatgaagaggtccttaaatcataatgtctcagccatgaggccatgaagacttgcaattaattttgtaatttctgccacatgaatgaagacaagaactattacagaggaataattagcagaattttgtaactgattggatataagaagtaaggaaagtttgaacagtaatagcttttgaaagtttgtgattaaattctgttactgctagttaaatgggcacatctgaataaaaacaggtgttggtgattgggaggataaaataattttggtgttaggtttattgagtttgaggatctgtaggtggaaataaccaggtgtaggtagttagaagctgaagcatcaagccttgtattaaaattggggaaagttcagaatcatctgggtagtagtgtttatcagataaaagtttttaagtgagatacaaaagtaattgcaggcccagggctgattatttatttaaaggaaggggttagaaaaaataggaagagctctcagagagagttataagaagaactcaggcagagtaatatcatatcaagaaaagata

SEQ ID NO: 107505 - DNA, 2490 bp, Homo sapiens
cgttacagtgaatgactttagaattctcatagtgggactctacatggtttagagtaatatggatactaggtataggacctcttagccaaattagtgtaaatactgttttaaagagttattattgataccaagtggtgtcttggtttttattgtcacagatgcccaccttacaagtgaaattattttataggaagacccattttgctgttttagaaactatctttggatagagcacagtgtctatttgcattagcattaaatgatgctctataaatatgttatagagggtgctaaaacattacatatttaagtgagatgactttgcatgaagaaaattgtagatatgtcatgaatggatctctgattcaatgagaattttatttgatattgtatgtatgtcttcaaataatatatttttctaacttccagttttctgaataaaatttttttaattatattttttctctgcttttctcccgttttattatgttggcagagccactcttacatggactgctattttggaagaatgggtgttcttaatggcctttattcattcatctttattaaaatgaaaatttgttactttttttttatactttcagtgaattttgtctgagatgcttttttattttgactaacatctcaaacatataatgcctcattttaactagctgtcaataaatatagtctgaagatatttaaaataattttatgcattttaaaatctaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcaggtaagttactatctgcttgcaaaatgagttatttaaaatatttctgaataatcatagtaacaatatgatcctaagcaataatttgtacttgtaaagatacagattcctcagtgtgaagtttttccaaataatctaaaaggaatatgataaaataatcctatcctgagataggtatgtaatgtggcatcctttattgaaatgtcaaagtgtctgtgcaacaagtttatttactttttgatgcctgtacatatagttaatttttcagttcaacagtactatttctttaatacatagtatgactttctagattcttttatctttacactaagaacaaatagtgatttttttcttttgctttgatggccactttgtacacagttgtctggtaaataaaatggaatattaaatttgatggcttgttaaatagcgttgtttcccacttaatatgggactataccatattgtgttactgagaggtgaaataggaatgctactgaaaatgtgttaatgaaataaaatttgtgatgttttttattgtctttaaactactaatagcttagatttttcacattctgtttcactttgaatatttttgttaatttggctgagtataaattttggcattcgtaaaatagagagctaaaaatacatcttttcctggttgtggctgcaagtaataaattatcaatagaatgcttatttataaaaattcaataaaatattttgagcatctccttactgattacaagaatgtagcaatcttcctgtctaacaaatggaaaattaagaggtaaaaggaagagaacctaagaaactcaggtttgtatggtaattatggaataaatagttaagggttttatctttgttcagatctaaaactagataaattagaggttttggtgaaattttgtgcttgcttaagtgttatattctcagtccttgtgtgatcagtccaagaaaagtaccacgtattatattgtcttagagcactcaccacagtttttagttgtatgctcatttctttgcttattatttatcttcacaattcagcaatttgtgcttgctttattcacgactgtatactcagcagtgagcattgtgcctggcacatgatagaggtgcaaactttctttttttttttttttttttgcatgagtctagaaagaagcttagagctgtatacatccctagccctttctgccagtatcagtactttggtggaaatctgtatttttttttcttttgagacgtggtctcgctgtgtcacccaggctggagtgagtgcagtggtgtgatttcagctcactgcaacctctgcctcccgggctcaagcaatcctcccacctcagccttcagtagctgagactacaggtatgcaccaccatgcccagctaatttttgtattttttgtagagacaggggtggtctctctatgttgtccaggctggtcgtgaacttctgagctcaagtgatctgcccacctcaacctcctaaagtgctgggattacaagcgtgagctactgtgcctggctggaaatctgaatgaggttacatattagtatattactctctctttagttagagaataagccagggaaatgcatag

SEQ ID NO: 107506 - DNA, 1543 bp, Homo sapiens
taacacagcatactatcctgagattagttaactcatctaacaactgcttggagtatgtcaggtatcctaggtataatgctgcctttccagaatgactatttagtaaaacctagtaggcttttacaagagtgagaagccataattcacaaaataaatgaccagttaatctttttcattgttacatgtactcattttcctctaggaaaaaaatgttacctcagtattaaaatagatatttaaaaatttgagaaattatttttaatatatgtaaaataaatgcatcttaggactagagatgaaaagttctgctcagaacagaataagcaactctgagggaaattgttcttaattttgttacacattttcccacattgataaatgtaagattttggataacaggtttttgatttaggattgcaatattcaacctcagttattaaattgtactctattatataatagtaatactctcaagaggtatagtagctctttgactagtacttactgactactggaaattgtgtttttctggtttgcttttgatgtatatttttcccttaactaatacctgtttcttatctttaaatttagaaaagcaaattttgatatgtcaaataagtgcccctatgtctaaaactcttattcctgtgcacagcttgaatttcaggtcatattgattttaggatccaagtgtagtttcaaacttaagaatctgcttacttagcaatccttaaacattaaaatgcattatttcatatatttaaacacctatatgaagtctaaaagaaaaataagccaattaatttttatgacactaaaaatataccttagaagactaaaatatgccttttacggggcattacatgactattttatggtttggcagaactcattagaaaaggaaacttaaagttcttcatttgggtgagaagaactataaaagtcattatatccattatatactcatttatcacacagtcagcaaagagtatgaaaaataatatctaactgaaaaatgaggaatacttttgggaaggatttaaaatcatgatatggtgatgaaaaatagtcctaccttataataattgtgactgtcattgtaaattagaaaacagagaaaatattttgcacgcattgtcatatttccattgcttaaaatgcaaaataatgaagtattaaatggcctctctttcatggaatgatattactagtgaggctcagttatttttaacactgattaaggagtgggatggtaggttgaaacatttctagaaccatcaacaaaaataagattttaaagtaacccttttggttagatttttctcaaagccatattttgttaaatctgagtgaaatggacaatagatgaccatttgtgttcatataaagaaatttgcaaatagaagtaataaatgtcagggtttcattatttaggatacttggtaaaaatgtgtcttatttggtgagagctcaaatatagtcactgttctgaaaaaaactagcatataaagaaccatgaaaaactttaaaactctactggcag

SEQ ID NO: 107507 - DNA, 2582 bp, Homo sapiens
gtgacattaaattttgcagatatagttgaagtttttaaatttctgaatgtttagataacttgcccatagggtgttagacatggtgatgacatttttattactttataacatatttttactttgtctattagtttcctttggtaatagcctatcaggctaacataagtttaaacatatgcttttttatttttttaaattactaaataatagtgtttactatatatctccttccaaaaattttgagcttttttatttaaagaaaatatttttgagagaattattaaaccaacagcttatactatgcccacttaacaagagtctatagtttttcattcttttaaagatacgctcagctcttataaaaataaaccatattattaataggtaaaatggatattaagaaaaactttaatttttttattctttttattttcttgagctactggctaagaaaatgtacatttgaattacttgatttacttttttgttatagtaattattaagcttgctatgtaataggacacttaagtaatactcttcattaaaaaaataaggacctcttttctggagtacaatatcactcataaacttggaatggaagaattacaacataggtttacaccataggttttattcctttctctttattggtgactgactaaatgtcagtgttgttttctttttaaatagatgagtaccactacattctaatcttaatcaaattaagaatgaaaaactattgttactatgaatatatattcattaactgtgctgtcttgtcaacttgctgctgaatcagcctgcattgacattctttgcctttctgtgtcttctctatctttactgtttccattagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgttttt

SEQ ID NO: 107508 - DNA, 1247 bp, Homo sapiens
tattagaactttatgtatatttactgtacatagagacttgtttgaaaacatgaatagtcattaaataaagacattgttaaattagtttttgaataccagtgatattcataactacttgacaggtatatatgaaaattctactatcgtgaaaaaaaatgaatatttgtactatttttggccatatttatatttatttctttcatatggtttgaactgttttagcattttgtaaattcacttgagagttttctttcatactggttaaaatatttcaatgatataatgaagatgaatgcaactcttatttttctgccattttttattaaaatacattgaaactaaagtaggctcggggttaactttaaaagtgatatttgagaagtgctttagagttgaaagatttagtattttaccacgtgcctagtagggttctatttgctaactctaatattgaggaaactattaaggttttcagtagtaagtgttgcttctaatagccatatacaggaaagttttataagataacccacggctaaatattttgcattaaggagctgtaggagtacagtgtataagtacagaaattgagagaaatgtagtcattttatatgtgaaaacatctgatttgagtttttgataaatactgctaaaacacagtatatgaacaagtaagaagtttatgtatgaaagtaatcaatgtaaaatataagaaaggaataaatggtacccattttgaatttttaattctaataggagagtagattgtagattgaattgtctttcctgtttacttgttaattagaaaatgcatccttcataaacagctcctttctcaaattttttgtatattgtgtttgtgtttgggttttagtttgtacccgcgctaagttttggttttgttgtgtttggtgttttttgttttgttttgttttgttttgttttttcttttttaaccaacctgtgtattaggtgttagccccaatagccatgcatgaaatctttaaataaaagttaaaaaagttctttagaggcatatttctgtaataagttcattgctctatgttaccatctttgtcctcgtatttactaaagtgtgtgtgtatgtgcgtgtgtaacctagtttattttaattatcaaaatgtaattaatgatttgtgggaatcagaaacctgttttcctaaaacaagactgtaatatcagattgaggatagttggcatgttggccactgtaaaattttttccttttt

SEQ ID NO: 107509 - DNA, 1569 bp, Homo sapiens
ttcaaaacacgattaatagttttagagcctcatttccttatgtgcataatattgctacatagacatgatatgcaagttgtacagtctcaattaagagaaatatcccagggaaaacctaattgtaaagtgacagttctatctaaaagccaaaggtaggatctaggtgactgggcctttcttaaaaaacaacaacaacaaaaagcttcttattatggaaaattatacaaaaaataggacagaataatgaaatggacctccatgtactagcttcagttatcatcagttcctggtcagtcttattcaatttagacccctacctacataatccttcttgatattatttcatctgtaaataaatcagtatatagctttgaaaaataaaagacctttttagaaagtaaccacagtatcattattacaccaaaattaataataattccctaacattctgtcaagtgagcattcaaatttctaattgtatgtattttgcagttttaatcaggctttccaaatatgatccattcatgtgattgctagaaatagcttttactctgtttacccccaccccattttcccttgcaatttatttcttaaagaaactgcttcatttgttctaaatttttccagtttaaattctgccatttgcatcccacacacatgcctctgtattttctgtaaattgatagtgagatctagagccttggttagattgaggtttaatttgagggcaagattacatcacacataagtggtgctatgtctttccatcagaaagtacatgcctacttttttgtgtgtgatattagctgccatttggtgctcgatgcctagatctattaaccctgttcttttaccatatcatatacctagatgtctgaataattgtcatgctgcttcctatcaactttatctatcataacctcacatcttcttctggtttttatttctcttctccagatcagtaaaaactcctttaagtgtacctcccagttcaaaattagtctgtactcctattatacatgtgctactacagcagtttgctaacatgcattataaaatattcaaaaatggaaattttagctatctgataatatatttaacatgttaattttttctcactaaaactaagacttggggaaacaatatgattgcatttcattttaaaagttaacttttttattactaaaacatttttggtaaaactacatgattaaatgttcttcatgcattttttattttcaattttatactttctgattcagtgattgaaaggtctgatatcatggtcagtgcatgttgatatttggtttttagatgtgataactaaaatgccacctctcaaaaacaaatagattcaaatggaagaagtagattgtttggatgttaacagttttcatcccaaccactatttttagagtttatctttatgttctagatatttggttgttcaatgtcttgctaatcaataacttctccttcacattagctactgtttcagcacattataggtttagtgtgaggtttattgttaatgagtaaatgtaaatatattttaactggtctgctgat

SEQ ID NO: 107510 - DNA, 1096 bp, Homo sapiens
ttctgtacagttgggcaaacatgataggtcttctttagcaaaagaaaaatttccaagagaggaagacctttagaataattggtgtggagtaaataacgtacttgacaattagtattttttatttgtgccactgactagagatgtatgaccttggtcaaattgcataaccttaatagtttcaactggcctactattaaggattgagtaggaccatctactttatggctgtgttcagtggtcaaagttataatctatatggtggggaaaaggataatatagattatccgtaagtcatcccaaatctctctcacatttacaagtgcagaatgatatttggctgtactgggtttcaatattttttttaatctagtacatattcaaatggagatagattagaaaattgagcaacaatagataaaccaggctggtattagaaaatgaaggtcaccatgaatgacagagttataatgtttcagaatctattcattggaaacgttattgaaatgagtgacttggacttactggttgtaagatttttatttcaaaatgagctaaacaaaatgagccattaataaacttaggattgttagtattctaaagacatttttataatttgaaagaaagtaaaacattctttttggcaatctaaactatgttacccacatttaaacaaaaacaattggaaaatacttataaatatgtatttatatgggaatactatcatggtaagtagatgaaacatatttcaaaaccaatagtgctagttctgtaactttgccgtgtctgggtcccaacaattattgcagttatttaagagtatatgtgaagattatgtcaatttaagtaaaactgagacctcttcattagtcggcgttatatatgttaacaaaaacattcttctcttccaacaaggggtaatagtggaggcttctaccctgctccaacctaactttatttctctctgtgttctctactattcattgattgaatggtcttggcagattatttaacttcagagctgcaatatctttatttatagaatattatctcagtatctttttttattggtaagaaagacaaaaacaaaatcagatgt

SEQ ID NO: 107511 - DNA, 1033 bp, Homo sapiens
tagtttaaatgaataacatgataaatatagatagctgttattcctgtaagtgaaagtgcttggggtcctcaagatgtaaaagatcataaaggggtcgtggggccaaaaatttgagaactgctgttgtaaactgtaagcagtatgaaggcaggggtcatgtcactattgtttagtaccatattcttagtgcataacacagtgcttggcacatataagtacctgataatttttttaatttgacagatcaaaattgtatatttttatgatatacagcatgcagcgtgatgttttaatatatgtggaataactaaatcaagcaaataaacatatgcattaccttatgtattccgataaacaggttttgaatgagtaggtaaaggaatcaagcccttttttatattctcttcagtttataatctgttaaaatttctgcatcatttataatatccatatcacagatactatatttcagtatatttaatgtcagtgtctataatatcactgtatcaagtatgagatatcaatatataatgtatgaaaaagaacagagaaaaagagactatagaaatatttttaaatgttagcagttatctttgtaatagacttctcagtgaatattatttttgttatattttctgtagtttctgttttttctgcagtgcctttccccacctctgtaagtagccttttagcataagaaaatagagatctattgaacacctgagtcactggcctggaatgttaagctggtcatactggttatgcagtgtgtcagcactgttaactatctgagaaaactgaatttctttccaataatttactatagtatattgcattctttagtaaatgtttgtaaatattcatgacagtgttagtagagaaagaatgtttttacatttttttagtgtatggataatacatacaaaacaatataaagaggtgttttctaaggtctcattcctatacctatttaccctacccccatctacagataaccacttttattaatttatgtcttggcactgtttcttta

SEQ ID NO: 107512 - DNA, 1010 bp, Homo sapiens
tttttcccacttttttgttctatcatggtcagtacattttaattgaatgctggacactgtgaatgttatgttttcaattgtttgaattttgttcttatttcttaataagaattcagttattttctggaagtcagttaatttacttcaagatcaacctgatcttctggaacctgatcttctggaagtttgtttttaagttttgttaggatggttatagagtagcctatcttctagagctactttagccttctaaggtgtgaacctgggtctctgctggatgtctcacatgttcagtgaggattttctacttcagctggttggatcaataagtatcactcaattctaatcaagttctggtaattgttaagataacagctccctagcaaattttctttctccaacagttattctttgctctgtgcatgcccagcctagtatgctgcccagggaactctcatgcagatttctggagctttttttatgtgtgtctttgtcttcttcaggaccctgttccacagatttcagtcacctcaactttcctaaatgccgaactctgtctccccagttcagcaagatcctgtgctcttcttgaatttttctcttcttacgtcaccagaaaaaaacagagttatcaaaagataacacatgtgcgtgtgtgtgtgcgagtgtgtgtggatggatattttgtgtatatgtatttttccatgatctgggatcccagtcctatacaacacagttgttcagtgtctgaaaactgttgttttatatattttgtccaattttttattagtttatgataggaaggttagtctggtattagttctccatcatggctggaaagcagaagtaaaaatgtatcacttgtcagtataaggaagaagcattagggcaagatatatcaatcaaatgaaacttttacagtgccttgtggagttataagcagaagagagggaaaatgccaacagatagatgcagagcaccttgtagagaataaacaaaaggaagaagta

SEQ ID NO: 107513 - DNA, 1839 bp, Homo sapiens
tcgaggtttcttttgtttggttggcttaattctctgtatgtctcatatgttcatttcaagcttgagccttgcttaagagacttctgaggtttataaccctgttcttctccagtttaccttaactgatagcaactccaaattttaaaatgtgaaactgatcccagtccccattagtcacaattttgtatttaggagctactactattcttattcagggtattgtaagcgacaaatgactggaaaatataagttgttgaactttaccttgccattcaatagtttttggcataatgaatcagggacactaaactgtagtgaattctattcttgcctgtttttaccagtgctagaaaaatgcaaacagctgctctgctaatgtaagcaatgtttgaatttttagaatggactaaatagcaggagttttgactatgaagatgagaatccagttggggaagatggcattcagcagatgtaccccctttacaatcaaatgtgctaccaagaccggagccctggcaaacatcatcaaaataacgaccctaagagagtctacatcgacccacgagaacattatgtgtgatttttctctttttccaatgggcgttctaacaaatgtttattcttagattggggagagaagctaaggccaatagttattttactgtctctcatataagaacagtcccactctaagggtattggaagtcttaatgaatgacgtaaagccaatagcaaatttcttttcttcattaagcgtttcttaaccaccagctgtgtttgtgaacttgactatagctttgtgtgtttctgtgatgatggtatttaactgctaacatttggcctacaatggcattttcatttaacagtacagcatctgcctgtgataactgcagtgattctccagaaagaaaggccccagctgatactattaacctcgttgggtctcaggcatgctagcctgttcatctgtaattcacacaggcataaaaatgagttcagaatctatttcactaattatttagctgggatttggatttccctgacatgcttaatacaattacaatacctgtgtacaaacagaggcctgaggaaagaggcaaaatttgcttttcatccaaacagcaacaaaaggcagttgaaaccttcaagcctgttggttgcttttaaacctttgtgttattatgatatatattctttgttgagcactgaggtcctgagggatacatatctcttgctgttttctgcctacttttgactagctgtatgtaacaaaggctctacttttgctctgtcactgttcctacagtcctgttctttactagctagattagcctattttgcacctattaaattctaaaaaccttgtttaaatggtgtacagcctttaaccttgttcctcttttctctagtattgtacatgacaggctcagctttcacttctgaaatttctttcaaactaatcccagccacacagtcttcacctccccttctgcattcttcagactacttatcatccatgttttatctacctcagaaaagcctgctggaaagtcaccatgaaataacttctgctcttaaaagccaggtgaaaatttagaaaacttaaaagaaaaggcacttcaatatggcacgtatgttaaactgacatgttttttatcccttctcccctactttacctggtcaccaagagtcaagagatgctaaaaagtaaataatataatgacttatctactagggtatcccgcaacactttagtgtctgtaaatgtgtcttgagttttctcatctccctttgccagctttccatccctgagattgacagtagtaattacagtgagat

SEQ ID NO: 107514 - DNA, 1048 bp, Homo sapiens
agaacatcagatttgctatgctggcttagaactgtgtcctatcctactacagatgtgtctgtcagccatgaagagatgttttaggtgtctcttccagaagttgatttccgctaataacccacagtggatctatgaataccagagttgtacgtgattttccaagtgaataggcgccattgttttggttttaaataccctttccagtaatgactggtattttttaaaaacctaccctagcatgttgatcaggctaaattaagttcctctctcaagccttattgatggctcagtgcccattatattttaactacaggtaacagcagtttgtcctaaatgcattagtttgcacttgtccaggttgtagctcttttatgcctctgctttttcccacatggtcttatgagaacatattgcatatattcccttcagctgagcatttcaatacccagacaagtgtttgtcattttaggcctcatcacatacttgaaattccaagtcctttttaaaagaaatgttaagtagctggtgttgctactagatccctggattattccacttgtccatccataaaagttcctgtttattctctaccttctgtttctatttctaagccaatgctttaagacataacatctgctccagcctgttcactatccatgtggttttaaactcttaactttacttcttagcttcatccctgtaagtaagtgctctctacctcacaggggtcttatgagggggaaaaaataagatgtttaagggttgttttaagagagagatccttcttttaaagtgattttatcaaagccccttgggttagaaatgaaaaactctatagctatttttttcctattctcgttttgctatttttatttctgaaaagtgatctgtctgaaaagagccttatatctggttttaacttctcctcattgacccttttcacagtgaaatctctactttatccatgctctgaactttttatttatggagcccaaactaattttcccacaacaaatctcacatacttttactcctatcattaaacaaa

SEQ ID NO: 107515 - DNA, 1047 bp, Homo sapiens
ggctgcacttctgtgtgtctttcaggaagccacagggcagggggcgtctgtgcagagaagcgggggagtgagtagcaggcaggcccagcttgtgtaccagcccagtgacatatatagaaacataaatcaggctagagccggcgcgcccgggcgcgcacctgtgtatggacccgcaggcatgtctgtacactgggtgggcacctgtcttgtgagtggctccgggtgtggctgctcctcggactttcagtttatgtaagatttatctctaggggcctaccttcccccatctccagaggggaacataagaagtttaacggagctgggactgagcagattaagggagtggagcggaggctgggccggagagagtggggactgtgagtgctagtgggtaaggatccatctgtttgccccgtcccccagccagaaaggcattttggaaagactggcgtggcaagcgtcgccctgaaacgtccacagagcccaagaagtgatgatcactgagtgagtggcactgggctgagactggccagtttgttaacaacagggatgctagcagttaggaaggccaggaggaaactcaggatggggaccatctgctcccccaaccccagcgggacaaagacatcatcggaggtctgcaatgccgactggatggcctcgctcccccctcacctccacaacctccccctttccaatctggcaatcccaggtattcgtctattcctacttgttcccactgtgtttaattctgccattttagtgttgttaaggggttgggttgcttttctattgtgctgagaaattaattgtcagtgacccctttttatttccaaaccaaaaacttaacactgaagcagctgctttaaagagattgcagtacactgcatcattggtaaaaggactcatgaaaacagaagcatcattgtttttgtttgtggtttttttgtttgtttgcttatatttgctagccccattctaagaatattatccttcttactgttgttatgtgtatgtgaggggtgcattgtcttaaatcacttgaag

SEQ ID NO: 107516 - DNA, 1587 bp, Homo sapiens
cttacagatgataccaataggcccttaagtggttaggggactgctcacctgttgtcttgcgtagagacgctggaagcccctcctgctagcattgcgaggaatgcagagctcacatgctgggcttgggtaactttctcttcccatgctctagggacaaagaaagacgtggctgctcccatggtggtttgtgcttgatcttgagctgaagcaaataggcaaaatatccttgagaagtgagcagaagaggggttatagtagaaaagttaagtgataagatagctagtttttttagtgaatatattctaggctctctagctcgcttatatgggaatcttgctttcacatgggctctctggagtgttctcaggcacccgatctggctgctacagtattacttttggaaatttgtagctgttgcaaatgtatctctagggtggtcagttgagaatatccccaaaggtgaaacacttctgagctttggtttgtgtccttagttggatatggaatgtgctcttttggatggagaacagaaatctgaaacaactgaacttatgaaggagaaggagattttggatcatctaaaccggaaaatagctgaactggaaaagaacattgttggtgaaaagaccaaggtaaaagaaaattatatttcaatgcagtttttatgggcaaagtggtggtcccagttgattgaatttaaatgttgaatgcattactggggttttggatttgtgtgtcatgttcctggaggcagtggcactagagaaaaatcctaagatcatacattgtcagaaaccaagaactgccaggtactgggcagctgatgctgagagagcagagttcatataatttgtgagccgatattcctggcagctttatcctacttgagatgagtgcgttgtttgtttgctttttttcattggcctttctgcttttctgattccattgtgttttttaagtaatttctttagtatactgaagttctttaccactgctgccctgtagggatggcttaagcaaattcaaatagggttgcctcatttcttttatttcttttcatttttctgtttattaaacagatgaatgagaaccactcatctcacctgctttgccttgctattgttttcaatgcaagtgcactgctttttgacaaatgtattggagtttctaaaattttcttcttggggtagtcctcacacactgccaagagaaagctatctgtgaaacacagttgacacttatcttggaaaaggttctgtgtatacattttggatcacaacctgaatggtggctgatatctattagggaaagtatgaaaaatcacttgcaaattttagaattcaggatggtagttgggtttgtctgtttatgtgtttttttcctctgggaaatatacattactctcctctcccattctgagttagttagagcagaactaaaaataaaattccaataaaactgaaaataaaattccaatttgagaaagaaaaagcaaataagctttaacacattcttccttactcaacatgttctccactaagctgagaaaaagaaaaaatttttagtttgagtaagttctagtggtaa

SEQ ID NO: 107517 - DNA, 1068 bp, Homo sapiens
gcagtgacacgatctcggctcactgcaagctctgcctcctgggttcacgccattctcctacctcagcctcccgagtagctgggactacagacacctgccaccatgcccagctaatttttttttttttttagtagagacggggtttcaccgtgttagccaggatggtctcgatcttctgacccgtgatccgcctgcctcggcctcccaaagtgctgggattacaggcatgaaagatttttttttattagttgttgatttgagtttattattaacaatacaaacatttgagagcatcaggagtacttttgttatttcttcagatttgagacctgtgttttaggccagtggctttctgtattatcaaatatcatatcagtgttttctgtcaaagataactttaaattttagggctttatacatgtgctattaaattataatgagtagtcttcttttttaaattactttttagctttccatttggaggtagagttgctgcaaactctggtgatgcagtacctagaaatagaactcttgggataaaattattttgctgtgtaaatagggcaatctttgatgcacacacataggagagaacaccttttcttagccagaggacaacagatattctgtatggctggttttattaaggaaaaaaaaaattctgaaactaaagactaaatctaacggtgctagtatattcagtttaactatggattagcacacgtgggcatcctttgttctgttaataatgccattgctttctccaactcttgcacaattggtgtgtacagtgagcaaacttaccattgaagatcgaagaaattttcgttgttgtctgttaaacttttaagttgttacagaaccatgttagattggtatgtgaagtaggggtctcaggtttatgatttctgaatttaattattttaagaaaattacatttctaaagccaaatatacatttctaaatttaagtgaaaaatggagactcaagtgaactggtattgatatcatgtagttttagatttgaaccataacatcttttatacggaatctatgtgtttatgtagga

SEQ ID NO: 107518 - DNA, 1028 bp, Homo sapiens
aatttttaaaaaaaagactttattttttagagcagttttatattttcagcaaaacccagcagaacttacagacatttgccatattccttctgcccctgcacatgcgtaggctcccctcattatcaacattctccaccagagcagtacaattgttacaattgctaaacctccaccgacacatcgtcatcacctagagcccatgtccaaaagttttttgattgcttatccctttaataaaattattagagcatgcatttcctttgtagatatatgatatataatccatattattataaatatatatagtgtgcatgcccaaagaatgtatatatttaaaatcgtgtatacatactatgctacttgtgtatacattagaaaacatatgttgagaaactgaaaaagaaaataaacaattaaaaacgagtatgaaaggggtctaatttttttctgcacagtccagcagattgtgttgtgtaccatctgggatacatgtatccctattagacacctctggtctgtacgtgtgccaacttttgactctttaatctccacattagtcttgttttctatgaaaaattgaagaaaagaagagcttcctttcctttcctttcctttctttctttttttatttttatctttatttttattttttgacagagtttcacccttgtcgcccagggtggagtgcaatggcacaatctcggctcactgcaacctccatctcaagcaattctcctgtctcagcctcccaagtagctgggactacaggtgcccaccaccacgcccagctaacttttgtatttttagtagagacggggtttcaccatgttggccaggctggtctcaaactcctgacctcaggtgatcccccctcctcagcctcccaaagtgctgggattacatgcatgagccacccaccacgcctggccaagaagaattttcttgtaacgctatgttacacctttggactgcagattatgtttaggttatttactgagttgtttttgtacttccttctccattttaaa

SEQ ID NO: 107519 - DNA, 1381 bp, Homo sapiens
gagtgtaaaatatacagtcctttcacagaactttatagaagtttattttaacatccatctatgacccagcaactccacttctagatatttacacaatataaatgaaaacatgtcttcatataaaacttcttcaagactgtttaaagtagttttttccataatagtaaacaaaacaaaacaaaactagaaaacctaaatatccatcaataggagcatggataagcaaattgttaggtatatttatataatacaggactcctcaacaataaaaaacagtgaactactgatgcctgtaacatggagtgaaagagggctgacacaaaagaatgcatattgtatgattccatttatataaagtggttacattttataagtaggcaaacactttataacacaggcaaaactagtgttaaggccgtggaaatcagaacaatgcttgctcataagggtggaagttgacaggtaggggcatgaggaaatgattggggtgacagaaatgctctttatcttgtctaggatattattccatttgttcaaactcataaatttatatacttaagatctatgcatttcactgaatgcacttttttttttaattaaaaatattttagccccagccatggcaaggacacatatacaaattatagcacaataaaaaagtgacccataaatgttgcttaataccaaattaattcaagatgaatcatagacaaatgtaaaagctaacaccataaagttcccaaaagaaaatatatcactgggttgtgatattacatcatcagatattatgtcatcaacaacatcatgtgatattacatcatcaacaattatgtgttatttggaaggattaaaagaaaaagacattagaaaataatttttgttggttttttttttgtttgttttgttttttcttagacagaatcttgctctgtctcccaggctgcagtgcagtggcgcgatctcggctcactgcaacctccgcctcatgccattctcctgcctcagcctcctgagtagctgggactacaggtgcctgccaccacgcctggctaatttttttgtatttttagtagagacaaggtttcaccatgttagccaggatggtctcaatctcgacctcatgatctgcccgcctcagcctcccaaagtgctggggattacaggcgtgagccatcacacctggctgaaaataatgtttttaaaattttattttaaacacatttttaaatgactctataaaatttattaggaattaaaggttatattgctaagtatgtttggaaacaactcatgcagcatatcagctagcagaagatgacctctagtatacagatttgaaattttgactgagtatgatgagaggaaatagaaatgggggaaa

SEQ ID NO: 107520 - DNA, 1107 bp, Homo sapiens
atttttaaaaaatgctaaaaccattagggtgttaatagatttcttcagtttcaacccaccgcataacaggggataaataaaaatgggtgcatttgtaacaagagtagctcttccctgttcttttgcatggtgcgcatgcattcttggccctgcatctgccctctgctccttatgcatgaagaactttcagccattctttcaggtgattttggacagtgtcttccccagctgtcttcacttttggaattgctgctgttggaggaagtgctttgatattgcgactaccctggaacttctcgggagggccagtaactggcctttaccacttagcatcaacaaatgaaatgcaaagacttaccttctctgccctgtacacttagataggagctttggaaacagggatgtggccatttcctaaaggtccattcagcctgcagcttgcctgaagtactccctcctgcttcccgcaggcccatctgcccctaggacagagtaacagctgtggaagtgtgctccctccctcactggcagccatggccaaagactcagaatctcggaggatgctcagaggtacgtaccttttaaatcaagtgtcatggccttttgttaagcattagaattcttcagggggaggaagtgagaacaggggtagggatgattagaggagggatcaaccaaaggcctaattttactcttaatgtgttctctttcgggagggatatataacttttcctatttatacatatagctggtatattttaaacattcccgttgtactttatagatttgatagaactctgaaaccagaaagacccctagagaattactaaccttcccattcgattaatagaaagaaaagagagaccagtgagatccaaggagattaccagggcacttaaccaagatcactcacctgggttgtgtctgagccactatgtcgaatgaaccttgtgctaaagaatcattgagctgacacagcaaatatagcattagtggcccagaacagaattcttataggccttttaatgtagatttgagcttttatacttcatagttgttatgtttcaggtagactttgactctcagcatttttttttgtagtaatac

SEQ ID NO: 107521 - DNA, 1005 bp, Homo sapiens
gaggattcagggcctttgattgtgtttctgtttggtttcttttgtgtttgtgtgttgctggttgtgctgagatgtaggaatgccataggaaagtgtcaagtgatcctgctgaggggtaagagactcagcagaccacttcattcaaactgttgcttgcactgagcacggtgctctttctttgatcttcttggcttcaaaacaaattagaccaaggcccaagcttcataggcagatgtttctggttgctggcttgtgtctgtagatgtttaagattcaaagactgaaaaatgaggcaaactaacatatttatggctccttccttaggttataatcaccaacagatgagtgaaggacacaggcagaaatctgaattttataaccgcacagcatctgaatcaaatgtctacttgaatagtttccattatccagatcacagctacaaggaccaggcctttgatactctgagcctcgatagctctgatagcatggagaccagcatctctgcttgctcaccagacaacatctctaggtaagatttatttatgggtaaggtttctggtttggaaaagagcctactgctcacaaaaagtaaagccatcaatttgggaactgtatatgcacaagcccaaatttttgagacataaagggtctgtaatgcagaagagggttggtatcatgatggcctttgaaagtagtttctcttatcttgtgtaacttagctagtcaggcatcatataatctgtttccacctttatcctgtttttctccacttgagctcaaatttacactgtgctttaaaattgatttccttctgttggttagctctaagcttcacttacactgcttttgatttaaaaaagagggcccaggcacagtggcgcatgcctgtaatcccagctactttgggaggccaaggtgagtggatcacctgaggtcaggagttcaagaccagccagaccaacatggtgaaaccctgtctctactaaatacaaaaaattagctggg

SEQ ID NO: 107522 - DNA, 1999 bp, Homo sapiens
gacgtttcccatctaggaccgttggatagggttcctttctgagcttccagctctgtagtatctatcagcccgctgatagggcagcctcccgacgccactcaaaacatcttaaaggccccaagccaaaccccgctactagtagaaccaacagtctaaacgaaagagccacgacgctctgcgcatgtgcgctcttcgcaagctgaaaatcttgcggggagctctttagcaagttccgccttccagcctgaagcgcatgcgcagcctcggttccgttgcgtagcgtgtccctcagtgggacactgcagggtgcggggacaactacgaagatggcggttgcgcgcttggcagctgtggcggcctgggtaccttgtcggagctggggctgggcagccgtccccttcggtccccaccgtggcctcagcgtgctgcttgcacggatacctcagcgggcgccacggtggctcccaggtcagtgtccgaaaggcgggagtaggatgcgttctttcgaacgcctcgggttccgtcagttaccgtgcctgtgcagtgcgtctttggcgcccggttcaaaaatgctcctccccctttctcaacaccccagttctaggcgctttgtagacttctggtgaaggctgtgaggagagctctgccgcggccctgcggcattctgggcaccccgggccctcgctggcgttttacactgtgcagtttaaagagctcctgctccttacctgcctcccctgcattaaaggccaacactagaaaaaattaaaatgtgcatttaatgcattattattagttacttctaggaatttgtagattgtgactcctaaaatgcttagactgactctcctttgagtttagggaacctaacaatgcgaggcatgttctttgtaaaagtgtagacgccctcataagcctaatttctagttctgctttcttgctgcacccactcagtgaaagaaccataatcattattgcacaaaggaaactagaatttgggctaaaaatcagagaacctcttatatgtatatatagtctttgaattagatccttttatttttttggctttgtgtgtggttcacaccattgccacgtagctgtcagatgatgcatggtgcttggagtggtaattaatgtcacggcagagatcttttgtatggagatttttgtatccagtttttaaacttttataatcagattaacttgcatttaattgtgcgcaaccaaaaggcatgttacacatgcaaatactcctagtaaaatgtagtatgtcaattcattaaccagagtataatattatttcatctagttagcacttattcattgagcacttatgcaccaggctttgaattaatccttatgttcaaagatgatttatgaatataattatatgaatctgtctacttagaacttacattaaataaattataatcatctcggggaaattatgttttaagaggtgatttctggaagaggatagtgagaattttttttagtgctcagctgagtagatgggaaatgaacatgagtggatcagcataactggtccttaccaaaagttttaaatttggcatatttctctatactttgaaacaagcttttatgtaaaaaggataactttaaggccttcagttacatctttaaaaaatcaacttcttaattacaaaatggggaaaactttagcagcacacatggattctcttctcaagactgagaagttttcaaagtggaggacggcttcatttaatataaaaaaagaaaatgtattagtccaaagactctaaggaagtacacaaaactagtgtctttggaaagaagaggtgggattataaatgactcttttaaaaaaatatctacttgtttcttaagagcaagtatagattttataatgggggaaaatttgaaaaagatgaagtaggataatcttatgaagttcaccaattgtactgttgtacttaaattacactaaaatctctgtgtaccatttacagaaagccaa

SEQ ID NO: 107523 - DNA, 1073 bp, Homo sapiens
catagtttactttttgtgtactttgtttagcttgtagacaaaagacgtcactctcattccttaatcgaccagaccttccaaacctggcttataagaagctaaaaggcaaaagtccaggaattatcttcatccctggctatctttcttatatgaatggtacaaaagcgttggcgattgaggagttttgcaaatctctaggtcacgcctgcataaggtaggaacaacacattactgagaaaatattgctactgttagcattacagtggagaattacttctgttctaatcagttgaagtaaatgccagcatttttatacattattttaatggtctgtaaacttgcatcttgtgatttagggtaattttaaaagcaacctttaaaagaccttttttaaaggcctttgtgccacgctgacaaccctggcagaaaaggacatcttaagggaaatattggtaactaagctctttagaggcaataatgtatgtgacaacaaacagatatactagttggctttcatacagtctcttatattatcattttccactggggacttaaggactttatttgatcactgtttatctaaaagtaatacatgtatttaaaagtatcataatgcaaatttctgctgagttttctcttccctctcctgtaatctgaatatgtataagcataaatagggataagtggtacttaactcaagcttgattttataattcctaatttttcacactgagagttattttagtaaataactttatgttattataaggtctacctgtagcagttatatgtttagtatccactgtccagaagagatggtatgatttcgtaaaaagaagattagcctggaattcaagaaacatgagttctagaataaattcgagcaataactatgacaagacaagtaagttaataaacattggacctaagtttgtcatcaaaagaaggaggttggactagagataacttctgagttattttctagcactaacagcctaaaaatctatccatctaaatttttagaagagtgactcacaaacattcattcaataattctagaaaatacagctgta

SEQ ID NO: 107524 - DNA, 1224 bp, Homo sapiens
gaagaaaatgaagcagagtaaagaattagagaatgatgaaagcagcacagttttaataattgaatggtcatgggaggcttttctgaggatgtaatatttgagccaaaggcctgaatgaagtgtgggagcaatctaaatggctatctggaggagagtatgccatgtggagagaaaagctgatgagatgggagcttcaagaagcaaagcgaagatacagttgggagggagggagggagagagagaaaacaatgagaaatgagatcagagaggtgatcaggcaccaaagtatggtaagggctctggatttaaagattatagaaagcctttggagggtttgcaagacatggttttgttttaaaaggatcactctactatatagggaaagacaatgagtgtgaaaatgcaaacaggagactttttaggagactattgcattcagttaggttgagagacagtgtgactagcaacaggctggtagcagtggaggaggtgagaaagtgattggacacaggaggtatttgaaagttaataagccaatagaatttgctaaaatacatattgattgtgatgtttcactataagcattatagtaatgaggaaggtgctatctttcttaaaaattaaagaagcagatatatagatatttagatatagatttttttcccctttttccaggtttgattactcaggagttggaagttcagatggtaactcagaggaaagcacactggggaaatggagaaaagatgttctttctataattgatgacttagctgatgggccacaggtgactgttttgttaagtatgatgataattactgtaacctcgtatttaagctgtttgttttgttttgttttgttttttgagatggagtctcgtgctgtcacccagcctggagtgcagtggcgcaatcttggctcactgcaagctctgcctcccgggttcacggcatcctcctgcctcagcctcccaggtagctgggactacaggcacccgccaccacgcccggctaattgttcgtatttttagtagagatggggtttcaccgtgttggccaggatggtctcgatctcctgacctcgtgatccgcccgcctgggcctcccaaagtgctgggattacaggcgtgagccaccacacccggcctaagctgtttctttagatatgaaaatgtttttatttaatttaaatgtttaatccattttgatatttgatttaaaatga

SEQ ID NO: 107525 - DNA, 1093 bp, Homo sapiens
ctagtatgtcataaagtaggaatcatacagtatgtatgcttttcagattccaccagctcttagataaccagactctatctcatttttgctatccctccatccagaaaattcccgacacttagttgatccttctttgaggaatgtttttctgttcttggaagaatggcctggagcagtggctttcaagctcacttgaggagccccagccatctaccaaagcatccagggtggctgtcagggagcaaagccattccaagctgcagggctctgggctgacttccaacttggaacagagcttttctaattatcgcttttacttttgactttgtggaggatatctctgaagaaaggagttattgcttaacaaatattacttagtacttaccacatggcagacatggggatgtttttaaacattgaaaaccaaagctttagagtagtatctgcttgtccatctggctgcctcacaatcatcccaggagactgccccagaatctgaatatttaagattcttgggtaatcctgaagatcagtttagcttgcaaatcaccaggcaacacctataactctcaaacttgcctgaagatatgaatcacccaggaagcttattaaaaatatggactcccagaatttaccaaatcattctctcaggagaatgacctcaaaatgcatattttaaaagagatgcccccctgcaaactcccataaataatccaagaagcttgggaaagcaggctgtgtatggccattttttatacttgcacaattttgaaggctttgtcattaggcagatatgacacttggttgtgatacgactagttttcttttcttgtttataaatttatttcatttatcttattgttatttagagacaggggttccctctgttgcccaggctggagtgcagtggtgcaatcataggtcactgcagcctgaaactcctgggctcaagcagtcttcctgcctcagcctcccaaagtgttgaaattaccgttgtgagccactgtgcccagccttttgttgttttatacttcgtgcacatcacagagcttccttaacctcagcgcttttttatgcacttaaatttttgacc

SEQ ID NO: 107526 - DNA, 1122 bp, Homo sapiens
atcctgagctggacttcctctgaaggccttaattgtttattttattacagttcatactccattctcactttccatctgcctttcccctgtaattctgtattccccagagactgagctgcagcagctgggccaaaaaactgcagacggttcaccaggtctaaagagagccttaatatttgcccttaactttcacagttccccgccaggttagatgctgccttcccttttaaccctatgctttttagcttttgtattccacactggtgccttgcatggacttttggtctgattctaaattgcaggccaccccctcagtagcatcttctcagtttaggacaggtcagtcaactggaagagaagaaaggagaaagaatgggaggaaaggctgagttgtaaggcccagttgctttctccatgggttaatggtcactgggctgcttaggtaacagggctccccatcccactgtgcaggggccacactgcacatccctctcccttgctctcctctctgtcacacacaagccagttgtttattgtctccatttagctgttttcaagcggcacaaaataaaggccctatcacttgtgtcacattgagtgctttctgtgttgatttgctgttcttcatttgccaggcctctggcccaaagagcaaagtgaatactcaatttgatgcacatggatgattttatttatacagcaactatgaacggattagaaacttggtatctctggtatgtaccatatagagaataattaaccaggttactttttgttcctttctgagaagtttgggtatggttgtcttagggccactttgggaggtgtttgatagcactgctcccttgaatctggtcacctgcagccttctatcagaacttccctcctgggtgtccagccgtatccttccagcattccttggctctgacacgtgcttggctttaagctctttgttggcttccagggaaggacatggcagctgtgcagaggaccctgatggctttaggcagcgttgcagtcaccaaggatgatggctgctatcggggagagccatcctggtttcacaggtaaaagcctcttccttgccccctggaccacaaggcgattttaaccagagggagg

SEQ ID NO: 107527 - DNA, 1050 bp, Homo sapiens
tagccacttatcataatagggagaagtgggtcctaagtagcagaaagacacttatcagtttctgaagagctgacctctcctctggttaggcaaagatgaaagtgtcacctcccgctgctaagtgccttctatgccagcagtgcagaaccttgttcacattagatagatgatttggacttacatcctgtcttcacaatgtgctagtctcagcacagggatggaaggttgaaacatctaaagtgttttcgtgtgttgaattcatgtattgattatgtgtttgctcccaataatcactgctaaatgcaatggagaaatatctctcctttgatctagatcactgtacactatctgcttagaaagccagctttcagacacctaccctgcttctcttagcacaggggcctttgctccagggaagaaatagaaatctctccaccgtcttctaaactgcttatgatggaaaacatcagcatgtacccggccattgcgattgtctttggtcatatgctctgggattgaaaggactctgtaccagaacttccataccagtaaaaaacaacaaggagatcaatgcatacttgctcaccaagcttgttgcaagcttgcttatcttacatcccagctttctttgccatcatcactcaaaaccagtgacttatctagtgtatttgactctcagagatgatcattttcccctcaacattttattaagaaaaatttcaaacaagcagttgaaataattttatagtgtaaatgcatatacccacacctagattctaccattaacattttgctgtagttgctttatcatataactgctcacttacagtagatcatttctttctatattttgtgttgtatcacttggtcaagatttatttcaaggcctgaagacattcagactaatcaaaatggtactacagtaatttattataatacataaataatataaaattttgaaaaatgctgacacaattcttaaacaaggataccctttgattttcaaaagtgagggctatttaacaaaatgcaagatgacaataaaacatc

SEQ ID NO: 107528 - DNA, 1037 bp, Homo sapiens
agttttagttttgaattatgtaatctaaaaagttttcagtttttagagttattctcttgattcctcttatggtttaaggtcttaggatggtgcttatcaaactgaagcgtatctctctgaggtataaactttactcagttgggggaaaaataactggtaattatgttaaacattttaataaaatagatgactgtattgtggaatgggatataagtatttcaaaaaatctgagtgcctataaaataaaacttcaaggacattttagaccattccatgggctgcctcagattgtgccttcaaatcctctggaatcatacatttactctcatattctaagttgactgtctctgtcatgaagattatagtcgtaaaaactgaagcagcattatttaagccaaggtatgttaaaaagactgtttctttaaaaattatctttttcttggtttctgtgcctagatactaactttgatatcactcttttctatagtacaggagagagaacagttagccatgaaaagatgtatagataggacaaaaacttcatataaataaatacctttcttcttataagccaaaaaatttatttttacatagaattggataaattttagaatacctattaggacaaagaaacaaatacaaacctctcaactctaaccaattagcttttcttaaaccctctcagttttggcttattctcagctaaataaacagcccagatcacaagattatagatacctctttgcttttttgtccaactgataccatgtgtctttttttttttttttttaatttgcctgatatgactcttgtttcttagagcaaacagctatcattccacattttctcctggaatgatttcctcatctctggttttctgccttccttgtctctcccaattatcagaacactaactaatgccatggtgtctgctgtgactaccatagctttttaagattatgccctcccctggtaaaactgttggcatggcataacaatctgttatcttttgtgtttcggaagtggaggggagatat

SEQ ID NO: 107529 - DNA, 1050 bp, Homo sapiens
tatcttgtgcattttaataactgtaaagtctgataacttgcctaattcagctaagatattgttaacaaattagaatgtaatagtgtttgatttatattttagcttatatttgatttacagatatgtgcactttttccccttataagtgcacaagttaatataattttgaactgattttctaatactaatgaattgattaaccaaaaatactgttttattggaagtgcaactggcaattatttttaaatagcttagatgactcttactgctcccataataacctttgttatttttcagtcacagcacttagcacgttacttttaatgactgatatatgaattcattatcttcattggagtttaaggtttttgtggacaagaactgccttgtcattcttattttcacagtggttaccactgtgctagcacatgggtgttcagtgttcaaattaatgtatatacttaagtgattttaaatataattaatttcaaaggacaatataaggcttcaagattgctcagcactatgtgaagaggaagaagatgaagatgaaggagaagctgcagatatggaaggtattcctgttctagatttgcttcagttccactagaatattgatttagaatatttgtaatttatgtggattaagaattcttcattgagttgtaagtttagcatttagcagcctagtgagtgttttatatatgtttagttcataaatttcattagtgtaaaacttatcttgatcttggactcttctattttactccaaacatagtcttggacaatatcatttttattggaataactattagtcataaatatttaatactggatacggctgcaagatattaattcctaactgaattatttcagagcagaacaaagtttgcttattatgcattttgtattttcttttccctctttgatagcatctttctattaaaacctgaagatagtgagtttcaatggggccttttttttttctttttttgagacggagtctcactctcgccaggctggagtgcagtggtgcgatctctgctcact

SEQ ID NO: 107530 - DNA, 1082 bp, Homo sapiens
aacttagaactgaattataccccacttcagtgtccacacttttggctaaattcctgggccaaaggaaaaattcattttaaatcagcactagagccaggttatttccatgcttatgccttcacgtgcacaagtgctatcatgaccttattttaactctttcctcagaacttcgggtgttgccatgacattgttgaatttgacacttgggactagtcaaaagaagtctagaaggccgtcaaataatattagggcatttcctgactttaccttgtgcccagatctatggtttgaactttagactgaagcttgaaaagacagctgaactccaaatttatggccatatgtttgtgaaaggcaccacataccactccacctctcaccgttttcagatgacccacaaattcttaagaagaggtgccagagcagctcagaaatgttgtagatagttggctctgacccacagagggagcagtgtttaagagtaggagccctgaagtcacttggctttgacccttgctctcccaccaagttttgtgatcataagcaacttgatctgtttaatctttagtttacttaactataaaatgggatatttatatgttctactgtttagagttatgaagactaattgaaaataacatgttggagacttaaattctatactcaataagcactcaataaaaggttttttgttttcaagaattattaatattgtcattttatgattcagagcatcttttatctcttaattctgattttaatccagtgataggaacagggattttgccagccacctacagtgttacataatgtcatgcagcttttttttctgccttttcttgttctcaagatgagcagcagtactttaggattaaaaatgtgagagattatacagtgggctacaactcactgaggagcagcatattttattgttgtttagaggcaaacataatagttgcttaatagttctatattattctaccttttttgtctaatatttaatccaaattctcttgggtctatctgcatctcttagtatgtttcacttagattattgttgtgcttttctccatgccctgaca

SEQ ID NO: 107531 - DNA, 1049 bp, Homo sapiens
tgtacggtaaatggcttttaggtttttcttgcttttttcctcctataatcttttttaaggtataaagtacgtgattagttacacacacacattcggcatattcttatgtgcttgttttcctagccagtctgctgtaatagctttctttcattttctaattccctctactttcttctcaacgacgcagtctctgccaatatctaagataccctttcttcaaaatcacccccactttgtctcaccatatctggccatggtaaacctttccaccaaccctaatgttcactatccctgtgtatgtgcgtgcacgaacgcacacacacccctttcattgagttggaacccttccatgagacttcactaggtcttttcttgctcctcacttcataaaatgattctctggctccatcgctaatgattcttcccattacttaaccctcccatccttactcctgccccgcctcaccaaataaatcagccaaatgatcacttctaagtagagtgatctccttccttttgtgagaggacaatggaggaaatgtattcttgacattcccaatctgtaattctaaaatcattttcctgtagacaaataaactgactgggaacttaaaatcaccatttataaaaatctttcctttgataatatttgttctaagatccaaacaattgacttaactttaaaaattgcctatcttgccgggcacagtggctcatgcctgtaatcccagcactttggggaggccgaggctggccaatcacctgaggttgggagttcgagaccagcctgaccaacatggagaaaccccatttccactaaaaatacaaaattagccaggcgcggtggtgcattcctgtaattccagctaatcgggaggctgaggcaagagaatcgcttgaacccaggaggtggaggttgcggtgagctgagattgcaccattgcactccagcctggacaacaagagtgaaactctgtctcaaaaaaaaaaaaaaaaaagttgcctatcataatcttatcttttctgattaatatctgttctatggacac

SEQ ID NO: 107532 - DNA, 1030 bp, Homo sapiens
tgtccatagaacagatattaatcagaaaagataagattatgataggcaacttttttttttttttttttgagacagagtttcactcttgttgtccaggctggagtgcaatggtgcaatctcagctcaccgcaacctccacctcctgggttcaagcgattctcttgcctcagcctcccgattagctggaattacaggaatgcaccaccgcgcctggctaattttgtatttttagtggaaatggggtttctccatgttggtcaggctggtctcgaactcccaacctcaggtgattggccagcctcggcctccccaaagtgctgggattacaggcatgagccactgtgcccggcaagataggcaatttttaaagttaagtcaattgtttggatcttagaacaaatattatcaaaggaaagatttttataaatggtgattttaagttcccagtcagtttatttgtctacaggaaaatgattttagaattacagattgggaatgtcaagaatacatttcctccattgtcctctcacaaaaggaaggagatcactctacttagaagtgatcatttggctgatttatttggtgaggcggggcaggagtaaggatgggagggttaagtaatgggaagaatcattagcgatggagccagagaatcattttatgaagtgaggagcaagaaaagacctagtgaagtctcatggaagggttccaactcaatgaaaggggtgtgtgtgcgttcgtgcacgcacatacacagggatagtgaacattagggttggtggaaaggtttaccatggccagatatggtgagacaaagtgggggtgattttgaagaaagggtatcttagatattggcagagactgcgtcgttgagaagaaagtagagggaattagaaaatgaaagaaagctattacagcagactggctaggaaaacaagcacataagaatatgccgaatgtgtgtgtgtaactaatcacgtactttataccttaaaaaagattataggaggaaaaaagcaagaaaaaccta

SEQ ID NO: 107533 - DNA, 1303 bp, Homo sapiens
tgtctcaaaaaccaccaccaccaccaaaaaaaactgtagtatatccatacctgagaaacattttggctgatctccatacggacggacagacggacgcacagatggatataggaagacagatagataaataatatgtacaataatggtgatggtaatttttttaaaacctaaaaagtctaacaaggtaattgaatatttattacaaaaagaacaaactaaagagatcaagacttattctggaaaacaaagcaaaatagaagatatagtgaaatttttggaatcatgaaggaaatggatcagataatattgatcatcagattttagaatactacaagacgcggctgggggaagagaagaaagctagaacacattaaaagatgttctgctttcatatatgaaatcataagaatttgtaaatttttttaagttgatgaattcagatgttatatctgaggaaaggaagaaaattatttctcttttcttttcacagtgctgtgaccttttctggaatccacctgttgagatgctttatagccagtgtaacaggaagtcttgactaatggttcccggtttagctgaagattcaaaaaaaaaaaaaaaagctttatgctaactggagttaaatacctagaagaatttcaacattgttttaaatgttgtgcatctgtaacttcaggaggatcacttgagctttaaaacctgtgccttctcgaaacaagaatttgtgcctgaggtgaaaaaagtttgtaagttattgaattatggtgttcattagaacagctactagctgattcccctattttaacaaactgacaagagcacatccataaaatgaaaacctgttacaactatgtacagaagggtttgacgttttattgggcttttgtcttttaaagaatatgtctactatgggtattttttttttaaatgttaaaatgggctaggtaaaagggggctgcttttctgttaagcatcgataggtaagttgatggataaaagttactatgtaagcctatttttttgagtccttatttgaatattgaaaacattcttgataaaatgtgttagtccatgttggaaacaaccgaaagaacagaattcaagttctagttctgatgtttattatatatgttggatcttgggcaacttacttgatttctcggaaattcatttgttactgtaaacgtgaaagctattaagattcaaatgaatggttttacagcaggtaacatgtgagaagacagctacatatttgtaaagccaaaccaacaaagaaatatagcaaaattcacaggtagattta

SEQ ID NO: 107534 - DNA, 1799 bp, Homo sapiens
tgtgtatctgggccagaagccctgtcttcatattgttttataaacccctcttagcctttattcctttttccttgttcatttcctgccacagcatgaagctgattatccagattcggattaatacgtactggcagattttttcatttgtgatgtttcctcatgtccactcattacattatgaacagattagcagttatgagggaaaagctctgacactaaagtatagggtatctcgccattcagctaattgctaggcggctgtacttttgagagtttgaaagcaaaatggggacacattcgtctacacttcaatcagagggcatttgtgctctcaaaaaacagacttggggtgaaatttttcgatgtggttctgggattgtacacaggcataggacttgtagataagttgtgtatttttcttttcagttggtaaattaaaagtgcttgagaatgtttttctcatcttaagcccagatttttcctctctctgtcttttaaagtttgccaaagaaactagagtgcataaaaacgtctatttgcaaccaccttcttcgtggctcaggtatcaaaacttcaaagcatcatctgagacagagaagatcacagaataaatttttacggagacaaaggaaaccacagagaaagttgcagtcgactcttttaagggaaattcagcagttctctcaagggactcggaagagtgctacagataccagtgctaagtggagactctcacactgtactgtgcatagaactgatctctaccctaacagtaagcagctcttgaatagtggagtttcaatgcctgtcatacaaactaaggagaaaatgattcatgaaaatcttagaggcatccatgaaaatgaaactgattcgtggacggtgatgcaaataaataaaaacagtacatcaggaaccattaaggagacagatgacattgatgatatttttgctttaatgggagtttagatgttcgttcatatgtgagacttttaagtgattaacaaggctagttcagtgttctaagtagaactgctaagatctggaagtaccacctggactcacagaggagctgctttagtgcagcattgcacaggagttcatttcagttcagtctacatttaaagtagcattgtgtcatttcatcaacaagtatttcttttttggcttcaactacatgtcaggtgttaatatgaaaaatctgccacagcctacccttgagaagcagatgtaattccttgagtgaggctagtaagtctctgaaaaactgaataattttatgacttactaggcaatttaataatcgtttgcaaaaaccattgtgtcttgaggtaaatgaggagcgggggtgggagatagcaaggaaacacctgaaaggtcaatttggtcttattggctccattatacataggtccgcctctgaatactaaagtttgtagctcctgacatttatgttttcttgtttatatgttggaattgatcaacaaggtttgccactgcttgtattaccagggactggttacaaccattatttctcttcatttgcttggcttatctcatattaaagtgagtttggagttctccaaaacgttttaattttatttatttgggtaccagtgattgattccaaataaacctttttacaaaaaggcaataaggtggtttatggttacatatgaaatataataggataacaggtagatgagaaagtaaaatgaaaaaatgaggttaggagatacaaagtagacccaggaatgaggctagaacatttataatttggtgttgatgctgtcatctga

SEQ ID NO: 107535 - DNA, 1143 bp, Homo sapiens
taattcagctgcagatgggacctgtcctggtacagagggggaacaaaacaacttgtatttggagcagtggagaaaaattcagtttttaaagacataaggaaagcttagtgagcaaaaaaatttccttacagactgattttttttttttaatttttaggttttgtgggtacgtagcaggtatatatatttatggggtacgtattttgttataagcatatagtgcataataaccacagggtaaatggggtatccatcacttcaagcatttagggactgataattctaatttttaaattttgattgtgagctagctttccttgttgtcatataattacaagtcagtaacatgtccaatatatttttctcatctttccacgtttcaggagaccagttttgattttaaatgttctcaatccagactaaagacaaccaagtattcttctcagaaagtgataggaactcctcatgccaaaagttttgtgcaaagattccgagaggctgagtccttcacacaactttctgaagaaatccagatggcagttgtatggtgcaggagcaaaaaactcaaggctcaggccatttttctgggtaacaaacttcttaaaagcaaccggcttaaacatctggaagctcaaggtactaggtaggtatattgcaaaaattatgttactttactttttctgttgttgttatgagtaaaagtattcaggtcacttttctttaaaatgtgatgtccagcagccgcagcggggctaaattgggatgtactcaaactgcaattgcatttgctgcttttattgtaagagcaaagctgtatcattggaggaagaagataaacaagttaattggacttcagtccccgttatgctcttcatcatttccatcagctcattcaggaaccattaagagtgtctagtgtgctgagcctgaggatacaactgcataaagacgtgacttggtcttcagggagctcagggtcttctgggaaaggcagcccttctgcagacagcttcagtgcagtgcagtgggataagggcatgagagcagaagcagaaggtgcctgccttccatgaggcccacacaagactgctggggtgttgtactgttgctacttgctactgtttgtagcagctggactctatc

SEQ ID NO: 107536 - DNA, 1050 bp, Homo sapiens
ggctcagcacactagacactcttaatggttcctgaatgagctgatggaaatgatgaagagcataacggggactgaagtccaattaacttgtttatcttcttcctccaatgatacagctttgctcttacaataaaagcagcaaatgcaattgcagtttgagtacatcccaatttagccccgctgcggctgctggacatcacattttaaagaaaagtgacctgaatacttttactcataacaacaacagaaaaagtaaagtaacataatttttgcaatatacctacctagtaccttgagcttccagatgtttaagccggttgcttttaagaagtttgttacccagaaaaatggcctgagccttgagttttttgctcctgcaccatacaactgccatctggatttcttcagaaagttgtgtgaaggactcagcctctcggaatctttgcacaaaacttttggcatgaggagttcctatcactttctgagaagaatacttggttgtctttagtctggattgagaacatttaaaatcaaaactggtctcctgaaacgtggaaagatgagaaaaatatattggacatgttactgacttgtaattatatgacaacaaggaaagctagctcacaatcaaaatttaaaaattagaattatcagtccctaaatgcttgaagtgatggataccccatttaccctgtggttattatgcactatatgcttataacaaaatacgtaccccataaatatatatacctgctacgtacccacaaaacctaaaaattaaaaaaaaaaaatcagtctgtaaggaaatttttttgctcactaagctttccttatgtctttaaaaactgaatttttctccactgctccaaatacaagttgttttgttccccctctgtaccaggacaggtcccatctgcagctgaattagattgacataggaaagttaacataaatatcctaacacacatatctcacatacacaataaaaaaaccccacatgattaaatactggtcaaagcctaattgcagagggttgggggatcactgaaa

SEQ ID NO: 107537 - DNA, 1855 bp, Homo sapiens
atttttaattttttttaaaaaaagtaagagccatgcatggtacaaaatgctgtaggaattctgtagtcctcaggaataacacacaaagggcagcatgggactgcatctagacagatacaaaaatttggatgggcattgatactggcaacaagagtatcttgccagagctgcaaatatacttctagaaattgaaccaaggttatggattctgttttaacagcggttttcaagaataatggagggaacaatccttaaattctttagggtcagctcctatctttttcagttttcaagtctggacaccatcctttgagggaggtattgacaaacccagatggtaaagcacttggaaaacatagtaagtgaactgcggttcaaaagagaaaaaaaacccaagagagagaagggagaaagagagaagatgcagaggaacataagaacaagcttcatctaatcaaagaatatatttgttcagtgattaaagccaatcgttttcctcatctctgtggtactttatagactgttgaaatttagtagttaataattttctatcttgttttaatagtttcactattaaaaatcatgttgtcggccaggcgcggtggctcatgcctgtaatcccagcactttgggaggccgaggtgggcggatcacaaggtccagatcgagaccatcctggcaaacacggtgaaaccccgtctctactaaaaatacaaaaaattagcctggcgtggtggcgggtgcctgtagtcccagctgcttggaaggctgaggcaggagaatggtgtgaacccaggaggtggagcttgcagtgagccgagatcacgccactgcactgcagcctgggcgacagagtgagactccatctgaaaaaaaaaaaaaaaatcttgtcttagcaaaattataatcttgagaataacctatactcgttttggtcccttttatgacatcaagctcattgtggcatatactaatttcttaggagtcacctgattttaaaaatgtgtttggctggataaattccaaatttgtaactagaagcaattgcttgcgctttggatttctctaccctgaaaaaaaataaggtattctgtgatatttagcatatttccatactttgaaaatctagaagtctttgctttcctggtcataatcagtgaccctgtctgcattacatacacatgaatttgaactgctcttcttctttcaggttgagcaatgtttaaagcgtttgaaaaacatgaatttggagggctcaattcaagacctgtttgagttgttttcttccaagtaagtaagtggtccagttgctttgtgatgtggtgggctgggaactcaatgtcttgtgatctccctttggatttctctatgcttgctgttggaatataaccaattatacctcagctgtataaattttgttttaatgtggggtacctggtgtttgtggtaatcttctgacattgatctatgggagtgactggtgtgacattgaaatctgggtcatggtagattatattaaaacatcagtgggctgttattgtgcttaactacctcaagttgagcttaaagcaagtcttcacttgaaaactgctatagaaatgctttatatttaaaaatgaaagtaatgggagcttgcacatagctgaaaatgtgaagggtcgcccagggaggacatggaagctctgtgcttcttctgccataccttgccctatgcatctctttgtttcaatcctttgtcatatcctttataataaactggtaaatgtaaaaaaaaaaaaaacaaaaaaaaaaccctttttttttaagtgaaagtaatgtactttttctatttttttcaagtgaaaatcagccctta

SEQ ID NO: 107538 - DNA, 1033 bp, Homo sapiens
agactgtgaatttattcattctgtcttgctttcgggcatagcgacatggggagttagagagttattacacatgttgtgacatgtgccctaccttcaaggtgggggttaagtgtacacatgaggcgtaagtgtacaccaaatgactgacagcaaagtattcatatgaaagattattaaaccatgataaaatgcaatgcaaagatacagcttcttgttttacagatgttctcttaatgatttcctggactttatatcatctgttaccattttccaacttctcttatacttagaatccttacgttcttacagttgagactgattacattagtttttgattcctttaaaacaaataaggaaagatgctttttttagtgtgtttttaatataatatacttactgtagaaatacatactaaatcttattagatgtctctgcttcagacctttgcattgcagctgtaattaaagaatgccatctcgtcatactgtcgctgaagagccaaaccttagatgcagaaacagatgtgttatgtgcagtcctttacagcaatcacaacagaatgggccgccacaaaccccatttggccctcaaacaggtgaggaagcccggtaggtgagacccaacctgttcacttgaaaatgtagatcacactgccacttactatattgctatttatggaaatctcgtggaaatctcagtaaattacttgtgttttataggcctatagcccacagttacatgtgcactttctttttttttcctaaaagcatttcagcatttcaaaaagtaatttttgttagaaaagaagtatgtttagattctttcccagtcttgtttctaataggcaagtaaacattttcttcattatatacaatctataacaacagtgcctttgcccagctcaaagataaagtgatttgagcaagacaaaatgttggacattaagaaacagttccctgggcataatcagaatgctaaaattatttttaaaaaaacttgtctacttattatggggtacataatctaattggtg

SEQ ID NO: 107539 - DNA, 1019 bp, Homo sapiens
cttagggattctcacacggttccacggctccaggcccggcggcaccgcagccatcatgcgaggcggggggacttacgaaaggcggagctacgcgagagcacgtccagcgaccggaggtggggcgatgggacccagtccgggccggaagggagcagggggtggggctcgggcggggccaggagcccggcgggaggctgccttcatcgagtaaacgcgtgggactgggaaggacccagtcatctgtatattggttaccaacacgtggccgcgtagaatcatgggggaaaaaaggccccatcccaatactaaccaacagaatctctgagaatgcgatgaggaatctgcgttttgtttaaacttagcgcaggggattcggaagcacaaccaagtttggaactgttaaatacttctaggcattttacaaatatggaaaatgaggcccagaattgagttggtgcttttacccccaactctgcctcagacattaggggaaaaaggaagaaatgaaatgaagaggtttgtgcaaggtgtggaatttgtagcgaagaagcagtgatttgctttgagtggtaaaggaaggctcctttatgtcttgaaccacagcaaaaccgagatcacatcaaagaaacttggaagacacctgtcagtcattcccacttttgtcagtctccaagacaagatcatattccaagctctagtgatccttacctcattaatatctttctaataattcatttatcctcagccatgctaatgcccccttaagttcttaacactcccacagtaacgtattagaaaaacagtgagttttggaaacagactgccaaggttctagttctagctttgctgtttactagctcggtgatctcaggaaatttacttacctcctcctccagaccttagtatccctgtgggtaaaatgaagatgataataatagtatcaatctcacagacttgtaaaatgccaaggcactcctggcatacaaacaatgaacatttaccatagttaatattgttga

SEQ ID NO: 107540 - DNA, 1042 bp, Homo sapiens
gttcctggttccttttgtatcgatgaagtaatattttcataggctgcgatatatttaattcctacagacactgtgatcaattagcctccactaaagttccttgctagtcaaaacaatctggttaccattttgttcctattgtccattatagtaaatgcatcaactgtctcttgtaattaatcattgctcattggtctttaccattctgggatcccattgaaatcaaggggccaatttcaatgatggtatcttctatcatcactctgacctacagaagacagccattgcagaactttgtaaagaaactgatagcacctcattaatgtatttctcaaggccttagtggagggtgtgacctctgagctctctcagaagacacagtcggggtggggtggatgtgcagaccacagattatatatccattccaacattccaattttcctaagtctttggatccctccttttacattaatccagggaaattctggcatcttaacctcgttgaatgtaggttatagctggattcaattttcaatcatcaaagaaaactgttagatacacttctcgctgcaagactctctagaaactgatatgatgactcatattgatacatttggtttagtccagtgcttgatattccatcctctatggtctaataacgttaaaatccaacactacttcagtttctgtcactaaaaattagcaacattttgcaactattttgaaatctaaactatttctttccatattagactttgtacttgtccccctggagctaactgagatctgattttagttatagctctagaagtgatgagaagtggtttggtgggtcttgaggttatcatagggtcttcatacaagtctcctcagacacaggaaggcagactgctccaagattctcagcttttcctgagttcaactaattccgaggctcagagtccttcttgctgccaatcaatgctctaactttcacagatgagatttgtgagtctatgaattcagtttaggttgtaattctgcaacccacagaactgaattt

SEQ ID NO: 107541 - DNA, 1021 bp, Homo sapiens
tcagtaagatccctttgctgtggctgccagcaagtctgtgcctgatttgacgagattctgaaaaggtaccagtgcctcctccctccaaggcctctcgtggaacataacaccctagaactatgccaagagacagagccaagccacatttcagtgtctgctgctgcaccaagctctgagcagaggccatcttttctgctcaagaagttgttactgaattctttcaagtgcttgctttggggacaaaaatgatcaagaaagatagtctctgtacaaccaacatttccaggaaacccattatttgtgcattatctgtatactcacaaacacacataagcacatgcacacatgccaagacacaaaaagttttcagttaagagagtcatgttcctaaaagctttatcttttacaccagtatttattgctgtctatcttcataaggtctactgtgggagatgctggcatagaaagaactttgcctcaggaatatacgagaaaacataatcagggcagaaagcagaggtattcaaataacaaggtcctaaagtgtgttgcagctgatacatgaactcacatctaactcaggtcaactctgggataaaaatgagcatcgaacagtctcctcccacaagtatgtaggcaccatgagaacagcaatgtttagtttcttgttccatcctaagtgcccggaacatttctgatgctcaattaatgtttgccaaataacaaaaacacttagggaatgtaccatatcagagacaaacataccgtctctcagtaagtccctccagcattaacacagattgtgatttctttaggttgacactagctgaagtagttggcttggatttaggggccatgttgtatgcatcgttaacaacaatcatatctaaaggagcaagaagctcacccaggagaagtgtgtgggcacagatactggtggaatgaatggaagactcccatctaacgctctctcaggagggttgctggatttagcaaataaaaatacaaggtattcagttac

SEQ ID NO: 107542 - DNA, 1039 bp, Homo sapiens
tcaccccaaatcccttccatgtaagcctgactgattttatatgaggcctgtttataatgtgttcttaagaaatagttgatgactattgatgaaaatggactgctgaacataaaggtaatggttttgtaaagtacaatcattgttcttaatccgttgttcatttcagcagggagccaggaaactggacatttcgggaggcctatggtcttagaaaaatcgcttttctactgttttcttatttataaaatgtattgataaggacttactatggtttatatcaatgcaccttgtaaaaagcaaatacttcagaactgtttattttgttcaaaagatgagataattctctttttcctcagtttcagaacaagcttcctggaacccatgacccatgaagtcttgtcgacatttataccgtctgagggtagcagctcgaaagtagaagaagtgggtgaggttttctcttcagtctgatagctctggcctattaggtcagccatttgttcatgttttgtgttaccacttagagatagtttttctcatcctcaagtattgggagtccaactttgagtggaatctggactaaacttcaggttagttctagctcggttcatatgctcttttagtcaaagcctgtgatggctatgtgaacccccttgctctgtggcaagctctgtcagacatgttagatacaaaccgtttactatgggatttggagtccaagcttgctgtgaaaaagtcccgcgtaggtttgggtgaggaaagccatgtgtttatgtctctgtcagtggtatcacagcaaatgccttgtggtctgatgtactgggcaatgtttatctcacaaaaatcagcgggattgtgattcttcccatcttctgaaataaagttaggaaataatttctcttttcctaatagtgaatttggccttctcttcaaagaaggcctttgatgtttgggacaggattattgggcagtaagaggaaatcagagcagaaagacacagttaacctaattcagttgccagagaaaatgttgaggaaag

SEQ ID NO: 107543 - DNA, 1061 bp, Homo sapiens
tctcacctcagaagcccaaggccattggcttctgtgcttacccaagttgagttaggagatgagaaattgtagggaactggccagaggttagagtctggggacaagggattcatctgcttctgtggttctgtttttatttctcagggcaggagcctggattagaggcattttggtcgtgttgtcagagaccctcctggatccctccagacaagctgcctttcccagccttgtgggatcgggcaatgtagggtctcaggtccaggaggaattgagagaggaaaaggactcgtggccaaataattctggttaacattcttttttgagagaggaaggaacagaaggcatctgtgaagtttccggagttcccatctgagacaacagaagtcaggaatgaatcttattagaagaagggtggagtgctgggaaagatggctgtgttgcaggaaggagccatatttctggagccacttccaagtttgagattgtgcagcatcctggttgaggggaggctttggaaccagacaagcctgggtttcagttctggctttgccagtcgataggtatgtgaccctaggcaaattacgtagacactgagaaccagtttcttagggttattgcaaagaagaggcaagataattcacataaagcacacgaaatgcgttgggagcagtctgtagaaggtagctgttattattagggaaggaaagaggaacagagtgaaaggagggttgctggtaggattgggcagctagaaggatgagcaggtgggagagcccactgatagagtcctcactggctcagggtttacggagagaaagaaatgtgaggatggagagatagaggaacacatggaggggcaaggccctgcctcaggtgcaccgttcgatgccagtccttggtcctggtcactgggtagataaaccccccatgccttcccctctgcttcttccccaactcagtgtatcccattctaccaggtgtgccaaaaatcttggagtcatccttgactatgttctttctctcatcctccactttaaattggccagtaatattggccttac

SEQ ID NO: 107544 - DNA, 1048 bp, Homo sapiens
cttctcagaaaagaaacatttcaaatgttaagggcaggtttttttctccctaaattgtggtgggggacattgcttttttgatcattggacttactttatgtcagtcattggtctccagacttttctgatgactgtataagtaaaaaaaatgaaaatggagcccctccccatacaataaatgtatatgtatttataaattgtatttatgaactattatgtatcttgtacaataggaaacatccacaaaaacagaaattaaatagaatgagataaaaataaatagaaatagaaactctgacattttcaatttataccccaatagatgattttgttgatcatctggggtgcatgcatcccatgttggagaccaccaatttctgccttaatctgctcactttccctcttaggtactcttgtctagagcaacatcacttaacttcattcatgttcagaaatatttttgatgtattatttctcctcttgcaaacaggaaatgatttggaaaactttcaggttttctaggacatggagaatgtgctttagaaatactatagttagcagtttcattgctttaaagcactgaaactttctttaatttgttgaagtcatgaccaaaaaagactcccaccattctgtcaaagacattccatgctgatgggctgcttttcatgcagaaaataaaagggagatgaggacatgtcttctgggctcttattcacaaaactttataactctggagtcatagaaatgactgaagagtgatgtggatcataacttggcagaaagaaaataatatgcattcctgagttgcaaactgggatcatgcacttaatcacagcccaacaaagcagattctgctcatgctttacttcctcccaagatgccttcattcaccatctttagatgtatgtttattgagtcttgtcaccatttcacaacacggggctttctacaggtgaaaattgtggcaactaatctgaatgcagcagaggaggccctggaggcttatcagcgagagaagcagcagcggctgaatgaactgctagtt

SEQ ID NO: 107545 - DNA, 1057 bp, Homo sapiens
cgcccggccaaatgactccattttgattctgacagctttcacagtacatacccctaaaggcagtcattttctgcctgtaatgtcctttgctcagttcctattacatatgtaatcatttaaaaattttacttcctcagagaggcctttcctggttatctgctgtttaaattgggtacttatacccacttcctcattccccaagattcccagatgtgagttaatatatgcgttaaaatgtgaacttgacagatggtttttcacaagggtactaacaaatgctttaaggaatgtaaaaagtctctgtacttgattacgaggggcggcattgctggtgtgttctctgctgaaaatagtttaagcattcagaagccaaacccttctactgaaatacttttctaactaccatggtgggctaatgaaatgagtatagtgccaatctatgggaaaataatacatatttgttatttttaaattcttatctatagtattgagaaggactgttcaaactcgtcctgctccacgacttcctccaactgtggaaataattgagaaggaacaaaattgggaagagaagaccttacctattgatacagacattcagaattcaagtgaagagaatcgtctcttcactcagagatggagagtctctcacatgggagaagatttggagaacaaaactcaggctccttttgttaacctctcacagcccctctgcaattcccattccaacactcaacagtcaagaagccccacattctcagaagagctcccagtactgggagatgggcagcagctgagaacaaatgagtcattaatacaaagaaaggacataatgacacgaattgctgatttgacattgcagaattcagctatcaaggcacatatgaataatattattgagcccagaggagagcaaggggatggactccgggagttgaacaaacaagaaagtgcaagtgacatgacttctgtgagtaccatttaaggattgattagggacatataggaatttaaataggaactttagcttgggcaacttaagaaacttcttttcaga

SEQ ID NO: 107546 - DNA, 1027 bp, Homo sapiens
tgggtgacagagtgagactctgtgtgaaaaaaaggaaaaatggaaaagacaaactctggaatgccacataggattttttaggagtccctaactggctcgcttttcatggctttgaggccttagtgattttctcaaaaatagtaacttctcagtactagccccccaggagcctgcccatgaatgattggcagaggaggatacagcctagaaagtgaaggctccaggagctatgttgattcatgtggattttgcactctactgagatgcatttaagaataaatacctgaaatgtgctcatagtttctttttgttcctattgtactaatatcctctcatcttcttcagagcgtccagttgtaaatgccaatgtctcagtgccattgatgttcagagaggaagtggctgaattcccacaggaagagttgcccgttaaactgtctcaggtgccagaccctccagataacatgaatctggccaagaattttccagcacatatttttgagccagctgtgttgttaacaccacccaggcagaagagcaacttaaaattctctcctcttcaggacggtaagtcttcttctaaagttacatgaaagttgttttttaatgtttcatttgtgcaatgtattactttcaccattacatgaaaaacagaattgaaaaagacactgattaccacacatagcctttaagctgaaggaagaattttcatgctatgtgtatcatacctgtggtcatgtgtgacatttaattaattttattgtatatctattttattaaacattgtaagtattaaactcagatcaaaagatcagagtccttagcattaagatgcagagtaaggggaatcccttttgtccctatggtccaggagcatttcaaagagttagaagcaggagattatactccaaagagtaatgaaagttagactaaggaaaggtgaaaactgtgactttaagggtcttgtaagtgacatctggtcattatattcacctctttctcatcaaaagttttcagctcagttagt

SEQ ID NO: 107547 - DNA, 1122 bp, Homo sapiens
gtaggatgcagttacaaatgagatgggccatgcctgtctgaggaagtgacatttgagccaagacctggaagaggcgaggagtgagcatgtgggtagctgagagaagagcagtctgggcagaggaaaagcaagtgcgaaggtcttgcggtgggagtgtgactggtgagcttagagtcatcaaggagatcagtgtggcaagagtagagtatgaggaagaggaagagagagaggcaggagacaagatcaggtaagcccaattacatagcgccttgcatgatggttaaagatatgggcttttatgctgagtgagatgggaaaccactaaagagaagagacgtgatttgtcttgggtttaagaggatcactctgggctgtgttgaaactagatcagagattggtgccctttcttgggtcgcgtgcccttagtgtcttataacaaaacagttctactaggccaaaaacagttctacttactaagttgttgagtccaaacaactatgtcctaacaactgaggggctgtttgagaaaaagtaatactttctcttaaataactacaattatttactaatgggttatatgtaccttttgagcactgtaccacttctcaaagcttggaatcatgtgggacacaatcattcttatttcctgttccacactgattttcctccagaacttgtttttttaacctagcaactgctgaaaacccagccatgagaagatttgacatcctcaaaaggaatgtaatggaatctgacattgaaattgtgaactgtcctgagctaatagttcaccagtgtctgatagatggcaggcatcactatttcccttgaagatttaaattttccccggtgcccctgtaagttcactttagtgccctgaggtgcctcagcaaacagtttgggaacagtatgggactagagtaggtggccaaaaagcagaatattacatgaggagttattggaatagttcaggtgagacatggcagcttggtctagggtggaagtgggagagggtgtgaaaagtgatcaagttatgaatatattttgaaggctgaccaatgcagtctgctaatttattggatgtggagtgaagtagaggatattggaaaagagtcaagggta

SEQ ID NO: 107548 - DNA, 1034 bp, Homo sapiens
tgccttggcctcccaatgtgctgggattacaggtgtgagccaccacgcccgaccagaagcgtgtacttttaagctaatcacttgttttacaaagttaaaccatttaaagttgtagtcatttactttaaattatattttaacaagcttaatttttgaattggcaatatagtcacatattatgaaattcaaagataacagcagattgtactaactctcatgactaacttccagctagcctgtttgcttatttatagccaactatcattccagataccagtgtatctttctagagatggtcagtgtatattcaaataatatgtatatgtatatccctctactttctttttacaaaaaatgtagttacttaattttatatagcatttagttcattttattctatttaaagaagggaagaggataaagaagcacattttctttaattaaatataataaaccttttaataaaactcttcatcattactgtcacataatatatgcttctttgtaaatatcttctttgccagctttgagtgcaaacttttagttttcaacatgtgatgctattggtggaagtttatttgatatttttttgtagagtgagatccagctacgtaaagaagtagagacaaggcaacaactggaacaagtattaggtgatcatcgagagctcattgatgctctgacagctgaaattcttcgtcttagagaagaaaacgctgctacacaggtactcagatgagatcccaatttttatgtgttcagtggtataaaacatctttaaacatgtactggattctcttagagttgcttttggtttaactgtatcgatgtgattacttatcagtcatttttatcatcagtggcaggtattattgaacatttattacatggaagtactatagtagaagcttggaagtagtatatggactgtcttcctgtcttcaagagacttactatttagtgggaagacagagtctacatttaaattataactacaagtgttacagtagttaatccaaaatgtgaaatgagtg

SEQ ID NO: 107549 - DNA, 1050 bp, Homo sapiens
cactaaggtgataggcatttttgctatctacctgtcttatcagttatagtgaatagtgttttttctttgactatgaattactaaaagctccttcaaatcaaacatgtaactatttgaacagtttaaatgatagcacctattttttatataaattaatataatatacatataaattagatataaatataatttaatttatataattaaattataaattaaattacatgtaatatagaatatattttataattatgtgtaattattatataattatatataattaattatataatttaattataaattataattaaatttatatgcatatttatatataaaattaaatttataattatataaatataaattataataatatagataatgtaaatataaattaaatgcctgctatcatttaatttatatttatattatattaatttatattataattctcatgtagcttattgtcctgtaatttataggtttctccaacaactaacagaagagaattttgagttaattagtaagttgtggactgacattcagcagaaaatagcaacccagtcacaaataactcctccaggaacgccatcatctgctctttcatcaggggagcaaagaggtttgtttcccttttgcattatttctaggtgcctgctttattaggttcattcttgaatgcagtaatttttgaaggaatgttatttgagttttgactgcctttgcctaattgactaaaatactgatggatctgtcaattgaaatactttcttaagaagtttgttcacttgagatacttttggaaatgttcttccttttagctgctctgaatgctaccaatgctgtcaagagactccaaaccaggcttcagcctgaagaatctactgagactctagactcaagctacgttgtgggacacgtgctgaactcaaggaagcaaaaacagctgttaaataaaggttcagtcccttaatttacaaagatgaatattaaacatgtaacttgatacagctgtcttaatctcttagtcaatgtttttctccctta

SEQ ID NO: 107550 - DNA, 1109 bp, Homo sapiens
ttggtagtagtgtgatgatcatgaaatgagtgtgtctttgccaaagatgactcggtggattttgtaccttttacattgtgctcagttagtgtgtgtatatgtgtgtatgtgtatgttaaaaaaaaatgctggttttgacccatgaattgattttatcatccattaagtgagtcccaacctgtggtttgaaaaacactagtttgctggatagtcttgcagaaaagtagtagaaattattatttctttctgtacatcttttaggtaggtttaccagttctatatactgctttctttaagatcatttttgaaaatttaggggactgaaaattttggctatgaatatatataaacatgcacatattggaccagaaaaagtttaaaaagtgatgaactagagtaggtgatctcatcatctgaataggcaacttctttgtgtctgaaacattcctttatgtacttttctcttctgtataggtacgccgtcatgaaatacacaaatcgaagaatagagcattagtacactgggaactccaagaaaaagctttgaagagaaaatggaggaagcagaaaccagaaactttaaatcttgagaaaagaagattgtctatcatgaaggaggtaatgctaaactgcattagagttagaaagaaaaaaaggagataaatagggttctttgtttttcttcaatttgattcacgttggagagactctagtaatcactgcattcttattcaataatctacatgtggacttcaaaaaaagcaacagagtggtgactggagtctggtttggtggtttgaattcctgttctactacttaccagctgtgtgaccctaagtaaattatttaacttttcagcctgaattttctcatatttaaaattattatttgcttgtattgctatgagatttcagtgatataatacttacaaagtgaatagcacaatctttgcttattcctctttttgtatataagctgctataataatttttctcagtaaagtgattagcacaatcttttcttattcctctttttatatataagctgctataattatttttctcagtttaacagcagtgctgttaggttactttgaaaaaaaaatgatg

SEQ ID NO: 107551 - DNA, 2841 bp, Homo sapiens
tggtaacagagcaagactccgtctcaaaaaaaaaaaaaaaaaaaaaagaaagcttttcagtgcaaaggtggggtcagagtttttgtaattaataaaacttggaggtagaactaaggattagtaaatacaggtgctaaagtgtaccttttcatgaagctggatggcaagagaagggcaaagatgggatagcagcttaactatacctgtgttatcctactgtacacaggtagtaaattaccacagatttagtggcctaaaacaattactatttatcatttcacaatttctgtgggttgtgagtttggacatggcttagttagattctttgcttagggtcttccaaagctgtaatcaagtcgttggccagtatgcattctcatctggagttttagcttctgaataagtaaaatattctaaatgtaacttgaaatacttttccccccatttttaagagtaacataggtccattatagaaaatttgggaaatataaaagcaaacagaggtaacccaattctggcaaagttttccagcatgtgctttacagtcagtcagacctggtcttgagtgtcagctcttggctctgcctgttattatttgtataactttgagctatatactttctctaagcctcatttttcattttttttgaattttaatattcttaatatttttaaattttgtttcaagttctagggtacacgtgcggtatgtgcaggtttgtttcataggtaaacgtgtgccatagtggtttgctgcatctatcaacccatcacctaggtattaaatctagcgtgcattagctatttttcctgatgctctgtctccctgcatccccctgccatctgacaggccccagtgtgtgttgctcccctccctgtgtccatgtgttctcattgttcagcacccacttataagtgagtacatgtggtgtttgattttctgttcctgcattcgtttgccaagtgtaatggcttccagttccatccatgcccctgcaaaggacatgatctcattcctttttatggctttatagtattccatggtttatatgtaccacatttctttattcagtctatcaatgatgggcatttgggttgattccatctctttgctattgtgaatagtgctgcagtgaacatatatgtgtgtgtatctttataattgaatgatttattttcctttgggtatatatgcagaaatgtgattgctgggtcaaatggtatttctggttctaggtctttgaggaatcgccacactgtcttccacaatggttgaactaatttgcatttccaccaacagtgtaaaattgttcctatttctccacagtcttgccagcatgtgttgtttcttgactttttaataatcgccattctgactggcatgagatggtatctcactgtagttttgatttgcatttctctaacgatcagtgatgttgactttttttcatacgtttgttggctgcataaatgtcttcttttgagaagtttgtgttcatgtcctttgcccacttattaatggggttgtttgtttttttgtcaatttaagttccttgtagactctggatattagccctttgtcagatggagagattgcaaaatttttctctcattttgtaggttgtctgtttgctctgatgataatttcttttgctgtgcagaagctctttagtttaattggattccatttgttaagttttgctttcgttacaattgcttttgacattttcatcatgaaatctttgcctgtgtgtatgtgctgaatggtattgcttagattttcttctagggtttttatagttttgggttttacatttaagcctttaattatcctgagttgatttttgtctatggtgtaaggaaggggtcccgtttcaattttctgcatatggctcaccagttctcccaacactattaagtagggaatcctttccccattgcttgtttttgtcaggtttgttgatgatcagatggttgtagatgtgcagtcttatttttgagttctccattctgttccgttggtctatatgtctgcttttgtagcagtaccatgctgttttggttactgtagccttgtagtatagtttgaagtagggtagcatgatgcctccaactttgttctttttgtttaggattgtcttggccatatgggctcttttttggttccatatgaattttaaaatagttttttctaattctgtgaagatgttaatggtagtttaataggcatagtattgaatctataaattacttaaaaatgccagtatggctattttcactgtattgattcttccagtctcatttttcttatttgggaaaagggttaattgttgtcactgacatcattatcctcaacatttaaatacaattttgtatgctaggcaggtgtattagttcattctcatgctgctataaagaaatactcgagactgggtaatttataaagaaaagaggtttaattgactcacagttttgcaggcctcaggaaacttacaattatggcagaaggccaaacagaagcaggtacctttttcacaaggtggcaggagagaaagtgagtgcaaacaggggaaatgccagacacttataaacccatcagatctcatgagaattcactatcatgaaaacagcaagagggaaactgctccccatgatccaatcacttcccactgggtccctctcatgacacatggggattatagggattacaattcgagatgagatttgggtggggactcagccaaaccatatcagcaggggttctaagcacttatatatttaattagttctgttttatagttagtgaaaaagctgggatgtgaacccagacagtgattccag

SEQ ID NO: 107552 - DNA, 1351 bp, Homo sapiens
gggatgattactcctttgccttgaaacatttattgggcccaccatgtatggatcagcatgtggtggtaagtcatactcccaaatcagtgattcccaagtcttggctttgggaaccagtatgcctcgtattctcttaaagagcaacaagaatttcttgaaacaaaattagttcagaattgatttaaattttttaacttctggaaatacacgaagttatgtctgagtcatgagtgacagtcattgattaaatcatttctctgtctcttttttagcattattgatcacagagtccgttataaaaagtggttgattcctttcaacatttaacaataacttctaatgaagggtaaaattccagattctcttcatgcgtaaacatttaatgtgtcaatcatagatgaaaggaatctagtttgatgttgtttctttctttcttttttttggaaaacacaagttgctctgggatggcttatatgttgttttataccggttcaggaaatttatttttgtttttattgtaagaccttttgcggtaccagagatggcaccttttttctaggtaaggtgtaggaattcctcaatggtcttgcttcgtaaaatttaacatatcagaactggggaaagagaaaggagggggttatttttttgcagcattttccagtcacatatcagggttatactgaactgcaacaaagatcaacttttaaaaattagccttcttaaaatacaaaatgatttaagtattttaaagataatttatttgccttgctcttgccttctaacattagccatttcatggagaggctaaaacttatactccaaaaaatgtggaagcacattttaatgggagtaaaattaaaaaattttgagaaagggtaaaatcttatgaatatgcatcttcttagctttatcttccctttgataggtaggcacttatgctcttccatctgctccatgtcaaatagggctcagggaagccagtcatttccttagcgagatgattactcctttgccttgaaacatttattgggcccaccatgtatggatcagtgtgtggtagtgagtcatactcccaaatcagtgattcccaagtcttggctttgggaaccagtatgccttgtattctcttaaaaagcaacaataatttcttgaaacaaaattagttcagaattgatttaaaatatttcagtgtgccatatagctctgtcccttggtttggttggccttgttttttcctgtgaagaatgaaagggcaaaggtgataccaaaatgaaacagctttggagtgatatctttaggagcctggaagccatttttgtaattttgttgtctatataaatgctacctttgc

SEQ ID NO: 107553 - DNA, 1036 bp, Homo sapiens
cacatattttaaagtatgaattggtcctttaaaaacaggcctgccatctgaaaatgggaaattgagacctgagacctgctaaagcatagaagaacttgatataggtagggttttttttttttttttttttttaatagatggagtctggctctgttgcccaggctggagtgcagtggcgtgatctcagctcactgcaagctccacctcccgggttcaagtgattctcctgcctcagcctcctgtgtagctgggactacaggcacgtgccaccacacctggctaatttttggtacttttagtagagacggggtttcaccgtgttagccaggatggtcttgatctcctgacctcgtgatccacctgcctcggcctcccaaagtgccaggattacaggcatgagccaccgtgcttggcctaggtacaggtttttaaaagccccacagaagtttataatacgtttaaaaacccatattaaaatttgaaaacttaaaaaaaaaactaagaaaacaatggcatatattccttttcttaaacctgtgaagtccattactttttgttcttgttatattctgccaaaaatgggatggggtgggagagatgcatagaaattgttttatctgccttgttaacaaagtgaactcaaggaccagcttttcttttctttcttcttttcttttttttttgagactctgtcacccaggctggagtgtcgttaggtgcaactaacaccaggaacagcaccttgaatattcctttttcaagttcctcttcctcaggagatattcaaggtcactttgtcacccaggctggagtctacaatggcaggatcttggctcactgcagcctctgcctcctgggttcaagcaaattcttgagcctcagcctcccgagtagctgagattacaggtctgtgccactacacctggctaatttttatatttttagtagagacggggtttcaccatcttggccaggctggtcttgaactcctgatgtcaggtgatccacccacctcggcctcccaaagtactggaat

SEQ ID NO: 107554 - DNA, 1285 bp, Homo sapiens
gacagagaagagctgtgaaaacccttcaactagtcggaaccatcataaccatccccagaaccatctcaatcaagatattatgcaccaacagcaggatgttggaagcagacagcaaggttcaggggtttcatctgaacatgtatctggccataatccaatgcagaggcttttgacatcaagaggcttagagcagcaaatggtgtcccaaccaagtattgtgactagatcttcagacatgacctgtactccacacaggccagagagaaatagagtttcaagttattctgctgaggcactcattggaaagacatcttctaattcagagcagagaatggggatatcaattcagggttccagagtttcagatcagcttgaaatgagaagctatcttgatgttcccagaaataagagtttggctattcataatatgcagggtcgtgtggaccatactgtggcctcagatatccgcctttctgattgtcagacgtttaaaccaagtggagctagtcaacagccccagagtaattttgaagtacaatcttcaagaaacaatgaaataggtaaccctgtatcatcattgcggagtatgcagtcccaggcttttcgaattagtcaaaacactggccccccaccaattgaccgtcaaaagagattatcttacccaccagttcagagcatcccaacaggaaatggtattccatcaagggacagtgaaaatacttgtcaccaaagtttcatgcagagcttacttgcccctcacctcagtgatcaggtcattgggagccagaggtcactctcagaacatcagaggaatacacagtgtggtccatcctctgcaattgaatataattgtcccccaactcatgaaaatgtccatattagaagagagagtgagagtcagaatagggaaagttgtgacatgtcgttaggtgcaattaacaccaggaacagcaccttgaatattcctttttcaagttcctcttcctcaggagatattcaaggtcgaaacacaagccccaatgtttctgtacagaaatccaatcccatgaggattactgagagtcatgccaccaagggccacatgaaccctccagtcacaaccaacatgcatggggttgcaaggccagcgttgccacatccatctgtgtctcatggaaatggcgatcaaggccctgctgtacgtcaagctaattcttcagttccccagagatcaaggcatcccctgcaagacagcagtggttccaaaattcgtcagcctgaaaggaatcgttctggaaaccaaagg

SEQ ID NO: 107555 - DNA, 2232 bp, Homo sapiens
ccagcctcaatcaaagcatatcacagatggctgggcaaagctgtgtacaattgtctattagccagcctgccaattctcaaactgctgcaaatagtcaaaccactacagctaactgtgtttcattaacaacaactgcagcacctcctgtgacaacagatagttcagccacactagctagtacttataatctagtgagtacttcctcaatgaacactgttgcttgtttgcctaacatgaaatctaaaaggttgaataagaagccaggtggcaggaaacacttagcagcaaacaagtcagcgtgtcccctgaattcagtcagagatgtgagcaagttagactgccccaacactgaaggctcagcagagccaccctgtaatgatggactgctagaaagcttccctgctgtgttaccatctgtctctgtgtctcaggcaaatagtgtgagtgtttctgcttcacattctttgggtgttctaagctctgaatcattaatacctgagtctgtatcgaaatctaagtcagcagaaaagtccagcccaccctcccaagaatctgtaacaagtgaacattttgcaatggccgcagcaaaatccaaagattctacccctaatctacaacaagagacatctcaggataaaccaccaagtagtttagcattatcagatgctgccaaaccctgcgcttcagccaatgtattgattccatctccaagtgatcctcacattttggtttctcaggttcctggtttgtcatctacaacaagcactacaagtactgactgtgtttctgaggtagaaatcattgctgaaccttgcagagttgagcaagattcatcagatacaatgcaaaccacaggtctcttaaaggggcaaggtttaactacattgctatctgatcttgctaaaaaaaaaaaccctcagaaatcatctctttctgatcagatggatcatcctgacttttcttcagaaaatcctaaaatagttgattcaagtgtgaatttacatcccaaacaggaactattactgatgaacaatgatgatagagatcctccacagcatcattcctgcctccctgatcaagaggttattaatggttctttgatcaacggtagacaggccgactctcccatgtcaaccagctctggcagtagtcgtagtttctcagttgcatccatgcttcctgaaacaacaagagaagatgtgaccagcaatgcaacaactaatacatgtgacagctgtacctttgtagagcaaactgatatagtagctcttgcagcaagagctatttttgaccaggagaaccttgagaaggggagagttggcctccaggctgatataagggaagttgcttcaaagccttctgaagcatcattgttagagggagacccacccttcaaatcacagatacctaaagagagtggcacaggacaggcagaagcaacaccaaatgaatttaattctcagggttcaattgaagcaactatggagaggccccttgagaaaccaagttgttctctaggaattaaaacatcaaatgcatctttacaggattcaacttctcagccaccaagcatcaccagtttaagtgtgaataatcttatccatcagagcagcatcagccatcctctggccagctgtgcgggtttatccccaacttcagagcaaacaactgtgcctgcaacggttaatctgaccgtttcatctagctcctatggcagtcaacctcctggaccatctctgatgactgaatattcccaagaacagctaaatactatgactagtaccataccaaattcacagattcaagagccactcttaaagccaagccatgaaagccgtaaggattctgctaagcgtgctgtccaagatgaccttttactgtcttcagctaaacgtcaaaagcactgtcagccagcccccctcaggcttgaaagtatgtccctgatgagcagaactccagacaccatttctgaccaaactcaaatgatggtcagtcagatccctcctaattcttcaaactcagttgtgcctgttagcaacccagctcatggagatggccttacacgattatttccacctagtaacaactttgtgactcctgcattgaggcaaactgaagttcagtgtggttctcagccttcagttgctgaacagcagcaaacccaggcaagtcagcatctacaggccctgcagcagcatgttccagctcaaggtgtatctcaccttcatagta

SEQ ID NO: 107556 - DNA, 1024 bp, Homo sapiens
agtttggaacttcctggagacttgttgaatgattttgaccaaaatgctgatagtgatgtggacaatgaagtccaggctgaggtggtctccgatggagattaggaacttcttgaagactagagcaaaggtgactcttgctatgctttagtgaagagactggaagcattttgccctgccctagagctgtggaactttgaacttgagagagagaatttaggttatccggtggaagaaatttctaagcagcaaaatgttcaagaggtgacagagcaccatgattgtaagtttccagaggcattctccagcactgtggagctgtgactcaattaaacctctttcctttaaaaattacccagtctcatgtatttctttatagcagcatgagaacggactaatacagttgtcaatctctgggatataaaagcatcacagctttcattatgaaatttttgaaagtcagagaagagaatgaaatcaccaaaatatcactacccttacttaactatgattaatatattaatgtatttgctttctggccttttccatatatgtatatattttccaatagtgcatgtattatttagtagcctgataattgaaatatatatagaattttcatacccagattttaatgacagtcaaatgataatatgagacttctagcagtttgaagttaatgcccaacaaatgagtgagtgaatgaatgcttgctttcatgtatggaatattacatgtttgtgctcttgtcacatttgttttttttgtgttcagagtagggaaccattgttttagtttaaattctgtataacacttcacatgaacaaatagcatactctcccaactcaactatgctctacctatctttccagctcttgctcaaattcacatcccctttaagcttttcttgatttccaagcctgcagtgatctttttctactcaaattttctcaagcagtttctggctatacctcacatttgatattcaccattttctacatttgctaattatagtacttttatgcta

SEQ ID NO: 107557 - DNA, 1439 bp, Homo sapiens
ctacctctgtgtcatttgagggaccagtttctctttggttataaacaatagagattgaatttggctaagcagcaaatggatactggataaactcacagaaagaaagggagatagaataatgaaggcttgggaaggccaggaaaacagaagctcccaggatcataaggatccatggggctaactcagcctcagcaagatattctccttgtgcagggagtcttattagttagccccatgcccaccccagaggtgagcctgtgtttgatggtcctatcagatttcaggaatgggacagagaagatctccgaaggaaaggcaggatattattgtcagaaggccaaaacaacagatttattacaaagttcatcggatttggcagtgtggaagtcttttgttgagcttggtttaagcagttttaggaataaaagtcaggtaacagctggttgaagagtgaataagaagtgaggaagagggggtagtaagtgtaaacaacttgttcaagaagactggtggttgggaggaagaatggggacacctgtggggagttgcaaggtcaggagaaaaatcagtttaggtttttacatggaaaaagttgaataaggatttatttttatttttgttgagatgggatctcactctgtctcccaggctggagtgcagtggtgcgatcttggctcactggaaccttcgcctcctgggctcaagccatcctcctacctcaggctcctgattagctgggattacaggtttgcagcaccacacctggctaattttttgtatttttggtagagatggggttttgccttgtttcccaggctggtctcaaactcctgagctcaagtgagccacctcccttggcctctcaaagtgctgggattacaggtgtgagccaccgtgcctggccctgaataaggatatttttaatggaaaggcactaagagagaaggagggattaataatatatgagagaaaagggacattatgtaagaagtttactaagtagcgagagtgatagagtccagagtataggtagagggtttagttttgctagaaatattagggaagattttatataggaggatagacttgcaccggactttaaagggttggtaggatttggataaacagagcaaagtggaaaggtcatttcagtgggaaaatagcatgaatttagcataaagtgaagtagctgataaggcgcacagggataaacctgtctgaattgaagaggagggaagggtagatggcataattagctagaaaacctgcttttatgtgtgttgtactaggtggaagggggtaggtgagacctgccagtgaagaaggtacagtcatgaatgccaagacctggagtttggatatgatgcagttgattgtgggaaatagtactgtagagtctgcagcaggagaggacatggtaaatatggtgaactgaaaag

SEQ ID NO: 107558 - DNA, 4395 bp, Homo sapiens
gattgaattatacagtgttattttgggagtaattgagaaagcttgcgtttttaatttttaaaacataccatgtattttatcaatcagaaggaagatatatcttcaagctttgagaccctagttttttatttttcatcattttttttctgtgtgttaatagggccttttaataatttatcctcttacagtgaaaaaattttgatagctgtggtacttttccctttgttgactacaagaataaacactgagccttctaatctcagccagctgtcttacaaatgtaaaaattagattaaaagtgtaaaattgtcatcaaaaggttttaggtaagcatgcctaacccttgttgattactggtagttgtaaagagaatgtaacagatgtttggagctatctgtggagaatgcttaaaacttgatgaaaccttaattttaattttttttctgatactctcttatatctcaggcatgtccagatcagcaatgagtcggcaattgacttctacaggaagtttggctttgagattattgagacaaagaagaactactataagaggatagagcccgcagatgctcatgtgctgcagaaaaacctcaaagttccttctggtcagaatgcagatgtgcaaaagacagacaactgaacaaattacaaatgaactttcttgcacttgcttgtcgccaaataaaagagaggcccattgattcctcccccaccccaacacttttcttttaaagcttttctccctccttgttcttgtttttctttcttcctttccttttctctgagagttttaatactttcaaggactttaaaaaaataatcatgtttgaattgttttctcttatttttgtgaggtggtttgaaggaaggacaaggtagatctgtttagttttgcagttgaagttagatggtcctaaacatttaattgtcaaataatttcaaatttaatgtcctgctttcacattgaagggcagagcctacaaaacattgtatatttcaaaagacaaaaagaagcagcagcagtatcttgttctctaattcatagacaagttgagtgtgtttgtggtactttgggtttttaaacactttgggatactaatccctagacattgccttcactccacctttagtccttctgagcactctctcgggagttggaacattgttatccttgtaagaaatactaagcttatgttgatttttaagtaattatatcttctcttcttgctggtgggtggggcagtttggtttagtgttatactttggtctaagtatttgagttaaactgcttttttgctaatgagtgggctggttgttagcaggtttgtttttcctgctgttgattgttactagtggcattaacttttagaatttgggctggtgagattaattttttttaatatcccagctagagatatggcctttaactgacctaaagaggtgtgttgtgatttaattttttcccgttcctttttcttcagtaaacccaacaatagtctaaccttaaaaattgagttgatgtccttataggtcactacccctaaataaacctgaagcaggtgttttctcttggacatactaaaaaatacctaaaaggaagcttagatgggctgtgacacaaaaaattcaattactgtcatctaatgccagctgttaaaagtgtggccactgagcatttgattttataggaaaaaatagtatttttgagaataacatagctgtgctattgcacatctgttggaggacatcccagatttgcttatactcagtgcctgtgatattgagtttaaggatttgaggcaggggtaattattaaacatattgcttctattcttggaaaaatagaagtgtaaaatgttaataatacaaatgtcactgtgacctcctccactgagaggactggtttatgccagatcattttccggcacacacggagtggctttgacagattgataactttgtaagatgggagacatctgaaatattcatgttttccttttgtagtcccatctccactatttagaaatgttctcagactttaaaataatgcacagggcttgagctttctgtcatttgactttaaaaggaagtttcattcatatttatcctcttatgtaaaattgcggtataaagtctcatttccaaatatgttaaatgacaaaattattttataaaatgtttatgcacactttataaccttaagtttttatttgagaatgtgaaagtacaaagtgcagtagacttcaacaatcttgagtgccaagaataatacagaaaaagaagacagttgatgaatgagtttatagggttctaatcttaagatggtaaaaatgtagaaagaccttgctggttttttgggggtattcgtttcttaaacaatccaaatctaagcttagaagaaaagtttagcgttaagcacctttatcttcatgaataagcttcagcttgctcttggcaagagaagagtgcttgagttacagaaggcataagtagtttgaagaatgcagcagcctttttgtaaacttcccagatatcaaaatagactttgatatataaatggttttctgagatgacactgcctctatttctataaccatttcacctggactatctaatcagtcctatgaatgtatccctaaatgtggttattgaaaacctaatagctgcctcatgacaagtacatgttatttaaggaggaaaaaatattaaattttgaattgagtgtgtaggctccctatcattatatatagagtttctttttccacggtagtcagtgacttaacctgaattgtaaatgtttgtaaagggttaattgtcctacatcaaacttagttaaataattccatccacttatggaggaggaggagaatgtggaagaggtaaaaagctgggcacaagttcatatgcctatgagtcagtaaagactgaagtaatgtcctatgttgagctggttattttgatatatgataataattatctttgaagtagaacaattctgttaactggaaaatcacaggatatatccatcatatttttcaggacagatagtttttactgtggggcaaataggttaaaattacactatgttagttgcatttaggttttaaagcaaagaatctgtagagaaatctatgcaatatatagtttgtccagattagctttcatttggggaatgaagttctgaaatatctaaagcagtttactcatcaattgaaaagtcctccaaaaagagaactattgggaaaccatggtgtggtggtggaaaagaaaagctccctcagttttttggagggaataacttaaaaaaatacttaaatggctaagtttacttggtgcagttaagaattaaacttgtcaattttaacattgctgttacatctgaaataaacttatgtgatgttctggtagtgatctgtgatatctgtaaatgtcaaaactgtattgttgaattctgcagccagcaaccgtacatactcattgtgtagtgtttcccttactgcttttatttactttcacatttaagatctaattttaaaatcattaaaataggccaagtgtaattaaggcatcctaattcagatcttctgtgacttgctaggtacagtgcccaatatctacaattcagttccaatgagagggaaaaagtaagatccaaggaactgtcttgctgctgtatttttaatgtaattattagaaatacttgacactttaggctgcaatctagttagtaatgtttattggctacagacaacatattcaggtgttttgtttttcttccttgtaaggaaggagtacggtagttcaatgagttgggaattggcttttaagctttttatcaaacatgaatttaagattttttctttaacagaattcagtatttaatatttctagtcaaaattgttataattagatttttgcttttttcatttaagaagcaatgagtgatccttgtctagtgtgtctcagttattactgtagtttaaaacaacaaacaagtattaccttccacagttctggatcaggaatctaggagctgcttaactgggtggttctgtcttgagatctcagaaggttgcagtcaagctgttagccaggactgtaccatcttgaagcttgacaaggctagaggagccatttccaagatgtcttgcttacgtggctcttgggcttctgttcctcactgtgtgggtatcacacacagtgcctgatgctcacgtggctcttgggcttcagttccttgggcaccagttgcctggtggacaactggtatgtggcttcccctagagcaggtgatataagaaagtgagcagaaaccatacttttttatgacgtagcctcaggtgacattatttctgccatattccatgagtcacacagaccaaccattgaatc

SEQ ID NO: 107559 - DNA, 2323 bp, Homo sapiens
ttcgccgggtccctctcacaacatgggaattatgggaactacaagatgaaatttggatggggacacagccaaaccatatcactcctgttgctttcttaatggatagttttcatcctggggtgattttcaagatggtggattcctttgtttcgtttccagcaactctggttctgaaaatggggtatgtgtatccaggaatgtgaattttgcatatcacctctgtgactctgatgtaggtagttcatagaccacggttttcatgaatagaatgtgcatggtattgcatacctccattgttttcttagaataaattactagaagtaataagatacttgggcaaaggaactgtaattttaccagaaataggtgtatctaaatttttctgaactatgaactacaaggaaaattttgacacttgcagaatgttattctggcctttgtagtagtcgttgtgtaccatatttgtccctgaatgtatgtaattatatgaaagctatgagtagaatttgtattgaatgactgtcaaaatttgcttataaatgataatttgcttataaatcaactctgaaagagttggatttatcaatcatgtaaaaaagacttggtacccctttcatatgttcatattaacaaatggggctaattatgttttattgagtacattttgatttgttccagtagccggatcgagctgggagatgtgacaccacacaatattaaacagttgaaaagattgaatcaggtcatctttccagtcagctacaatgacaagttctacaaggatgtgctggaggttggcgagctagcaaaacttggtataatatagttttttttttgtcctcccttcttttctttctttttgttcttgaaccctagttttttatagagcagaagaagttaactaatttagtttgtttattttataagtgaggaaatgggagtggtctaggttgtgagaaaaatctcagagaaatcagttgaataaaacagttgaattttaaaaagaaatgcttagtgttcttagtgtatacctgtgtgttttcactttaagctatactctagaggaggcttaaacttcctaagatggcataagagctttgagatcattgatattcatgaaatagttgatgaaatttaatgttgataggaacagtgtagtcctttaaaagggaaaaagattaaatgtgttattctgtctgttcaacattatatctttatgttttccttggcagcctatttcaatgatattgctgtaggtgcagtatgctgtagggtggatcattcacagaatcagaagagactttacatcatgacactaggatgtctggcaccttaccgaaggctaggaataggtaaaaaattgtggtttttttacttcttcagagaagcataaacatattatttgttaatgtgtctgacctagtaagttaatttgggtctttttaaggaatactgagaaagggttactgaattatgtaaaatatggtgaaaaataactagtgtttattaacataattctattggaagccctacatagatttgctgtttacgtccccttctgctttttctgtttttcttctacccggaagtgcttgtttaaaaaggttagtcttctgctaacagttttaaacatacgtagctattgtagagagagaacacaactttggaaaataaggatatctagtgtatacctcataaattcttttaggactcaataagtagttcagatggcaagtggatagatacataatttaaaggttgatttatgaagtcacgtgtttgttatttattttattaacaggaactaaaatgttaaatcatgtcttaaacatctgtgaaaaagatggtacttttgacaacatttatctgtaagtaaaataatatttaatgttcttatcaaaggggtttaattggcaggagaaatctttactagaaactttaaaatctggtcacttattgtgcctttggaaacactgtggaagtagttgttacaaagtattcgagtagttgttagttttgtttagttttgttttattaataatagtagattaggaacctgagatagaacacattgctttattatattaggatgagagcaccaaagtcacagggatgaaatcaggattaaaactcaggccttcagaattcaagactattaatactacttttctcatgcaaaaccttgtgtgttttgttcaaggctatgttgatagctttgaacattgtagtagatcatttgtagtagagtttaataatcaaaatcagagattacctagctgagattgtacttgaatctcaagaggctgtagataaagagttatga

SEQ ID NO: 107560 - DNA, 1013 bp, Homo sapiens
gtaggagagttctggcacccagtgggtaaaatctagggatgctgctgagtattctgcagtgtaccagaaaggccctttacaacaaagaataatgtagccccaaatgctaatgttgagattgagaaaccctgctgtaaaatctaggtaagatggaacttactaaaagtaatttagtaattccctgaaataatctgagatcctgccctaagtcttatagttttatagaagaggtaagatacaagaataaatgtttgtagcagggcagaggtgccttgtaaggacagaaacggtaatatagttcatatgaggtagaaatctcagtgggtgacaggttaagacctcatgagcagttagtgttgaaactgtgtgataaattctgaatgggcttactttcaggttgaaggaatttattttccagaggaatcactctttcatgtaatttactacagggtaagagtttagaaacattactgctagcaaagaaaaaattacctcccttctaaccccttgacatttttaaatcaaaggaccatttgatcctaactaaaagatgctttgagttttatgcaaatgcacctttatcagtatacgtcagaaaaatgtttaccaatagatctctctccctttttttaaaaagtgaccttgaggggtaaaggtcattcctttgacagaaattgttgtgactgatcttgtgctacaatggaaattaagagacataggcttgattctggctttatccataactgtctgtataactataggtacatttgtctcttgggggtttagtttcatcatctgtaaaatgaagggggagtagatccagtccagatcaaatactctgcacaacaaatgaacaggcagttaaaattatgtgccaaggtactcttaatactcactaaaagtataaacaggctttaagctttctctatacttcattttcactttttgttatataacttaaaaagtcacactttgagcctggtgtggtgatgtggtgcctgttgtcccaatag

SEQ ID NO: 107561 - DNA, 1095 bp, Homo sapiens
aataaaaaaaatttttaaggtaaaataagttttattttgactacatgttgaaatgatttcttccccttgtaaatgtggatgctaaacttgaatgaaaaaaaacttctaagggaaaataagttttattttgactacatgtttaaatgatttctccctcttgtaaatgtggatactaaacttgaatgaaaaagtttttaaggtaaaataagttttattttgattacatgttgaaatgatttcttccccttgtaaatgtgaatactaaacttttttttgttatatcaaggaagtcttcccaagatattaaacattttaaaattttgtatgtcacttgtatatctgttggacggtcctgtgctaaacccataaaaaagccaaagttgtataaaacaggatcttttcccttagaatctacttcccatcccagatggtagatatttctaaatgtttcaacttgtgggccaacagaaagtttatggctgtttatacctctgtgttgaaggattttgaggcgaatctggttttttggttaaagtgttgccattcagtcacttggtctgctgtgaaagggtagggaagagataattggaagtattcatctttcttgagctagtgcaagctatattctgcctctgtcagaaacttgttctccaactccagaggcttcttacctcagtcccctatagtgctgtagtgaatgcttgttcataaaactacctgacacacatccttaattacttcttttggataatttcctaagaatgaattttctggatcaaaaggtactgacatttttaaagctctggtgtttcttgccagttgacctccaaaaagatagtagcaatttattctgtcagcaatgtatgagaatgtccttctctttccaagggctaacgaaagggaagggcacgtggaaaaacctcaggaaaacatattgtggctgacatttcagccatgaatggtataaattttctttgcgatgcgttcaatacatttaaatacattaaaatgatagaaataactaatagcttccttacaagttgtctttgagtaaatattcacattttgctttaactctacttttactttgctgat

SEQ ID NO: 107562 - DNA, 2312 bp, Homo sapiens
ggcaacagcgtttgaaggtcactctggagaccacaaactgggaagaacggggctgagaaaaactatcttgcggatatgggacaagagagggaggggtggaaaaatctggattttaccgccagggcctaccgagccagccccacaagcagtgtcgtaagcgggtgggagggaggagcatgaccccagaaggcccagtccaggagaaagatggaggttccggagtggagggggcagggtgcgcggaggcgagcagtgcggctgcgcgtgaggcggcggcgcgccggcgcgcgaggggcggggtgaaaggtcacagcgcggcagcgggtctggctggcggcagcggcgggagggagccgagagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcggagacctaagggcggcgactacgacggcgttgatatcggtggtaacgacggcctcagcaggcggggaagatgaaagggtgaggaagggcagccgggcagggcccggccggtggggtagaagggtccgggcccatgtagagggggagagccgcaaaggcgaggagagattcagggcgaagacgggcggagggagatttctctgcttctcagttccctcggctcccggagggggcggaggcgaggctcgggctgttggcgggctgaagggccagcggaggcaagacccggggggcttcagggtttcggttcggagacgagtgtgggttgttgagtggggagaagcgaccgagtggggcaacatggaaaggctattgtgaagcgcccggggcctccttcccgggagcggaccgctgagccacgccggcccgcagctccaggtggagtggtttggttgtcttccacctccagactcaactctggaactgcggtgtttgacacctttcagtttaattcacgcttgggagctgtgcagaaccttctggaggaagaagaaattggaataaagagcacggggatgagtattaagagctagtgactcaactagatttgggttgggtcacagcgagtggaggagggggagagagcgcgatcactgtagacttggggtgccaacatatttaaggaagtatagggtggatcagtaggtggagctgttgcttcagtagttcactattgcccctgagtgctgaggcggtcctgggtagttctaccacgctgctcctttcaggtgattggcaaagttaatgttcggtctttcaccgtttgcctcttacgtaaaattaggaattattttggatcgactggttaagtttttatgaaatgtctccttaccattaagttgtatagttttaatgtattaattacgtaacatttttccgaagcattgtctcaagccgttttggagcttgtctttaccctcaaagagatgaagctcataaacgttaaaaagctctctgcgatgccatagtttgttgttgtaagtcgattaagaagtcgtaactatgttttaagttaacgaagtcattccaactattcaatagcacttttgaggatgaaataaaagtcactttcaacgtaatctcatactgccccaaacaaggacctaaatattacctctgtgtatcggtatttgaggttcctgaagagattccaagaaagtttaatttggtcttaggtctgtaacatgtttccttactttaattttcctttaaatactggatatttattctaatgttgaattgtatgttttgtactaataatctttaaagtttaagaaccatgaactattcacagtacctgcattgtttcacatcaagttgtaaagagttccagttagggaaatataattgacgggtataggaagtatttgctccacttgaatcatgatcttggaagtttggctatttcagatacaatccaacatatttggagaatgttgtttttctgctatactgcactccttttgttttgttcttttcatttttttttttttaatgaggcagggtctggctctgttgcccaggctggagtgcagtggcgctatctcggcccactgcaacctttgcctccccagctcaagcaatcctcccgcctcagccttccgagtcggtgggacctcaggcgcgcaccaccacgccttgctaattttttgtatattttgtagagacgggggtctgactatgttggccaggctggtctcaaactcctgagctcaagcgat

SEQ ID NO: 107563 - DNA, 1083 bp, Homo sapiens
taccctccagcacgcctcaagttttaagatcacgtgattggcccaaacctcagagcctggaattttaccggcggactccagagggacggaacgccaccgccatttcctgtccctcgattgtggcgtgaacgtcacttccttagcaatgcgctttaactcttgctgtccacattttccacattgtactttataacatactctttgtgaaaatttatcttttatttctttaatccaagaaaattaatattcaagggatccgtaaaaattcaggccccccgagatgtagagcgctgggatggaggaggcagggcggagctcgacgtcatgtgactggttgggcccgcccccccccccccccccaacctgtgcagctgaggacttcccctccgtggtgacagcctctgggtcctcggtcggtacagtctctgcacctcgcgccccagcaggtgagcggcgaccggtaactggcgagtggtggggatagagggggtggaaggaggcagaggaaggagagaagggagagtgtgaacggcgacttttctgcctgaggcttcctccccgctgtcaccctgcaccggcaaggagctcatttctccttaacccccgctcccccaagtgtggtcgttcccgctacttggggattcagatgtccacctttcccagggttggaagtgagtgcggccattatggttccctactcagagcctttggggcttcgggtagcagattgtttcagccatttcacagggtctgcagtagacattaggtcccattccttaaagcccattctttggcaaaggtcctcactgtccttaccctcagctcagggctgaggagcggggaggtagcaaaaaccctggaggcagaggcgtctccggtgagacaggcttgggagggactgtcactgatacggccctcactgcagagtcactgtgaagcttccctccgaatgtgctttctcagtgattctaaggattttatctgacatacctgcagggaaggttccgtagatgttcacgtgcttcggatgggactagaaaagtaaaagaagggcttttactttttcttctctgcagagaggac

SEQ ID NO: 107564 - DNA, 1042 bp, Homo sapiens
tatttgccagctgggtgcagtggctcacacctgtaatcccagcactttgggaggccgatgcaggcggattgcttgagcccaggaattgaagggcaacatggcaaaaccatgtctgtacaaaaaaaaaaaaaaaaaaaattagccaggcgtggtggcacacacatctagttcccgctattcgggaggctgaggtgggaggattgcttgagcctgggaggcagaggttgcagtgagctgagatcgtgccactgcagaccctgggtgacagagccagaccctgtctcagaaaaatatatatgtaataataatatgtgctattatttgctcagtcaattaggtgcaatatataatagttttacttggctcagttgttttaacattcatttactcatccaacaatatttttaattcagttgaatgggtaatacatgtacaaatatggtaaaatttatatattcatacaagtgtgttttctctcccctcatccttattcttttcttcccccatatatttatccacaaatggtagcacctcttcgtattattctggaccttacatttttcgcttgagtattacgttggagatcttttcacattgatacagttaaaactgcctcattctttttaatgatagtttagtattcaattgtattaatataccctcatcatcatatgtaacatttattgagagcttactcctgatccaaatgctttcttaatactttagttttattaactcatggaagcctcataacaacctatgagataggcactatttttctatatttaacaaatgaggaaaactaggcacgggatgattaaatgtccaacagtcacacagtttataagtggtagggctcaggattagagcccagggagtcactttccagagattgctgccataataccgctaaacatgtagcctgtcatagtattacaaggtatttaaccagcctccatattaatggacattccaatcttttgcttaagaaacagtgctatagttaatattttgttaatagaacattttgtacatctacaat

SEQ ID NO: 107565 - DNA, 1050 bp, Homo sapiens
cttatttccaaagcagtcgagggaactggaattacaataataggcttaacaaattttgaacaaagttggcttttggttggcaaggaaaaatcaggaaactaaatatacatagtgaaataaatctgccacataagccattctaataggattgctaggtaggtggattgaaggagatgaatagagagtgtcacaaaatgactagcactatactctaaaagtatgatcaggtaatgttatttgttggaattccacctgttctataactttctgaccaaacataaaaatattaaacagatttaagatacctttctctaaaaagattaacagtgtgtgaaaataagtaattggttataatccattagattcttctgaatcttttttaaaaaaaatctgtgatttccagagatagtctttaatcaattagatagaatgtattttttcattacactctaatgtaacaagtgttacatcaaaataatgcttcattatcaatgaagtgccccaggattttgtatgtgagtaaatattaccttggaatcttagtgtttaacttttatatatcacctcccctttgcccccaacagccatatcatccaagactttggtaataaaaagaataatttctgaaataatgaaattaccagttgcattaaccagcagcaatttggagtggactttataggaaaaaaattttttcctctggtgttatttgccactgcagtgttctgcagtgcctgttggggagaggctgatgactcattaactcagatcagttgcctatgctgcctttctggatttttcctcttctaccacagggttttggtttttgtttaaatctttcacaaattgggtagggaggggcactgctataatttgtaaccaaagaatcttagttgtaagttgcatttactttttatccttaaacacagttgaagtcaaaacagctaaaggcaacatttttatataatcattgatttgatttttctatgagtgcatctgtgtataccacactgctttcatcaaagtatgtaataagtattcctgctttta

SEQ ID NO: 107566 - DNA, 3288 bp, Homo sapiens
gggaggcagaggttgcagtgagcagagatccttccactgcactccagcctgggtggtggagttagactctgtctcaaaaaaacaaacaaacaaacaaacaaaaaactagttgggcatggtggtacacacctgtagtcatagctacttgggaggctgaggcaggaggatcgctagagtccaggagtctgaggctgcagtgagctatgactgtaccaccacactccagcctgggtgacagagagcctcttaaaaattttttttaaattaagaaaaggaatttttttattctactttgaagaagtataataactcaagaatacaccaaagatgagagtggtctcatcttagtggactacctatattttgggtcttttgctttacggtttataattataacttatttatttatttatttactataggtaaactaacattatggatttttccaagctacccaaaatactcgatgaagataaagaaagcacatttggttatgtgcatggggtctcaggacctggtaagtaatacatcataatctcaaaataaggatatctaactttgattaatgtcttttcaaaatattttacatagaaatatacaactttctgtttacctgcataaattctgtttgtccttaggcgatctcatagtgactataagaccgaagtagaatctctgtcataagggctcatctagcattgattatctaaattttataattattgaggtactactttgtgatatcctgtttataattatgtaaatgttcaaccagtgttcagttttatatgtcttaattttttgttaaatttgaggtaaataaactatgaagtttatagcttttaatatgtaataccttgcatatagcaggcattcagtaaatgttaatttgctttgaactttaataattcaaacgctcagagcatttctcagcaatattagcttttgccctttgcatttatgaaactttttgaatggttattttaagtgtcacattattaactacctgtgggaaagaagtcttaggacccaaactttatgtccattctgccaaaacatggagtgctgctttttaaataataaatcttacgccagtatttgttttgttattgaatactcccactacacaatgtgattcacagtcacagtttctctaagtaaaacctggtcagtgatgtattatccttaaaacctcatgctatatagtctttttcttgttctagttagagtagtggtgatgacagttttttgatgtttacgcaaatgaagactgtcagtcactgtgcctcttttttctcccccaagaacttggtgtttgagcttgatttcattggcaggtcattaaaaggttatcagtatcttttgccatgcagagaaataattgtcctctcaatgatcataagggtcttcaggatggacagactaaacccaagaacctttagagaaaaggcaaaagaacatcagagagtttaggaaaaaatattctgtgaaactgtgtagtaaactgctcctggaaacaatttttattttattttaaaaatttttttaaattttactttaagttctgggatacatgtgcagaaagtgtaggtgtgttacataggtatacatgtgccatggtggcttgctgcacctatcaacctgttacctaggttttaagccccacgtgcgttaggtatttgtcctaatgctctccctccccttgcctcctgcaatttttaattcttaagtacttaataaggtaatggaacaatggcatccttttttggcttatgaaatatgatttttaaatttcattatctctggtatttcagtgcatcttaattcttaagtagtcggcatagaggtaaatatttatagaatgaataagtcttcattgtttttacacaggttaattaactcataaagctttaatagtttccactgaagtattacctataacatagttctaatcagttgtatcagaaggctaaatattaaaaattggtttattcttacacgtgtctaaaaatatggcaaccttccttccctgctagaaaagtaatttttgcttactagaccacatggtccaaaatagtaagttcagtaaatggaattccattgacaatttcttacccaatggtggtgactgattataaatatccttacggcctatgaaaaaaattttgtagatgtgtgtgtgagtttttctagtagagctattattagtttttgaaaagggtccatgtcccagaagagttttaagaactactgctataagttattagaaagtaaacatgttgctttaggtctgtctctcaaaggaaatggtaacagcacagcgaagtgataattgtgtggcattctaccatactactagccaaaccatttattccaatttctacttttaaaagttttttttattgttccaaagccttcactccatgtatcatagcaactctcagaacatacctgaatcctaccaggtaagtttgccatgcagaacttgaaatgtttgaaaagttttcatgtatattatgtaaataaataatctttggcttacctctttatattatacactaaaatatatatctatgtgaaactaccagtatgttccatagtaggtttttatccttcttatgaatatatgagagaggcacaatactgggtttattgggtgttttaattatttgtgactattcacagagcactagagtcttaagtcatcaaaatagtcttttgttctcttcagtggttacagcctgtgacatggcgggtgcagccatgtatgagctggtgagagtgggccacagcgaattggttggagagattattcgattggagggtgacatggctactattcaggtgtatgaagaaacttgtatcctttttggctcaatttcctgccactttctatatttcaaaatttaaggatttaggccaggcatagtgcctcacacaaagtaatcccagcactttgggaggcaggcaggtggatcacctgaggtcaggaatttgagaccagcctggccaacatggtgaaactccatctctaataaaaatacaaaaatcagctgggtatagtggcaggcgcctgtaatcccagccgcttgggaggctgaggcaggggaatcgcttgcaccctggaggtgggaggttgcagtgagcagagatcgcaccactgcactccagcctgggcaacagagtgagactccatctcagaaaagaaaaaaaaaattgaggatttaagccaaaggtggaagcagcaaagcagcaacaactaatgatattagaagcatgaaatgctgg

SEQ ID NO: 107567 - DNA, 1055 bp, Homo sapiens
ctggtctcaagggatcctctcatctcagcctcccaagtagctgaggctacagacatgagccaccatgcctggctaatttttttattttctgtagagatgggggtctcactatgttgcccaggatgggcaacttctagcctcaagagatcctcctgccttggcctcccaaagtcctgggattataggcatgaaccaccatgcttggcctctttgtacatttcttagggtaatttcttagaagcaaaattcctgccaatacagctgctaattattattttacattctgatagcccttcaaaagggctaactgtggacaagagtttctgcttctcaacatcttcaccaatgctagttttttcaacacgttcttatgataattatcaaagatacggaaaagttgaaagaatgttacagtgaataccatgtacccagcacttagatttgacaattgaaattttaactattcttgctttattagatacctgttcaatctgtatttaacaatgaactagcatctttcttgtgtgtatgaaccatttaaaaactgccttgtgttcattttccttttggatgatagttgtttttcatactgatttctagaaactctttttggttttttgttgtttttttttgtttgtttgttggttttgagacaaagtctcactcagtcacccaggctggaatgcagtggtgcgatcttggctcactgcagcctctgcctcctggattcaagcagttctacaacctcagcctcccgagtagctgggattacaggcatgcaccaccaccacacctggctaatttttgtatttttagtagagatggggtttcaccatgttggccaggctggtctcgaactcctgacctcgggggatctgcccaccttggcctcccaaagtgctgggattacaggcttgagccaccgcgcctggccagaaactctttgattaatgaataaattcgtcctttatctgtcatgagttgcaaatatgtcccagcttgtttatctcttgattttgtctgaggcatatttttcttgtaggcactgatacctg

SEQ ID NO: 107568 - DNA, 1204 bp, Homo sapiens
tgtgacatttcatcacagatttaaaacacagcatgcttgtataagaaagaatctgttcttattagattggaatatgtggtaattattgtgttgttgaagccttaatattgataagtaatgtttcctaaagactttcttcatgagaccattttatggatgcctgaacagtcagtattttttattctgaaagatgcaatatgataaataggaaagtactgaattttccactaattatgttaattttacttatataaacctctgtttctttaccagtaaaataaaaaaaccaaggcattataaaagttccaaaatcttttggaacttttataatataactatatatttttcctaatatcttagtgtttcatagcgctttgtactttttagatgacatttatttaattcacttcatctgccatatatacaagtatatagggcaggcgttattccatttttaataggttaggaagccacactgggaaatcaagttattttgctaaggttaatgacagaataggaactagaacccaacactcgtttctgtatattagctgcttataagtggtttactgtctaaatttacaggataggacctgatctgcatagcagaataatctggacaattaagatattactcattttaataacatttgctacttttgaaaagtaaccacccaagctgattggttaagggttacttttgcatgcatacatgtttgtgtgtgtgtatgtgatatatagagagaagctacatttgaaaattaatttcagacttaattatttcaacaaagaatagagaaagtcatttcctgctttctaaaatgtgcattatattagggccagctaggctatggcatcaaataattccaaatatatatttgctcaatataatagatgtttatttcaagtgttcagggcactctttactctgtcattctgagccatgatccagcctgaaatgagctctaccattttcaacacatggcttccaagactactgggagttctttccatttcagtaggccagaaggaagaaagagtatggaagagcgtgtgacttgcctgaccgtagaacacattattttgacttgagttttgttagccagagatcagttacatggccatatctaagtgcacaggatgctaggaaacaattcagtgtgtgcccagaaaaagaggaagagcagctttgagggagccacta

SEQ ID NO: 107569 - DNA, 1088 bp, Homo sapiens
ctgtatatcagtaagccccagaaatctgctctactgggaacttaacgaagcttctaggaaccacctacacaaagataacaagggaaaaattctttggaaaaggtgtaataggagtatccgtgaaattatgtatgcaaaggtgtttaaacatatccaaaagttgtacgaatgtatgtgactgaagttgaatatttgttcacgtgtctgttatttaaaagtatgggcaaatgaaaacaaacacattaagaaaaaaggggctactactaacttcaggaacttgcagtttcctgctttcctattactcattaaacctaatccactatcacaagggagtctttacaactcagttattttaccatttgggttacttatttaactgcattgtacaaaaacaaaccctcagagagtcattagattatagtaatactgtttcattgtttctcccacttgatgatgttaacagagaaaagtaaaatttacccttaaaataaatacaagaatatatatcttcttctatcccatatcctgagacatctctgtccaaaaactctggttaagtagttgttggtcttttcactattatttttttattccttaggtatcatctaataaataagcaatctgcatacttagataaagaaactaatgctctagtagttttatataaagtatgaacctgttttggagtttatttttgttaattttttggaccttcatttattctaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggtatattttgtttctgctgtaactttttttatttggaaatgcttctttttttcttttttttttagacagagtctcactctgttgcgaggctggagtgcagtggcatgatcttgtctcactgcaacctctgcctcctgggttcaaacgattctcctgcatcagcctcctgaatagctgggacgacaggtgc

SEQ ID NO: 107570 - DNA, 3493 bp, Homo sapiens
tcacgcctgtaatcccagcactttgggaggccgaggcaagtggatcacttgagatcaggagttcaagaccagcctggccaacatggtgaaacctgtctctactaaaaatatgaaaaaaaaaattagctgggcgtgatggtgggcgcctgtaatcccaactacttgggaggctgaggcaggagaatcacttgaagccaggaggtggaggttgcagtgagccaagatcgtgccactgcactccagcctgggtgacagagcaagactctgcctccaaaaaaaaaaaagtaacttaacatacgtaatgaaaattattttccaaatgcgagttgaatttgtaatgtcttctttcaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttctatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaattaacatttttttctttttctcttttttatggcacaatctgctagaaaatatgtaccttgtatcttgacttaatgttttggtatgaccttttaaaattttttccttccttttttatagattgttacttaagattatgaaattgaattggagccctcattatagcctgcaaaaagtcccataactgtatcacactatgttttggaaatataatctacagaatcccatcccattctgaattttactttgagaaagtgaatggtttctataaattcacttctaagtgcaaggaaatcagtggtactcttcagtttttaacaagtaaactaaagccttgtaatttatgattttgcaagccaatttaaagtccaatataacaatgtgcaacatcctttgtagcaattcattatggtacgtaggatatat

SEQ ID NO: 107571 - DNA, 1050 bp, Homo sapiens
tcctcccttttccctagccacctcccccgctgccccctcccccaattatccttccccttccctcctggtctcggaggaccccatcctagcccgacctgtctcggcccgcaacttccccgaaggcgtcggtgccactcccagtccatgtgggcccccgcgggctgcccacgcctgtcccccagctccccattccgctgggctttcccctcgccaggggtggctttctgagccgcccgctccgtgcccctctctgcattctctcctgccacttggggcccccgttccccctcccttcggcgggggttgcccccggggggctggcggagctgggccgtgggggcctccggggccggcggtgccggggtcatccggatggtgcggacgcagtgtctgctgggactgcgcacgttcgtggccttcgctgccaagctctggagcttcttcatttaccttttgcgggggcagatccgcacggtaattcagtaccaaactgttcgatatgatatcctccccttatctcctgtgtcccggaattggctagcccaggtgaggaggaagatcctggtgctggatctggatgagacacttattcactcccaccatgatggggtcctgaggccgcagtccggcctgttaggcctcctgacttcatcctcaaggtggtaatagacaaacattctgtccggttttttgtacgtaagaggccccatgtggatttcttcctggaagtggtgagccagtggtacgagctggtggtgtttacagaaagcatggagatctatggctttgctgtggcaggtaaactggacaatagcagaagcatccttaagaggagatattacagacagcactgcactttgcagttgagcagctacatcaaggacctctctgtggtccacagtgacctctccagcattgtgatcctggataactccctaggggcttacaggagccatccagacaatgccatccccatcaaatcctggttcagtgaccccagcgacacagcccttctcaacctgctcccgatgctggatgccctcaggttca

SEQ ID NO: 107572 - DNA, 1128 bp, Homo sapiens
caaagtgctgggattacaggtgtcagccactgcacctggcctgaatgctttctttttttcttttctttctttcttttttttttggagatggagtctcactctgtcaccaggctggagtgcagtggcgtgatcttggctcactgcaacctctgcctccgggttcaagcgagtcttctgcctcagcctcccaagtagctgagacttcaggtgcgtgccaccacgcccagctaatttttgcatttttttttttttttagtagagacggcatttcaccatgttggccaggatggtctcgatctcttgacctcatgatcagctcacctcagcctcccaaagtgttgggattacaggcatgagccatcatgcccggtcggcctgaatgctttctaagaaagtgtgtggcaggatcctcattctctcttctacttcttttcctgttcttcagtctctgaaagaagcatatctgtttcaaacctttatttcctcggttcttccatcttcttcctctttatttgcaatctctccttccttcttcctcctcctttcctctctgtttttccacatctcacctccatcctgttgagcattggaaattagatcagttgtgctcccattgtatttaataggttttcctttctttttgctccttgagaaagggaaagcagatcccaggacatttattatagtcttggccatatgatcatttgacagctgtttcttaaaccttgttcttagggctgggaagagtgaggaggcaggagtggccaatgggcttaggctcagacatcttgagcgtccacttctgggagggcttcgccatttcagctgagactgagtcagaaggaaggagatataaaactgccttcttgtgcgatctagtatctaactcaaacatctactctgtacctgtccaagctttgtggttgtacacaaatgaaatttaaaggagcaattttcatttgattagttactgttacggccatttgtactttgttaattttttaatgtttttgagatttatagaatcccatgtgagtgtatcttgttttcagaaatgatatcaacttgcatgtaatttaagaagatagccttgttataagtaaacatttatttgctatattacagtag

SEQ ID NO: 107573 - DNA, 1050 bp, Homo sapiens
ccactgtactcatatgtgacttttatctctccattttctttccatttccctgttaggtcttgagagatgggtgagttttcttccttgagatgatggggcaggcactggctggggaagctaactgggtttggttcttctcccttgtctaccccaaagaatggattgttctattatttttgtcctttgtcccctttcccttctccataagtgatttacatgatctgtgaagctcttttatatggtgtttttcataaacttgtttattattgtgtaggatgactttagaatggtatatattatttattcatattttacggaccgacatttaatagcatgggaaatgtgatgcaagtataacaaacaaaatgctgtaaatattcttcaaagctcaatatttcaaagtatctttaatattaaagttctcactgcaaaatctaagctaaacctgtgttttattttgaaactggattgtttaccttttagggattaggcaaagaggagtcccaaaatgagaaacagaccaaaaagagtctcttaccaactttggaaaagaagttaactagagtgccatcaaagtcactggacttgaataaaaatgaatatctttctctggacaaaagcagcacttcagattctgttgatgaaggtaaataatttcttataaattttattaaatttcagttatgtctttttatgtttatctttgtaataggggtgtgcagattgagaatttagttttattagacacagtctcaccctataaagaaacaaaaaaagaatgggagcttatagaaaataggagaaagaggctgttaaatctaacgtatcccactgtcttcagaagcctggaatctgaaaagcttctttgcatttagcttctaaatgtggtgttaataaaaacatatatgcccattctatataccaggcagtgtgatatgctcacacgtcataggtagagtgacatattatttcatttaggctatccctcattttcctggtagggaaaataagacctacaggagctaaatctaaagtcacacagctagttaa

SEQ ID NO: 107574 - DNA, 1054 bp, Homo sapiens
acagagccgtcatgagggtcacgtgagggaagatggatgtggaaagcactaaaaaacaactcaagagccatggaaatacaaagtattaggaaaatattatgatggaagaaaaacgtttatagtctagaatattgaagccaatattattagggtaatcagttttcagcatataccttgttgtacagttatgagaatttctccttcttattagacatgaactactcaaacagagaagatgaccagatggattgatgctaagttgtctcatcttgaaaagacagttgacaacagttataaagataattattgctagtgtaatgtagtgtggccatgagtttaggtgatgagttcttctatttatattttataaattctgcttgggtttcttataaataactccaacaggcattcatgtgtttttcctcttcccatgtttcaccaggtaaggtgctagcacacttgtgactgtggctggaagaggagaacagacactcctgtggggatgctttactctcttttctggtaggaaggctgagtaacatcacgggctcgattattttcttcatgtatttcaaatgctgtcagttatagcactaaattgtgaaaatcagccttctggcattcacattattctggtatgaactttgaggagttgagtgacatcttcccacttaacttgcacattaattctcaattacccctccctaaataacagtatctcactaagagagaagaaacagggtatatgtggtttccactattaatggattactgttcttccctggctcttccgacaataacaagttgtttctttaatcatatcttaaaaccgaaaatgtataaaagattaaatatttatgtacaatgggttgttctactatagaattaagatgagggaatttcagatgaggaaaatacccttttgaaatgttagttttgaacatgtactgttgtgcaatcccaaagataattcatgactccttaaatttgccttggcttatagcttaatatagggaaaatattgccagcgttttcagtcattctgtgcatgctg

SEQ ID NO: 107575 - DNA, 1448 bp, Homo sapiens
ttggtagtcgtgcttttgaatgtcagctgtagagccaactctgattatctagccattgatcatacaaattgatagaaacattagtcagtaattttagcttcttgccaaattgttcacaacatctaaatgtaatgtgatgtgatgaagataagtagtacaaagagaccaaaataatttgggagaattaggaatgatgacaattttttttaacaacttacctctaatagggttacttggatgagccaactccgcttccttcccatggataggaagggactctgtgtattattcaggtttattggcacgaagatacttgttttaagttccttgagaacccatgatggacagttgacagaatgcttaaacctgtcaaaagatgagtgatcttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcacgtccttagtctctgttaatgaacatactggatgtggagtttaataaattacctactatcatctggccacttagattattatcacaccactgtggactgttcctggggggagaagaacagaccgatttgaaagattcaagggagaaagattaaggatcaggattgcatgaaagaagaaaatccttcaatatttaaaatgtttcttacaatacccacggagcacttttatggttccagccgagcgttcctgaaatgaactgaccattaacagcgcctctttgataggttaccctgatgctgctaaagtaaagccttaagtgtgtttttgggacaacgtgctgcttattccacctcagccacatatgtgtttgtgtttaggatattgtaaatctttgctaagtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttag

SEQ ID NO: 107576 - DNA, 1157 bp, Homo sapiens
caacatcaggtccacatggagcagcccctgggctggcttatttcctagcttaaatttgtagttgttagggataaaacaaaacatctttgagcctcaaataagagcccaagtttctcaaaagccacgtaagatggtttcagttgtgcttgagacatactcattgcatgtggtaaatggtaggataagatgtggtgacacctatggatttgaagcattaggatgggagtcacagtacctgactcactgtgtagactcatgccgatcacacaacctttccatacctcattacacatatttatggagtggatataatatgtagttatctcagagagtagggattcattaaggtctgtaaaaggctttgagcatctcaggtcaaaggagtttgaaggaaactggttagtagtctaaattcctttcctttattttttccctagttcacctgttgcttcccctgggactgaaggcagaagtgactcccgaaattctctttctggactcagaaggaaaccaaagcaattgatgacaccgcatcccatactaaaaggcagggctgtctcggtggtggccttggtggttgttatcttctctcctagagtagaatgtgtacactgggactgaattctggcaactcttgaggttttgagacttggcagaacctgacatcaaaaatctcagaatggtagacatgtgaggagtggagtacaccagagagccccactacttttttcctgccccttttgccaacctttttggcattcccagccaacacacacacaaaaaaacatagctgaaaggtatatcatttttctgtaatttgagatttggattgtgaaaaaaaaaggaataattacacaaatgagaaaactctgagtaactgccaaggacaaacactgataaaggacacctgtcattgtactttgttaatgttcaaatttgatcagtttacagtaatccaagataagttattattttataatattataacttgttgataggattttagtaataaaacctacaaaccagatatgttaatttgataacatttttgatgcatctagaaacatttatttatttggtacaggcagggtcttcctgtgttgcccaggctggtctcaaactcctggcctcaaggagtcctcccacctcaacatccc

SEQ ID NO: 107577 - DNA, 1727 bp, Homo sapiens
ccttaggaaggtgtagaaaataaatgagttccatgagaccaggggccttgcctttgccctttacacatctagtgcttagcaagtaccttcttggggcagacatgcattcagttcaagggtttggtaaatgagtccttctctttagcagtcctttccctgaccagttcttctttcacaagatcaaccctcagtgttactttgatttttgtaagccttttacttaaattattgacaatttaacttgttaagtgttataattttgttgctttctctttctcctaaacctgtctttttaaaattttcgtgcatagctgaacctctgtctccctcatgcattcatctttttaaagtcattacttgtgtacctcttctttttgctctttcccctccaaaagctttcagaaactatggtaatcaaaaacatgtaacatgcccttgtgacatgagaacagaacagttcctctttcttcttgaaggtaatctgttgaagtgctgacaccttctatgaggagatcctttgcactggggaatttataaagcaatttcatttagcttaatataaaatgttaagcgagagctaagatggagcatttctagaacccttttggacttatgtttcatttatattatcaattaacaaactgtaaatggcttctttattttaatggaagtgctttgttgcttagaaaacaacaactggccactgagtataaccggaaacaagttctccgacactgctttacagaatggcagcattggcatggcgccgagctcctgaagagagagctggctctcacaaaagaggaaactaggaagaagatggatgcactgctgcaggcagcatcactggggaaactcagtgccaatgggttatcaggcatcagtctacctgaggaggcaacagccatggtgggtccaccagtaaaaaatggacaggtacgttgtttttcctgcttagtaaacacttgcatttgaggtttgtgcttttatagctggtatgtcagtcattgtcagattgctttgtctaggctatcagaagattagagctgcctcaatgcactacctttcaggcagtgtttatttccttgaattgaatcttctttttataatcatatataaactttggcatcattggaagttagtagggatttaatatcgaaagggcatttaaaacaactaagtaaaatattcgtttaggaaaagacaggtaaagcactgtctataactcttgaactcccctttttgatcatcagacatttcctttctaaatgagtttgtgacttacaagaggggaaatttaaaatttttctttttctaataagaaaagtcatatgtactaattgtagcaatttgatagaagatcacagagaaaaactcctataattctgtcatctatagataatcactaataacatgttaaagtatagccatctagtctttaagcatatgcaaatttatctcttaatattttatttagcttttaaattttctttagtcaggccattgaggaactcgtctgccaaaattcaggaaaaggaaggccatgtttttttttccttcttaatactaatacttactgttcttctaaaaaaaaaattacgttttcacaatataacatgagcattttctgtcattacatacacttctgcaatagtagttctcaactgagagtatacctcagaatcacatctactaaaacagaatttttgggtgtggggcagctcttt

SEQ ID NO: 107578 - DNA, 1458 bp, Homo sapiens
agctttagagcaaaaaaaatcccagagcaggaaggcacctcaaggatcatctgatccagcccctcattttacagatgataaaagtaaggcccagagacagtaaatgactcaaggtcacaaagcaaagagcagcctcaatggacaccaaatccatacttgttgaataataagcaagtcagggaacaaatgaagaactcagttgcttcctctcctgcaatttaacttgatagggttttgaagcattctttctaaatagacagctcagggataggagagagcatttattatcgtggttactcactatagaaacttagctctgaccagattgacaaaacacaggtaattctgtggttcactcacctggacattgaaattacttattatgttcgttatttaaatgtcagttgttttcctcatcctctagctcccctcgctgacgtgtgtgtttgccacctcgatttccgctcactggcctgtccgccatgaagggcccagacttgtgggcttttttcttttgccccttttctttctgttcttcccactttctctctgaagcaaccacaaatctctctctttttattcgtaatttagcaaccatctttccttgttgagcctgtgctgagtctcacttgcagtccaaggagtcatccacttatttcttctaaaaatgcatcttgcttttcctaataggaattgtggttactctgtttttgttcatgtttattattttaaaagaagttatggcaataatgttacaaaatgtccttacaatattgtgatgcagcttcaacatgaacaaatatttccaaaccctgaggattcatttagtaatacaacaaaattctagtatacacactaaattagaccatttgacatggtggtattgaaatttgaactgtatattcaatttccttagtgtgttcatttttgaaagttggttccagatcttccattcctcctctccccctttctgtctgcatttacagctagccccagacaaaattgggaagaaacatggtttgttttcaacatctgcaccaaaatctcataaatcactacttaaaaacttactcatgtaagtgaataccacctctaccccaataactatggataaattaaaataaaaattttagaaaaatcttctgccagtccttcctgagccctgcttcccagatttctcaattctttcctgggccgcatctctgcccttctctgtattaacctccacagtctttaatcctgccttctcttgcaccagtgctctgggcctttcctggaacatgcttttacctcttccctttgtccctcaagcccttcgttctttgttactgtaattctcacttgatatgttatccctcccgggacattttttttttattttaacaggcactgtctggaaacagtgcccaaagtgggagtgacagagatttgagggtactgtggcaggccagtgaaaaa

SEQ ID NO: 107579 - DNA, 1062 bp, Homo sapiens
ggttatgaaaagcaatggcaaaaaccgcaattacttttgcaccaacgtaatatgaacataggaaactatgaaatggcatggttggtgtcaaggccaaaagctgaaagtaatttgatctagaaggaatgtaaagtttgctgaaaagagagaagatataagcaaggactaggtctcagtgattttcttagactaggatcatgagttaagtactgctttggggacatccttaggatcagtagaccttgtctaatttgctgtcaagtgcatgtagtggaagattataggcagcctgaacatctagtctttctagactcaccaaagccctaaagtggtcagtggtagtagcccagctgattttgttgtttatagctgtcttattctcagggaccagagactccatcctatcttcatggaatctcccccgttcacttgtgtggacactagtgtgtcagaaacggtagtgaattaaatggttggtattttgagctccaagacacctggcagggggagtcatgttggaaacaagttttcaagcttctcaaacaagccccttggttcatgtcatagatgtgacttattccagctccccatgggactggtggcttacaatgacaatgaagtattttagtttaagttgtgaggctgagaatgcctcatttgcatgattgaatattccttgtcattattagcataaaggaattgtgctttgtctcttcctttccattaagacaacagttcctgtatttgtttttaaaagtgtgaggggaaaatctgaggagagggctgtcagtgttagatattagaaacactagcgctgatgggtggtgattttcctaatatttccgctgcagtgtcaaaaacggtatttcgctgcctggcacaagctgattcttgatcataggattaagctggggaaagctgggaccctgtctgactggaagattcagctgaaggtcctgcgggcctggagagactacacaagattccagaagttggagcgggagactcaagccttggaaaatgatcttagggaagaaaacaggtatcattatttgtattgtg

SEQ ID NO: 107580 - DNA, 1069 bp, Homo sapiens
ttcaacgtgtctattgggaaacctatcaagttggctcctttgttctttcaacatgcttccatcctattttggacactttcttttttgttggcaccacaagatactttatgcttatcttgtgttttacctgtcctcaccctagaatcaaccacttctacatggaactttgattccttttgttggaaaaacggtctttggaaactaagatctaggcactaagtgtgttcactgctactggagtgtcatttttttctaggccgcctcagcagacagagctaaaatatatataaaatatatatagatatatacatagatatatgtgtgtatgtatgtatgtatactaacatacatatacacacacattatatttatttctgtgtctatctgtatacatattaaaatccatgagttcagcaacacaagggtcatgttattctccttttccttatttgtaactgacttctgtatctatgaatctacatatatatgtatatataaatatatataaaataactgtgaatttataataatattgtcaaggataatccagcaccacaggtttcagtgtagtctttccatctcgctcacttgtaatttctttctctgacactgagaaacctggctctcattatctctattatatttacttattagggtaatcctagtacactataaaaatagttttagaggccgggcacggtggctcaagcctgtaattccagcactttgggaggccaaagcgggcggatcacgaggtcaggagatcgagaccatcctggctaacacggtgaaaccccatctctactaaatatacaaaaaattagccaggcatggtggcgggcgcctgtagtcccagctactcgggaggctgaggcaggagaatggcgtgaacccaggaggcagagcttgcagtgagccgagatcatgccgctgcactccagcctgggcgacagagcgagactccgtctcgataaaaaaaaaaaaaaaaaaaaaaaaatttttagaattgctaacccataccacagtgggaataaattcactaaagcaaaatattgtacggttatttttg

SEQ ID NO: 107581 - DNA, 2615 bp, Homo sapiens
taatagaaatgaataaagggttgtggtgttcctaaaggcaataaatcactgttctatcattcacagtgtggcttccaaaaaagttctgttctttcttaaattagaatgcagacatgacctaagtataataaaagcagtaatgtacaccttggacaatcttacaagtgagaaatcattcctaaatgagaatccagaacttggggtctgactcattagattctcaacttttctgtgatgtggatcattcccagattatttgagtcatcttcatctgacttcatctaaaatgttatattcatctttacccagtaaacagatgaattcctcctttcctaccaataaacagtggagttctgggccagcatatttcaaactggttgtattctgaacttcaaaatgtattgtaaggcttttcatatccctttctacttgaaaggccacacttcatctttattatatttgctttaaggtaaaagaaaatcgcttaagacgtgagaaagaactggagtaccagagaatagaaaagaccctgaaaaaatcggccttcttggaggctcagtgtctggtgcaagaagagaagaaaaggaaggctctggaggccaagaaagaggaagaggagattcaaagggagatggtgaagctgcggagggagataattgagaggagacgcactgtgaaagcagcatggaaaatgtaagccagtgtgataagcactgtggggtttctctgtttaagcagtcattttagaaatgctctgaagtttttgaagtgcacaaacattcaataacaaaacatagaagagaaatcactcactattccaccatcttaacaaattaactaatttcatatttccatgttcctcctgacgtggtccctttccatacttaattatacaaccataaagtacatttaatttgtaattctgcttgttgtaattaacacattgcctggagtcctgggatgtgtataatactccattgagttcctataccataatttatgtaatgaccacctccccatactggtaaatgtttcagctattttggatttttcaccattataagattgcaatgagcatctttaagcatagagttttttcactcttttgtattatattcttagaataaattcttagcataatttctgagttaaatgacacaggtctttttctgactcttgaaacattgccaaattgctttcaaaatgggttgttttgctgatgatacttgtttactgtatcatcagcagcaggccagtttatcatactcttctcagccttagggagtatcatcattttcaatatttttacacttttaataggtattacattgattagtttgcatttctttggttagataatatttttaaggttgaacatgttcagtaattgtgtcttatcctgttgtgaattgtgtgtcttattttctgataaacatatggaaagtcaccactgccttactaccactgataaagaaaaagaatatctgacataagaggaagatgaaaatagtcctcacaggatgtagtactattatccatcctcatgcagaaaatgagcttcataagtgaaataactaatgtatttattctgagaaacagcactgatgcaggaactgcaaaagccttggaacagcatgactgaagtgtctgactactcgaactgagaggccacaaagacctattagataatcccttccacccccatcagcctacacagctttcccccctgtgctcttgattgctcttattctacccagtttaaaacagctcagcagtggacatgtgctttacttcttcaagtgccaggctgaggcttcctccagatgccattcctttcagaaagcaatcactggtgttttagtgagttctttctaaggtcagccttgcttttcatattgctcccaagccctggaaaaactaggttgacctaaaataaattgtgaaaacaagtaacgtttaatggtagtaggatgctctgctcacagtgggcactcaacaaatgttcactgaccagtcatttattttaaaagttaagatcttatccatggttacagtgagataggtaatatgttctacttctgggtggatgaactgatttaaactttccagaaagcaatttggcagtaaacaacaagagccgtaaaatagtattatcccttgacctaggaattacagccttaggaaaactgccctaagaaaattatcagaaatccagacaaagatttgtgcagaaagataatttaaacaacattatttataataacagactttcgtaaatattggagaaattgctaagtcatggctgtacaatgaaacaggactgactttttttctgggtagaaatatggatggcttttatgggcgtggtggcacacacctgtaaccccagctactcgggaggctgaggcaggagaatcgcctgaacccaggaggcagaggttgcagtgagccgagatcatgccactgcactccagcctgagtgacagagtgagtgagactccatcgcaaacagaaaataaaaaaaaaaaaaagaaatatggatgacttttatacttctccagtttttcacaatgagcatatatttcttttaaaatagatatatattctaatgttat

SEQ ID NO: 107582 - DNA, 1040 bp, Homo sapiens
ctcatctcctgctgtctcctcctcacttctctctgaccacactggcctccttgctgtttttccaacactgtagatactcctgcacaggacctctgcatttgctttccctctgcagagaataatattaccttatagatcctcacttctctatctttcttcccttctttgctcaaatatctttttctcagtgaagctttcttttacctcccaatttaaagctacaacacccatcttccatgtcttcctgtccctgccttttctcttatttacttattgtctctcttccccaattggaatgtaagtttcatgatgctagggcttattttttcagttttgttcactgttgtattccagtatctagaacagtacttgacacgataggtactcaattaatatttattgaataaatgaaaacagtgaataaagaaaatctctgaagtaactgaaatacttaacatgtttttgttttattgtagctcaggagctggtcaatgactggttagacaccaaacttaagcaagaattagcaagtgaggaagaaggtgatgctaaaaacactgtgtcaagtgtcactattatgccggaagccaatggccatttgaaatatgacaagtttgatggtaagaacttacctgattgttctaagttttaacatctaatgaatgtgtctaagaagtcttttaattgttttgaataacaaatgatacatatttaagttttctgtgttttttttagtttttattattggttttaatttatcatggttaaatgtaaatttcttatgctatatcttcagtaaattcatggtgttttaaaaattaaaatattctattacagttatccctaactaactgtgaggaattagttccaggaccccctggcccccacagataccaaactcctcagatgttctagtcttgtgcgtatcctctcgcatactttaaatcatctctagacaacttacaatacctaatacagtataaattctatgtaaatagttgttatactgtattttaaaatgtttattattttttattgtt

SEQ ID NO: 107583 - DNA, 1040 bp, Homo sapiens
ttaaggatgtaatgttttaacacaaacaaatatagagattatgtatagtccttagtatcatccagtagttctttctcctcaaatcttcattttaagtgatatcccaaacacttgccttgttaaagccaagcaaacatttgtctttatttccttgtcagtaccagcctctatccttctttatccttcagtctttctcctcttctctcccaacctctctaccctcctctgttaagaacctgtacaaattccaactcaggtaggatgacacataacacataattatttctttcactcaaggcctgaggaactaagtcaagtctacgaatctgtttttgttgctaattttttgtttgtggatttttaaaacactaaagttgatcaatttatttgtacgttatttacatatgtgcatatacgaacacatacagtatatgcaaaattcatctttctgtctcagaatttaggagcctaaaggaaagaccatgtgccaaccatgaatctaatacatgacgtatgctaccaacataaacttgcatgcatcagaggctatcagaaataatatgggaaaataggtctctaccaagtgacttcataaggagtgaatgatattttcttgactctaactctaatgagatcatgttttcttctggctcatgtctttgcctgtatgttctgttttctacatctttttcaaattacccttcacttttcagctttattcctctgcttctgtctgacttaaagctaatgtatgaaacgcacaagaatttggatggaaaagcccatggcaagttttggcagaggttccaccagtctttccataaagggcaggaggaaaagtcattttcagaataggtcaggtgacaatataaatatcggaaagtacagcttttctgaataaagttttcatgtattcattcctttaacaaatatttattggacacctgttgagtgccaagcactgttcttggtgccaggttctccttgagaagaagataagaattcctgccaacattctacctgagggagacaataagtga

SEQ ID NO: 107584 - DNA, 1468 bp, Homo sapiens
agccactgctcccggccaaaacacacctgcatttttggcaaagaagataactctatttgttaagtgactattagagggaattctccaagcttctaggagttacagagagtgaagaaaggaaatgccctgatggttttacttctaatttcagattaatacctgactgatctgggtggaaatttatattttctgctttgtaaaacagtagaagtcagattttttaaccttcagtttttattgggccaaacaagatccctgatctgggtaagatgagaaagcctcttgctacaggctacttatgaaaggagtaaggagaggaacacacccttctttaagctaaagattacttggataatctggctaattaatcagtgctttttttttttaatgagtagctttatatttagcatttctatatcttgactcttaaccctaaggaggtttaaaaaaatagcagtgccagggtcctatcccagaccaattaaatcacaatatcaaggtggacctagacaagaaataaaaacaatcagtgtcccaggaaggcttcatgttttctcctcatactgctattctgtgtcttttattgctaatcatgctgaactttctaatgaaatgctttggggaaataataaaggacactgttccatatgctttagtcagaaggatagatttaaatggcaaagttgataaagatattgctgcgtattgatatcatatatatgttatctacagcctacttttggtcctgacagtgtggaacactggataaaggtaaggatatttcaaatttagaataaaaagagtattaagagtcaagcataatcagatggaaaagaaatatgaatagatctccactttgcacatactctgctatttttattcccgtgtgactatgtaagttgccttaattttatactttttagtattttttttcataattctgttgcctctcatgataccatttaagtaggaatgacaagaaaacaggtgtgtagacttcgtttcaaatgccatgagtatcacatgaagaggattaaaggagttgtgaaaagaagccttgggagaggatatggtggccttcctcagatgttggaaagactgcactgtagttacaatgacctagggactaatgggtgaaaactacgtgtgcatcacaaataagaattttctaatgactagtccatccaaaagtggactgggtgttcttatagagatgtgttttctaccactgaagctattttaatggactctaactggtcacttaatgttaggctaatgaacaatatgtttgaggattcagtgaaggggagattgtgttagataacctctgacatctcttccaggcctgagatatgtatttttgagtctgagtaccatttaatttgaaagtgccattaaatcatttcaggtgtgtgcttctgcgtgtcagtttagcaacttgccatattcaattcatcgtgtaccacat

SEQ ID NO: 107585 - DNA, 1039 bp, Homo sapiens
ggctctgcactggaggcagtgattttggggcagagaattttgcaacacgtggtagtgaactgtgaggagtttgaggggtctgaagactgaaagagtcgaatggtttgttggcaggtaagtgcccctttgccctgctggtgtgggagctgctagagatggatgagtcacgtcgcgtccagacgcttcctggttgtgttgcagtaacggtgattgtactcccgccatgtctcctctgcttcccttttcagggtgtcctggtggattggtttctgtaagttcagattctcataaatcgtgtgagcgtcgccgacacctctgagataaaagggcccctttcgactagcctctgctgaaaggtagagttttcaggaagtttttattccgaactgcccatgggagggtgggaccgtcttcaatctctgagccaggtgcctagggaggtctggggccatggagatggcccatggagcaaagataaatccaggcttattggcttagccgaggtgtttccagagacagcccatttaggggtgataaatgggcttataaagcagagtaaagatttagaacaggagttttgaattcaactactttgtggctatatgaccctaggcaacttgtttaataactcagagaccctgttttctcatgcaaaatggggacgataatacctgaatcactggagtgttgtaatgattaaaaataaatgtatgtgaagcattctgccaggaaatgtaaactaaagttgatttgaaattggtgaaaatgaagttagggaagctatgccctcggactgttgcagcgatcctaggaccagctctgtaactggtctgtctgaaaggcggttgaataaattgtgctcatacaaactatgcagtaccacgaagtagtttttttcaaaagggtaagttagctttatgtctcttcttcaggaaagacgtctaatgtttattcttgagagaaaagcaaattgcagagaagtgcatatattatagtataatatgtttccatttttgtaaaagcaaaccctgaccaaaac

SEQ ID NO: 107586 - DNA, 1048 bp, Homo sapiens
tgctcttttcttcacttaacagcattattaggaaaaaattgctatattgcttagccttccctcaaattggagaaagaaaaaagtggattatatcaataatcagtatggcctaagcagtgttactgttctctgtatacattttcaaggctgagagagccttggcttcatggcattctttccatgattagtctttctaattctgttctttcatttgtttggttttcatcagctcagacaaaaattccatgactaaatttaaaattagttgatgccaatatgtggttctgggaccttagggaagatgtcttattctctttatgtcttttcccattcccccgttcctgatatctatgaaaatatttagactggaagcagtaataagcatgctatcattcattttcctgaagattttttttttttgcaaaatgcttggcctctaggtgttgtgaagctccttctatacttaatgctcttttcttgacaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctgtaagtgttagaaccaatgattcaagtatcaactgtggcagcagcttagttaccttaggtgcaaaaaagagaaatatttttttttgttcatatatataaattgtcgattttcataatgaaatcagaagagaggtttcaaatattatacatcttctggccctaatctggaagccacaggccagacctatatgttagatctgcttcacttttcctccaaacctacagtcccatactgccatgtcgccactgctcccaggggtgacagggcggggaatgttctgtgagagctgcatttggagttcaggagctgttatcatgcaccagcctcaaagttttttctgcc

SEQ ID NO: 107587 - DNA, 1382 bp, Homo sapiens
cggccttacttatgcatatttattggtcaaacgtgtagtccctctccataccctttattattgtcttgacatgattattaatagtgcccccccattcttccattttagataataaattatatgatcgtgcttcttacacccaggaaagggagtttcccgaatagtcatgctagtcgtataagcaggcaggcctatgtaactctctgctttgtgtttctgcatacatcttttcccatgattccctccctgtcttattgactggctcctcttattctgaatgcccttcaatattgaagctctccaagattcggtttttggctttcttttcttctccatatattacctgggttagggatggcgaatggtttcaaccgaggtggtcgggtgcagcaagaagagagtcatctgttagtcacatctgctgtggaatcaggagtagagagtggtagcatcatgccaagtgtctgccattctagcctgggcaatcatgtttgtatcacacatagccttatctttaggttcatttaggttcagtggctgaattaagattgccatttggacatcctgctgattcctcaaattcagaacacacagaacagagtaatcatcttgcttcatccactgtttttctaggagtccctgccttttgctcttatcaccatctacctgtacttgcaaaacaggagccaggagtcatttgagactttgtctttatcctctccttggacaactaatcagtcaagttatgttgatcctacttcctgataggtttcaagttttatctttcctcttcatccacactgccactgccttagtccggatcatctcatctttcacctggatcattaaagttgtctgctattccattctttaatcgtactcacccttaatttatttttcacacggcagccaaagtgttctttctagaggaatagtctgattatgtccctcctgcttaaactaaagagtgagattctctcttcacagtgttccaggcctcctctccatccctttcttctactggagagccattgttgatttgtgtattttcttgcaaaacttattttttgcaattacatacacataattaatacatagatatacatggctgtattacatcagtatgatcatatattcagcaatttgcttgtttttcatttagcaatatcctgaaactctttctctataaatgcatatattgctattatctactgcattctttttaaacagctgcgtaggaagccatactgtgtatatattatgatctacgtaagcctttactctatggataaacatttaggttgtttccagtttttcattattctaaacatctttgtaaataaaccttggcacatgtgaatgagtataggagagattgttag

SEQ ID NO: 107588 - DNA, 1032 bp, Homo sapiens
cctgattggtaaagtatgtttttcaaagtatgttcctcagagccttaaaggttcttagggaggagggagcaccatcccctttaatgcttcaactacagcagcttcactgaggtctcttctatacattggacttccatgtaaggttcatttaaacaaaggtctcatactgaaaatggttaaaaacatatcatccttcttacctcaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggccagtgttcggttaggacacaggctggcctcaagggatgcagggaaggagtgctggccgattgtatattaaatagtgtctgtgcataggcatgcctttgatgttttgtttatgtcctttctgggctgagtctgctgaggtgctgaggcagactgtaaggggagtttccatcaaggctgtcctggccttgatttcagaatgtagagtagaggataattgccatttgaattatgttatttgatcctcctaagtgagagcaagtattatactgtttcccctcattcttgtgccaattacaaatattgttgttataatatggtacctggagaccaagtgtaaagtcacatggaatgctggtttaaattgaggaaagttgaggacagatctgggatgactagtgagaagatgagctccaccaacaagaacttaagaagctcttagatttgaggctggtagtgagtggtgtcaatttttgaaattgaggggactgacaacactagtaggattggttcttatgtttccataaattgcaggattcaccttgtgctgataagaaaagacgatctgcaagatttgaagctacaaattctgagtttctgaatgcagctgatatcgtattaggctacc

SEQ ID NO: 107589 - DNA, 1208 bp, Homo sapiens
gggtctccctgactcattgtgttctttgttaacttttttttttcttttttgagatggagtctcgctctgttgcccaggctggagtgcagtggtgcgatcttggctcaccacaacctctgccccctgggttcaagcgattctcctgcctcagcctcccgagtagctgggactacaggcacgcgccaccatgcctggctaatttttgtatttttagtacagacggggtttcgccatattggccaggctggtcttgaactcctgacctcgtgatccgcctgccccggcctcccaaaatgctgggattacaggcatgagccaccacacccggccctttgttaacttttaaccatattgccattttaagcaggtgcacagcactgaacatttgccagtgatgttattaaccactggtaactttaccagcagaatagatagctgaggttgtggatttcttgtattccgtactttctggaatgtcactgtgacttctttcttaggtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaagacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatac

SEQ ID NO: 107590 - DNA, 1016 bp, Homo sapiens
tcctgctcagatatgactcctgggcaattcacttaacttctccatggctgcttcctgctgaataaatagggacaggcataatggataggaatgaatgaacttttaagatactgtctagctctaaaattggaagaacaaaaagttttagattagagtcatagccttaatagccctagttgtcatcctgggagacaggcaacagtagagatatttgagagcctaaagagaggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgagtagctgggactacaggcgcccgccaccatgcctggctaattttttatatttttagtagagatggggtttcaccgtatgagccaggatggtctcgatctcctgacctcatgatccacaagactgggtaatctgtaaagaaaagaggtttaattggctcatggctctgcaggctttacaggaagcatggtactggcatctgcttggtttctggggaggcctccggaagcttatagtcatgacagaaggtgaagggggagcaggcacatcaca

SEQ ID NO: 107591 - DNA, 1066 bp, Homo sapiens
ggaaataaccccagccttcctcataccactggatttccacatcaccttttaacttatgcttgagctcccttttgagaaaaaatatttaaaaacaaattggctatgtaacaaatttgtgtgtgtgtgtgtatatatatatgtatatgcttatatatatatatatatgtatatgcttgagaaagtggtttttcaagatgtatgtgtacagtacacacatggacacgcttcagtcctctgacttcccatgtgctacctcatgtgtttctcttctcatgaggatttgcaatggatagttgtacaacctggggactgtcagtgactcattggtatcagcatatgctaaagaagctcttgaatccaatcttgaaacctgatctcccttcgtcaacattccccaataccaaactggcccgtttacccatacaaatgcacagtaaagggaagaacagcggtatttttcctagccaactgactctatcatttgtttaatgtttgctggtttttttctggttttgttttgttttagagcaggggtgggagtggctgtaacttcacaatcctaatacagtaaatgttttgcatcttccatgttttatgcaaaaacagacatttaaatcaataaataattgtgccctagactgaaggttaatgtttaggagaggaaaaaaattgttggaattttttctacatttttttgtgaagaatcttttttggaaaggaaggatacatatttttgttgtgtaatattttctatttttgaatgcattttattggtacaagactgtttttttggtgaagacattatttaaaaaaaaaaaaagaaaaaaactaatcgaaaagtttgcccttaaggatatgctgcagttttgaggttaaaaaaaaattactgattcaagatgcgtgttaaaagttgggattatattgttgttttttgtaattgttacaagaagaagtttgtacccactgctgtttattttgtttcagatgagtaagtaaagggattgttcttgttttattctttttttagagaaaaaaagctatttatgaaatgtcaaaaacactggac

SEQ ID NO: 107592 - DNA, 1055 bp, Homo sapiens
tatgagcctcctgtctttccaagctgacacctgtcaggagcatcaatagccctaacagtaactaatgcatcaaaataatagacagaaacactatagtatatattcgtgaggataggaagatttttttttcttcttttctccaggaaaagcttgctttgctcccctctccctctgcaacacacacacatacaatgcatttcagaaagtctgcatcttattttacagatatgtagctctagaatttacaaatatagcttaggaaatgttctgagattgaggctggtagcaaacaagtttattttctgcactggacttcaggataagtgtgcatagatgcaattccttcaaagaaagtgaaacatggtagagcaaagggataatactttcacacattcaaacagttgtttgctatctataaaccttgatttaagcataattattactttttagaaatctgaaactggaggaatgtgtattttagtaaggtttttttgttgatttatttgtttccctttctttcttctcaagatagtaaaggatttttatttcttaatttgttactgtccatggacagtcaaataactgctcacccttactgtattattttccccttagaaagaaaagccttccatcctaccatgaaggaatttttcctccaaaaaatcttatcttccatttcaaatagcactcatgagcttttaagagagaaattctctctttactttgaggatagaacagttaaaacaaaaacctgttccttgagaaagaaaccgtatttacctaaactaacaggtctggggccaaagaatagatttttttattgattgcagatgaagaccatgcattttgtactacaaatccttattgcctcctcaaatcctttttggaataaggctgggaataaattagtttaattaaattctttgggtatttctaattaatatctactgcaagatacccaggaaagaaaaggaaggggtgctgccgaaatgccaaaatcaattgatctgttgatttttatcattgtagttgttgcttttctagccatttcaaga

SEQ ID NO: 107593 - DNA, 1034 bp, Homo sapiens
aacagtactagtgactttgtgaaagaatatgagttactatttaggtatgcttacttaactacaatacactacattgcagtatttctgaaacctaggacatacacattatatataacaactctatattgaaatatatattacattatattcattttaacttttgaatctgcctatgatcatgagttgattgaaatattatgtctttgcttatatcacccatcaccaacctgctgcagttaatctggtgcatctagtaataatcattagtgctctaatttgctttttatattatcagcttcagtattgtctttagaggattttagaattttttaaagctcagacttagcaaatgtaggaaagtgaaaactttttttgaaacttttttgttggtgtgactaatacaaagaggttcatattcaaagtgatcttgtttagctgacccactcaatatctgaagaacaaaagaggtgcatatgaatgtatctgtgattttcccctgtaggactgtcactgtctatatttgcttttaaaaatatgaccaaggggctacttaagtgccacatgatctgaccaacaataacaggctgcgtttcaaagggccagtcttctgaaaagcgtaagacagtgaattacctagttgtccccactgtattctcaaacattcattttaatactggatctttacactttcttttttcaatacgcttagaattattttaactagtcttcaacctttccctggaggcagcttggcaatatagtgttcattttcctgggagttgttttttttttttttttttttttttttttccaaaaaaagtaaaaccagagtttcaggaactctttatccacagaggctaatagaaatagaatttggaaatatctatctgagacatttttaaatctgaggaatccgtaaaatggtggctcttgggtatccagccctcaggatctccatttacctgttaaagtgaggatttggtgcctttcttctttagttgggccatcaagaaaacttcagaaatcaggcattc

SEQ ID NO: 107594 - DNA, 2073 bp, Homo sapiens
ttaaacctttacaagaaaaaaggctgtggtgactcagtgttcctataaattcagaatgtggaaactactaatccaaagcatcatttctagcactgagtatcaagacgatcagcctgaccaaaatattgcaaagagttttctaagtctctgaagatttttttctccttgaacactgagtctatagcagtcagcaatgtaccttagccgatccctgggaatggttatggaacagtagggcttgtttccatcctttttagagtgaagagatagaaaattagggctacctagtgtgggttctttttcagaactatgtattttctcctcactgcatgatgggtaaaaatgccctgggttgaaacaagaaacattatctttccacaccactgactaaaacacctgccagtggtttctttaggctccaccttttgctccgtaaactgtagactttcagactgaaatctaatcttaagtgacctcaattaaggtattttcacaaaaggctacttatagtgtagcattattgccttaaatcagaaagccctgggaagaggataaaagatatagaaatgagaaggctctgaagttataggcatttcttgctgtttaatagttacattatcacaaaaacaagccctattcatgattgaggactatggaaatagtgacttcttgaggaggcaccaaactttcctagaactgggtactctcagatagtggctgctatttcctattctatttcagtgacgtaggttggggctgaatgtaaaatagacatcatattactaaatagaatcctataaaatgcaatcacaggtgcccgggagtactagttttaaacatttccttaacaaggagaacaatccagcaaaaagctttctttctctatacagtgtatatctctaaactttttttcctcagttttagagaacatctgttttatctggtggttctttgtttgaatgcaaactcataactttcaagtctccggtgcaagagcataatctacagatcatgggcaaaatctagccacagtcctgagagtccaggcttctgggatgcccagctgggtataaaagtccctactaaccctgtttcaaattcagaggtttctttggtttagaatgcctcaatgagattttgatacatccaagagagaaaaaaaaaaaaaaaaaaaaaaaaaccttgggggcatctgtttctactagtgttgcaacagttgtttttacccagcaaactcattgcaatttatatgtagattctaataatgaaagagtcttaacccatccagtatgtcaccgctgctgtccaaaatgtctataaatgagtatacattatttatacatgtgcacacacagtgtgagcttccctcagcacaaaactgtttcacattcatattgcccagtgacaacaagatacatttttgaacttctggttagaagtcgaaggtctgacatatctcacgtatctgcttatgctttgttgccttagttgggtgcatcagtatctgtgatgagactttagggcattctgaaggagcccaaccatcagtaatttctatgtatccgtttcatgagaaacttgaatatgcttatgtggagtagagtgcatttaacaaactctacagttctattggatttattgacatgtgtgcacatgtgtgtgtttgtgtatatacttattgtcatctggaagtgtgtgtgccccccaaaggaagcacacacaggcagaggtcctcgtgcatagatacagttgcctcttcccaccattgtgtttaagacttgtggctcccttcccaggaagcagtcacctgcccactctgttgctttttgtaatgtttcagaattgggagaaacaaatgcagcttgttgaatccacagcaaacccacagggacaggctgttttcctccataataaggtataacagaagtcttcaactggtgagcagacaagagggagcagcagtccagggcgtctccccaggtctcctggaggtggcaggggtggggaccaatgccaggcaggcaaagcccacacaaactttggcctgagccatcccatagctcaaaggtcttc

SEQ ID NO: 107595 - DNA, 1050 bp, Homo sapiens
atttagatatggtttataaaaaaataatattttctaccactaaaaacactggtattatctcagcatcatgggcaatttttccttattacatgccaatatttgtacaaaaaaggcccccaaatgtgtgaaatataatcctaaaaaagaaaataattggaacacatggatctgttacaattctacacagggggaaacaagctaagcaaagaaaaaaaatctgaaatgaaaatctctgtatcaaaatggtttcctgtatcttttaattgagaggtaaactttagctcctaataacagttttatagaccgttctcttcccaaattcctaatgctttgaatctatttgtgccatgattaagtgtgctggataatttcctgctcatattctagcctcagttcattcctagtcatcttagagatcatagtagctcttggccttagaaagacttgggtttgctgtgtttaaaagtcataagggttttattttgtatcatcaaaatattctataaggtcccaaatactctttttcaacccatgaacagtaagaatttgtgaattctgataatgaaaaaagttttcctccaggtatgtttgtttcacattcagtcctaaagccttgagctatgtgtacttccctcacacaggaacaccagctgtcctgtctgtgctctgcctgcgcccaaaactcaatattttctctcagcacagaagtcaaaaatgagatatgccccttataaaaccccttcgattcctgagaaaacataataaagccatatgttgcttccttgttggggctcctccacaatgctcccaacacctgtgacccctaggaagacagggagcaaggtggatctggccaggagtcacaggatatacacccattctggagctttcctctgttgttctagaagatgttatttgattagttggggctgggagcaggggatatatgattttgtggaaaaggtatcagataatcaaatcaggtctgcctctgctatagccagtgtgctgctgcattaaaagggaacaaaaggaaggtgcaacgtaaga

SEQ ID NO: 107596 - DNA, 1013 bp, Homo sapiens
taaacttgggtggttaactgactattaagtgtaacctattgtgatttctaagaggagtcctgccaagaactgtatgtccaaaactgatctgttttaacagttagtgaggaacagcttccgagataaagtaagttcatttttctattgctaattttgctttttaaaatagcagtgttgtaagactaatatttccacttaccaccaatagagggagcattaattaactatgtcatggaattgttttgatattttggaaaacaagtgattccacccataaaatgaaaagagaagattgaccttaagaaaaaaactcttaaagctaggagacaatgacatgaaatcactcaatacatgttacaaatgaaagaaggccaaaagccactttaaaatattttaaactgtttcacagtagatttgaaagtgtctttgttcaaatttagcaaagtaggaagaattttcactaataccgcctgaaaagttgatcttaggtgccattatgggccacgtgtagctttctgtttctcaaatctgagagagacccatttgccttaatgctgatttgccatgtaaaatgctaagcaattgggttagaatccaccttttcttttggtagaacatgtagagaaaaagctgcaggtgacttgaaaccctgaggagtctatcatcctttccctgtaaaggaagtgtctcttaaaaaaaagggagtgggggaggaggtggaggatccctaaagaattcttaatgaggtgatataatcattgtagtccatgacaaaatggaccagccaggtttgcatagcagtagacatattcctactgtacatttatccttcccaaatatgtcacattctaaaatagttgacaaattattttgtggaaagaggaagaagctggattggagtgggagatctaatctggaggagcaaagaggtagttgtttattgctatgttcctggcccatcaaatggccactttccaaactgacccacattttaggaaataaaccaatctgga

SEQ ID NO: 107597 - DNA, 1136 bp, Homo sapiens
ggtcattcactgacaaggccaggactagagtcctcaggggttgcagtccaccacggactcaggaccactaaatccacaaaggaccatgtgcaactgcctggtccaactcttcacatacagaaaatgaaataaacccagagaaatgaaaacacttaaaaagcccagggtcacatggataattaatggtagaaccaatactacatgcacacaaacaacatacctatatatgctatagagagaaacatgacaactatgaggaatcaatttatagacagattagaagagtgtgaaaataaagtcttcatcagtgaccttgcctcgaggaaaaacacacagaaggtgaaagtttcaaacagcagagcattttaacataggtgaagtttcaacttcttagcagccaaaataccatctggaatttaaggcacgcttcccataaaaggtgacaggtggacatgttttaaatgatagttggccagcctatcatagcctctataaatcgtctgaaagcatgaggatagcaaagaccagctgacttccaggcatgtttacagctgacagaaatgtttcagctaaaaacatgcatgactgtctctcttagggaatctcttacttcaaaaaaaaaaaaggtaccaatgtaaacactatgcatagactgaagtcttcagcaaattgagattattagcaatgaggcttccctaacctttcctgttttaatctaaaagtaaaattatcttctaaccatgtgatcttacgcagcatactgtctggtcagtgtgcttcaaaacatatctgtttatgtttgaaaacacaataacaacaaattcctgatgagagaaagtttaataaaatggatcatgaacatacagcacttaataccaaccctgctacatagtcagcacttaataccaaccttgcttcatagtaagcactcaatacatggtgattgttttcattgctgctattaccataatacatcaaagctctcctatttcataatgggaaaaaatgaaaaacagtcaaggcatatattttaagtggaagttagctcaaattttaaaagacttcttaccttgatgcatagtccaaatgttgaaatattatcctaaggagtttcagaggctttcagttttagtttg

SEQ ID NO: 107598 - DNA, 1031 bp, Homo sapiens
cacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaa

SEQ ID NO: 107599 - DNA, 1022 bp, Homo sapiens
agagaacttgtcttatataagtaaaaacgatggaatctgtagcctaatacaatattttaggcacataacagacctgatagagtcagaacgagaaagaatgctcttatacaaattagtgcaaattgtattattgaacatttattaagttaagctcataccatgtgagggtgattgagtgaagcaaggtagaaacgctcattgaactcagagtttcctgaacaagtcttctatcgcaaggtagagcggaaagagtttgaggaggtaggccttcttcctatctgcaggctgttacctctcaggtggcttctcacaagacagagagatttgggtccaggccaacaatcagtgcttgggccatttggttttgaaagcccacttatttcactttcccaagctgattgttcagttgtaaaggcaagaatggggaatctgattgaagaattatttggagggggattctctagagccatctgagagatgagctagaaaaatagaaaagccctaagatctactgctgtagccacctgttttctttctcattctgaatccaaatcttatcaatagtatcccttgccataacagcctacgttatagggtggcgctgggtcaggctatccgcagcctccacatagctgttgccttcctcctgggagctgtttaatacttccctgtggcaagtacataaagcaccctattacccaaggagatcatatatcccacttctggcttactcctgctatcctggcctaattattaacaatgctctctttcactcttgaaagtgccctgtttgcataataaatatgatcaccaatgtactgtagtctcctgggtcagaactgccatctctgacctttttaacattcctccttcattaagcctcagaaaattcagaaaaccttccatatcacatgcaaccaccctagaaagtgctcaaacaggttgtcagagatgacaagaagaatgagtagatacagaaagcagccatggagtgcccctttagctagcagattgctttctgt

SEQ ID NO: 107600 - DNA, 1114 bp, Homo sapiens
tacaaaaacctggccattcattcctacaggtggaggaaaggggagataccttctcattaagaaagttttctaattcagtgagaacaagccaaaaatgaatgtcttagtttattacctcaccaaccagtggaaaccaagaaaagtgaactctagtaatcacagaaggcttcacagaaaaggaaaaagtttgaataaggttcatggggatgataagaattggtgaggagagaaaccacaataacttcagaactgcggaaaattcagcagaagagaagtaaaaatgaatgtaatccacacacaggaaagcaaaatggccaaccttttggattagcacagagattttattttagagaaaatcaaatccaaccaaatcagtgaagtgaaatcagataatttgaatgttagctatagctataggagacttctatagctcaatgtcttttttgacaatatgtaaataatataataaatattatacaaaagactatataaagaatatcataaagataaaatgcctacttgtgattaaaataattataaagtatgccttctactttacttatttaccagaacctcccaaggttttgagttctatctgacagcacttattcttcatctcagtatgagccaaaaaggaacttaggtcctattcttttttttaatgatttcccgtgcctggttctataccctaggtgcgcagatgaatttcagctactctcttaacctagcccacacaaatcatctcagtgcttccattttaaccagtcatccaacaaaacagatttacttttttccttggcttttccctgttgctttgggatagaaggtctttactcctcagtgaacttatctatcatggctcaagtccatagagaaattggccgggcacagtggctcacgcctgtaatcccagcactttgggaggccaaggtgggcagatcacaaggtaaggagttcgagaccagcctgaccaacttagtgaaaaccgtctctactaaaaataccaaaaaaaaaaaaaaattagccgagtttggtagcacgcttgtaatcccagctactcaggaggctgaggcaggagaatcacttgaacccaggaggcagaggttgcagtgag

SEQ ID NO: 107601 - DNA, 1020 bp, Homo sapiens
atatacatgtgatagacgcgaccagaacttttacttgcatatttcttccattttgttttcccccaaataaggctcccattgaaagaagtgattttcctccctgtggccgtcctccctacttctgctgtagatccacctattctgatgtctttcttttgttggaagctgatatccatggtgacttaccttcccatgttttataccggcctcatcagactgtctcattttttgtgtctttgccaagatgcacttacgcatgaacagtttttatttatttttcattgaacctttacacatttccaaactgttgtgtgggtgggtttaactttagctccgtaggtagcatcattctgctggggctggacactcacagaggccaatgggctcttccttttccaactcttgccatccaccttccttggcctccccctcccaaccatttgcttcacccgcccaagtctgtgtgattaaaatttttagtacacttggctcattttgaacttttaagcaattttttagagaacaaaacagaagatttttatggcaaactccattaatgccacattaaggctgacattttaattaccccaaagtcaggaaatgcaaagttcaggttcccacagcaacagaaactgtccccttgagtgctggcatcacagcagattctttcattccctgattacacaacactgggtgtggggacattgtttttatccacgtatgtggaaaggagcacagcttttatcctttgatttttttcctgtaactacagttgaggatatgggtctttagcttccctcccaaaaccatctatacgtattatcctggaacggaagactattatagctctacatgtgcacacggacagaattaaagttgctgtgggaacattaactctgatttccggacttccgtgccagtcacatttaaaccataatgttgtaatttttggcatgtaataaatgtgcatttcatgtacacagacagaaagaagcataaaatgtattttaaagagcaatt

SEQ ID NO: 107602 - DNA, 1047 bp, Homo sapiens
gagagccagttagtaaacaatcagctagataaaaagcagtaggtgattgcagtgaaattggaatggaaacacagatgtgagaaaaaatatgaaggaagcagaactgtaagaacttactgatgaattggctttaaggcagaggaaggtgtatagtgaccctgaggtttccaacctggtggtagacaacagtgatagagatatggaccttagagaaagcattggttttaataaaggagttgggctttagcaactttgatcttggctacatctttaaactgaaaatcagaataccagctccttcagggtccatgtagacactcaagatttgggggttactcccatagtcaccattcaaaaatcaattgataaggtcttataatttgttgcttctcttgtattggcttcctccatactgaaaaagatgtctgaaagcctcacctctattctaatctttgccatgccatctctgcctcctgccctctgaagaaacagattttatttcacaacctgttggactgaaaacacagcatactaatcataacaccatattctgcgagggcagatttaactacccagcacaacaaatttaaatacaaaatattctgcataacaagtacattaccatgctcacagaaacaagggaaacatggaaacaaatctacttacaacaaattctgtaccacacatagtcttctacaaataaaataaatgctttttctggtcatgtccacataatgatagaaaaagacacaaatccaagggaattggagaaatgttcaggaactattactaataaaccagtttggctgtggtctagggtctgtgtagtataagctaagtatttgttaatttcatatcagttgcattgtcctggggagaggagacctgagctgactgatagctgtgctgttttacttcctattcctgaccccatataacaattagtaacaattactttctaattcccttcacccttctcttcctcatgtcccaaacacacaatcacaccctaaactccaggacgatgcaccaaatcaaaaatcttag

SEQ ID NO: 107603 - DNA, 1049 bp, Homo sapiens
ccagtgtttctacttggcatgtagggtttttttttttaatctgctcagcaatttggaagtttgcttggaacacagatgagttaagataaaaagctgttttttaaaaaaaaatgcctctagtaagtaaaaatgaagatactatatctgaatgaatgtgaaaagttgtccctttgtatatttttaaagcttcctaaactatccccagttctcagccaaatgcagcctacccagattgtctttaggaaagtagcaattcacagagatttgcagttagccatgtatcaaactacactctctttagtccctgcttacagctccaccattttagaatatggtgagatatgccagagccctaccatctgtttaatgggctaattatgtttaccacatgcctacttcacaggaataccatgagtgaggttgccaaacatcatacaaatatatatgtttgtatatattgatatataaatatacacataaataaaattgtatacatatataaaagcattcagcatttctgagtttcattccatcttttactctcaagatatatcatggcccatcccttaaacccagccaggtgttgtcagagtttgtgaagctgttgatgataagaccgtcagactgagagggatcctctaactgagagatttggaggaagtgaaactcaaattgtatacacattcctatgtcttcgccatttagctatgccccatgttctctctactaaaatgtagacattttagcttcataattaatgcaattaaactttatgacactgtatgttgctatatccaatgactaaacttcttttaagaaacagaggatctcttctcctttattggaaaaaaaaagtcagactgttttaacacaattcctcccgtacatggctacaacttttctcttacataccacagcttctatattgggcttgttcttaaagctaggattttttttttcctcctatgaggacactgcaacccttgaaagtttttctctggtattctctgagtgcttcctagatacctggtttcagtgactccagttat

SEQ ID NO: 107604 - DNA, 1096 bp, Homo sapiens
atcaagaatggatttctggacaaccctgtttaaaataagaagccttgcaataaaagtgcataaatgtttcactctgtgttacacaataatacctcaaaatccactttctggtagttcagatctctgagttacaaccctgagcaaagaagtaactgaagaccttcaagtgtccaaatgagtttcccccaaatcttctaccaaaccctgcattcaagcagtattgtctctacagttcttatttatttgattttctaatccaaagcacattagaaaatacatttagcagagaggatttagaggcgatgggtctgaaaaactgggacagtgacgccagttggctatggcagtggctagtgggctatagctcagtctgtggccgttaggctgagccaagggatgaggccagttctcaccacaagtaagaaaagtgtattcctgtaaaacaggaacaatgaatagtcacaaggatgaccctgtatcatagaaaaaaattaaattacatcaacatactgtgtttaagaaaacaaagatatgtaaaagttttctatgaaaaacatgtgtagaatatattttactgcttaaaaaggcaagtttatgtcattaaaaaacattttaaaatatatggaacattttattcctcaatatagcttgcttttttatatcctttttcagtttgaaaaaatatagggattgttttgtagtagtgactctacaaacctgtctagccaaaactactcagtacaaacaccttagaaggagtacaaacaccttagaaggaaggatgtttattcttgaatattttaagtccaggtctcttaaaataaagatgttctttttcattgatcttagttatataatgtatgttgtcatctcgagtaaggcgcagttgctcatatttagctggtttactttgtaatgcgtcattataagtgaccaaaaacatggtacaggaagttgtttgtgtgttttttcattgcttatgcaacttccaagcagaaaatgttcttgagaccagatggtaaagaacagtcaattgcaagttctattctccagatgtattgatgtttcatgtcttcctgaagccagttcaaacaca

SEQ ID NO: 107605 - DNA, 1108 bp, Homo sapiens
tcccagctacattttttatgagtcaaagccatgttttaagagcttgttatcatccaaactaaaaccctcactaactcgatgtgtccctggatgactccctagtttatttcttcccttccctccactaagtcagttgtctccctatgcaccccaggagtagccattttccacagcggccaccacctctcctccagaaaatgggcggctcaaaatggagcccttcctctcctccggacctcaaatctgccacctgtctgctccattcatcattagttagctatagagcctgatttttctccaaactgtatgtatttaatccctgatttcttcctcacccccacgatgtgacatcctttcagcattttacctgctggaaccagcgctctcttgtttcttttactgtggtcacttgctagagtttgaaggaaaactttttgatgtgaacacatttcagtttttttccaatttacactggagagaggaatgaaggggagagggggctctggccctgttacttcctgtttgtttttgttctggagaatgcagaccatctgtgtctctcagaagctattcttctacagccaccgtgctgaggctgatatttaatttcttagtttttccctcgtttctctctaatgtccttttcctcttccaaaaactcctaagcccctcattaaatctttcttcctgaattttcttatcttaatagtacctctggatacggttctgtccccattaaggccagaatttcaaattaagtaaatgataattggagagagaaaacaggagagaagggaacaaggaatcagtaagcaaacagaaaaaaaaaaagtgggttgactttttaaacatggagttcgctgattctcagagccacttcccatgtcctggcatccattgttcagctgatgtctcacctgttagatggaccttgtctttctcagaagaaacatctgctggatgttgggtctctctctgagttgcctgagaaggtccctccctaatttatttttcctgccacccagacttcgataaaggctatactttctcatgataatcaagatggttattttctagaactagtagagatattctccctcttctgaga

SEQ ID NO: 107606 - DNA, 1059 bp, Homo sapiens
acatgatttgatgacaagaagctactgcacacacagtttagatatcaaggcaaatgaagagcaagacttcatatcgctttaacaggttaaattagtcatcttaagctgttaatacatcaggctactgggcagaaaacagcagcagtgtggtagcagagcttcagaagtagataatcctaaattcaaatcccaaatctgccatttaccagctgtgtgacctttgttaatttacttttcgtctctgaacttccctgatccttacttctctcatctgtaatatggagatgataatagttgctgcagagaaggagtggcataatacagcttaggtaatgtgacatatgtgactgcaggttcaagaatttgtgcaccttctggccccagcaggcttaatatcagcactatagttagtccctactttcttacaagcatgtgattataagaaaagcccctctggttcaggcttatggtcctttcagttcagcattcattttctgatcacagggacaggaaactgttatataagacacaattgtccttgttgctaacttaaagaattagagttattttcctccagatagcctagtttctctgaataacccactatggacttatccatgaatttagctaaacctttgtgatactatttatgtcatcgacctttaatgaattttataagttgattgcctactgtgtaaagtagttctttagtttgtcataaattgtttcttttgaaaagtagtaagatgacttccagttcacgtatactagaatttgaaaaagaaatccatagtcagtttcccagaccttttgtttctttatagacatttaccatatccttgcctggattttatcattataaatagaaatcttcatcttatgtcatgattattttaattaatactgaacgttctcctattctttttatttatttattttttgaagtacttcatccagaaagtatcccacccatgagttgccgttaccttttactagagctgatcgtaatttaactctccccttcctctatcaaaattacactctatgctctgggctcaa

SEQ ID NO: 107607 - DNA, 1052 bp, Homo sapiens
aaggaaccctgcaggatcgtctcagtcagtattcaaattttgtgtattgggaaaaggagacctagaagacagatgtggtcgaagtaagcagagacaacgtgtagaagaaataggacttcaagtgccccttcacctctgctatgctgcctcagtgggggacttgtccagtcatctcttgcaaatgtcatgatttaagcaaagaacagctaaatttgtagagggccaggctgacacaaactggcttttgtaaatccattgccaagagtaagggagaaggcgatattaaaatctctatcactgcttcagctgtaaacagggtggtcagctgaagaattaatggtttttcaaatttcagagcgacaccttgttgcctactaagtatcagaatcacgtgcataagagggcattcagatacacagctacacaattatgtaatggttttcaacttggtccttaatatggagggaaaattctagggatgtctgccaaattaaaataattaaaattgaacctagacttaattgatttaaaaaaagaaagaaagaaagaaactgaagaatccttcactctgtcctaaactgagaggccggtttgctttacaccttgaccagctttcttcagaatgacagtaaaaggacttggtcaatgccatggtacaaaagatgtgccatgccttgcttactagatatttttaaattgcttcttttctttaggaagacctcctaagtttcacctaagtaaagaccgtaaacttgagcccatgcaaactacaactgtaagatcgtgcaggggatggaggttctgtgcaattgtgacacgttaaacggggctcccctgcataatgtgatccctgtctttaggaatagcgctttgctcccatgttaatacattctggaaattgctcaagaggcagctttggcattagaatagcaactttcaaagcagtgaacgtcagcacttctatttctccttctttttggcgtgcattacatgaagctggaaggactaattggctaaatgaagggactcagtgtcgcagagttgaaatcctg

SEQ ID NO: 107608 - DNA, 1088 bp, Homo sapiens
aataacttgagacatgtaagggtagagatataacattaaatgtatgggtttagcaagcagagcaacatacaaagtggactctgagtatgtatggatcttgccagtccttcaaggtttcagtggatagcaagaaaacgaaaaagaggtagatcacatgaacatggcagaagagagactgacagcagggtgtgctcaagtcagaaggaatgttacattttaatcagccagaagttccatttatttgagaataagctggtatttgtgaggggaacaaggtcacatttagtagaactgataattcaataaaggattttgactttgccagagtaatggtgttggcatcaagagaagaaagttttgcagatttctgtgtgtgcacttgctgttactggtgttcctggtgggtggctgaatcatcctgatggcattcaacaggaaccagctgctgagaatattaaaatgcaagcatttattcctctagagagacagtagcatctgcaaagttttcctatcttgatagtacagataatcccagggagcattctctagtagttttcactctctattcatttatacattttctttttatcattagcattaatatctcaagttctaaatgaagagaagagtgcctgagtcctgagtccacaacaggctgtagagatggatagttaacacttggccaagaacttggtattgcctcttgggctttaccttgaattgttatctaaaagggggaaactgacatttccctcccttggcctgtcttcaaagcaaagagtcatccatactcctagtcttcagcgagctccatcagtgtaaatcctgcccccaacaacccccaccaaacacgagctttggagcttttcactttacttataaaatttgtaaatttgttgctttccttgtgtgtttgtattttatttgtttgtttggtttattttgttttgttggtggttttttttgttttggttttggtttggattttttgagctaccatcaacagttaggggaaagggagttacaaaaaggaggtttggactctgtaatcttccaggtctttccatctctaatatttatgaataatg

SEQ ID NO: 107609 - DNA, 1053 bp, Homo sapiens
gaagtggaagaaaccagaccctcagggtttctatttctatgccagtaacctcacctcggatgtggcagggacaaatatgtgtgatgaggataaggcattctgaggaatgaaggaaaatgcacccaaatgcattgtactccctagagactctggagttaacactgctgcccagacctccatagccttgtatctcacattttttctccctctatcgccaccaaaaaataaataacaagaaaagttttgagaaattgtagtcagaagatcttttggaaagaagtatttctttgtagaaatattcctgtacagattggtatattttactatcttatcaaagtatgagttctaatgagacattgatgattcaacaggtttataacattacaaactggaacaatccttgtttcctaagcacacaccacattttcccatccatgttccttttctcctagtattcccaaatagaaacacattctgcctcctttatttctacaacactttgtatcttttaatgagccttgccatatttcattttatatgcaagctatttatgtatttatttgtaatgtaaagaacaggtctacataattttaggcaatgtacttaattttactgggcctcacgttccacgtctgtaaagagaaaaacgatatctgccttcctaggatactataagaattccatgaaatgtagtatataaagtgcttagcagaatgactagctcaaggttatcactcatcattgttgttattgttattgctactattacttattaatattcccctgcctctgattctttcccatttatatacttctcgaggtcatagattgacctaattcattgtcttctcatgcaatgaacacaatgatttttgtgtaacaggaacctaataaaaatatattgaatctttttataaaagtccatattggacctattatttccctacaaagatccttaaatcctgtcctggaagtttaaaatagtggtggttatggccagtgcctgacccacatacattgtaaaatgcagtggtgttgcttgctgtggactgt

SEQ ID NO: 107610 - DNA, 1008 bp, Homo sapiens
aagtagtgtgttagtaaggtgcctttgtggaagccaaaatattttcagcaataactgaaaatagatttccagtatctgttttaatgggggaagagctacttgtttatttctttttaaattaattgaaatgaataattgccacagaatttttgtcagtgttacattgttttcagtaccaatagaataagtttgatcatgtctcttcctggtaccaagtggagaaatatatgtacactgtatgtaataaattatcttccttagtggaatgtcttctcacagattggagatattactgaatatctcttgttaaatcttgataagatcatttggccaaagtagaactggtcttggctttagtaccaaaagaaatagcatttttaaaagacttggatttcctttgcataccacgtgtctgagtttgatacagtccaggaaaatagagaggatgagatgaaattattcctaagcagccgccgtaggccaaacactgaaacagtgccaacctggaccaatcaggccggcttctcagaagatacatgcttttgtcaaacacttacatgaagaaagagagagaggaagttcgtgaaactgtatttgtatgaatattcttcactgatttcaataaagtccagggtaataaattcgatgatttttattcttttgtaaagcagaaaatctgagtttttctgggcagctaaggttctctaaatgttgtactgtgacatcttttaaacaaaactatcctttcgaatttaagcagtgcaaaacttctcacaaagagcaaagagtaaaattgatggaaactcagaatcaattccaaacccatttctggcatgatgagaataacatttgtgctgtgtttaaagtagtttaaaacaagaaaatgataaaatgatcaatatacttaaagccaaaaataaccaggagagaacaatctgtaatccattctcagtctgaaaccccacactacttatttattgaacatgaaaataaacaactatatatttt

SEQ ID NO: 107611 - DNA, 1062 bp, Homo sapiens
tgatttgtatgatctttcgcagaggcaccttctgtgagtctactcagttttccagaagggaaaaaggcgagagctgagtttagacctggacacctttctaaatatcatagagcaaaagtaaattgccccattaaggcttgcacattacacttagggtaagtactgttcaactttccttttttataggagttgcctgccttaacttttcagcttaatacgagcagcgtaaattaagaaaaaaaattaactcaatcagttatttcactgaaatagaaaatttgcagattttaaagggtatctattgtgcataaatttggggatacgagaatttgccagtgaaatgatagcagctctgtgcttacagagcaaagatgtgctagtctgaacatgcctgatctcatctggaatcgaaagctaaatctaggtgggcctgtaataataccagaaaaggaacacatgtatcttttgtgcaacctttttttttttttttttttaaagctaggcttccaaagggaatgacaaagaagcaggttctcctcttgcttaataagtagtcatagtttgcctctggagatatgtatttccagttgttttagttgttttgttttgttttgttttgttgttgtcatcgctatcgaagaatattctttcctgtcagtgattattaacactttccgtttttcagaatgctttaactctgtttgatgtttcctcacttggttacctttctcaagtctgcgatgaccctctcaggctttgccattcttatcgattcttaccagaatgtacttactcattagctgttttgttatagttatggtggagataatcttgtttttcaggcttttataactaaccaaacaaattaccttttgaggtgaaatttctcatagttatccttgacacagaactgaacttgtcttgaaaaggcttgaagaaaatccaattagccgttttttgagaactgaatattctaataaatgcaaatggattattttacaaaatacttattgatgtgcaatgcttttctaatctgtttttcttttcgtgctttaaaacaga

SEQ ID NO: 107612 - DNA, 1042 bp, Homo sapiens
gatctcacaagtttttgcatccatctgtttaaaaggtaccacttgtgtcacttgtcagttattaagaaaaggtagtaagggagcagatatttgtattttatttttgtttctaattatgtaaatgacaaaacccccagagagatttcttgccccttctatgatacactagttcatgcaaaatatagtctagatggagattttgtcaacgattctgattgccacgtagctttgtgttctccatttcaatttttgcctatgcatgtatatttttaccatgaatttgtgttgtagcaaacatttcagaatgcttatcattttcaaattaatgctccaacaaaagcaaaaagaaatcagatgtgagctgtatgtgtaaaatgtagtaaacaattttatcttttatatatgctgtacatttatatctttatgctaatatcctggatttgtaaacccaagataatgttttctttcttaaagttctcctcttaatgcatttatatgttgattgtcacttagaaatctttttaaggtacattatagacacgaaactaaacaaggggaacaattctcaagctctacaaaaatccttaaatatatattatgtaccattcctaactacagataactgttttgctaagtagaaaacagctacaacagttgtttcaagaatcagaaactcttttctttttttttctattaactgaaaataaaatctattcatatccctggggagggaaaatgtaggggaaaatatagatatatacattttccataattatagaatgcatttatgtaactgcttcttaagggtgtaatacatatcagggcagagtgtgatgctcatcaaaaaaccctcctggctgggaggtgtgagtgccttatgtttgaagtaacttgataacaaggagtcttttcgggaaaccttactatgtatgtgttgcctcagtaatgatcctcagataaaaaacaagtactaggtggccagtgttagcacttgaactcactgaaagatattagaagtaggggaacttttggcaaatccaga

SEQ ID NO: 107613 - DNA, 1064 bp, Homo sapiens
ctagttatttaccatctctaagcctctgttttctcacacgcaaaatgggagtagtgtaaaaattaaatatgatatatagataggatgaagaatattaagagttcaatgcatggagttattattgttaatattatttattatctttactcccctcaacaacttcaattgggattctcccctgattctaccttggagaacctttcttgagtgttgtatgctggtcaggactagtttcctggatgtgaccttttcagcattttatacacaaaataatgtcagacactacatattttctgaacaaagacttaggacataattttataaatacatgcatatttatggggataataaaagacaagatttgaaaccaggtctgctccaggagatcagagacttaatctcctatatctaaccttaggatgtgaattctatacactggacaaagatgaattttagagtcgtaaggtaatactgataattaagaatatgatagctctgataaccaattgtattaagaaaggatggtcaattacacaaagaaaagatgttagtatttcaggaaggagtttttttcttctaaaggagaaagcagagccgttggagtcatatctgggtttgcatgcaaattctaccacttaaaatccatggacaaaaagacactaactaaatcaccttggtaaaagcattaaatttatttgagtttcaatttccttatcagtaacagattaatgacacccaacttgtagacttattatgaagattagaaataatgcataaaattctggtatattgttaggtctaaataaatatatttcctggaaattgagagccaggtttctcttcaagatgaaaaaggagctgaaattatgcctgtcttccacatataaccaagatctatatttaaaagcaaataaaaaactaactactataaaacatggaaataaacattttccacatttacatttttaaccctaatttttccactaagtatattcagataggcaggttaaatataaattaagtactttttcaacatcagtttctaaaacagaaactttcaaagg

SEQ ID NO: 107614 - DNA, 1083 bp, Homo sapiens
gaatgttattttatggtttccaagcttctcaattaaccatttggtccttattctataagattatttgcttctgtgtttctttaccctctgactgctatatctttagttctcatgccttcttttcgtagtttttatttttcttctttagctattaagttactttctgttgtgcaagtctctaagatcctcattccttctctgatgcattatttctaatcttctttagacaataaaacaaaaaaacatgttttgattgtgtgtaaagtacatacatgaactcattcacttgacaaatattgtgagtcgtgcacttgtatacttggcactggagaggatacacagataagacatgtcttgccctagaagttttaatctagcaacggagctgagacatgtgtctactttgctagaattaatagtgaaaagtgaaatgctctataaaagtagtacagataaggtattcttggagctcagaggagggctaactgagggcttcatcagaaaagatgacactggatttgggctttgaaaaacaagcaggatttgagcatacagagatagaaggaaagaacattactctatcatgagaaaagcatggaagaatcaaagggtaaagattctgcaaagaagtaattgagtttaacttgagcatggaatgtgtgaagataagtagtgggaaataaagcggtaaaagtatattgggaccagaaagtgaaaggacttgattattagggcaaggaatttggactttattcaggagacagtggggagctattgaaagtttttagtaggagagtaacataatcagagctgtgcctcaggaagattaatctggcaacagtgagtaaaatggattggagtagggagagaccagaggacacaagatcaggcaggagactattacaatagtccaggtgaaaggcaatgaaggcactaactagggcaggggcagagggaatgaacagagatggcaaactgatttatgaaatgtggcgggagaattaatccattatatttggggagcaagggagaggaagacaccaaacacatctctatgattttgaaccttagtagagtcataaa

SEQ ID NO: 107615 - DNA, 1036 bp, Homo sapiens
ccttgcatctggctttctcctgtaaaccttttgccaaatagaaaatagagaattaaaaactcccaaattcaagatgcatgaaatgtcattaaatctagtacaaatttttttgaatctgtcagataaaggaaatcatgtatccagagtaaagatggaatatcagttgacaggcacttaattttgagagacatataaatctaaaaatctaatagtgcctcatcctttgaaaacactggaaaccagaaaggtattaggaaaatcaataaggtaaaaatcatcatcctactatttggaatgactcccacataagaattaattaacgcaatacttctagaacgttaaagggatgttaaaacattatctctaccgatagaaaacaaacatataaacccatctaacttttagacagagtagttaaggaaaaaagattggaaatattaattaagattggaaataagaggtcatttctgtcctgttgtcacaccatttaccctcttcagctagaaggataagtgtcaaacttcagttcatccaaattcctcagctctgtcatcagtgcagtgacacattctaattttctgactcatttgtgatgaataatctctcccttttctattcacaatgctgaaagtaaccaattttggtgtgagttatgattacttattttccctttttttcaattgcactattattgttttctcttagcagaatttgtctcactctttatcacccagtgtgaatctcatgttcagaaaagcccatggacagtaatagtgcctaggcttggagttagtcaagaggaatgagagtctgacgacccagattctgtttttaacccagccagatacctcagctggcaagtggttcagcttcctcaccataaaatgggtataataatagctttcgcttaccactgtgaaatatttagaatgcaaatcaagccaaacctgtctgcttccaaagagaagcttaaactagcctgcgtaatcctgaatgagcccagattcaaggggaaacataaagtgggaaactccta

SEQ ID NO: 107616 - DNA, 1115 bp, Homo sapiens
gagaaagctccctctcaggacagctctcctggttctcttcaggctgataatggaactctggtatgatggaagggtatgaaagtctttttctaaatgctgtatgtcttgccttttttgtatatttgtgtaaagaaattcatagtagtaattctctgacactgagttaaaagaagtcttatttttaatctgtcttcacttatctagtcctcaaacttaggctaaaatctcaaatggactataaaagcactacaggatttagaacttaattagataatttagataagggacaagaaagaaagaaaaggagagtttaatgtttctaaattgatgtcatctaccaagagctggaacacaggaggaagaaggtttgacttgaaagggcaaggagtgcttttggtttgggacttgaatttaaggtggcacaaaatatttagattttcttaaaatgcccaggatactataggcaatacaggttttgaagctccgaagaaaggtctgggctaaagatcaagagtcgggagttatttgtgaggaagtagtaggtaaagccataagactagataagatgactcaaggaaaaattatgagagaaagaaaaactcagagcagaacactaggaaattctaatacttaaagaatagatgagaaagaggagccaaacaaaagaggagagaaaactagagatagagaatagggaaattaggccagtattattaaggaaaccagggatgaagtatttcagggaggggcagtgatgagaattaaaaaataaaactgaaaatgtccaataaacttgactcaaaagaggtcagccatgacactgagagtaaagtatcaaaagggcgatgatcattttgagacagtagttaatacctgtaatttcataggtggtaatgatgttaaaaaccctatgtaactaaaagcacttcttttaaattacctagttcttagatttctcaagttagctcttcacttgtccctccctttagtattattttaacttttcaaaatgtagtcacacattgctcaacaaagggaatacattctgagaaatgcatcattaggcaatttcatcgttgtgtgaacaatatagagtgtacttacacaaacctaga

SEQ ID NO: 107617 - DNA, 1046 bp, Homo sapiens
gtaagagcaaattttcaggagagggcaggtgtttcccttacatttgcatgacaacatcttactgggaatgagcagtactggatatgagaactaagaatttcacttctttttttttctctaaatgtggcagaaaaggttttgttggggtgagataagcattttccatgaaacaatgcagtagtgacattaggtaattacgtggtgactgggacacaccgcatggtatactggagaaattgcatgatacctacatgataactgtagtaactttagttatcgctaccgtattatctcctgataactatataattagtttgtgtcatcaaagcaccctaaacgtatgcctgttccagctactctggtagaaaaaagaaaataaactttttgcaaggggggagaaaaagctaatgaagaaagttgccaagaacagatattttgtaatctgtgctaaatctctgctggaaaacatgaacagtaatgaagctgagaagacagtaaaagaaattcggggcaaggtgccagacgcccagacggaaggagaatgtggaccaaaagattgcgacaatcgggtaattatggtttatgaatttcagctttaatctgtagttcagtgagtcctgattaaatatctgttaaacacaattaaagtttgtttttgtatttcaccgtcttgatcagaataattagagactgcgtgtttcatgtcaaaagtagcaagaggaattttagtgaatgaacatcgtttttaaaagccatttgtagcaccagctgttggcattattttatattttagtgttatcagcataaagatggtcctctggatgctgaatagtttccagcaggacaaggatgttatgctgttatgatgggcatgtgctgatgaggcttaaatgtttaagggttagtgttcattggaaacaatggacaagggagatgtaggtcaggcaagcagatattttaggtaagagaaggaagacatttgagttaactttacccatgcaaggcgtgacataagggaatttctcatggtatagtcattggtgtta

SEQ ID NO: 107618 - DNA, 1066 bp, Homo sapiens
ctgtgggagctctctttttaaatacacattaggggatagataatggcaaacaaaaaaaagtctttcttcctattcagatggatagctatcagtgtgtgtatgtctttttaatatttatttatttgcttatttgatcatttatttgtctatttattgtaaggaaattaacaaaggaaagaagaaaaacacctcatgataaattaatctcattagatacgtagaattttagggctagaaaggagtttgatgatcaagctatgactttatatcacactcactttagaaatgtgaatgtatgtgaattttgagacccaaagatgtttaatcagatgaaccaagatgcgcaataggattgtggcagagctcggcctaaaactttcatttcaggcaatactccctcagagattacattacattttttaaagctttattttaaacaaagacagtctcattttaataatttgcactgatgtgcttaaatctaatagaacatttgctattatagtaactgagacctcacattggttacaccaactaaggaatatacatttcaacagtttgaagacatttctttctaagccgtttcttatttgcatagggtaaggaaccttagttagttcaattaatttttatcttttgtaagatttcaaagaaacacttgcaccgttcctatttacctaaaaacatgttttttaaatgaatctgtttctttaataagtattcacttaagtaggtcatactgtaacgttcttggtgataaaaaatcttttatcaggataaaagaaatcttatttttattcccacttttagccatgtttgagttggtccttgtaattgttggtttcaacaaaacactaagtcaaaaaatcaatgtttgtgtttatttttgtttaatacatgagaaaaaagtccattgatctttttgcagttatgatacataaatactgtatttttcacttatgcgaaacttaatttttgagggtttcctttttgtttcatttctctgtttcacatttttcaaacatctgtaccatggttagtggttagagtagcagtggctggcact

SEQ ID NO: 107619 - DNA, 1054 bp, Homo sapiens
tccccagtgcattaaagtaggaataggtcaggcctggagaaaggaatgacatcttgatgaaactcagctttctcagaggcctaacaaggatggcaatacagatagagctagaatcttctcactggcccttttgtatcaaattagtgaattcctgtatttccagactgaaatgttttccagtaagcaagagagaaaaggcttctggaggcagtggaaatgactttcgttcttctatggttaagagtacatgggctttggaacaatggaaaactggtttcaaatctctgcagcttacatatttatggtgtgaagtacttaactccctacattttagttctcacatctgaaaaaatattgagcatgcatatgccatagaattattgtaatgattaaattacacatgtaaattgtataatacacatagtgtctggcacaggatcattcacaataaaatttttattcaatgagtactattatcgctttctgtaacattctctagtagccctttctaagctctgcttcactttacatcattacttttgtctagtccttgacattccacctgttccggctttgacttgcttccccagatagtgtacatctgtgtctgcttcaaagcctcattctgttatgttctttaagagttatacctagaattgggccaggcacggtggctcacacctgtaatcccagcactttgagaggccgaggtgggcagatcacctgtagtcaggagttcgagaccagcctgtccaacatggtgaaaccccgtctctactaaaaatacaaaaattagccgggtgtggtggtgggtgcctgtagtcccagctgctcaggaggctgaggcaggagaatcgcttgaacccgggagatggaggttgccgtgagccaagatcacaccattgcactccagcctgggtgacaagagtgagacttcatctcaaaaaaaaaaaaaaaaaaaaaaaagggagttatacctagagttatgtataaattcagtaccaacaatgggcaaaaatgtaaaattgtagaaagaataaatgatgtttagaga

SEQ ID NO: 107620 - DNA, 1033 bp, Homo sapiens
gttctgatttcagataatactgaatacaaacatcttagagagacagaattatcaaacccctccaaacaaatttaaatttaacattttggaaaaaaattctcaaggaagagtcaaaaacattgactttttttatcttggaaaaaggaatgttaaggtagagcgctaatagtagctgttaagcaagtgatgagaagtgggaaacaaggctttctctcttttcttcactgaggtctgataatgacaaaatatgctgcaacagaaaatcttaaggtttgataatgagataggttattaatagtgagtgctaaacactgaaagggaagttgtgagattatcctctatgaagctctttaaccagtatagagtcatatctttctggaatggtctgcatgtgtcagcgagaagggaagaaatgacttctctaagtggttcacattttccaggcactttctccttacctttctttttcttaaagccacagttactcagaagcaaaaaaactgccaaaagttaccaggacttccaaatgtgcttgacgagggtgaaagcaatagaaatgccaccaacattttaatggagattaaaggatcactcttaaattaccatcatttcctataataactcatttactacaaacttgaaattgtggatacagctgctgaaatttttatttatttatttatttttatttttgtttattttttatttatttttattttttattaaataaattaataaataaatttatttatttatttttattttttgagacggagtctcagtctttcgcccaggctgcaggctggagtgcagtggcaccatctcagcttcactgcaacctccgcctcccaagttcaagcgattcacttgcctcagcctcctgctgggataacaggtgcccaccatcatgactggctaatttttgtatttttagtagagacggggtttcaccatgttggccgttcttggtctcaaactcctgacctcaggtgatccgcccgcctcgccctcccaaaatgctgggattacaagc

SEQ ID NO: 107621 - DNA, 1902 bp, Homo sapiens
cactgattacagtgtctgagattttactgcaatttccatttgagttaaaactgattttgtcttcaaaataaaagcctttaaagacagggaaaataattatttttcccatggcaggaaatctaaatcctttcattttatctcctaacataaaaaagaaaagtactaagaaattactgaaaagttgatgcaaaaacaaaacctctattgaatatttgagctatggaactttattctccaagtatatacctgctaaagtcccatgtatccaaaacagagagagccagatgtagaaaaataacttacaccaaggctttttgtgatgctagtaaaaaggcagctagggctttgtgaaaccatgttgctgcaggttaaaaaccaaaacagaaaacttacccatgtgcttttgaattggaagaagaattttgtttgtgtgccttggcatgatcgctttatgtaaaacgtggagattgtacaactctagtatagaacagtaaatgcacaaacaagccatattctaaccttgaaagtgtgactgctttcaatggcacagtgtatcaaggtcaagagaagctgccctcagcagatggaaaactttcaaagtaaaaaagcttcctttacgtttaaaatatattgagttacacatgatttctaaggaatacttggtcgttctagttataaccatggctcacttttgttatcatgtgtcaagtaactgactcgtatattttcctggcagatgttttctgtggaaaggcaggaaaagagaggtgaaggaagaaggcatcccttaatatcgtgcaataaacccactaggggtcactactttcagtaggactgtggagaagaaaatgtcagaggacacatttgtgtcttggcataaaatagatttcatgacaccttgacttttcaccttttatgcatatggagaactgcttagaaggctccaatgcttatctgtgcctgtgggcctttatatatatatatatttttttaatttgctttaggattgagtcgggaagtatttatatttgaactgtattttgctcagaaatagtttgttgaagctattctgtaacatgtatctcccttaacttttaaaataccatgcaatgaaatgattaaaagtgtttgagtgctttggtaatgcaatgcattcagaaggcttgatctcacatcctgtgtaaggagttatgattgagctttagagatgagatgccacatgctttcatgtcagtgttatggaagtgattttcttctttcttgtttctttcctgcctctcattctgtgttctttctctcctcttgctcttcctctctctcagtttcatgaaaattcatttatctgtgacatttaaagactctgtctgagaggtgtctggagctgtggccggctgtgtacatcaatagtttcttagaatctggcactctgtcaatatttgggggcctcgataaccgcacttaaatgcagagcctgccagccatcatgctcttagtgaatgaatggatattagcatgtcaaatcctttcacaactggcaacacttggtagacaatatataggcatcttgcatttgccttctacacctttctgtttgcctgcctcatttatatgatgtcatgtttcccattacgtataaaaataggaatcttcaaaaagcagtattataaaaattgaagtaaatgacatcattgtgcattctaagtttggtgggttttatagtatacatggtgatggcatataggcagtactttttaagattatattctaggtagttttcgtttgtttgattttgtttgtatttttgcttaggttatgatatttgggccaaaattgttgttgctgttttatagtagaaatatatatatggctctaaggccattgagaccttctaggtgaagtctc

SEQ ID NO: 107622 - DNA, 1051 bp, Homo sapiens
gtcattgctcctccatctcatgcttgtaagatggcatagaccattcttttcttcaaaattcaattttcctcaagattgtggaattgttgcaaaagaagtgacaggaatatttttgtttcttggttagttttcttgttatccatttaatagaagtctaactgaaagacacccagaagtgagctcatcttagatggtgtttctgactgtgcctttctaaatggtaagtggaagagcagaagagttttgtctcagaccaaatttgtaaggaaatagactgatttatcagagagatgaggcgatgtgaaaggtcttatttctgcctgtcaaaaaggtataagacagatgtttcactaggcaggacaaagactggactcaaatatggtggtttcttttcctgtttatttatgtttggtttactttttaaaaatcattattattgttaatatctctgtaatgcaaacatggcagacctgtttttctaaagatcacttccagtagagtagaaattagtaatctgatcaaccagattgacagacaatgaaataaaagtaaaaaaagaaaccctctgttacatgactaagcatatgcttttatttttgaacacattagaattgatacttgggaattacaggttggtgcttctgtgggaatgggctagttaacagccctatttgactttttgctaatcctgaaaactgagtaaatgtatcttaagctattttaaaggaacataggagtttatggtttgctatgagagtctgcacctgcttaagacacaccacagaaacattaaaatgggatgattcattaggaatgaagaaatgtttagctattgtacaaagttttctccagaacagtgtttcccaaacatccctgaactaagaatcatcagggtcacccttgaaatatgcacattcctgagtctaccataaacctagagaataagaaattttcacgaaggggccttggcatttggatctgaaacaagaaactagtcaattggtatgattagggaagtttgggaaatattgttctaaaagatttcttagag

SEQ ID NO: 107623 - DNA, 1109 bp, Homo sapiens
ttatggtatttgagtgagtgtctttcactacttacttacccatagctccttctagataggaccaagctttacttttcccttcatcttctcgtttcagcaaaatgtatatgccccacagtagaccaccagtacacatctttggactctcctgatttcatggatgttgaatagggacaaccctttttgagttttctatcttgagttctgagtttctaatgtggaaaatacctcttaaatgccaacctctcctgccttcctaaccagtcaaccccagttacgtacaaggcctaattttgccctgcagttgggatgaaaaatgtgaaattgacagctctgcttgtcaaacctgtctgtctgcactacacagctcagagtagcaccatttagagaaagggtgtttggaaaattaaacaaggactgtgtgaataggagacctatcggcctgcaatggaatgacaggtttctgcccacaaactggggttaagacctgcatattgatgcttcttttcacccatttgtgagtaatgggtctcaccccattagtgggtgcatttgttataccactagaagctgttatgcattctctgtaagtctgtgtgagggaactgtagatacacataaatatgtacttgccaacagatctctgtatttatctgcctgtcagtgggagcagacagggcacagctctttgatgggcaagaactgcgggtcaaaaccatgttcttgctgctgctgttgctgcttcagctgctgctgttgctgcttttgctgctgctgctgctgctgtgattgccatggctttatcatttaagtcctgaaggaggctaggggcagcttgttagttctcgttctcacttaacctgggaggctagctctggtcactgacataattaaacagaccttgcaaatgttgactgctaattttcttgtggctagcagagatagactctcaaaaccatgctcacctacaatctgtaatctttcagtgttccttgagagtccacatacctctgctatcttcaaacactgtgtttaatgctgtcctgatgctgtctgatcctggtggattctgccatcaggtgtatttccggctgtatttcactgtcttt

SEQ ID NO: 107624 - DNA, 1015 bp, Homo sapiens
atatatatatatatgtaaaatatgtggcattttatgataagtgctatggagaaaatttaaagaggagaaagagtgtatacatgtgtgtttgtgtcagggataagtttgcaattttaaatagggtggagaggtagagagggaagtcttcattgggggacagcatttgagaaaagacctcaatgaaagtgaagaagcaagttttgtggatatctaagcaaaagcattttcaacagtggaaccatcaagtgcaaaggccttggacatgaatgtatctggaaagtttgagtgacaacaaggaagtctgtgtggcagaatctgagtgggtaagcatgagactagtaggagatgaagtaagggagacaagggtgtctgatcacatgggccctaatatgctgttgtgaaggcattggctttgtcatttacaatacaaagatgaatacaacatggtctcaagttgctcactagaggagaggcagatagggaaacaagttggggtaataccattatgctaagtgccgtaactgaaggatgttcaaggaaccatggaggcacagtgagtgttcagctgaacatatcttggagtgggggatcagaggaagtttcacagaagagctgataaatccgtgctgggaatggaaggattttcccagatggtcagagggaggaagaacattcagtaagggagccagcaggggcaaaggcagttaactagaaatagcatggcagagctggggaacactatcacttatgtgtagtaggggagtacagagaaacgatgctgtagatgcaggcagggaacaatcatgttggaccctgattgccatgcaaagaagttttaacttcatcttgtggcattcagggagctattgaaaggttttaagtagagaaggttaatgatgaaattgtgtgatacaagatcaccctgtcagcagggtagaggatagattataggagtgggagaatagaggcaagaaaatgagttaggaggcaactgaaattgttcagacaggaaaca

SEQ ID NO: 107625 - DNA, 1050 bp, Homo sapiens
acatccagagagtaactgcatgtactacaaactgaccctaataaacaatttaaaaaaaaaacccaaaatattgtgtataataaaacatgctttaatcttacccattttcaattgtcaatcaacttagcaatccccaaactatatctcattctgtcccctaaaccaatttttttcctggagtttatatatatagaatattccttttcgtctctttattttccctgctcactctctagtaaactgaattcctagatgtaagcagccacagaaagaaaagtgattcacataatggataattaacccttgaacaatggaaagttaactctccatagaaatgccaaaaactgaaatgttttgttattgaatttattctcctttgggagttaacactaatggagaacatctccattagtacaaacctggcaccaaacaacctgttcatccttaagctatgaatgctgcactcaccttccagttcattctggcaggatttgtaacacaatgtcctcctgggtagtcatgtacaaaccactccgaagggcaaaattatatgagtgcctaatccacttgtgaaaattaaagaaaggggatcttttttatgaaaaacacctaatatggaaagacataaattgtaataaaaagtgttagcaccttgcacctcctgctaattgcattcctagtcaagaggaagcaaaattgtataacaaatgtcagaggtacatcatgaacaaagtgcaaagaattgtctgttcctttcaatagtgaattgaaaaagagtagcaaacctgtttaagctatgtatagtagctttaattttggctcctaacctttctgggactcatctatttcatttgtctaatgaggataatagtaacccattcaacttactgtacacagactgtactgtacacagactgtttcttcattatattcattaaagatggatttaacattaattcattcattcacccatgtattttttagtttaagaaatatttttgggccagatgcagtggctcacacctataatcccagcagtttgaaaggcca

SEQ ID NO: 107626 - DNA, 1010 bp, Homo sapiens
tattccaggcctggcctctcatgaccagagactgctgactcatcctggcctgtgccaagctgtgcagtcgcttagtgatgtggacaggagtcgaaggactagaatgagatcactgaactcatttcacttgttgcttacggtacagtccagcatgagctggaaatgtaggaacctcagcctcccgagcagaaagagtaagtagataaaacacaccgcatcaccaagtcctcaacaagcagtagtcgggtggtgggtgggggctcgctctatcatggccgtggctagggcattctggttcatcaggagttttcctttgtcctctcttcttcctcttctccacagtcgtacccttccccccttccctgaacttcccttctgaaaatgtctggatggtacagcagtgatctgggcagaaatgaaatttggctaataagcagcctctgcacaaaattctggaacagtgacactgttgaaattgcttagtttagtttgtctactgggaactcacatgaacttcccaacagaattcaaggggatgaaatcttttttgttctgttttgttctcctttcctttttgattctctttttctttctgttttgagggaggtagtttcaggagacatggctgcattctggtgtggtgtaaagttttccgtcgggagacaataatgtacattcctctggcaggacgggatgggttttttttttttttgtttctcttactgttgtttatttataagacatttcctcccagttagtggaagttagatcgtaagaggctccagtgattttccttccacctcccctccctaatttctgtgcttcagcactctggaacactgtgaactcgacaaactaatcagagcagggagcttaacagccaggcctggacaccctcaagagactgtgtgctgattctcagtcgtcactccttggatcaggaaccatagtcctggtgagtggtgaggttccagaatttgatgtgtcaaggattttattcttggtgtctc

SEQ ID NO: 107627 - DNA, 1068 bp, Homo sapiens
ataatgcttgaccaggtctagtaaaatattccctgccacaaccactattccatgaagagattgagccaagaggcctgaataaactaaccttaagttcagagttgccattattgtgggaggcatcagggagagcacatccggaattgtgttacacagtaatcactgctgggtgtcagcattcatcagccagatggtcagacccacaattaatcaattaggctgcgatgatcaactggactacgttttcccctttggtaaaaagccctcatcatgcggttaaggccaataacacttttatcctgttgcttttggagaagcttctaaaaattcctcttttcttttttgggcctctagttactggacaactgttaggctccaagttgctttgacaacatagatacccaaattcaaggatttcacataatagattttcaacatcctgtgtcttcaagtataatgtttaacatacccagacagaaataatctttttaaagcagcagtgtaagcagtgttactcaactgattttactagagtcttcatattgattcctctcaatccagtggaacaacactggagggggattctttcactggatacttataaagatgatatgatatgataatcaaataatatgaataataagcaatttactgaatgttcaccatgtgacaggtactgctgagataagggttaatgaacattgattcagtgcttacaatgattccatgaggatgataatattatttccatttcaaagagagagaaactgaggctagaaagctcatttgcccaagattaaacagttagtaaatatgtgttcagatgacttaataccctctgaaatgaaagctgaaagtttattttacatttccttacccatatacatctgtgcatctctgagggacaacatttaggaatatgtggtgggtcctcattactcctcttaaaaggactttaaagaaatattttactcgtgttcccgaagtctgttgctctccttctgttttccatgctgttttattctacatcatgtgacttgagattgctttcttccttctttatggcca

SEQ ID NO: 107628 - DNA, 1115 bp, Homo sapiens
atcacagtatcatagtttaccaaattggtcatttattgatgcttctctatttaatattaagagtagaacaatataggaccagaatcataagaaaaaatttctaaatatgtatttttctgaaaaacagtaacctatattttgctgggcacgtggctcatgcctgtaatcccagcactttgggaggccgaggcaggcggatcacgaggtcaggagttcaagaccagcctgaccaatatggtgaaaccctgtctctactaaaaatacaaaaattagctgggtgtggtggcacatgtctgtaatcccagctactcaagaggctgaggcaggagaattgcttgaacccggaaggcagaggttgcagtgagccaagattgcaccactgcactccagcctgggcaacagagcaagacgccatctcaaaaaaaaaaaaaaaaaaaaaaaaaaaagaataacctatttaagagccaccccacccctccacaaaaatgtcatagaagaagcaaatatgagttctagagttaattaaaaagaaaaggaaagagaaaggaaaaatgataatcgaggcaatttttacctctctcaaagcttttggttgtttgtaatgactcttctgaatacccacttagttgagattctggtgtgagatcactgatgcatacatttaggtcaatagcttagtacttctgtatatttttttcttaagtaaattataaacatgtaattaaaatgtatgtgggcagcacttgggggaaaaggttatgtacatatactagtactgtcactttaaaatattctattataggtatttatctactggcctcttatttttcttaattctgacagtatttgcttaactatgcaaagggagttggtttattagtaaatgtgaacagtagtgcaatcagttgaaaatactggattataatctctaatgtgagttatttcatgaagtgtgtgagcaaataataatatctgtgccagttaccaatgtattacctcccattgcctccttccaaatgtagttctccttgcctgctctgcaaaaatgtatctggattctttaaatattttttctttgctagctggtttgagggtgctttgtcagtagagaaggt

SEQ ID NO: 107629 - DNA, 2655 bp, Homo sapiens
gcttcacagagggaactctgaaatgctgagaataaggcccccttcattccctttcctccctcatctaagaataacctcagttctgccccattcctaatcttgcaaggcagctctaactgtaaggagttgccctcctcatttctttgctcctacgcatccctgggaacgaagttctacaggtgcgtcagtacacagtatgaggcaatataggaactgacccaacagagggttctctgagaggccagaggccaggaagccagatacacactccaatctcactttctgtggcacaggagaaatcatgagctgaagcagtcctctcagtgttgagctaagccagtctgggggaagtactgatatgacattctaacatgaaattgcactttttacccatgcaaatgcaactgcttttagtttgggatcctctagggtgcctctatttcttagctacaatctgaatatatttgcaaggtattttggttccaacattgttttatcagtatttctgtggaagaatgagaggtagagttttccactctgccatcttgctgacttcacccctattatttgttaagacattaattttacttgaaaaaaatatgccatttggactggctgatagacaaagtattaagatatgcacccctcagtaacttggcatttctaacatgcctatgggtctatagctatttaattatgtttacttgttactttaggcttcagccttcttgattaggttaggatacatcggattatttgagctgaatagtgcttcttattttgacagaagaatgtctattttgttttaattcagtgatatattttcagtggcagatctttaaaataactcttctaaaacttgtaatatttttagtattggacttagttaagttacttatctgggcctcagttgtatcatctgcaaaatgaggcaacaggatttaacatggtctctagttaattcgagctctaaaattgtgcgatctcatttgtcatttcaattcaacatatgttaacgaatggaatacttacataatgtaaatcaatgaggtagaacttgggtggatacagagatgaatgtgattccttcatgcaaatagcttataatttgatgccttcaaaactgagatgtgtattccccaacacatcctagttccttatgtttgacatgtcatttataaataagggtatattatttatttttgaagtggaagaaatttattcctttgttactatttttcatctctagatttggagaaacaaaaatgtggcctaaactatcattttaataatattgtgcatttgtatttcctcttcattgcaaagcatttacaagattctggaatcattttcttatccatccctaaagtagcccagtgcaagtagaaaaggacagttattccccttttagtgattagaaaactggaccctgatttttctggagttatataatatgccactgaatgagaacaggtaaaaatccaggaactctcatttcaagactgcccagccaggttcctttgtatgttacagtttcttttagtaagttctgcagagcctgattcctaaatcatctttcaaaccaaattctttcttattccctatccaaacagcagcatagccattgatgatttcagatagatcaacaggaaaaaaaaattgtagtgaaagaatagaatgtatgcagcaagaaatgtgctgtgcaagctgtgatacagtgtacaatgtttcagtctttagctggaattaaaattagaagttgaaaaaacttggggactcctccatcaatctaatctagaaacatttgactgtaggcccagcagcccacaatgaaacctgcccttttgctaggtgagaacatcattctgaacatgccaccttggaaactttgcatcagttcttggtatcactagaattttcctatcctgcttttgagaagagtcagtgtgagaacaaatatacttctttttacaaatcttgaaagtagatccttagaaataggtgattacatttccttcataacctaattctttctatgtagtaaaaaagtcatattcatgtttggtctcatagtttccttagtcaaaaaatttgcatctaaaagcctaggaaaatgtttggcctgcacagttgaatgtttaaacaggtgcgcactgcactggtctggctgaagaaaggtagtctcctccacttggaaaccctgacattaagagaatgattcttgtgccagctttcaggaaagcttgtgaaggaaaagttcaggtgattcttaagtcttattacctgattatcagcccatgtgcctcccttccattctgtattctcatgaagaaattgatttaatagattgaagatattattaaatacattctgcattaatattatatgtcctctttgaatccaagtggcaatacaatagaatttcattttataaataacacctttcaagcgaacaccacagggcacagtacaaaagaatcaaaatagaacacaaatgctgtaatcaaatgcagaccccaggaaggctgattaaaaaggcatgttgctactaagaacagccgacaggttaagtatagtgggtcatagcagaaaagccagcagaacagaagggcaaactaaaataaaatggacttgcctgcctgaatcacacggact

SEQ ID NO: 107630 - DNA, 1081 bp, Homo sapiens
taacagcatatggatagtcttcctcttaatctcttcagccagtttgtatcttttgattggggaagctaatccatttacacttaattattaataggtgagaacttattactgccatttttaaattattgtctggttgttttgtagttcctttgtccctctgttgctgtctttttttgtgatttgattatcttttgtagcaatatgctttgattcctttctctttatgttttatatatctactacaggtgtttttcttgtatttaccatgaggcttccataaaacaacttataatcatctattttaagctgatagcaacttaaatttgatcacatacaaaatctctactcttttacttctcctatatacacacttcatgttattggtgtcacaatttacgtctttttatactgtgtatccattaacaaatcatgtcattacttttatagttttgtcttttaatgtttataccagagttgaaagtgatttacacactatcattagagtactagaggtctctagtatttgactatatacttgactttattggcaagttttatactttcatcttttcatgctgctaatcaacatcctttcatttcagcttaaagaactttctgtagcatttcatgcaaagcaggtacagtgatggtgaacacccctctgcatgtttgtctaggaaagtctttacctcttctttattattgaaggatggcttttctgagtatagcgttcttggttgacaggttgttgttgttttttgatcttcagtactttgaatatgtcatcttactctctctttgcctgtgaggattctgctgagaaatttgctgacagtcttatggggactcctttgaatgtgatgagttgcttcgctcttgtttctctcaaaattctgtctttgacttttgacaattggattataatgggtcttggtgtagatctttggagctctttggacttcatgaatctggatgttgatttctctcccctgatttgggaagttccttaccattatttctttaaataggctttctacccctttccctctcttctccccagaattccctaatgtgtttattg

SEQ ID NO: 107631 - DNA, 1056 bp, Homo sapiens
ggatgaagattatgactgtgagatgggtcaaaatctccccaaccaaaatgtaatgtgcttgtaaccagaagaccttgtgttgctattcatttgtttttggcacagcacctagaatgttgttaagacatacaagcaaataattaatactggtctattacattaatttgccaggataattggtctggtggaagggtagatggttccagattaaacatgggaagagatgaatgtctagaagaaatgaatttgaaactgagatctaaaggacaagaatgatggacagaagtgaacaggctgtctcaggttcattgattgagagatgcttcttggctattcactgcttcaattgttattctccattttatggctgctccatgaaaatgaacaagaaaggcacggagatgatagagagcaagtttacatgatagaggaagaaagttgttaacatgggagatgggaaagaacattaataggtgatgtatattcttagaaaaaatgatgactgctgtggatgagttttatctcaattctgagcaggtagttagagggaatggttggaatttaactctggagtctgatggcctgggatactttgtagttttgtgatctacaaaataatgttacaatactatttttaaaaattgttatgaaaattatataagttcatatatataaactacttagcaaatgcttctcttagaatgacttaaaaaataatgaagataagagttatccattttccctacacaactgtaccacatgttcaacttctctgtcatgattagaaatatcacataccactgatctcccaagcaagttcattaaggtagttttctttacatacaggtctgtttcattttattcacagattattctgctaaatttaattatagaaatattcattggccatatttagcgactgagtggaatatatagcactttcctagggcactatgagtgatttttttaaggttaaaaaatagtcttgtctcaattttaaaatactgaatattgagagaggaagccctatagacactttgattctaatgcagtttt

SEQ ID NO: 107632 - DNA, 1004 bp, Homo sapiens
ctaccttttatttttctgcaccttgttctagaaataaattttagtggtggtctcttggtaggaggtacttggcagtttttaattgaacttctgtgaaaacctaaaactatctctaccttctctatctccatctccctgatcctagaacttcccttaaggtagaaaaaggcaagtgttttgaaggtaaatctagaaatttaaatggagaaaaggagggtgaaaaatattgccaactcagaaattactgagctttcattctttgtgaggctaatccagttattccacctcttatttcctcctcagtaagatatgattccctagtatcttcctaggaagtaaatttttggggttctaagtgtaaagaaataaagtcaacttttgcgaagccctcagtacagtttagtgcttgctaccactaaccaaagtagaattcaaacacaagagggtaattgcagaaatgagtaaatctgtacaacttcacattggtagtatccaaatgctcttatgaatgtcaacttcaggcatcctctttcattagaaaaatatgtgttgtctttgacagggaaacccttaaaaaaataaaatgtcacatatttgaattttagctgtattcataataattctcacaaacttttctcagaaaaaattttcttgattttcaaatttcctttatatttgttcttcctttcatatataattgacattctttaacagttgagaggtgctaggttaaatgtttgcagaataattgtggcttatttagaaaataaattttactctagggcttatgttgtgctaaaaatgactcatacagaaatggttctgcaactcttagctttagcctgatttgtcttcagagaggagttgtattagaaatgtggtgctatgttctgcacaaatgaatgtttgcggtacatatggaaaatactatgcacaggaaaaaaaactggtcctagaaaaaatgactttaactttgcataactcatttgggctagttttttttt

SEQ ID NO: 107633 - DNA, 1046 bp, Homo sapiens
gaaagtaatccggtctatcacatatattattggtttggactcagaaacaaatggtttgaataaacaacttaagaagcctgatgagttataagggacttttgtgttagtgattgataccacatttacaatcacagtctctctaatcactttcaggggttttcatcatagattagttttgaattcatcaattatggtaagcactgaatagaaaataagggtcagataaaacacagtaggttagagatgaagagtgcgaattctattccagctctatcactgagggtgaaatctcacacatttctactgattttctcccccctcagtattatgatctcaaaaaaggagtactactcttcttttttattttttcttagtatagaaagcatacaaaaggcattgtagaattctgtgcgtagcataaattacaagaggacgattaaaatccccacaatcgtctagaagtaatttgttttcaaactttggggatatacctttctaatcattttttttcctgtgcatatataccctttttgtttttggtaaaacactgtgaacactgtttctacttttgtctcttaaatctgtgttgtgagtaacattctatgcctttaaataatcttcagtgtcatttttgtgaagatttattccacattcaccatcctttttttgtgaaatttaaatcagatgtcataaagtctttaaaaagcagaattactttgaaaataaaggtattattattatagaattttagagattaaagaaaaaacagaaactaacatttaatgaagacctactctgtgccatgccatgtgcttagaactttgtttaagccatttcatttaataacctttcaacctaatgaagcaatatagcatgatggttaaactctgtgggctataggctgtcaagttcagctgcacagcggctaactagctttatgacttttcaaatgtttatcttctttttggcttagtttctctgttacaaagtggcaataataataatagcactcacttccaaaagattgttgtaggattaaatgattg

SEQ ID NO: 107634 - DNA, 1037 bp, Homo sapiens
agaattgtggttagatgattctgcttacatgaggcagggaatccttggcagatacccccaccaaccaagattttcattttagacctaaggataccaatacatgtcacaaaagcaagataagtggtttgttcagatcatcagatccctgtttaatgaagctgacatattttctgaataaactttattggatgcataacacaggatcatgcacaactgctataggatgggatttatgacattaccgtaatgagagaactttggtgattctgctctacctagagtggtgaaggaaggataaaaaccccactcaagacaaaaatattcaagaaaatggttctgtagtcagctcattcctttcatggtggaagtgttaacgaaagaaatcttcacttatttttctcctcttacctagagaatactttcttcttacctagagtctgtgatatgaagaatatgctctgtagatggtcttatcttatgtggattggtccatgggacactatgctaggctccatagagaactggttatgtatgttctgtcctcctctatgaaaacattcctaaccgtactgttgatgtatacatttcggtcaaaagtaatttgctttctgggtatttgatggccactctgtgaatcaacctaatgtatttgtggtatggaaatctgtaacctctcaatactaagtttaaagactcttataattaattattgaaaggcactttagcccttaactatttctctctttggagaaacaaattgatcggttaatcatgtctttgtttatttttattgttgttgctgtacacattgcacataaaacaggaaagaggaaaggctgtttgtaagaggtaattacaatggcaaaattgtattttctctaactgttctcattttctcatgtctgattatatcaagacctgcactctagaagtgtgtttcagttttgctaagaaaatgatagaggagaagaataaatccatttctataaagtggtgtcaaacacaacttgacacagttacaaatttctttttttttt

SEQ ID NO: 107635 - DNA, 1212 bp, Homo sapiens
ctcattaaaaataatttagaaaaacacataggagtaaaatgaagaaaaattaaagtaattatttctataatttaaatccaatcattaataaccatttgatatatttccttactctcattttccccgaggatatatttttaaaacatgatgttatcatactttctatataattttgtgtcctgctttcaaaatttaacctaagaaatatgtaattacatagaccttataaacatttaaaataaatatataatattcctgaagaggaatagctcatttaacctaaatgcccaataagagcattattattattatttatatctcaataataccttgcataaacagtaaatgaatcagtcaacaaataataaatgaataaaagttcaaatcagtatatgtttttaaattttttatgataaaaaatcttaaattcatgaatataaacaaattactataatgaactcccatgtactcatcaccagcttgcacaatgactaactgatggcctgttattttctcactatatcaccatgttatgttgaagcaaaccccagacattgtagtatttagtacatcattatttcagatccatcaggatattttttacacgttaatgttaaaaactattcagataaatagttcttattattgtatatagtagtatttttcttcatagtatcctgacatcatattttctaacatgtaacagttgattgtaaaatctcatcagtgagttgcctaatattcttagacacatctgtaagccacagggcaatttggttgcctagagaaatatttcacagatttggctaggtttcttgggggaactattttcttttggtactttttttacttgactcaaatttaggatgctaatttgcctgccagatctatacagcattaattatacttattattgggtttaagcatgtgttgaatacaatttcttacctgaggtgaaaggaaagcatagtccccttattacttagaactccagtctggctacagccaaccaataccagataaatatggcaaatctacttaaatcaaatgtaacactggctttaaaagtttataatttttaattaagattattggcagacatggaaaacatgtgatgggtatgtgaggcatttagaaatatgtaaaagggggaattatataataaaaatctgaatcatttttaaacaacatgtttggggggaaagaaattat

SEQ ID NO: 107636 - DNA, 1042 bp, Homo sapiens
ttgtctttgattaaaaaagcataaaaagtacctcacatcttctgttactcccagcagatttatgtatcattaatacaagagaaagtcacacacaaatagacttcttaaatatacaataattaatatttaatgcccccttttatgagggggtctttgtgctgggatgtctctaatcttcacaacgttcctgcaaaataggtggttttattctttattccacaggtgatgaaaatgaggtttcagaatcatttaagtgatgtgcctacagctttattgttaataaatggaaaacctgggattcaaactcaagtctgtctctctctctctctctctttctctacatcatattcttcctataatatcatgacctatatgggagtatggtagctcccatttcctatagaccgtggctagatggtgttatgaaagagttaagtaaaatgtgccatttgtgacaaatgtctgaaagttgtttttataactaggatttaattcacaaatgaagagtaattatcaatatggcacagatgaagagctgcatgtatggatcagtataatttctgttctttggcttatggatgcagtatgccccagggagtttcacaaatccacatgacatctcccagtgctgggttctgggttagctggccaaagtgtaaaattcctccgtgttcggatggctcacaactggttactatctgaagagatttgtataaaactacctaccatacgtagacttagtttcttttctgaatttgtctctaacacttgagtggggaaaaaaataccaaattttgatactgggtttgttgtttttaatgggtgtttgtttttggaagtgttgtgccaagagaggaagaagaagtgggtgtgggtctttcttccttttgctattttccctttgccttcttgtggtcttatttccaatctgattctatattatcagtttgccataatcctttgcaaaagacataaaatgttcatagactggaagttattaaggctttaaatcacatcacactatcattggagtaattttggg

SEQ ID NO: 107637 - DNA, 1489 bp, Homo sapiens
aggctgaattgaaagcaaaatataggacttaaagagaaattggtattttttctaagcaggaacctaagattaaaaccacagatttaataagattttttatttgtttaattggtagggtatcttttataactacatagtcccaaatacttaagattttagaatgcaacacatacatctataaaaacaggagaaggaagacttctagagacaaaagagtgcctacagagggtcacttttaggcctttagagaaggaaggttggtatagatgaatattttaagtaatattttactatgaaataaatgtgcttttattatggaaaagttcaaataaacaaaaattatttataatttctctacccagaaacaagcacttctagtgttttctggtctttttgcactttgtgtgtacacaactatcacttcttaaacaatatttaagttaacaatatttaacttagcaatatttacttaaacaatatattttcctgtacatatattgttggttatatgccttttcacttaacagtattccaaaaacatttcttcatgtaattaagtggtatctaaaatatgatttcttaaactgcatagtatttaagtctaggaatgtactgtcatttatttaatcaactctctattgtcagacaaggttaccagtctttcacaattataaataatgccatggtaaacattcttgcttctaaatctttgtgtagatctttgagtaattcctttagatacattcctagaggtgagatttctgggtcaacagtcttcatatattttttaaatttttgatgcatattgctaagatgccctccagagcattttgccagttttattttttcggtggtaacatcttaaagttttcttccaaaagtgatttgattcaaagccatgctgttgcttttctctgagtcctttctggtccaccagttatagcagacttaatttaactcttaccttaaggttaacacttagagtaaccaaaacatttttgtagtcatttatgctgcaaatgagacagtttacagaatataaattgacagtgagattagattgcgtttctttcttatgcatgttctgtacaagcattctgcttatcctggataacaaacaaataacaaaaagaaagaaaaaaccttacctctcttgcttgtcctaactgaacactcacaatgcattaggcattgaactgaacgtggaggagatatgattcctgctttctgagactttgcaattccaagtaccatgattgataaggtacaatataaatagtgggcttctaggacaatgccctgtggttaaaagtaattaagttatatggtgccagcagactacaggatacttgtgatccacatatgcaggtggattgtgtgcatcagtcatgatatctgtggaatctgagagacgggaaaggcatacctgttttaactccagaataatatagagaactcaaattcctgcccaggcaaatagggataagtt

SEQ ID NO: 107638 - DNA, 1009 bp, Homo sapiens
agaacaaagggattgaaaagcagaggttttctatttaggctcaattagtgtaacctgggcttcagccagtttaatggaggaagtcatgtctcctgtgttttggcttacctacgtaaccaaagccttgagcagaatgtagagttgggcttttaaaaccatcagttagaataaggttttgccctgaagcatgttcatctcatggaagaattctcttagctgggcacttggccaaagttaagaggacacaccatggtttcatggaagaaaaagctgaagactatgattttcagattttgattaatcacttgtctgtacttcacttatttcagtatttctgtctaggatgatagctttcctttcctgcaaaaagcagacggatatagtagtagtatattagagtgacatttttttcctctgtattgtttgcagtaggtctaacttttgcatctgattctttagggaaagcacctaccaaggcttcctattacctatttcacaggtaagtgaaagtcagttataaaaattcgatcagagatgaaactcattacactgagcctgggaggcataaatattacaaatgtaggtaactgttgatctttttagtcatgggagcttaaaaaaatggacacatcaaatagaattttttctcctaatttcactgtttcgtgtatattataaatttagatatttcttttttatcattaaatttaaaagacataaaagaaatggagcctcaaaagtaggtctagttactgagactgaccagagatacttagaaagaagatattacccttcaatgttcaaagcctggcattgtaatctctttggaaaatgcagtgtttttcagactctaatccagattccaatggctattctgtgcccaaagaccaattactattttggagttctcttaaagccagatgatgctttgagggggccatcaggaccttaaggagaccacaggggactgtctcagtttgtcttataataaatatctcggcagaattag

SEQ ID NO: 107639 - DNA, 1069 bp, Homo sapiens
tctggagtcagattgcctgggtttgaatccaggcttcaccacttactaactgcataaccttgaaaaagttgcttaatccttatctgtaaaatggaaacaataaagttacttacctcttagggttagcatggagattaatgggttaatctacataaagcacatagttcggtgcctggcacagagtagaactttagtaaatattgttattttttcctccacaatgtctctagaacatgttatttcctgtacatttctgctgacactaccgaagtcagatatttatcacatagtacctgggttgttgcagtggatcacttctcattctcttgctctcacaagctcgcactctctctctttctctctcattacctttatgctctccctgtttcagttttttctgtccaccattcccaattatttatactagaatatcactgtgaccatgccagtgtcctactttacaagcctttaatagacctcttgtgttcacagaataaagtggactactcagcccattattcaaggaccccgtttcgcattccacactcaacccatctttccagcattgtttcctattacaattccaactaacttgtttatttgctgctcccaaatacatatctcaattttctgcttccatgctttctctcatgcccttcacacaacttgaaatgtcttatcacctcccaaatcttacatgtttttcaaagtataactagatttgttcatcatactgaagctttcctttgtcagcctacatatcagtgatgattttctctctaaacccctattctgaatatctgaattttattgcataataattccttctgggcattatcccaacaaatagatattaaatatgtcaggcacaggtcagtgtctccatacacatcattatttacccaatagcatctatcaaagaaaatcaaacatagatatacaattagtatatgccaaatgaatacatggtctgaattggaagtttctttccttgttctaaacactttttttccaaaaaagttactccaaatttagccctttatttctactgattttctaaacttccttt

SEQ ID NO: 107640 - DNA, 1049 bp, Homo sapiens
tgttcaactgcaattagagaccataattctcctgttatttgttacacaataacttttagaatatagagagttaatgcacatttgttggtatattgtattagaaactctaaacacatttctgggatttcgctgattgggaatgaaaatgtttaaatttctccttagatccagaacagtctccatgtgtaagttgagtatattcattttagcgaagtaatcaattgcatttaaaatattcaactcacaattatatattgactttcattatcaatttcgattaatgcgttttgaaaatactttattctacaatgcatttagaggaggaaatagctgcttttgtttattcaaggaatttaccaattttatgaaacctgtttattattttgtaagaagaaaatggatgagtcgatagcaaatctgacccttgtctgtatacttacatgtacccagtagtgatgaaaagagatgaagataatgttagtggctaaatgataattgttgagaaggcatatttaattgaagagaaatagattttttaactctgtgtgcataaatatactctataaacattttgtatttgcacatggtttaaactcatctaactgaattctgacttaaggaatagaaagcatggtctcttccaggtcaagccacactgtagttatttgggggataaatgcttggctaatttatattcctttataactgtctttattaaagtgaagacccttgaccctgagtcagaatcacctggatggttcctagactccactcctacaaactgaatcagaatctctgggattggagcccagaaatttgcatttttaatgatcatttccaggtgatcattaaaataaaattgtattttataaaatttatttaataaaatgtattttattttatggctcaattaaatgtgaaagccattcctatttggactcactctctttttctttggcaaatcaaatcttccagaaaactgatctgtgagtcaccaaactgatagttgttaagcatagagtctcagtgacaaccttaaaagtgactat

SEQ ID NO: 107641 - DNA, 1037 bp, Homo sapiens
attgaaaaattagctactgtatattctatatacacacacagcagctgcataaaatgcaaattctattcatgtctgatctcttctgcatttatatggtgactatcgctgtagcacctaagcactttatgttatttcctcttattattatttaccacctgatcattccagagtgctttttacaatcagagaatttcattaacaacccattccctcgctctttgtttttcagcacccttgcatgtaaaagtatcaagcatcttggtagctatatcagataaattacagtaaaaagatagagggcttccgacaggagggcaggggaaaaaacaccctaaagcatctcctaaaatttggtttgtgttttatggtatccaaataatgttacagaagtctgtaattttagtgaaaaccaaaccactagataagcgcttttatttatcatggtttccaccattgcaataatcgaaagtgtgaggtgaggaagaggaatactgtctgcacttcatagatagagaggactgggcaattgcactttcttctcactgtggaaagcttgtgattcttattgactcttgagctgcctttagcccagaagtatagaagtcaatctgttttaaaatccaaaaagctactgttatattttttaagctaagaggatagaaacatgtttattaaaaggttcattgtgattatagatgaaagtgcgtggttggtaccttaacagtttgattgaataaaaatcaagttcacactggggtttccttctcagctctactccttgctttctctttgactccaagctaattgcataacctctggttgacttgtgcctcgtctacacattcaaagtgaaattcagaaatgaggttattatctaactaatgtaggctgtaacattatttctctaaaatatctctgtgagagaattttgaaatttctgatttcagtagatagtaaaaaaaataacaattttatggaccatctccttttattcttagacaacaaccccatggaggtggatacatcagagtcagctg

SEQ ID NO: 107642 - DNA, 1054 bp, Homo sapiens
ccaaggatcttcaacttttattcttctctttaagatagtgagtcctggaaataaaagtgaaaatgaacagttctaaaaggttagtattttaaaaattatagtttgccattctcaggtttattcaaaattgactttctgatataactatatgtttttacaaatataagcattacctaggtagtaaaacatattcacagagagttattatcaaaaatatagagaaaaattttacatgtatatgtcccattccctccccactccttcctgagttgttgacatgagaaaatatctttccaacagtggggtatcatttgtttggtgaattttaacgtttgcatgagatggtgttcatgtttgtgaaaaatatcgaagacttctgacttctttctttttaactgcacatggctcaatctaataaattttcaatatagattctgatatggttataatcccaatcataccacatttaaaagctatattcctgactgtgtttctctgctagcatgacgccacaaggaaaatgaaaccaacccaaacaaaaccctccttataacagaaagtaaaatgaagcttgtaacgactgttttgaaaaatggtttgaacagtgaggaacaaccaatttttcaaacactgttgtagctgtttcaagctgtagtgtggatagtgtatgcaagaaatcaataaagggaagagatctctctctgacacagatgaaacctaaaaatactgttaagaccaattctccctccatgcatctgttactgcattccactaaaaggtgttgggaaaaaaatcagccaaattctactagaacgaagcatccagacaagtgactcttcaaataattaaaaaaaaacaaaaacaaaaaacaaacaaacaaaacacactacagtagaaaaaggggaatgggggaaaaaagattaagcacttaacatgttgagtatatacccaaagcagaaaactcagtgagtgaaaaacttgtccttcaaaagaagatactttctatccttcaccagtaacacagaattgatagtctggtaacagaagcctttta

SEQ ID NO: 107643 - DNA, 1115 bp, Homo sapiens
aaatgtatgtgtatgtatcatgtatacttctatatttgtttacataaaaatgttttcagaaatatacactttattaggctgattaagccaaaacttttttgtgtgtgtaatcgaaagactgaacacaaaaattttaaaacagaactgaaagatgtcagtcagaactgaattaatgacctggggctgaaaatacctatgtcaaatttcatatggattttttcatggtggtattttaattttatatctccctaaatggaagtgctgcagtcaagtgaatctatagcccaaagaataatgaaatatgtcaattattttaggtggttagtttttattttttattttgagtacatgcgatgtaaataccaaatacacatacatacatatgtttttgttttgtttatttgtcttatttactatttattgcaccaataagggaattaaaatggctgacaatgaaaaaataaacataaatacatgattgcagcaaaatacatgaattagaaataggtaagaaaaataaaacaataaaggaaaggatataaaaatggagttagaagtgaggtcagcataaaactatattcagtgaagtgctatacagttgcctttaaactttcttgcagcaaagttaaagagaaaagcttgttacacagtttgtaacatccataagcataagaaaataattttcattatttgtcttgaaaatggcttttgaaaacagctcttagttttccaagaaatcaatgctaaagcaactcccactgtaaagaattgaaggctgcagatacctaaaggtcaggtcggaagcagaagcagtaccttccctgggacatggatgtggaagtagaccaaagtaatccccttttaatcccagggcatgtgtttctagagagagaaaaaaaggacaccattaacgcagtaatgttggcaagctaaaaatgtgtggaaagtagggagttaaggggggaatttaaaaaaaaaatttcatgtaaataaatacatatatattttagcagcaaatcaaagattagaaggcattcacttttataataaccattaaaacatgttatcaaataaacctcttgaatcaatgttgctttcctaaattgttcataaaa

SEQ ID NO: 107644 - DNA, 1031 bp, Homo sapiens
tatttgtatgttcctaaagtgattgtgaatctttggaaattgtttatgaacatattaatatgtttcttagtgctctagtcactttgagggaaattttttaatctttgaaaaacatattttttaatctctgtatattcttttttaccccgagcattacttttgcataatggactcaagtgtgttgtcaattactgattatttggttgagccacacagaaactgttagaaatccttatttttatttgcacactatctgtttggtggctttgttcaagcccatggattgtcagttaaatggaaaagtcttactttcaagcaaaattctcagcatttaatacagtgtgtagcatatatttgggagtcaataaatgttcatagaatgcatgaacaaatcagtcattgttgcaaactgatttgaggatgaggtatgagattttttttttaaggctaaatgaaatgcccagtatcacatagcaggataagagaaaatctgacactcataactcatacttctgtgtttccagactgttacccaagctcactgagaagtgcagtatatgtctgatttctcaacttcaccctgcagtaaacttttgcaatccagaggctagagacctcttttgtgaatgttgtctgcccaatgactgtgttggcaccagggagtccctagcagataaagtggaggaacatatggtttccatctgaatacaaattggtggacataacgtggtaattcaactgagatgtcctctatattgtaaactgaaagagtatgattagaggtgtttataaacggcatctgaattcccccacacccctccccatcccctttccactgtagttttatctgtctgaatcatagcaatctagcctcccagcctcactgcattatttgtgaaaatggccagtgtgaggaattattaattaaagctaacaaatcaccctgacaagctgtgccctggcatggctgaaggttgattggcgaaagtcttctcctttggagaaaagactttttgtgctcgtgacgcagt

SEQ ID NO: 107645 - DNA, 1049 bp, Homo sapiens
atttatagtgttaagaactttcttttttcatagtagtggttcctgtcccaattctttactctatgattttaaactaatgtgtctgttggcctttggactgggatagtatgttggataatatatttgttttctgttgctgttgtaccaaccacaaacttagcagcttatgacaatacaaatttattatttgacagttctgcagatcagaagtttagattggctctaccagtttctctgctgtaggctttacaaggccaaaatcaaggtgtcggctggattcttaactggaggaaactctgaaaaaaaatccactttcatgcttattcagttcctcatggttgtgggactaagatctccatttccttgctatcagctgggaaccatctttagatccttgcatgtgtgctgtccctatatgtcagagccagcagcagcaccttgaatcattattacacttgacatctttcaaatttccccttctaccacacctcttttccaaattccagccaaaaaagttctctgcttttaagatgattagactgggccagcttggataatctaggatactctccctgttttagtgttaacaaccttcattacatttacagagtcgctttttcatgtaacataacattttgccatgtaccacaggttctgggctttaggcagtgggcattttggggtgcaattattttgcctcccacagatgaattctaaaagaatgagtcacctacctccatcatacatttctagagtactctgagtattctagtgcttttgatctagaagtagaagattcagtatgaattctcaccttctaaatgctattagtagatttttttaatatatatgttatgaaacttggtaaagagtatttattttctgtttgataaacagaataactaggggcgagggaaaaccaagttgaccattagggcttgaggtagaccagaaattttttggtttatggcagtggttttatttatcctaatccttttaatcactacaaagcatactagaaccatagagagagcccagctgggaaaagg

SEQ ID NO: 107646 - DNA, 1776 bp, Homo sapiens
aacttaaacacagagcactcaaatgataaccacatagcacaccttccctgagtccagcagatgatagtgaaaactctttgttctctcatgctgtgtatcttgaggacattttcactatatttaagactacttgaactgattacaattcttttatgattgggcagtggatcagtggctgggtttttaaaaatcatatttaattgtattttgtgcaatggtgaagtgttatatttctgttcactcttttctgttattcacacaaaacattacttgcccagtttattgtttctgttcatctactgcttagactacaaagccatgatgttgagctagatgaaatccagttagataaatgcagtatatattggatcagttagtattttactctgttagtcctcttgcctgtggcaactctagttaactatagaaagaaaaaaaaagttctattcctccaaaagaattaaaatgaaggaggacagcatattttctgctttaaaaaatctagaattgtggtttctaaagaaaacccactgtgtacttgataatttctaaagaaaaatttgttatggactataggttataccttgcatttaagaaccacaacgaaaagaccaactttaacttctcctcattaaaatgataagaattggtattgcctataattgtttccactgtgactcctatgtggtttttgttcaatatactagtccaaacaagattttactcttctcagccctgtagatctaatctcacaaaactaagcatatttttttcagtttcatacatcatcaccatcatcttcctgaggatgtatttttttttttttttttgaggcagagtcttgctccgtcaccaggctggagtgcagtggcgcgatctcagctcactgcaacctctgcttcccagattcaagcaattcttctgcctcagcctcctgagtagctgggattacaggcacgtgtcaccagcccagctaatttttctatttttagtagatacggggtttcaccatgttggtcaagctggtctcgatctcgtgacctcgtgatccacccgcctcagcctcccaaagtgctgggattacaggcatgagccaccgtgcctggccaaaagatgtatcttaacagaagagaaacactggagtaggaaaaatgctgccatgtttagtcttaaggaatttaagaaaataaattgatttgtgcttcatgaatccataattaaataggtagttcaagaggcaagattttgaatagcaaacagtataagtaagacccagatgtggcagtctactctgtaggtaaacaagaccaaatcagaagaaattcaaggtcaataaaaaccaccagcactttatccaaatatagttctgccatatttatgtaatgagtttaagtataaattgcttataattacatatttccataacatgtagtactttacctaacataatatgtattgcattataattattaatttaattgtctgaacctacttcttatgcagagactttattctgtcttgaccaccgtggtttccaatgtactcagcacagttcggaatttgatattcagtagattatcacattaggttgaaagagtgaatggatgaatgaatattcatgaataaatgaattttttaaaggacattattattattttatttactggactgattgccatacagggatatatgcatcaaataatagccaatttttcaagtatattgggaattaggaatacctttgatgtttatgtcacctattcacaggactttcaa

SEQ ID NO: 107647 - DNA, 2228 bp, Homo sapiens
aaaagcaatctgagcaagatacagtcagtactgaatagttggaagagcaataagagaagtgcctgaattaacatagacctcctaagctggaatgctttgttgttctttccttgaagttctgtgacctggtgatatctaaaactccttctgtgtgaggattttagaaagtagaatgtggtcagaagcagccctttgttcgtagtcaatggtaagatctgtagttctcaccccccttcaggttttgttttgttttgtttttttattgactagaggctttgtttgtggccttgtgacttacaagataggttactgcaatataatgcatttgctacttctctggaaagccattcagaatctttaaggagtgcagaatgtacaactcttttgctaaagggtctctgccagagaagcattcttccggattttgtatattgcattgattacggagctgttgctcagtgcatcattggatgttgactgtaatctataaagccttacatagttttcttccaattaaagaagtctgacactggtggtcaattttaataatgactgagattgatctatgtgacttaaaattttaacagattttggaacctgaaatgtgagaaacaagttttcttattgatgacacatactctgaaatctattttaaaggtgggttcagtgtacagtagtgaatttgaattaaaaaaaaaaaaaaaaacagaaagttgaaaatagacaaaagtgccaaaaataaggtatttgtcctgactttctgttccttcatctcacctgacattccctcagaatattttacatccttgatgaccagtcttttaagcaattctacctgataaccccactatatagtgacagagttactgatttgttccatgaggagataagaagaggagcactattcatatcaaagacaactggtcctacttccaggtccatctttgggccaagatatgtagtcgccaacagtgagttggcgactatattttttgagtcctggcgcaaagtaagatccatctgttttgcccagccgtttgcctgagtgccacaaaatggtcctgttattagtcttatttgtggtcctatttgaggttaggtataatgtaaataaatttcagttctcctcgtgatgagtagtacagcatgggaattaagagggctggtgttggtagttgtaagtgatgttgagtctctattttttcaattgctctgttttctttggattgggaaacagacatttaagaatgagtttgtcatctggaaggatagttgtgaccaagtttccctcaacaggatacaagatgttatttttgagcctcattaccctcaccaagagaaaaaaaaaaaagaaggaaaaaggaataagaaagaaagtgaaagtggagaagaaacaagcagaaatagaagaaaaagatcaaagaggagaaggagaaatggcatggggggggaatgaaaattggtacactgaccatctattcatataattgatttaattattttgagctgatagttcaattcattcaacatctggcaaattgaggagaaggaaacctgactgaatgaattgaattactagttgttagttatatgtttatatgtaaatattcagcctagtttctatcaccttttcacgtctaaactagagaatgaatttgtttcgctaaccatattttgttggtgagtagaacaatgccagttggtgaattagatttatccagaggtgggcagttttaaatttctgaatcatttttcagagattattgttattcaatatatttatattatatctcataatttctgagcacaagttatttttgtcagtttcttttatgaatattttgctgccttataaggaaataatgtgcactcccctcctctcattcagttgtccctggtgacgcctccataatttctgcctttacgctggttcatttttagcctaattcaggcatgtgagaggagggggaaaagtttagttagtcaatgtcagtgattttttttaaatctaatctcattcatgagtgaatttactgtgaacctgagcatgtttacgcttaaaatctatgtacatcaaatagaccaattacccaaaatattcctctatacatttcaagagaaaaagaaaacaggaatcccaagtaagaactacatatgctttctaataatagtacaatttaaggggtgatttgtgattatgctctcatatggggaaatattaaaatatt

SEQ ID NO: 107648 - DNA, 1048 bp, Homo sapiens
ctgagatttttttcaagtctttctctcaaacctactttgtaaatacattagaatagccccagttttacttttattcattcattttatttcccttacccgtagtgttgaaatggaatttatcaatgctttagcattataagattttcaaataatttaaaagaaaaattatcttcactttaagcattgaatgcatcacttttttccataaacccgaaactcagaacctgtaggaacgccttcatttgctttatttctgacattaaatttgcaaaaaggcactttccaggtaacccatcagctatgtcaccctgggtatttggccagagggcagtcatgttgaccccatctgcaaaggctggctaaactagagtcttggactattagaatctcattcatcaaggtccacataaagtacggtaggtgggaagcaggaggacagatggtagggtcgggcgcaaggaacttgtttgttgacattgatgtagacgcttcttcttgccagagtgactccatgcacttattttggcatggaagactaggccaaagctatcatcttaatagaaggtgagctgcaggcaaactagagagatccatgcacagtaggtatttagagttggcttagattttatctatcagcttgactgtcatacatacttgattgatgtgcagcagggcttgaaagtgctgcattgatgttgaggactgtgtcataaggttcctgatatggtgcacatgtctgaatggagttggacattggctgtctttgcccatgccaaacaacaccagacttcagtgcattattctgcagttgagtagcagatggtgactgcagacgtttggagggggtgtgccttcaaacacaatatggagccagcaaacttacttagaaggttattacatgtcttgactttggcagctattttttaagcactgttgaaaatccaagttccatccattgttattcgcaaaatactaggcaaggttggtattccatggaaaagaaatgtgaaaacgcaaatacactgttcactatgctggttacagttac

SEQ ID NO: 107649 - DNA, 1036 bp, Homo sapiens
tcttctagtgatatggatagtacataaaatctagtatcaatggcccagtgtttctctttcatagagttctttgattttttcttatattcttataagtcctttctttggaaaatatatgaacttagaaacagaagtttccctggctcatattatgcccatgagacaatgataatgctgaagtccttttcataatcaggacctttatagagatcatccaggtattcttagccaaaatatccctctcattgtacactactccagggcaacatgtggtgtgccagctggatgccctccctacatgcctcaggtggccacatttcaatggtgcctatagagcacaggccaaattctcattctctgtgttaatcagtgggagaattcccatagaaaatgggatgtgaacatatttcaggaaaactcaaagagattagccagatgattaggccaggacattgtaagttcaagttttatgtaggatttctatagcattatcttagttgaccgaagaatgctataaaatttggagatatttagaaattaaaaataatcatccttttcattttactgtgatttctccaaagagaaattcaacaatattttttcttttgatataataggatctcatcttgattcataacatcaaagacaacggatgtacctagtcatataatttgactgaaactttttcccatggtattaaaaggatctgattctacttgtagaagtctcattatacttctcttttcaattaaattctagtcaattctacaaacatttagtaaatgcttactatgtacaaagcactttaatagatgctctgaataattctgtgtatggtgctttatagtatgtaacatattttcacattcattttctcatttggtgaagattcactttcttattattacttaaattgtctagagtttcagatgatgttgtttcctaggtagaatgtttgttttgtttttgcttgttctatttttgatgtgtccagagaccattctagaaatacatttagctttccttgaaggaaaaa

SEQ ID NO: 107650 - DNA, 1037 bp, Homo sapiens
ctgataccagtcaccatgccttcactagatctggggatggacaataaagtatatgaggagtactggcatactaagtcataataaaattagctaaatgttctatatatcaaagaatgaggtgattttggtaggtaaaaggtagtccaacctgcacttctgttgaaaaaaaatgactgttgtatcaacctggtattccatccaaacctgaatttgagtttatccaaagagctgcactgaaattcagcaagatagcatggactgggccaggtgttgcaggcagaggacaggattttactggcttggcagagtaggactttaggttatttcctccaaagtgacattaaattcctctctgtgctatcacaacaccttttgttttttcagacctgtctatagactctcagaggcttattctgtttcgtgaaaacaatgcagataagctgattgaaatgtcaacagatataaacatgcagataaaatgttagtatgtaatggtagttttcaaacataatgagtaatgaaatttaagcagggtccaggtggaataggatcctagaatcctagaataaaaacatatcattttagaggcagaggtacagtcccattcctctgtttaaaaagatgaggtagataaagtccaagatctttcatctggagtgtttgaaagagttgggactagaagcacatctctggtctccagtcaagtgccttttctagttgagcttgacttctttatatctggataataaaatcaatctcatacaatgatataggtcatatttttccaaggcagttaagtattcattcactcctataccatcaataataatgacaaacatttatataaagcttacaacctaggcagtaccctaattgctgcctagcaggctgtaagcgctatatgaatattgctgtatgaatgttgcctgacgtgaagagttagacactgtagagtaattttccttatattgccttttgcttaatattgcccctcttttaaatcttcacaagagccacattaactaggtactgttgtc

SEQ ID NO: 107651 - DNA, 1089 bp, Homo sapiens
aaatctataaaagctcttcctgggagatcaagttgagaattgtaaagatacatttaaattccctagtcaatgctataagccttattttgagggaaaaagaactctcccatctgcttactctgtggggataaagcgatactgggagaaaattgactttacaaaagccctcctgaaacctttagcaagctttaggtgtcacttcagagaccccctattagtataaataacatcagtgggtaaacagtagctggtgtccttaaatacaaagtagaaattattgtttagctttgtcctaaccagaccttgattagaagtgggaaagagtattttggggtgaccacaacaactttcctttcactgtggctttaagaatggaatgagaaaatacggtgaaaatataatgaaactgttttctttgggagagtttattagatgaatattttaatacaaatataacatattttaataccaaagataaaaaaaatccaggctttcttttcaatgtgataacgactccatatctaactcaatcagacacttgcttcagacaaagaacgggactcttgccatgggcgggtctgggtttaatctcaggagcgtgagggtccaggcatccagacagtttgcagccctcttccctgaggcttcagggagagagagaacaagggtggaaaggtgcaaggattggagcaaaggagctaagaggtggatggaaaagagaaaaaagaacagcctaaaataaaatattttagcaccaaagcaatgaaaatacattctgtggataatgtaaatgctatttattgaatttttacttttcaaaaatgtttaacttaaaaattcttgctgacagtgggaatgtaaatctaagactaagagacgaacttaccagaagaagtttattattgtctgataacagctgaattccggtcttctttgggtactgtaaaatggggcagatttgtatatctgtgatgtcataggcactgttggaagggcttgtctctggttttgtcataagtttcctacttgagcagttataagccatgaattagaaattcattttagattttgaagagttacaaatttgga

SEQ ID NO: 107652 - DNA, 1011 bp, Homo sapiens
gaagcacggtgaacaaaggaaaaatgttagaagatgagaacagaaagatggtcatgaacagataatggagagacttactggtcatggttttgaattttaatttcttcttattgcactatatataacttgtagaattttaccaaaggaatgatatcatctttcctgcatttcaagaattctagcttctgtttagataatggattataaggtgcaacagtggaagcagagaaatcagttaggagaccagataagagataattgtgatttttgttcgtgatagcagagatagtgaggaatggtcgggtttgggatgtacttttgtgtttgggttaatgcggcttattgatggattagatgtggtgggtgaggcaaaaagagttgctgatgtttggcctgatcaactgtcagggcagatggtggcacctttcactgagacgagagaagtacagttagattagaggaggaagtggcaacatggataatagggaaaccagagttctgtttggggcataaattagtttacagtatgtagaactaacaagaaaagtgctcattattgctattctatgttttaagccagttcttgctttggaaaaccatttccaacatcttgtagcatcttgtttccatatacttccattttttaaaatctttgtggtggaattttttcagaggctatttgagaatttgtaagtaatatatactgactcccacttttcaatatagcaagttaatcagacaaaatatctcttatagaatgctagaaaatccactgaggaaaaagtcagtgtagtattttgattataatttattaaaacacacatatcaaatacaagataacctttggcctttccttgagtcagactttgttatagcttctaatcatgtcttgccctattcattagcagctcattcatttcccttatgccacctcactcaccttaaaatttaagttttagcagctttgctgtaagtcttataagtgcagtggggcatttgaatggatcgttg

SEQ ID NO: 107653 - DNA, 1305 bp, Homo sapiens
agctcaaacaatctgcccactttggcctcccaaagtgctgggattataggcatgagacagcgaggcaagcctatctttgaactatttaatggtcaaagttttgctaatgtatatacagggaggaaaatggctggttcatgctgattctccatcagggctatcagtaaaagagtgagtgacactgtaattaatagaacaggaatgataacatcttataggggtgctgttcctgcttttggaatggcttctttaaatgtgggatgcatctaccccatttggttgtaaatggaaacatcagtaaataagtttaaagacatccttgtttgcctctctgatggcaaactccaatccatacatccactacagtctattttggtatatcttctatgaatttctccaacttcttacttaagttttgctaccttccaaggcaggcattaaaaaaaaatatggaatagtgctttattacctgaccctatttgtacttttctgaatatgaagtttgacctctagtattactattctaggatttcatgaataattctatgactaccctctgcctaaatttcataaccccattacatattagatcagggttcagtgccctgtcttcttttaacttttcagagactttccccccccagtcacaccatggatcttcaattccagggctctacacatctctctccctttaggccctcatgattgtggagattgcaaatgcatcattatgtccattcgaagatgtcaaaactttacataaatatatggaaagctttctagcctattttcagtacacttgatgagttccaaaattttattagtctttttggttacagtctcatatttaagctaatataattaggaaacaattgaaagtggttcttaaattcttttttgagttaaacctgatgtatcaaataccatcattataaaaacatgatttgtgttattttccctaaaaatgcttcccttgcatttatacttattaagaatagataatagctaacatctatccactgcctttgattcatgaggccctcacgaattgcctcattaggtctccgacagtatggtacaactactctttatattttacagatgaagaaactgaggctgtactgctactttctgcttacacatcctaatgaaaccttcctactggggtgatctcttttggtttgaatgtcactacttgagtgagattttattcactactttttcttgatcattggcaaaatgtccaatggaactaattcatgagagagtcattttttaaattaatttgtttactgaaagtccgaa

SEQ ID NO: 107654 - DNA, 1053 bp, Homo sapiens
caaatagtactgacctattagaaaaattaattatgaaagaaaagtaatggattatagttgcagataatggttttggggacactgctggttgaaattcatcctgaggcttatttacaattggcacaattagagcttttgagaattcagcagccttgatttatttgcaggggttcatatagcacttgagtcacgggcgaggtgaggcacagaggtgggtaggggacttactgctttacatttaagttctatggaatttcacatttctattttggggaagaaaggattgtctctagagagagagcatcaggttctttaacaagatttaataaatttgggtccttgtatcgatcaaacttcatactagatcagataacaaaaaattgaatatggctttgcactagaggctattttattttctgtgctgccaatgaactaagtttctataattttgctttcactatttgaaattttaatttatccatcagatgtttattgatacctaatgtgtattcagtactttactagccacttgggatccatcagtgaaaagataagtaactcatgtagtatgttaggagatgattagtgcacaattcatttatgaatgacccataaaagaataagttgataaattagatttcatgaaaattaaaaaattctgcactttgaaaacattattaagaaaatgaaaaggtaagccacagactgtaagaaaatatttgcaaagaatatatctgataaagaacttatatccagaaaatacaaagaacttcgaaaactcaataatatacaacatattatttaaatgggcaaagatttgatcaggcacttcaccaaaaaaaaaaaaaaaagaaaaagaaaaagatggtatatgatgagcacatgaaatgatgctcaatatcaatcattgttagaagaaggcaaattaaaatcatgagacactattacacatcctttagaatgactgacatttaaaagactgagcatagcaagatttttgaggatatggagaaactggaagcctcataagttgctggcagtaaagtaaaatgg

SEQ ID NO: 107655 - DNA, 1050 bp, Homo sapiens
tcaaattctctctcttcctttgagctggtttgtaggaagtggggattaggaggcataagagtggttctgtcaattagatgcattacttcctgaaagctagaaagtatttgggttgttggattttaatgcagtatgtatatagttaattcacattgatagtgagccacgcattcagtcaatcaacaagtgcttactgaaggcccacagggtgcaaagaaccctggactaagtgcttaaacttgactccatgtgccttactgtgttattgcacaagtgctggagtaaggttggagttttcccagattccaggtacccaatgactacagtagattatgaaagagcagttcaggtgagagccaagctagaaacacacacatgcaaacctcagaaaaaaaaggattcccaaaagtcctctattttgtcatggagacttttttctccatttcactggtcccacgaaaaggcccttgataatctgagttttatattgcatttttggccaaaggaatttcatatgtttcacagatgaaataattaaaaatagactctcttaattcctataaaccctcttcatcccccaccctcccagtaaagcccaggataaataggccgtgttaccatttccaggaggcttttggttgatcagtgtaaatgaggcatattcaaagttggtgatcagggatatgtagtgttaggtggggagggtaactatgaagcatgtagtgtttctttttttttttttctcatgaaccaattctaaaggtaaggtcccaaatctgaagtaatgacggtatccctggagtgactttcttccaaggtgaccattgtgaaaaatagcccttgtgagaagcctatagatttgtttaaaaaattagtccgattcctttataatcatggctcacacatgatgaagctattaattggttgtggtactaaaaccatttgcttgagtgaaatgaaacttctcctctctcagatcactaaatatactttaactgtggagtaatcattccgtttcttggactaagatatttttagatcaagagtaaa

SEQ ID NO: 107656 - DNA, 1067 bp, Homo sapiens
gggacgttaagtgatgagcacaaaaacacagtcaggattcaaaccaggtctgtctgactccaaagctgctttctcttttcattaccctatgcaatcttttgcagccaatttaaagccacagaaaacataccaaagaaacaaagacaaaaactatacaaatgtactggagaagaggaggcgggaaaacagaaagtgttttttctagaggcagactcactgatggcaatgagaactgaaatagaagtgagtaccttggctaaacaactaggaaaaaacacacaaaagaatcatgaaagtatttatataacttccctgttagcctctattatctttgatagtagtgtaatattttatttggattatcttttattattaaggctcttatcattttctagttgttagtatacaaagtattttgacacatattatgtcattttccactcacagaaaacttatattgcaagaaaggaagtattgctattcctgttttacagatgggagaactgaggcttgggtgggctaaatgatgtgtcaaaactttattaataataagtaacagaaagaacttaagaatctggaactactcactccagtacatttctaccatatcaagtcacttatttgtttcagaaaataggaactcattgtaaagattttcatcttaaagtttaaaagaaaactgcttaaacaggtaactagaaaatttacttacaacaaatgcctcattttcctattactcttctattatagaaaacaatgaagcattgcagaagctaattttaaagattaaagcaactcacacataactttgctactcacatgaggtcattttacagatactaattggggtcctctaacttcttttccacatataccatgttatttgtcattctacaatcaaagttttaatttataacttcatctggtagtctaaagtttagtttagatttttaaaatctcctatttaaatgcaaatatgcttatgaggggaaatataaatggtcaatgaatgtgaatgctgtagttgacaccttacaacaggacaccttacaagggattagtccagg

SEQ ID NO: 107657 - DNA, 1034 bp, Homo sapiens
actccctgtgatatccatgagattatgtgctgtatgagaaaagaatcaggaagtggaatgtgaaacaaaagaactggaaataggcctgcaatcaatctagcttggtatctcaacaaaccagtgacttttttttaatatgtaagaaattcagggcagatattacagccctatcatgacagcacggccttttcttcctcctcttctattaaatctacattttgaaggtggatggtgctgactcataaattaaattggagtaatacatacagtgtatatatatttctgtcactttgtctcaaattaaacacgaaccttctcccctgacaagatgatagaaaagttaattgctcgccctggctttaaattggaatttgaatttgcaaaatgctaaaggtttatgagatctaaatcatgaggagcttaaattacattcctgtgataaaatattaataaatcaattaaaacataagccgagtataatattactttttttttgtaagaaccttgaacacaataattcattagggtgtagtgcagtaacaattattgtatctttttttaattttctttttattagttttttttgataaatacatcatcagataacattccacatggtggattatcattaccccaatgcagcttccagaaattctgttgtacccctaaacaagagctcacaggctgaattgtctgctcttatttatccttgttagcatcagctgcttcttttactgaaggggtatttgcctcttgggaacatctgttcaatgccaactctgccattttgtggtttctgaatctctcttccaaaaatgggcataatcataataatactacctcagaactggcatgaagatcaaattagataatgtatgtggaaatcatttgtaggtggtaaaggaccatcaaatgttaattattattatcatagattggggaattttttatctctagaagggctcttagacgtcacttagtaatcaaccccctcattttaaatctgaaggatcagagaggtccagagaggttaa

SEQ ID NO: 107658 - DNA, 1762 bp, Homo sapiens
acataacaaatgcagaaattggagaagtgtaaatctatcatttcttttgacatttatgtagcttcagtaacctcctaagttgagatcatttgagatttttagaacatggatacctctagaaaaaatgaggaggttccagtagctcctcagaaatagcttagcttcacattgaaggaagattcataaggtctttatggagcaaagatatttgatcagaacaaacattcttatcatatggaacctttttcctgcaaaaaaaaatgactgttagggtaattaaattggttatttgcagcttctctcctttcccctcttccctcttccacctgcacagtattgttatattgagttgccatgataagagtaaaaaataatcaaaccaacctatacacatttttattatgaacaaaaaatacttggaaggattctattgatacaagctaatgcaagataataatttgtttattcaaaagtgttttgaatgtccttttccattgatcatgtgcaactggtataaacaaagatcctatgtatggtagagagcttatatttgcatttctttgtatatttaagcatttttagcagacttacatttctgtttattgagagtactctttagaatttgtgcaatcatatgtatatatcagcagcagacatttgggtaggtagtgaaggtaagttctatagtcagtgtaactagaagattatataaattaattatattagttttgatgctttgggtaaaatcagtgtgctacatgaacctccagttacacaggacaatatactgtgctcaaaagacatgaaggcagactaagagtacagaaaagctgttggttttgtttggggagttcctggctttttatccgcttggggaaggagcaggtcttattgtcagttgccaagtgctctgatgctgagaagtttgtcagctgtggttactttggggattttggcaatgataagcacttttccttgagaaaaatcagcatagataccacacattggaattggacaaattgcttttattttctattttctttaaaaatcaaattggcttttccttcttgtcccagctgttgcagcttccttgttttttagcttagatgatgggagaaacacatgttccctgagatccagagtaaagcttacttattttcttcctgtacagactacgtgaagttacgatactggccccaaatctaactaaacaaagttattcagaagagatttgacagagagggtgtctaacaggtgttgagctggggtaattgaatgggtatttcaaagatattaatgtaactcgcatatattagaaagctttaattgccatctccagcatgtttagacctgaaaacttcagggacctaacctgttccatagagaagtctttttatgcccctatggtttatagctggaaacaaagtatgtatgtaagagttggattggggcaggtgcggtggctcactcctgtaatctcagcactttgagaggtggaggcaggtggatcacttgaggccaggagtttgagaccagcctggccaacatggtgagatcccatctctactgaaaataccaagttagccgggcgtggtggggtgcgtctgtaaccctggctactcaggaggctgagtcatgagaatcgctggaatctgggaggtggaggttgcaatgagacgagattgtgccagtgcactccaacctgggtgatagagctgaattggttgaagtagtacacagtaaggcactaaacaaacttgac

SEQ ID NO: 107659 - DNA, 1050 bp, Homo sapiens
catatgtttttacagaacaatcatgatggtgctcccttaagaatgccctttgtattctgtcctcctgttctattctgtggtttgataagctatcaatgaaatgctgtgatatctacttgtttgaatgtattcagagagcaaaaagcatttcaggattgtttagtgaatattcatttttttaaaaaatgttttcagtccatgagatttttcctttactctggagtttaagcaaatgtatacgttatttataaaagggagggtctgcttccctctatataacctgacagaatatttatttaccttttctttttaagcctatgtctaagcacagctcatcttcacaaactgaagtggatcttgatttctggaaatgtccaaataatggtaagagtgctacagaggcaaagtcattgatgatacctccagaataggatgtattcataagttatttgtccaggcagtgttggttcttggataaagacaggctttcagttttcataatttctttaacctggaacaatttcattttaaaatatgaagagaatgacataaatctttggtttccaaggagagtctggaaagaaatagattgttagaggacagcgcccacaaattgagaaagcctgttgggggccctttgggaatttggctggaaaattatgttataagcagtccttctgctcagcttcatgggaacatggttttagaaatgaaatattgcttctgtgttccccaccccccaaaactaagacaaagatgaaatattcatattatcctttattttcagaaccttttgtgttatttctcaatatgttaaaaaactttccttaattccttaatgattctgcccaaagggtactttgtaaattctattcattgatggtgtactaaactcttaattcctggtgaaggcatttgaagccaaagaccttgctacataagacatttataatgtcactgggatgtttaaaggagaaaatcatgtgatccaaatggcaaataaaaataaatttagtaacatctaactaaatatgaccagttttccattta

SEQ ID NO: 107660 - DNA, 1038 bp, Homo sapiens
tgggggataggagatttagggacctagaatggaatacctcatgtacgtaaagtgtcttgcagttcacaaagcaccttcctaaattattattttaattacagttattgaggtagcagaactggtgttattattttaattttgcagatgagggaactgaggttccaaaaagttaaatcacttagccaggaaatgtcatagccaggtttttctgataggttgtccagttctttccacatgcctcattgtcacccagaagcaacacaagggagggttatatagttctatataactctctctatgcttctatacgcatcatatatcttgttttctaatgttattctaaatatttttcattcacttggttttatatccccattttctccattttaacatgggtaaaatatgtaagacccaaactgagggagatgtgtatgggtaagaaactgattattttggtaactggtatggatatgaaaaccataacgagtctgtggattgcaagcattttaatttattttcttgacttttgagttaaagaaaagatttcaatgtgaaggtgcaaaatatgctgcactgaactaatcttggaggtaaccaaagggctgtgggactaacagcttttgatattacttagtgcttattattgttattattattatttctttttaattatgcaaagtgctaatcagtttgattatgcacagtgctaatcaggttaattatgcaaagtgctaatcagttcttcttgaagcacacgaggagagcagaggtgctggcggtgaatggcatagctagatgggggtagtcacggcagtcattccttattaagataggagtagacaagatagcaagggggatttatccataaaaataaataggaaaagaaagaggactatgagcacatgaaagattgtagtttgggcaggacattgcttacacatagaaagctcctcccccctgtagcatagtttggttggatagtctctgctatattttgaaggcactcatttgaagccaaaaagactgtagagggaagga

SEQ ID NO: 107661 - DNA, 1046 bp, Homo sapiens
caagttcacacttctttgggtcactaaaattgtaaatttgcattatcagatgcagaaaacaggccaaattaataatgttaaatatatgtccaaggaaatgcatctcccatgaccatttgcagcacccagatacggatgataattccatcgaggctttggtgccaattcgtacctggctttataattttcagtttgcccttatgtcctgctttacatttgtatagcttgttataatcttgaagcatttttgtgtaccatatttcttttttgtgtgttattttagacatggcatttcagaaacttgaatgagcctagtgtttattttcagttggttgtgaccgcagctttattagttattttgtgtgttttcaataattgttaatatttacaaaacactgaacaaacctcttcaagattgctttacataatctccttttccatgtgtcaaggatgagagctacagagagaagagtcatagtgactcaccccgtatcacagagtatgtgaatttactttcaaaggagagtcaagggtccctggttttcagttcttttttttttttttttttttaattctccaagagtcatgcaggtttggagacttacaaagggatagcattgctgagtggagaaacatttgactcaagtactcttttacccctaacatctattttaccatttccctccctatattcaagtcttcttttccatcatctctccagtagatgctgaaaaccatttctttttgaagagctggttcatatgataaagacccaaagtctcaataaaatctattaacctgttaagggtaagtgtatgcattgttcactggagagcatgatgccatattctaccctgtctgcttgggaacaaggccgatggcagcacaaattagcatcagaacagagctttatcgcagtggaatcccaggttgttttaggaatgagacacgaaacaaaaatagataaagggattaaatctatcaaatataatagaggaaattgtagtagattcagggaacttggacccctgaattgtagtaaccaa

SEQ ID NO: 107662 - DNA, 1089 bp, Homo sapiens
ccttggcagaactaaaccattgagacccagaggtacttgtgcatggggatggtctttaagataatatttagtttattcaatgagccaaaattttcagtacatttattgtttgtttttgtcataaagacatggctacagtctacatacaaaataccaagtagagatttgtttattgtagtaggtacaggtgctcaaaattgatatttaagtctcaaacatatttttccaccattctgtattggattattaacacatgaaaatatgtactgttagaactataaggtaacttacagattattctttgagctaatttaattattattttacaaatgaggaaatgaaatcccagtgaagttgaatgatttactgtgggactagagaagtctagaatgagaaatttaacagtgcagtactctttacttccatgtatatacctttcaccatttaccattacactgaacaatctttctgctatttgtatttttaaaatgtgctcacagggttaaaaaatttgaatggtacacaaggatataaagtgaaaagtatgtctttaccgactgatagcactattcaccagagataaaaagtttcaactgtacttgcgtagagaaatgtgtctatatacctttaatttaaaaacagaaagggaatcatactgttcaaatacatttgtacttttttcttaatgccatgtcttagagattttatatattctagaaattttatagtgtttatattttggtatattatattttaccttttcctctttttaaacagctacttaatatttccattttatggatgtcacaaaatgtatttaaccactgcctatttatggaaatttggttatttacagtttcttcgctgtttaaaaatattacaaaacagctttctaaatatatccttgtttttattttaatatccacatagcatactttcttagatatgtttatataattaaaattttgatgcctgttaaaaattttccttcaaaaacatttttctgacacacacatgtaacaacattatatgagaattcctgctttctcacagcctcatcagtactgggctttagcaaatttttcctaa

SEQ ID NO: 107663 - DNA, 1256 bp, Homo sapiens
cagtatgcatccatttctgtcttcccagccataagaaaaaaactgactctaacgtttttttttacttagagttgcaaacctcatatataaggctctggtcatctgcaggatctccttagaatacataaaaaggtgataagtgcctacatgtgattgctaagaccattacacggcaccttggtccaattccagttgagtaattatattcattttgtccttattttccttttcctgattgtttcagttaaatgtggaaagtgatccttcatttttcacccagagaagttcggcagtgttgctgcacgtattatttagactttactgcctttcttttcagtcataggaatggagcttaaaagtgctggttagaattgttattgtggctattactattgttgcagtgttgcctgattcagaaatgttctgtgaacatcaagcacatgactggcttttggatgagctgctggactgtagggtgatgtcttcaacaagccttctttatctccttactccttgcctagcttagttccttagcttaaagggacagacatgctttcccttttcatacaactatgatagtactaacagttcccttttatcaaatgcttacctcatggctggcactgtgctagttcctttatatggctataacatataacctgcatagacaacctcgtagggtgagtaacatgatcaccattttacagacagaaaatttaaattgcttaggatcacagaactaaagatggggagctggaatttgattccaggtttgtttgatggcaaaagctaagtgcttaactaccaccctacctcataactctactgcttcccagaactctgagccccagtctatggatcactgatcacacaaatagcttcttaccttctcttagtgtttgtcaccacttcacacagattgaccccattgacctcacattggaataatcctgcagcactggcctcagaagggcattgctgattatgtttacaggccagcaggaaactgaactgctattgagagaatctctatgctgaatcattttatctgcataacaaaagtggtttgctctatcttcttttctttccctggtggtgttgtcataacagtgtcttttagcaggattaaccagtaactaacttatttgctttggtttccaataaataactgcagcctgttaataattgtgcatgtgttttatgtggcctcagataaactgagacaatcttacacatctgcattccagattgggtca

SEQ ID NO: 107664 - DNA, 1048 bp, Homo sapiens
gatttcagaaaagagcaaagtgctgtggcagaggtaagcatagatttgaggaatcgtgggcagcaaagtaaagaaggctttcctgaagaggtcgcaggtaagtggaggtctaaaagatgaagaggactctgccagggcagagtctagaaatggggaaagttggggaaggtacattttaggcagtaggaacaatgcttggtgcaaagatccataggtgtagggtttcaacagatctataactcgatgagattcatgcattagggacctaagagagacagaaaagggcaagtacataatgggttcttgtattctaaggtggggtattccagagatggagaggtgctggattaatgctgcatttaccttgaccctttcctgtggtattagtagggaaggaaggaaggatgattctgaatgcagtgcaatggaggtagcaaaaaattgatctgatgacctttattttctcattgggatagagagcatattgctttgctgataccgaagggggaggggtaggtggaatagaagatttaataaaagtgggaagttttgaaatagatgtaaaatatactaaagtaaacagatgattagggaaacttggaaggattattaagtaacatttgggacccagctaagtttgggagctgtagatgtgtagtggttataatctgtgagtgtatgtgacccactttagctgttgcagttctaggagtggagaaagcagatagctggactgctctaggcctgggttttcacctatgttgacgctcttcctgtttccttccaccactcacctcttgtcacagaagactgcttattcctgatactgtgactgtctgcctgaaggcattttttgtgtgtggctgctgagcagatttggctcacagtgttgggcaggcttaaagtaccaaatagttactgtcactagaaaaagacttaagcaaataactgttagcaagtgggtggattacactatcatccttacccttcacatgggataactgtgaggcatgttctttactgttttccagagtatcccagaaggact

SEQ ID NO: 107665 - DNA, 1025 bp, Homo sapiens
gtttacaaaatgcagtaattttcagatggtttactaatcttatttacccttcttttctgcatttttgctttaacctaattttttttaaaaaagaaaatcttaattggaaggatgttttgagtcaagaatacgacacttcataatgtaacatatattctggattcaaggtggcaggtaataaaaaataattggagtggaatttcaatgtctttatttccctgaagaccagccttgaagagcttcctcaagtgtgtctcctcttcctaaaggtaacatggtggggaagggagaaggtaggaattactctgacaagattttagttgttctaaatcagtgtgattaattttatcttaaagacttaaaatgtcccatattccctagttgccaagaacatggtagggaggaggcaaagtacacattctttgtttcaaagtattttgcagacagtctggtctattaagaacaaattctaggactaggtagtagggcttagaagttaccatgacccaaattgattttttcatttctcttaaagttgatggttcattttttgatgaaagtagcaatcatatctataaaaaccaattttgataggcctatcaaatctgaccataaaacagaaagctattttacattctacaaacatattattaaataagctcactgtgagtatacaagtactgtatgcatttttacttatgaaaatctttttaaaactgaagaaattttgaaacttttgtgatgataattaacaattatatgttaaaagccagtatggaagcctattttgtcataacattataacaaggcaacaagttttaactgaacaatggattcctgagcttctaagcaaatgcattttgacgtgttatttttcactatatgcaaatttagaagagactcagtttatcatgacctgtatgatacctcttagaatgttaaaaagaaaaaaaaagatagaaagaggaagggccacagtacacataaatcttgcctgcagcttccactaaagttactctggaaag

SEQ ID NO: 107666 - DNA, 1005 bp, Homo sapiens
aaaatatataaggaactcaaacaactcaatagtaagaaaacaaataacccaactgaaaaataggcaaaggacctgaatagacgtatctcaaaagaagacatacaaatggttaatgggtatatgaaaaaatgctcaacatcactaatcatcggagaaatgcaaattaaaaccacagtgagtaccacctcacacctgtcagaatggatgttatcatgtgaccatcaatggaggaatagataataatatacataaacatgatgcaatgtaagtcatctttaaaaaagaaaatgctgttatttgtgacaacatggatagacctggaggatttttaagtgaaataagccaggtacagaaagacaaatgctgcatgatctcacttatatgtggaatctaaaaaagtcaagctcatagaaacggagagtataatgttggttaccagaggctgggatgagagactggggagctgctggtcaaggggtacaaaatttcacttagacaggaggaataagttgaagagatatgttgtacattgtgtaaataaaaatatactctatacttaaaaattgctatgagagtataccttaagtcttctcactacaaaaatatgtggagtaaggcatgcgttaaaaatagcatgttgtatatcataagtatatacaacttttagttgccaattaaaatttaaaaaacaaaaacaacatcatgatatattaactaagggagaattttcaaaaggcagaaaatttctgaaattaattataaacagatttttatatcacaaagtacatttaattatttgcagatttctcaggattccctggggtataaacctaacagcttctctttctactggcttccattaatatgttatcatcccatctttcagatagacatattttaggaatttttttccacatggcacaaattctttgatctaaatgcaagggcttccaaataacattatgggaggtttgaaatttgaaaatgtttttcaaagatcagtag

SEQ ID NO: 107667 - DNA, 1043 bp, Homo sapiens
agatatccagatgtgtgaacactttgctgatatcatcagtatttgaaatggaggaatttagtatgttttttattggataaaaataagatatttatatagctgaaaataacaccaagtataacgttttctgctgctatttaataaaatctattaatatttagatgatttcttcacttctgaacaggttttctcattttgtgctaaactgtgttctttgttgctaaattcacaaaattaaatctaaaatactatggagagatgaatacttaaaaacatctgaataattatcttcaaggttacacaaccacctctttgtattttaagtattttagaaatggttaacttggttttgttcaaattattctctaggttaaaactagcgtgatgtgtttcataacagaaagttaatttaggcaacagcactgaaagcaaagaactcttcaggaaggtgactcttttcttatagaatagatagtattatcctaaaatgtttcccatgaaaaatgttttcccagtatgtttgagtgtactttttaaagattttttaaaaaaatatttaactttatgtaaatattttcattttaatttcagaattatgttactaccttagttaactctagagctttgagtggcttgtttttaacagactgatgtaattttggagttctttattgataggtatatgtgaacgtttgtttatttaacctgtatgttttgtacttcctatactggacataccattttattttccactggatttgagattcagtcttgactgaactattcactaacagttgggcaaattactttagttctctgggtttaagcctacacaccgataaaataaaatggaaaaaataacatctatctcttggggttataattaggattggagatattattaataaattgatgaattgaatacctagcacatagaaagtgttaaataactgatgattatttaaattggagaaatgttcaccatatttagaaaatattaaaacttttttaaacaatttccatctttctgataaatttgctac

SEQ ID NO: 107668 - DNA, 1042 bp, Homo sapiens
agattaaaaattgtggagaggccaaagtatttcagattatgttttaaggagcaggtggctttgagatgaagctaggtgtggtaatatttgcatccaagatgagtcgtaaacagttttgtaaacctggcttactttatatgatatagaagatctccatagacatttgaaaatctcagattggaatattataggaatttctagtatttttaaattataaaaatcatttcttttgatgattatttatcaatagcccagagttcattcgtgaattggggtatagtaatgatgaaaaaagaggaggtgaccgaagtgtgttttcttttttctcattgggtgtatatgtggagtatttttgtcttctgatcagatagttcattatgctcccttttggatgtgtgtactgtttggccttccaacctgcatgcttattcaaaggcattccaagtcattatgttggacttcagccttgttcagtaaaaggctatttcctccatcagctgtccacttggacatacattctttttactcgcaaaaatatttcatatgcattcagtttatattagatgcatttgtcaaattactcacaaataatcagttttttaaggttataatttgaggtatgacctctcaaactgtaaattataaggtttgacctttttggttcacagtttgacataacagccattaattacagtttttaaagaacattttatttcatttagaatttgtattttgaaaacagtttaagtattttctctctaagtttttggaataaatgtggaaatgtaaatgcatatgtatctatatataatatatacattcaaatatactaaatagattgcatatatacgcatgctatattcaaatgtgtttatgcatagtacattggtatacatatatacaaatatttttatataatagcttgtgagttaacactaagatcttcttttatacaactctagcatcaggatgagatcaactcttttttttttttttgagacagagtctcgctgtgtcacctaggttggagtgcaatggggtg

SEQ ID NO: 107669 - DNA, 1050 bp, Homo sapiens
actttgcgaactctctgttaataagaatgagcaagtaaataggttaaaagcaatttgggatttgcttttcttaaaagaaaacatgaaataaaaatgcaaatatccttatgagttaagataacttcttatgatactatagcaaacaccgtgctatgcctcctcaaaaatgtatatgcagtggtttagattgtatatttgggccacgttttactgagtacttgtacacatatgaatgtgttagctttcagttttctttttaaaactatagatattagttggcatacacaaactcagctacctgggtcataaagatattatagaaatgcaaatgttttccttggcagatttctaattttaagtattcctttttttacagacaaataaaaagaagtgttaagaattgcctttgggactctgaaggctgaaggtaatgtccagtggtattttcctgaatgggctttatcttcttgaattgtcttataatatttaaggtcttggatttgctacctcaacttttcttttattttattatttttcttttattgtccttaaacacattaaatatctttttctatgtatacctaaaaataatatgaaattgtaagttaaaaagtagaaattttatactctttctgaatatttcagcttaattaggtgttgctctaactcttgttccttctatttcattatgtattatgtccctctgtcctcctttttttttttttttttaactggtttggaactcatgattttaaactgtgttcttttgttaaacagacatattggcttaaagtcagaatgtcagtaacaatttctcctgaggaagagctttacaattaactataagaaataaaattgtatttgttggggacattgaaactcttcagatgagatttagtggctactgatagtcagaagtccagaatttcaggcaagaagtttacaatagactcgtgtggctgcattgtgtataaagagctcacagggattgaaggaggcttcttagacaagagggggctgtaattacttttcttcttacatgcatggtta

SEQ ID NO: 107670 - DNA, 1034 bp, Homo sapiens
ttctccactctaaaatgtgctcatattaattaaatatagtcataaaatttatccagttggatatatatatatatatatataaccatttgtccttagtaaagcttgaaatatgtgaaatcatggcacttcttttttttcccctgaatattatttcttggtcagaacattatcttcctccttggcaaaaatatattgtgcctttatgttttagcaaagtatctcaaagaatcatataaccgtagcaaaatggagctgaagggcaccttagagcccacctacccctatcatgcacctggcacctgagcctcttctacagcatcaagtggccactgagacataccaggctggaggaactaagtaccttttaaggcaacacatctaattcttagtgttttaatagcctaatatttgtttagcgttttggtactaatacattccaagtttctgctgtctactgacttttcactatttgttcccttagatattcatttgaaatctttttagtttaacctgatttagctgtttctttttattaaaaaaaactcgaggtaacttcttttctgatttaatgtagcaataccagaaaatcccttttgagtttagtctttcagattgttagtaaacttaatgatgagaataggagtatttgttatttttctgcaaaatagttctatctatatttctttctacttctcattgtgcaaagtctgttctttcattaagacactgtaattacattatagtcagtatgttttaagtaaaattctgagattcctttactttttcttgagtcgtctaaaaaaatatgttttgataaaatcaagtgaaatatcctttatgacttcaacttcttctggaaatacttgtcctctatatattttatcacttaatttgccaattatgtctactccttttgaataaggaggaaataccattttctgaaataaaaaaaagagaaagagaaaaaacagaaattagagaatattttaaacaatgtgttttatgtgttttttaaatgtcatcaaactcattct

SEQ ID NO: 107671 - DNA, 1030 bp, Homo sapiens
ttagtgtgtttaaagagttagatcattgggttaatcatgctttgccatagtatcattgctatcctttaaataaaaaaaaaaggtttagttagaaaattttttaacaagataaaattaaccacagactataacgaaaagtaatttcagcaggattatttattctcccaaagttgaaaaaacaacaaaccaaaaaaggtgtatatgtgacatctacttaattttttaaatatgattatttccatcttttgttctttgatctccacatgagcagagacacataaagtggcaatggggccaagggtgctagatggcttggcattcattaactatggcaattagcaccatttagattgatatgttcccaagatgaaagtaagaattggactagacaaaaaaaatgatgatcgcatttgtgaaagtggaacaacactgaccaacaagaaacaaagaaacagagctcaccttaaaagacttggaatatttgaaaaattgattatgagataagataatttcaacataactacaattccttgaagagttattaatgcttcggtagcattaaagtaaaatgaaaagacaccagggcagtctgctttaatagcttgctggcttgaaccctaatacataatgttcttgtaatagtttatgggtgactgcagtaaattggtagtgaatgtttttcatttttttggctcttcatatcagatctgctcttggagaacattttgttctgagaatattatgaaggcagttcatctactttagaagttgcttgacaattttaatacagtgttaacttttctcccctccagattgtgtgatttttttgtcctttgtacccgacatcaatttatggtttgaaattcagcaatttgctcagttatactttacctaccctgactaaatattttaagtgctgccacaagaaaagaaaaaatctaatttttcccaatgttgttgttacccctctctgtttatatagcagtttaaatctgcccttcatcttgacagagaaaaaattttagatgga

SEQ ID NO: 107672 - DNA, 1011 bp, Homo sapiens
cagcctgataattcaaagaagacttcttgttgtctaaagggatgtcagaaatgatgcttgaaagatgaataggagatgtatagacagggaaggaaggaggatctcttcagtcaaaggggactatatgtataaaagcatggaaattataaacatggtatatgtgggaaaccattatacccaaatgtaagtgtattttacaaagttcctataataatgtatgtactgttttataacaatttctccgtttaacactatgtgctagttgtttttcccaggtccttaattatttttcataggacattgttttcagctgctatatgatactctgtcatatgttgcaaatagttttttctaaatttattgtttgccttttagtttcatttgtttttgctatactgacctttcatttttatgtgttcaaatattctatttttaaaaaccatattacattttttatggcttctgcctttgcttttatgcttaggaagaccttctccaacccaagataagattaaaaattcttctgtatttgcttctatttcttttatggttttattgtttacatataactcttcaaaccatctggaattttattttgatatacagtgtgagataggctctaaatttactctgttctaaatatttaaccagttgtctcagcaccatcaattgaaaaaaaatctatgtttttcccactgatttaaaatgcattatttatcatatgctaaatacttaatttacaaataggcttgtttcttgtctttctatttgatttccagcctattttttctcttcagttctatcagtttctatatggtttactaggactacactatttattgtggcttttacaatacagtttaaacctgctaataaaagtttctttttagtatttttcattttaaaaggttactggctattcttaaccaattttttataagagatttagaattatttaatcaaggtctctctaccactgcccccccccttcaattttattggacttctgag

SEQ ID NO: 107673 - DNA, 1071 bp, Homo sapiens
taaaaatcagacacttgtaggttgataactgcagattccaggccacactgtaaaaacatccaccactcagcattattaaatattttaattctgagctttgagaagactaatagaatcatattgtaaaactgctttaaacacctccagtctctgcttgaaatatgttcactaatatttcaagcaacacgtcatctgtgagcaattctgatgttaagaggttcttatttactttgagttgaaacctgtatctagtattctcaacccatcattttattaatagtatatgccttgggaacatacagagtaatctcatttgaagttttcaaacatttgaaacgttttctatcccgattgttttcctaatcgcatagtcaacatgtaatacccttgattctttctaccattccaaatatgttatgattctagtctttcacccttcctcttcccccttcttaggatattattgtgcttctgggtcatgtatcacagtattgatcatgccatctgaccattgctgatgagagtgggaatgtcatctccctcattctagatactgttattctgtcaggtcagtttaagatttaattggaatttttcagtacccatatcacatggttgactcatatttgaccttactggagatgctatctcctcttatccaaggatacagtaacaggtcattgagatattatctagttatgatgtcagagaagaaggcaataatctccagtaaagggagagaatgcaaaaaataataataaaaaggtaaaaaattgcataactttgatataatgcaatggctaaaaggtgaaaatattattttaaaatgttaaacctttagacgttaccactttcatattgcagatgtgtgaagcaaatgttgatagtagtatatagtttttagaattaaaatattaaaattttaataattttaacatttcctttgaatataatgacgttaatagtttaccaacaacagatttttaaaaattgatgatttctataatgttggatgcattgtttacatttagggataaacttgtttaggcaaaatttagctgcagttttata

SEQ ID NO: 107674 - DNA, 1035 bp, Homo sapiens
ttatttgcaggtttcaatatggaaattcttaaattatagaaagaatatgtattctaatgaaagttgggatgaaatacagtagaatctcatcaataaatgtgagttaatatacacatacttaatttacacaaatttaaccatatgcattcatttaaaaaagaaatttttatcaaattattgagcaagtactctcactattccacttaaataagctcttgctgattagtgaactcaccaccctgagtgagattggagttatggttggcttccatccctgtttacttctcaggatgtgagcatcttgccattctgagtgattctaatatttgatgacaccaaaaaatacatagctttgacctaaaaccaattcagttactttatatggttctgaactgaaataaaaacaaaacaaagcaaaacaaacaaacaagaaactgttccaacgatgaaggataagaaaagctctgttggatttatagggagaagatttatagtctccaatgtgttacatcttttaaagggatagatcaaatgctttaaagtcgttatttctcatttggattcacaggaaaacaacataggctttgttttgtacttctttatctgtggttaacaatatttagttcagggggaattactgttcttgaaaggggagctaaaatggctaaaccacaacagagagagttataggcagtgatgtcagcattcagattagcctttactgtggactttactgaagagtacaaaaaactgaatgaccagagagtttgattagctataaacgttttttgaaattaattaaaaattcaattaaagaatgaaaattattattactaaaaacaattcaaacatgaaaatttttacagtgctcattttgcagtgatgggattctgaataattttatcttctgaaatttctagctttttgcattttctgagtctcctataatagcatttacagtttatagtgaaaattagatatacctcaaacattataacaaaactctcagtaatttaaatttatgatttcttaaat

SEQ ID NO: 107675 - DNA, 1031 bp, Homo sapiens
tcctctgaagggttttaagtgaggaaatgacttcttagttctattgagaaaaagcacttcagcaattgagtgtggaagaaggggtatgaagaaagcagaccagagtctgtgagactgttagaagacaattaatggaaatcagggtgaagtatagtgagggcatgaactgaaacagtgactgtgaagctatgaggaacctaagaggaatggattcaagggatttttaggaagtagaattgataagatttgggtactgtatcggtgaaggggtggaagttggatgctgttaaagaaaaagagaagtttaggatgactctcaagatgtttttctcgagtacctgggtggtgccatttgcagaaaaaaaaaaggactattttaggagtaggaggttggtggccagccagaggtcaggaaggaattgagggtagaaacttaggaaagatataaaagattcatttgaatttcaaacacagatttaccttgctttgagaaaatatgatgtgattctgtaacctgaaagagtaaaagttaggataagtgtgttatgctgaagctgaataaggggaatgagtttcatgggagagtattgattagggaatttctactagtagaaaacaggatgtccagagtcaaatatttattcttggagacattttttcccagattttctttaatgacagctctcctccattttatatccaaaagctagattggcttattcaaatgtgttaaccctaggatgtgtctgggagtcttctgagtcactactttaaggggatatctatttgaggaggcactatggtaatgaaagcaagtcaaataccaaatgtatggattgctatttaaataaccttgcacaaaccacttaacctctttgggtttccattttctcacttttataaaataagagggttgaatcggatgatctctgataacctttttatagtaagagccctatgattttatgaccctgtgaatagcatgattatagctctaggattaacatcttcaggaaatttaacagcagact

SEQ ID NO: 107676 - DNA, 1001 bp, Homo sapiens
cgtggcatattagtggaggtgtgtggaatgcttacacagtactcacccacactgaacctagatctagccaacgtgtttctgacttaaacgaacactcagcttcacacagttctctcccgattgaaaacagaggaaacaaaggaaaaagaaacaaaagtcgtgacaaaaaagactgttagctaagctagaatagttgtgtggtagtagaacactgattctaatagttggcattgtactgtatgccttccattcctaaatgcttctgctgactgctaggttgtaagttttcattaatgaatccacatttagaaactgctttttttggaggagaattaagcttttacctgctttctttctgaatgctggggcacatatttttgtgtaatttcatatcctgttttcctccctaagcatgtgctctttgtagaaaagagactcacacttcagagtaggagacagcatcaagactgctgaaagtttcctcttggtttgaatgttatagtggttgattcagtgctggaggcataagaatgaatgcactatcaaactgtcaacttttttttttttcaaacaagcaatgcaatactatctacagtgatttacatggcatttttctaattttttaaaaaataaagcaagtaggtagcaaagtggaatttgaaacattttcccaagttgaaaaaaatttaaatggtataatctaaagttaagtgcccagttgctttcttaaatattataagtatcactattggtcactttcggggcctataatggaaattaggtctatttgttcttcagattatagtctatctttacctgtcgtgaagcttttggataaaagaaatacaatcattctatatcgtgccttatcatggcattggaatttccacagttcattcctatctatgaatattattcaagtttcttctctactctttcttgtgcttttatttcagtcattacaaattctatcaatttcaactgtcctcagccttttgccc

SEQ ID NO: 107677 - DNA, 1849 bp, Homo sapiens
ctatgaatgagtgaacttaatcagaaaaggccgatgccccagtgcagcattgtctttcaaaactttaggtgctgcttttgaccctctttaaacatggatatccaaggcagcttaagagttggattatgcgttgctgtgaccaactgaggggccaagagcaatggcagctgtatggcaggttcttatgactcttaattctatttggagcacttcctgtgggcaaactcttacctgacacagctattcgagatccttagaacccatgagacctgatgccatgcaatgagtattccgtcagttacatcactgagacctcaaagtctgtgatcttaaccagcatgctacttggtataacaagcatatttattattcattgtatctacatcagttacagaaaagcccaatacctattcttccatacagttttaaactctggggtgatatagagcttcaactcggaggaaaaaataatcaattatataatatggtctcttatgaatgggaaaccctcaaaactgtataaccaattagaaattattcaaatttcttttactcgcaagaatgtttaaatgtgggtgaattgcagagataaaagaaataaaccctgatatttctcaagttctgccataaagaagtctagtttattgccttagtttcaaaagaatagttttctaagtatttcaaaatgtccggctggctgccccttccattctctttggaagcttctttgtcatcctcgtggcacatccctctggcatgcatgaccagctgcaagctaaaccctgtggaataagaattctttcatccctttgtgtgatgtgtttcattttcagagtttggatgatcctcttcggcagcagcagcaggcattgttagtttcaataggctgcctggatgcacaagaacagtcatcatagagagacaggctctcagggtccgtcccttcatgtcatggtgctgtgttagatcactttcctctgctggattaatggtcagagaaaaagggaaacaaactgtacccaaaggaatccaattaaagcacttgaacttcactgacgtctatcctattgttttcttaacttcctaacctatggttaattattctgaccagtggaaagaaacagcataaacatgggaattatcttaaattccctactttgtttagtttgtaaaggcatcaaaattttactgtgcaggatggaatactaatttggtatagttgaaattttttttggctaatctttctatttcttctttactctcctcaccaaaggcactgccaggacttaccgtacaacactccttggcttctggaattttatctctgctcacagtctacattacaacattagttcattctgggcactttagcttccttgaatctccagttgatctcacacccatgcctatgatattcttctcctggttaatcaagaattctctatttctgctccgtcatccatgccactgtaagtaggaaagtaatttaggcttttgaatcacagccttgtcatttgtgaaatgacttcccttgactctgaaattctctgtccaaaatataagctaggatttccagtaataacaatttatatgtataagatgattgatagtttgcagagtgtctttatatattttattttatataattctgactacagttttgtgaggagagaaccattattattatcttttttttttcagaaaaggatactatagctcagtgaggtgaattgatttactccatcacataagtagtaactgcccgaacctgaactttaaattcagttttccccaccaagaggtgatggttttctctagtagggagaaagtttctttcttaaaaccttaa

SEQ ID NO: 107678 - DNA, 1037 bp, Homo sapiens
ttacattcttttaattcacttgatacaatctattgttaaagaaaaggaatatcaaaatttcagggttcaacttttttttacctcatggttgttgtgaggaccaggtgagatgattaacataaaagacctaataaggtgccgagctcttgataggtgtttgagaaaatgttagttgttttcatttctattatcttgttattaccattgctggtttcttcattcccaactacctcaacccccatatcatctaccccactctctctctcactcttcatatatatatatatatatatatatatacacacacacacacacacatattcttactgataatgttgttctatacttagactaaaatgtatgaaatatgtgccataatggtcattaagaatagacataaaataatcgtctgtaattttccaatattgaagttagctaagagtgaagatcctatgagtgaaacatgtgaaaactttagttacttgtggataaaatttctgaggagttgtgaggatgaagaataatttctcataaagaattttaggcacactttatatatagtttatggtttaccagagttctggcttagcactcagtgtgattattcctccatagcttcatattgctcttttattcattcattcatatcaaaaacaacatagaatatctattagcaataacacgttgttctagatagtgtgagatatacaaataacaagattagttatatgaattgtctctatatttaagaagtctattaggtgattcagatagggaagcaatgaggttatgtgcatggactttggagccagattttctgttttgaattcctgctctgaaactcactagttatttcacttcaggcaagttatttagcctgggtttcagtttccttatctacaaattgaggctaaaagtagtacctattgggttgtcctgaggattaaatgatttggtacaagtgcatcatttagagaaataccgtggtaagctcttttcaagatactaattttagtttcttttgataaatacctaaa

SEQ ID NO: 107679 - DNA, 1058 bp, Homo sapiens
tggattgagatattcaaggattgtaatccttcttaaaaagtaagcagcatcgtactgaaatgcaaggaaaagtcttagatatgaactggatataggatagtgtagtttatttccaaccaaaccctacagatgtgtgttttaggctcttttaggttttggttatattactgtgatctttctgctggggtttaaaaatgatgatgaaggaagagaaactgttaaagtttgttctactcaacaattttgagatttatgtgattcccagggttgttttagatattgctttacatagaatccagagaatgatgattatttgataaaaagaggtatttgcctttaatacccagttgtttagttgactttcttggatattatcacattgaagcataattagaaacagttttcccagtgccagtttgtaagggaattcatcaatgtttcttctagtacttgcatgatatcctatagtaagtttttctatacagtcagatgtatttctatattcttctattctgtgccattgacctgtctatgcatgtgatattatcacattattttaattatagaagctttataacttgtttttatatctgaaatgttagcttccctccctgcttctaccattactctttttcagtgttttctggcttttcttgcatacttgttattccaagtgaactttataatcaactagcagatcttgaggaaaaagaaaatccctgatggcatttctattgaaattataaggaatttatgaattaacatcacaacaattaatgttcttatgagggtgaatctttttatccaagaatctgttttttatttccatttgctcagtaactgttgtatcttgctgaaatgttctaattttccttttggctttaggtttaaacatttattattaagtctgccttttggtattgcatccacttatttatttacttgcttactttcttacagccttactatactaaacaggctcttttcttctatattttctagctggcatttgtttctgtgtaggaaggctgttgatttttgtatgttaactttatagt

SEQ ID NO: 107680 - DNA, 3020 bp, Homo sapiens
gccacgcaattagtgctttatttcatgagcaccaaattcacccaatagtgttttgatttaaggaagagcttgaaattcacaataacgggtttcatttatcagagccatatgggactcaacatctttggatatatttgtaaggctttcacaaagaagactttttagacatctcagatttcaccgattggagggcaatctggatgaatatctttttttggaaaagatgaactatcgttttcacatgtagtctccaatttcagtattccttgagaagctcaaaacaacaacaacaacaacaacaaaacaaaacaggaaagcgttaagtaagtctcagcttattagcttttactggaaaataaagaccatgattcttagatctggttcagaatgccaagtgaatctttgatgttgaaatttggccacctaatctttgcagtttgtgatggggcatttatgaaagagaaggtgggttctaagtctcaacatatttgtgcactttttgctagttcggtcttggtcatatgtcagtggattcttgggacgctttctgcagcatagctaactgattaacatgatgatactttttatatttactcaagattatttctttgttcactcctgattttccataattttctgatcattagggatctatcttaatgcaaagtattcttgaagatgttaatataaattaatcttttaaaaaaacaaatctcatatttttccactgatctgttaatttagatattaaaaaaacagattgaccttcatttggcaattgttgttaatactttaatttttggttcacagattttgtttagtgggctataaatggcctataaacaaatatttcagtgtttactaattaaaaatcagtattttttttaagcatagagtgctattgtgttatgagacaggcaaccactaattctgttaggttttcaactttttattttcttagttctctagtctttttttttttttttttggcactcttcatgcagtatggtaagcctggttaagtcagaatatttacaagtagtaaatattactgtgacagttgctacttacctatacaaagtctatgtaaacatcgtaaggatgataattttaatttgtaaattgttatggtaaactggaaattacttgaaataactcttgctcatctttaaataccattttattgcatctaacattattttactatcctttattaaaaaaacttttaacactttattagctaatagtgcttatattagcaagttttagttttcacagacaatatccactaaactttgttcagttatgagcatgttgaataatactaaattaaaacaaaatacagtatattcttggttaccatttacattttatattaataccaatgtcatatattttaatgctatttcaaaaatatttagaaaccctctctctgctccctaccatttcttctccaatatatatcctactctacagagagagcacttaggaatttgttatgtagcccatctctatcatgcacacctatattgctatgggtcattgacccctatgctataggccaatgagcctgctggacaataggtagaaaattggaattatagcatgagctataattatagcttaactgcttaaatcaacttaacatgaattgtgctgaatggctgaatatattctttctatatttattttgtagtcaaatgttctaaaataactttctataaaaagtataatactcttaggtttaagttttattattcacctttgtttacaaacataggtattgtaatccaatgagggtaagtgttttcatcactgaaaatttcattatggaatacagacttttttggtattttctttgtgaaacagtatagtttgatggcaacaaggaaattaaagatggcagaaagactatatagatatagtggtatctaataagactttggatttataaactctaggctgtgaggagaagatgggcacatggattgaaaaagaaaatgtggatgcgatgatcaatggttattctttaataatattcctaatgaaggacatatgatgaggcaaagaagaatacaaattgatggagtatatgtatgaatgataaaatagttgtatgctgagagaaggagattgtgaagcaaagagataagagttatatgtagctttgtggctataattgccttggtttttgcatttaccttgagtttccattgtaggtattaatggctcctgtatataatgttcttagtataagtagaatccataaagcatttggtttgagcaggaatatttatttgcttgtgaggatagacctgtttgactttgaaatgtagtgtgctattaccttatggtcagagtaaagtttatattgtttttattcaaattacaatatgagtatatttaagaggagcagatatgtgtgtgtttgtgcatgtgtgtgcatgtacacacatgtaaggaaggacattttcatttctgtatatttctcctgtgtttgctgctttttgcttgccagtttttctttgtctctatcattttatcactgaaaccatctgtgtagaaaatagtatgcttggttttatcattttaaattgttttctatttttgttattttgtcctcccaacttgttttcaccttaagtattcaggctcaagtataaggcattttagttttcacattcaagaggtgtttctgctttctttcccgtccgtttgtccatatgtttactggtttctgataggctgtgcagtgagacagcagtttactatctgtgtgtgtgtgaaattagctaattggtgttagcagaaatattttcacatgttttataagcaaagtgcagcaaggtatataaatgtagatatgatccagacacgcgcacactcacgactgtcactgctcatgcataggcgctcagaagtaattaatgttaataagattttaatgtgcttgtgagatcataatgaggagaaatgaatgctctgattaggaaaaggtaactgtgtgtgtgttttggctt

SEQ ID NO: 107681 - DNA, 2673 bp, Homo sapiens
gtaatttcttaaatcttgtaaagtttggaattgataatgcataatcctctagggaaatcagttgaagtgaataatcttttgtttatatttatatttgagagttaaaactcttggatgggacagattatttgaaggaaaattccaattttacctattatgacacgctgtgaaacacaacaatttcatggcatatccattgttattggtcttaaaatatttggtttgcatttaaatttcaatgaaagtgttaacagcatcaatgcctcagtgcttcataacatctaaaaactgactcttgagcattcctgatgttcttgtctgaaaaaaacaatgcctcatagtataaaatgacagcacatgtatgcaaacttgtacaatttctcacttatcctgtatggatagctaaaaatgtaatttttatattttttaaatatttaataatatgcaaattattgatatgcagtaaaatgcagtaagggcagtcacaatttaaaagagctctaaaatatatcctttagttgtgaaaataatcatgattttgtaaatttagatatgtgtacacttttgggatattcttaacacctctctatgtattaaaaggttcattttttttaaaggaagacccacaaaatctctaaccagggttatggtcttgtctttagcagacttacaagtttattggaaatttggggttatatttcaattttcttctctaagagtggtcttttctcaaatggcattcttttagaatactgtcagagaagagagaagaatgaaaacccaaagtgaagaactttacctatactcctttttcagatgtagaaattaaaacatgattttgtagaacgtcccctttagcagcagagcatgaattggaaaatttggtcagtgatttatttaggctccacaggaaaaatcctgtagggcattttttgaatatcctaaatttattttgatttgagaccagcttacagggcatgtctatcttaaaacagttctccattttcctgagaaaaattccagtggagctagttgtgggaggtggtatcccaacaatgaaccatttggggccaaataagcactttaacacaacttactccatccctttccttaaaccaaagtctgtcttgcccactgggcatgtttaactttgactgctaattttatttccctgcagaggcaaaggaggcaggaaaaaggagggaaaataactgatggcatgtgggtgaggttttgtccaggaaataatttttaaaagatcctagccagtatagggatgcaggaagcagttggtgcctgaaactatattacccttgcatcacagattaagaagtaggagccagttgaagttaaataacttgcctacagttacacagcagttttcagtgttggggttggtactgggaactaggttattcattgctccagtgaggaaattggacaatccagcttttttgctgataaagatgctctcctaatatccctactcacgttttctttccttcttttctttggctactgtcttttaacatctaaaaaagtattctgctgataatctcaggtgtagaggctagttattaaatatatttagacttttaaaaccattagaattagctgagctgtaaggacagtgtccaccacgtgaagcctttttttctctattttatttggatcatgtaagtaatgaagatataactggaaaaaggaaatgtcattgaataaatagttctgagctcatggcagagttctaaacgtgaaaaatgtaatggacacctatttaaagacaggccatttttatttttacctcctaattacagttaatctgaggtatttgaaatgaacataagctaaattttgataccttttcctcctaaattgatatcattagatggatttaagttggaaaggaggaccatggtagaaatacgaatcagaattttagacttccataaagtttataactgtcccagttagcctctgtgcttgaaccccaggggaaagttgctatttggccctagtatcaccctaagttgtgaatatgttttggatcaacttctcactgatatgataaatatttgacttaaaaattagtgaaaactttttaatgtggtatctgttgaatattaccatttaccccttagtgtccttagtaaggttctagataccaaacaatttctactagagtgtgagttttactcggttaccagagctgactaactgaatatgcaacagaacttagaagtgatgccatcacatcagacatagtacaaacacagactagtgcactacagatcctctaaattttgatttggaaatatatgaattattcagagatccaaaaccccagagaaaatcaggtagaggaccttcatataaacacacccatagcctgtattccattctaagaattgcagtttgaaccaatagaagcccgaagcagctacacacatttgatttacaactgtgtcctgtctacttgcaaatagcagctagtttccttgtagggttggctgacaaggctgttgttttttttatatattattaagagtcaatagcagcagcacatgcaggctaattgttagaatataaagctttgttggaggtggaacatagggttctagtaatactcttaaattcacaccaattgacacaaaataaatacggttctctaag

SEQ ID NO: 107682 - DNA, 1619 bp, Homo sapiens
tcctaatggcaaagctgcactctatgcctttggacatttctatgaatacacacatgacattttggagaagtcatcagagaatatgtcctatttctatataggcatgatataatattcatgaaatgcaaaatactcctctttaggccagtgttaatgttggtagacccagtcggccagtattacaactgtggtgttagttgtcacaatagggtctattctgtctcttacaaatttgtccatttagaaaggaccctgaaatgaatgtcagcacgacagtgccaccttgtgtccctgttgctgtgcaagtaactgatgcatgagttagtgaaaaaaacaaacaacaacaaaaaaacaggacatttgcaaaaaattggcaaattgtttcaggccctgatttcgtagtagctgtaccaaaattctataatatgttttagtctttgaaatttcttattacccaagaaaaagttaggatgtgtgcactttactacttttctcctatcagggtatataaaaaattctttaacaattctaggcataaacagggaagtatttaatttagaattggaaatggagaagacagggattgtcagagatactcacttaagctcggtcatttcaggcattgaggtgctccttctttcacattcccacagcaattttatatgcataacttggcaatatcacctctcacattgtattgccattgtttgtaagcacatcttccaactaaaccttgagcttcttgaggatagtgtctgtgtcttattcatcctccagaaccttctattggcattcagcacagagctatgcaaatatttgaggtctaaacaaatgattatgtctagctggtttataacattctcgtgtatatatatatatatatgtatgtattatatatatgtgtgtgttatatatatatatataaaatacacatttctttgttgtaaataagtttggagcctttttactttggaaaaacagcttctgataccacttcctgcctaaacatccctttataaattaccttcttccttttatcttaaaatgaccattttctctttttgattatgaaaacaaggcattgcctattcacaagtgtgtattgtaattgactttgatgtaaagataatttttaattctagctttacaacaaatttgctattatttggggtaacatacttaagtttttttaggtctacttcctatgtataaaatgagtggactggactagttgatttgacaggatttttgtagggattgggcaaatgttagtattattctagctgtatatttagttgtactttttaaagtaccatcatagttgaaaatgaaattgctagcctttgaaagtgctatttgatatttcatgttttagaagaggaaactgaggcaaaggggcttataggggaatgaattgcaagtaggcagagtaaatagtattataatggatgaatattccatttttttatttgtttttcacttttttgttcatttgtttttggttaattgagctccactctccttctattctttaaccatataataaataaagtacaatgaacttatatagtaagatgaacccacaggttggtagaggactatggactacttgcagttca

SEQ ID NO: 107683 - DNA, 1034 bp, Homo sapiens
tcccaaaacatgcccccaaacagcatcacatgctgaattaaaatagatgaagtgattagctggataagtgtgcgtgtgtttcctttttaaaaacaaagtcaaataatttgtatgaaacaaaacaaaaagaacttttctagcagtctgaatgaattcaggttgtttcacataatggctttctgaaaccattttttgtatagtaattttgaccaacacatccacctattccctaccccacttgctttttcgctttctaaatgttggatgaatgtaattccttaatataaaaataattgtgttcttataacacattcaaaatatacctatggatatgaagatgtggtacggcctatacacagtagtttcacttatatcaccttagtctgaaaatatatgaataaaaaacatttttagaaattatttttctggtatgttgaaagaaactttatggtgtgatacaaaaagcatttcctggggaatcaggaggtattaatcaatatcaaaaaggatttaaagtggttaaatctggaggtctggttttttgttctgactttgtgactttgagtacatcatgatctctctgtccctcagtttccttcctgtaaaatgaggagaaagctttttaaaatattttttcatcttaaagactgtgattttaagtagctatatatgtagataatcttgcttgcattttctatctaaaagtcacaaataaatggagaaaagttagggtgggtaataaaggaagaataacggacatttatgtggcttgagagagcacaggcactttaattttgtgatgatttttcttagcttaactacatatcataatgtattattgagtctgtttaatgattgaacgaatgccataaaccaaaaatagtcatttgtcagacaaactgacttaattgcctatgggtgatttggtaaaagggctgtttttaatggaatgaagtgcagcatggttactatggctccactcctctccactggccactagatggagaggcgatccgtgtccactgccttgccaa

SEQ ID NO: 107684 - DNA, 1046 bp, Homo sapiens
gcatatgccagtttaaactttttcttcttttttaacttaagaggagaatcactatgattatttttaatataaagactatatagtgatttattggattttactcattagggtttcaaaaattgcagatactttttattctgcacatttttatctccagaagcctatattcatcaaaaggatagcagctgcatactttccccatgaaatgttaacaaataaatggcattcctgtttatttatctatttttgaattttaatgattagtccttgtgctaattaacaaattctcgtattcataaaatctggcactacataaatatctaattgtgtgattatctacacatgttctggctttctataaatatagaaattatcagtggatgtgttcatggacttgcccaactctaagcagtggccggtcatgccgccacataggaagccaaattcaggccctgagcaaacgtgttaccccaacatctggcaaggtatgttgaagcagcagcacctggctaatattgctaactagtgatcttttctggcaaaagaatgactggtgttgatattctttgaatgctgctagctcctgggttcttcagcctcaagggtggcctctgaagtctaaatgttgaaaatggacattaaagctggtttatcttggaggtcactttataaatatattttaacaaactacatttttggtgggagacatgttttactgtaaaacataagtaaaatagtatccttatccctcactttcttaaccagtgaagatctaagttaccatgagaagtcacaaagcactgaaaagaacctctaaatattttcatttgcatggctgtgtaactatttcagggacattatagaaatcaggtattacctacatagaaacagtttaccctccatcaaggacaataaacactagcaatcggacaggtgtgtacctgccagagttatcattaaattagaaaccaaatctttaaaataatttgtttcatactgtgtaagacatttttgttattttatacaattactatggattatttaca

SEQ ID NO: 107685 - DNA, 1082 bp, Homo sapiens
ggagggtggagtgaggggctggccatctttttacaaagtggaagctatgaagtgtatcaggccatcttgcacaacaactgtaagtattcatttaacattttggggagcataaataatataatttttatttcaaattcagttttgtggtgctttcttttcctttatttctttttttcttttttatagtgggaaaagttacatttcaaactagcagacattgttgaagagttttcccagaatagtgttcttcaaaattgaaaggattattttaataagggccatttgaaatggacttcttaatggaattttatttcagatttgtcaaagtaaaactgctcttcatttgataaaatttaagtcacatagatacacaaatgtttcggcatatacagagcaatgttagaaaatggatgctgatctgtagagatctttgataataacagtcatctttttgtaataaattatttatttaacagaagtggcagacttttttcccccttaattccattaggcttctctgacaacacaaagaagtccataaagcaatattcttaacccacctgggacactagagcagattcccaaacacattctcaaggttcaaacctagtaaaatgtttattaaaaatccattatttcaggaaggtgatgaacttttgctgctgaaagacttttttacctcttcttttaaaaaattaattctgagactttcaatttgcttatcttgcctgaacagtttttttaaactggataggctggctttgaccaagagtagtacaaatactaagtacgctcaatcaggtcccgtcggagatttttttccgtaaggtctaaggggaactttaggagagtattttatgttaatatggtacacgataattttgtttttcatatacaattttatatatactttatgccatttctgacggtgacccaaaaatttgtttcaaaactgatactgtatgtcaaaagtgtacatgtctcatgcacctgtcattttctgtgttagccttgtgaggaccatctaaaattctactgtttttatcaatagaaatctttcatctatgtcttgattagtcatt

SEQ ID NO: 107686 - DNA, 2002 bp, Homo sapiens
aaacgcagggtttgaataagtcaaatgcacttatattttttatttgtgtgtaaatattttttagaaaattttacctctattataatgttcttaagtcccatctaaatgacacatagccaaactgtatagaaatatattaaggaaggtgggtgtctagatagataatagtgctagaaggagatatgactcgtcaagcagagtctagtttttaaaaattcggggacgaggagagtggcttaaaactatttctgttttctgatgtttgtaattctatagctgcaaatatatcacttacaggagaaagggcacctaggagtggggaaagtgggtgggaagcatgtgatggggtgaggagtataataacatcataattttggaactagaatatagaaaaaatctggttagaagtatcagacaaagaaaaactgttttttttctcttttaaggcaagtttatttagaagcattgattatttttatttttccctcctaataaaagattaagggtaactgctgtagtttcagtcccatattctatgaaatatcatcctgattgtgatggtagcttcttatgggatttatttctgttgttgtaccactatgtactatacgcattgcacctgttcacacagagtacattgcattgtgatgtttgtacagctagatgctttaaatgagaagccaatctcccttcttctaggttcctagcctattagttacttaattaagcttaattctgttttggtctgtaattttgtaagtctgcaattttgtatatggtctcgatttattaactgagcaatgatttcttctttgcagttatcagttttgtctgagatcagttttcctattgtatggagtctgtttcttacagagcctcctttaagactgctctgactttaaaatcattactaggcttttgtcagagctgatttgttcacattcttctcacattaaaaataaatttaaaagattgcacaaataagctatgcatttcactatttcctgcttatatgcaaaaaatgtatttatgataattacatgtactgccagaactgaaacaatacattcctcataatggagcataaataaagaaggtggagccagctgctcttaaactgtttatttgcaagcaataatgatatagagaatatacctttttcactctgttagtctggcaatactgaacctgttgctgcattagacgagttgcattttgctggataggggaaggagagctgtctgctgtctggtaggagggctttgtctgtgcctttctctctgtttctttctgtttttctttctctctctctctctctcctcttctctctctcttactcgcttgctctgtctctgtctctctctccctctcttcccccctccctcctctctcttgctctctctctctcttcccgtctctgtggtttgtaaggtaggttgcagtgtgtgtatatacacaacatcaagagcaggaaaatggactcattagggaggcaggcagtcattaccactcacactgtacttccagggagacaccgattataagaagagaaactcagcgctggggaagaaggtagggcagacaactttcttaaaaaaaaaaaaatcctgcttcctcaatgccccctctgtcatctcctttagcccccaatgcctttattctttcctgcttgaattttaatttccagatttaagtttgacagagctagtgctagcttaaaatttagaacatctgtaggaggcctaccctttactaattttcttcctacttacttaggggtgtgcccttgtgattcagttttgttactttaaaaataattacaaacaaatctatttttctcactaaagtaccaaataaatcagaatctttcactcttttaaaacagacccttccgtatgtttgtctctttgcttttcttgtctgtttatgcaattccatctgtctgtctatatatcatgttgtccttatttattgctaactcggttttgttagttatttgcca

SEQ ID NO: 107687 - DNA, 1063 bp, Homo sapiens
gacatctatctgtcactattgtattatacaaagtagtttcactgccttgaaaatcctgtgttcttcctgttcatccctctctctaccctaaactcttgcaaacaatgagtttttgctgtctccatggttttgccttttcagaatgtcatatagttggaatcatacagtgtatagatacgtacagtggatagaaggcaatcttttcagattggcttcttttgcttagtaatatgcatttaagtttcctacatgtcttttcatggcttgatatctcatttcgttttagcactaaataatatttcactgcctggatgtaccataatttatccattcatctactaatgggcatattaatttcttccaaatattggcaattatgaataaaattactgtaaacatctgtgtgtaggtttttgtgtgggcataagttttcaattcctttgcataaataccaaccactgcaattgctggattgtatatgtgtttagttttgtaagaaactgccaaactgtcttccaaagtggctgtaccatttttcattcctaccaacaatgaatgagagttcctgttgctccacatccgcatcatcatttggtgttgtcagtgctgtgagtttgggccattctattacatgtgtggtggtatgtcattgttatttttaatgtgcatttccccaatgacatataatatggagcccctttcatacgcttatttgccatctgtatatcttctttggtgaggtcactgttaaagtcttctgcccatttttaatcaggttataatattttcttactgttgagttttaagaattctttgcatgttttagataacagtcctttatgagatgcatcttttgcaaatattttcttccagtctgtggcttgtcttttcattacctttacagtgtcttttgcagagtagaactttttaatttgaattaaatccagcttatcaattatttctttcatggattatgtctttggtgttgtatctaaaatagtcattgtgaaacccagaattatccagattttttcctatttaggagtcttagaattttgcattt

SEQ ID NO: 107688 - DNA, 1020 bp, Homo sapiens
atgtaatactttattttagttttaaatttaaacatttgttgattagaatttaaattagatgtgcaactcttcccatttaaggatggtactcctggcctactattgtccttgggcccgatgggatacaattttaaaatagatgactagggttaagaattattgcctaattggccgggcacagtggctcatgcttgtaattccattactttgggaggctgaggcaggcggaacacaaggtcaggagatcgagaccatcctggctaacatggtgaaaccccgtttctgctaaaaatacaaaaaattagctgggcgtggtggcgggcacctgtagtcccagctactcgggaggctgaggcaggagagtggtgtgaacccgggaggcagagcttgcagtgagctaagatcgggccactgcactacagcctgggcgacagagtgagactctgtctcaaaaaaaaaaaaaaaaaaagaattattgtgtaattacgccacttacaattaactttatggtggtgtcctcaatggcaaagtcatttacttagcgtagcaattactcattttgacccactaatcccagacttttcttgtctgggcacggtggctcacgcctgtaatcccagcactttgggaggctgaggtgggcggatcacaaggtcgggaatttgagaccagcctgaccaacatggtgaaatcctgtctctactaaaaatacaaaaattagacaggcatggtggcacgcgcctgtaatcccagctagtcaggaggctgaggcaggagaatcgcttgaactggggaggcgaagattgcagtgagccgagattgcaccactgcactccagcctgggcgacggagctgtctcaaaaaacaaacaaacaaacaaaacccccaaaatacacaaatcctttacaattgaattcttgcttttttaattcctttctcaggctatagaaaataggaaatattttattgtgtttattatttagttctttaaacaattatttgcattactattagatattt

SEQ ID NO: 107689 - DNA, 1522 bp, Homo sapiens
catgtagtagagataacttttaataaagcattcttattaatagtagcaacttttgtattttggaaagatatgaagactattgagtttttgagtatagccgcaccaggtcaaacagtaaggatctcaccaacctgcttgacaaacatctatggcaattaagatgtaccttttatatcttctctgtgacttttatttttcctatagaatgcactctgtagtttctctttcctttccttttgtattaaatataaactgtacatataagtaaattatgtagatgtggaaacttttaagatagttgctggcattgttgtagattgtttagtagagaggattgaccaggcagcagaagagttcatatagtatatgtgtctaatacgttgttctggagccagggagatattacaaataacatttttatattttgtaatccattgatttagcatttattgattgtgtcacaaaagtaccctcttctaaatttctaaagataatcatatcatttaagatcagcttataggagtagtaacaacagctataatagcataataatcttatcattcagatactaaactccgtgccacttttccccatggtcatatttctcctttacaattgtggaaaatgactcatatatagatatgagtcattctatattaaagatacttttgattttctactctttgctatttactattcactggccactgttcactctaccactggtcactccgaggaactccggtaatattttctgtcttattaggaaactgccgtgattataaaggctacagtatatgggtgaatgtgaggcaataacttcattttttcattatttgattcttcgttctactactatataagactgtagaatatacattatcctttcctgaaagtttggagagaaggagaatatttgcatcacaaaacataaacttcatagaatttattattaggcattactttaaaaaatctggccacgtttacattgggaaattcccactactcctcttcttcctccctctcatctctgtgctcccctaacttcaaattgttactcattttttatgtagtacagtttaaccccacaagaaatattcatgcctcactctctgactccagcagcttatcaagatgttttcctcaaagaggacaattccattcccatgaagtactctgaagccaacttcagccttttacaaacacttatgttatagatttgaaagaaataatagataaatgaaatgtgaaggcaagctgaattttcttttcagaaatgatgtttattgaaattctgatagttgtatgggaatatctttttttttttttaagttccaggatacatgcacagaacctctacatttgttacataggtatacgtgtgccatcatggtttgctgcatctatcaacccgtcatctaggttttaagccccacatgcattagctatttgtcctgatgctctccctcctctcaccccccacccgccgacaggccctggtgtgtgtcgttcctctccctgt

SEQ ID NO: 107690 - DNA, 1843 bp, Homo sapiens
aagacagaaggaatgtcatttgcagcaatgtgaatggagctggaggtcattatgttaagtgaaataagccaagcacagaaatacagatatctcgtgttctcactcatgtgggagctaaaatgttgatctcatggaggcagaaagtagaatgatagataatagaggctgggaggattgagtgggttgggagaggatgaagagaggttggttaatgggtacaaacgtcagacaaaagaagttctaatgttcaatagcagagtagggtgactgtagttaataaaaatattctatattgcaaaatagctagaagagagtactcaaaaaaaaagaaaaccacatagaaattataaatactcagggtgatggataacctaaataccctgactttgtcattacacattttatgcatgtaacaaaatatcacatataccccataaatatgtataaatactttatgtcatttaaaaaataaaaggtaaatctaagcacaaaaatgtaatagaaaatacacacccaaacatggaagagccttaaaattttagtaataatctaaaatttagataggaatggagttgagaactaacagtgatctgtgcaaagttttaaatgtttttactgagggagcatacactttttaataatcggagaatcaatttcttgagagtaggggaaggaactcagtggtaaaactacatattacttcacttttcttgattagctttaagagatggattttgatttgacacctaaagctagggttgatattcagggaatacacactgtatttacagccagcatctgttttgattagtcatggtaacatttcttctgtgcccattccttatgagctataaatattttgactgccactgagcactacctaaaacttctctaatttattatttatttctatacacttattaaggtaacttaaaataatagtaatagtaaaaatgtagtgcctggaaaacttcagaatttaattattgaattattttatgttatcaaatattctataatatctattgttttattgtaaatatgtatttttaaacatctgattaaactgctaaagtgcaaattaattattgagtgggtattaagtgcatttattggtggaaaaatactagggagagaattttaattactttagacaaaagttacatgaattttattaagatattagcttacagtggtttgcagtttatttccgtttgtgaccttcagataaaacatcataagaggtatgtattggagtcccaaaccatttaatttttaaaataaaattcataataatgatttatttctttcataactctttttgtaattaatacagatttcattatgggcagtgttcttttgttgattactaataaaattttctcaactggtgagatactgtttgatattcaaatttcacataggtttaagtgatgttgggagtattatttgtgttatggaagatccagttattacattttcagtggtaaagtgccatcggtttgaaatagagtagtacatcatatttagtgataagtaaattcaatccattcaaatgtgtggacatttaacatgaaggaggatttgttttatttttatttatttatttatttatttatttatttatttatttatttttatttttatttttttgagatggagtctcactctgttgccgaagctggagtgtagtggcgcaagctcggctcactgcagcctctgcctcccaggttcaagtaatttttcctgtctcagcctcttgggtaggtgggattacaggcacatgccacctagcccggataatttttgtatttttagtagagatggcattttaccatgttgg

SEQ ID NO: 107691 - DNA, 1005 bp, Homo sapiens
agacattgggacgaagagcttgggctttagaggtttgtgaactcctgtaggaggagatcaatatttatccattttaagtaccgaagtgtcgctagctgctaaaaagctaaagtagctgaatgtcctggtggagtcctctctgtctttggaggctaaaaagaaatagagataggacaacagagctctttgtccatgtgcctttgcagggaactgacaggctgtttacctttgcttttcaccacctgtgatatttctgccatttaggataatctggcaaccagacctgagctccagtgagttagcgaaaaatagcaattcatttaaggagacccatagcaagtgagagaggaaaatcagagtacacactccaggtaactaggactactggcgaaaacatgaaaactgaatttgaaaacaaaaattgggagcacttaaggaaattcaaagaacagaaaataatttcagatattaaatatatctcatttgaacaactcaggatttgtgggagagcatagtcactgtcgaaatatgaattagtgaatgaaaagaccaaatgcaagaaatgtatccaagcatataaaaaaacccatgatgaaatattgaaaaaaaaaagatgagatttggaggatagatctagaaatcaaaacgtgaataataggaattacagtgggacattctttaaatatttttgagcatctctgcacttggctgctaagaaaactgagttttagagagcagagattttgcaggcactttctctgactgtaagctaacatatatcaaattttaacagtttttctaaaaggttaaaaaaatctacatagaaattaaaacattcccagatatcttttggatgaagaggaaatcacctagaaagcaatgaaaaggaaatattttttgtaaaagccaatgaaaattagctaaaatagttgtcagaggaaaattgatggccttaaaggcctttgttattaaggaagagggaagataaagataacctaatgttaa

SEQ ID NO: 107692 - DNA, 2145 bp, Homo sapiens
cagctgcagatcaaaaatattttgggtgtgggggaatagatggaatagaatatatatagtttttttcttgccacaattccctaaacaatacagtgtaacaacgatttattaatacatggcatttacttgtattaggtgttataagtaacctagagatgatttaaagtatgtgggagaatgtgattaggttaaatgcaaatactacactattttatgtaagggacttgagcatctgtggattttggtttcctagagaggtcccagaaccaatctcccatggatactgagggtcaactgtaagtttgtccagtcaagatgtggctactttttgcttttttgctttaaaatgaagaatctgtatttttctagtgaaagaaaaaaaattacattgattttcatgcctttgttctttgtgattcttagaatatatcaaagttgttgcacacatagtgcatggtgatatccctgtgccatctttccagtagtctcccaggaaagcttttgaaattgcccttgaggaattgctgatgtaactgttcagtactcaaggcttaattttcaagattggggttttgatttttatggagctcaattttggagggccttaggtttggggacacatggtgttgaagtaaacaggtgagaagaagaaaagtgagatttctagaactatattagctgctcagtgagttgggcaattggatatttttggttttatgatttcagattttatagaccagtggaatacaggccttgtgcatatgaagatcaggtgacaagtttgctgcctaccagcctccacagcaatatgccctttcacggtgaggtcctaattttaacaagctaaagaaagtatcaggttaaaaattgtcaaattttatccatttccaggaagaagtctttatgcttacccatctaggcccgtgttttaagattactacaaaaccaagaaaatgcacatataggtcatgtgtacattgactagctactaaaagaaaatacgagattaaatggaatactagaggaaagagaaactttcatgtgagggctataattggggaagggggtgtttagaactaccagttgatgtgatgccagtttcttctataattggatcagaaagtttttgaggcccgcaaacatctaattcctcttgttgtcctgttaataagaatttgactacttggtataggaagaaaatctaaggaaaaaatattttaagcgaatcatttttgttgcattagtgaaagttttcagaagactttttagacaaattggactttctagtaaaaaggctagtctgaataattaggtaaattggactttctagaaaaaaaggccagtctgaataattaggttgttttagaagggcaataaaagctacagctaagttcctgcgatctataatttataaaataattacatattattttgaataacttcacagaatcagtggcaagcagagacttcttcaaaaacatttggaatacggaagtagagattgatgggctttgctttagtctctgaaataatcatatttttctgaaatggatggttaaatttatcatattgttctagacacttggagtgtaataatgaacaagagagaaaattgcctgcccttgtggagcttacattctaatgtcacacacactttgtgcattttagattgttaggggaggagattttttaatgaaactttaaaacctagctgctttcttgtcttaggaactacagtttgaaagagcctacagaagtttgagaaggaggaaggtgtttaccagttggcagtgataggaaagaaagatcttagtttatttcttatttgtaccttttgttattgtcatgaaactttctccatatatttcagttggtaattttaacagatagggatttttttcatgattttaataatgtctttgaaattaataaaacgttgctttatattaaaaaaatcttgtgtcttgaaagttactataaaattcctacatagtattatcccgttagcaaagtatggtaaaacaaaagctagaatatctgttaatttttggttgggatttgtttttaggaacatatctgaaaaatcaagtacctaaatctttttcagttctgggtttctttttcgttttttgagatgggaatctc

SEQ ID NO: 107693 - DNA, 1101 bp, Homo sapiens
ggactagccggggctcaggagctgctagaggcgcccgcttgtcttctgccccctccctcctcgccctcccccgcttgccgtggctctcgcggtctctggagcgtcttcagagaactggggggcaggaggtgtcctggccccacagccgctggatgtctctccagacgccggagctcccggcccccgcctgcttcgcttctacgactagagaggagggggcttgggaagggaagacacacctttccttctttctcttctttgggccacttcggaaacattaaaacatgttaacactttttgattcctgatataaaaatggttggaaggttcttgaaagtttaaaacaaatgccgtctctcgtacactgtttaatgtattcctgtctgtgtggcttttgggtcctccccccaccccccgcccccagctgttatcctttttaaggatgctgaagaggcaggaggcagggattttctaaaagttctattgataaacacacttgcacaaacatatgctaggcacacacacaaactaaacattagcgaaaaacacaatatggcgtacagctacggtacctagcgcggtaatccgctgatctctcactccgaactgggttgaatgaggtcagtagcaggatgacagctctccaatgaaaatctgaatgaatcaggaagtagtttggaagcttgcgggtgtagtactgtcctcagaatcagcattggccaaacctaagttgaacatgttacctttctagacatgtgaaaatcttctccactgttttttctattaaaaataccaaaagggtgctaaagtcaagtttcctcactgcgtggcggtgtatacatttcagctaaaaaaattatagaggccattcacccaatgttttcaagtgaacgctattctgaagttactgttgtaacttgttgccattgaaagttttaaaacacaattaccattttataaataaatagctgtagacactaaatttaagtgataaccagtcatctttaaatttataatggtttgttttcatttctgttcatgctcccaatcccaagtaccctttgctattttgtggaaatatttatatagatccccctccac

SEQ ID NO: 107694 - DNA, 1059 bp, Homo sapiens
agatagccgtccttgacactataaacttcttaatatctgggctaaggatgagtactcactgtaaaatatacagctatatcattttagccaattattctgcttcctaagcttggtgctgaacagttagcctttcctcacatttaaagcttgtatcttctggtactcctcccacaggaatcctggtgaggtttcagatcttcccctttgtcaataatataatttatagttacatgtacactgtctcttaccttctctagttaaaaaactatgtacaataacgcttagttgttgctattttttcttgtccccctttattatgggggaagtatccatctgtctgatgttattctatctatccccaaaccaataaacaaaggaaaaatgctagtagattttcctaaagggaaataaaactacaaacggccagaaaatcaatgacttctcaaccctaacttatgtctcctacacacaaaaatataattcctgggggacggatctgggaaggaatgggcttccccttataattctggtgagggaaaaatatctccaattaaatctgttccctttgcaagaatatttaagagaatcaagaagggaaaagaatggtccatgaacattaggtagctagatctttctgaagtgaagctaaataacatagaaattaaatatacctctttggggtctagatgggaaacttaaacactctcttggatttatttttttcaggaaatgttagtctaagtttcaaactggtaacttggaaaataaactttggaaatacatctaacttgtaggttgggatagtgttcactcaaaaataaaatttaggaaggaccaaaagaatataatttttctgtttagagaatggatgatcataaggaaagaaagatgaagtacactttagctgaaaaaatatgtcactttttttccattgtactttaaaatttttaattatgtcgaaggtgaagaagatgcatgagtagtttgggttgccaagaaagcaggtaagacaggcaagtattcagtattgaagacattgatttggtgggatatggtaga

SEQ ID NO: 107695 - DNA, 1067 bp, Homo sapiens
actaattactactgtgctagaaatttttttctatttattggatcccagaaaggctcaattaaccagtgccttttggtcaaggatagtagctgaagaataagacctcaagattatagcatttaaactttgcacggttcatcttgttgatatggcaaggattcagggataattgcctaataggcaatattgcctaacaggataggtgggggttcagaagggctctaatgaaagagaaaaagagagagaacttcaaatcatactgaagaaatagaggaaagcagaagtaacctgagacaaaagagggaaagcccttcggatatcttgaattaaatataaaccctcagaaatatttacagtgctctaagttagtagattgtcatttcttatggagaagacataattagaatggaccccaaccacaagagacctctctattaagactcatttgcgatttggtaccatattgcaaatgagtcttaatataaaagatgtgtcagaaaccctcttctcacttcactttatatattaagtatctcttttcaggaaaccaaacaaccaacatgtatttcctgaacccctacaatgaaccaaagtctattagaggtagtatgggacattgtgatgggggcagagggatacaaaaccccaccaacaaggagggtgctatgatttgaatgttagttcccctcacatttcctctgttgaaatcctcatctgaggattacatctgggattactatcactgagatagtattaggaggtggggcctttggaaggtgattaggtcatgagagtgaagcccttatgaatgggattagtgcccttttaaagagaccccatagagcttccttgcttgacccttctgccatgtgagaacatgagaaggctcggtctattatacagaaggcaggccctcactagacaccaaatctgccagcactttgatcttggacttcccatcctctggaatggtgagaaataaatttctcttgttaactacagttaaccagtttatgtttattttgttttctaatagcagtgggaactaaaacagagaagaaagaagg

SEQ ID NO: 107696 - DNA, 1051 bp, Homo sapiens
tgtcctgggattctgctggatctcaaagatgtgccaagccaaggaaaaagatacaagagcagaatagtacttaaaatccaaactgccgcccagatgggcttgttcttcatgcctaacttaataatttttaagagattaaagtgccagatggagtttaaatattgaaattattttaaaaggtaggtgtctttaagaaaataacaagcaaccctgtgatatgttccgtctctcccaattccctcgttatatagagggcttaatggtataaatggttaatattggtcccaacagggctgactcttctatcatataatcaaaactttttacatgagcaaaattcagtaagaaatgggggaagacaaaggaaacgtctttgagaagccccttcatatttatttatttatctcttcctgaaccatgaatttcatatgtggaatattgctatattgacagattcttgcctgtctgtgttattctaggatctgttacaggtccatggcaattactgtttattttttcctggaaaaatatttttttataaaaggcttttttttttttttaaatacatgagaggcattgggctaagaaagaaaagactgttgtataataccttgttcaatggttgtatttagtgagctcatagaggtccatcatatcatgaccgagctaggttgtgtgggcaggaaggtagggctaaggggttgtagccttgctgggcagcctctcagagcaaggttgttcagatctcccttgctattacagtaggttactattaatgagggcagcacctgatgccttttgtactgaggtatgtaactttctccttatttgacaagtagaagttaacttacttgtcagggagggcagacgtttttttgttctgtttcgtttttcaaaataatgctttttgcaaaagaggtaagactgagactaaaggtgttatcttctggtgtgctcctggaagtgtctaccctacatttgtgtcagctcagggttgcagtgttgcccagatgcattttacatcactgtaaagagattacttttgtggtta

SEQ ID NO: 107697 - DNA, 1008 bp, Homo sapiens
ttttgttcacaacaattctttttactcttctgtttttttttttctcatttctgtggccttttcttacctttccttaatcttgcctggtcttttctgaacgctatgaactgctccatacccagaactcatccacccaactgctgaatataaaataagttgtcctttcgtcatctttctttcatccctctaaaatgacattttattactatgcagtaaacatgttttaataaatgcttccctaattccaaacataacatacattttgcagggattttagaagtggtagacaggtagaaagaagaaaattaaaattaccctaatgcttcgcactgagagctcacatctgctaaatttttaatgtatctgttctgtctcctaaaaaattatttaggaaatgtttggattttcagtgcagctcacatatatttgttagatttagaagatcagcaccacatttatgatctatgataatttggaactagttttcctcaagaattttaatgacttttttttttttacctctatctggcataagatgactgtgtttactaacattgattcattttcgagccaaaaaaaagcaacaaaacaaatcaggagagagaagagctcttttatttattaattcctgacacattttagatgctcatcacatagttaattttcttttcattgcttcttacttttccctccctttattttttatactccttatagctcacacatttagctaaggagtggcatcccactgggtctctttagggtgccgtatgtagctcatgttagaatttgagtatggtaccttagaagacatgctttatctaaattgaaggctcctgatctgggggttatttatattttctaaaattatatgctaaagtatatttttatatgtttatttttctgggaagataatcagcctatgagttttatcagatttttaaatgattctgtgtccagaaaaaacattcaggatctgaatctaagatctgcttgtggcctagccct

SEQ ID NO: 107698 - DNA, 1049 bp, Homo sapiens
ggtctctaaaatggatagaattagttacattgacaaaacttaaataattctgagattcataaactcactgcctagtattttatcttggtaagtagaatctgttttcaggtcattaaatttttcctgaaacaacctaccgataagagatggttcttgaattttgtattccaacatattaatagtaaaagaaatttaaacatgattcattttcgtgagaatattttctgaaattgtgacttttgatgctttctaatttgtgatttcgttgtcctcagaacaggacaagttttagttgcttgttgattaatatgtgtattcattctcggtcttaacatttgcatttctttgaacaaattaattgtgctcttatcctcccaaccccttactcccaccacagttattttgaatttagggagttatctttctcattaataagaaagtataatgttgtgagctacagggagctggacaagtaaggtctcttagagccctttaattccataatgtccttgatctgatgaagctgctcggtaaatctcttcacaatttccatgaccaagccatctgcctgcattaaaataaatcaaatctgcttactccttcagtgtctaacaaatattctataaactgatgatgatgaagaccatgaacacaaaaataatttgcagtcttcagcacttccttttgagttctcagctcagattctcttgacatagtgggggtcggcatgttagctttttcttcgacttgagtggagagtagtgaagtccattctcctagtccttttcattgtatttatcccaactgtggcaagtgaactaattcatgttcatgtttaggttaaacttcacaaaactttactttttcttctacttcatgtatgttaattagacaaatgcacttagatgtatctaattttatatgtggcagtttacatatgtgtaaactgggtgtggggggtgcgtacatgtgcatatgtgtttttaaatctctggcaggctgattttgtatctggttcaggcttctgatattgtccagactttaggaac

SEQ ID NO: 107699 - DNA, 1074 bp, Homo sapiens
gatatgcagtagtttcttaaagactggctgaaatgtggaaccagaaaccatatcagtgaacatttcctacttgttatattaaaatccactggtttatcttgtactttgagtggatcttttactcatgcatgagttttcataaatctatgcattgatcattggaaaatactggttctctttgttacacagatcttacaaatgttactgtattacattatataaatttaaaaattatgtttatcaatatgaccactgagatgatcagaacagtcttttaagtattatgaagctgctaagctcacaatgtcagatacaagttttccaaaattttgatattgcttgaattttatcattggccgcaaatgactgtcagttatttcacttgaagtgatgatctcattttgtacagttttgagaaaatgtctgctaaatatataagtttgaataaccatagtctgtgagttgttcattcaagtagatatgaaggaaagtgattagttccttcagccttgagctcaaataattgcaccaatgccttactttgggatgaccattttgcttcagtatgcagcataagtggttttatactacccattttgtcacacagaatattacaaaaggtcaagatttaatgaaattattgttattgcttcatcaaagacattctttaatgaaactggattttttttttaactgtgactacataatggcgaagactacagtgactactagtacagtcttaatgtcaaagccttgacctgtgttaaggtgccaacagtttcacccactactgcttttgtaccatcaatgcacatgttaacccagggaaaaaggcataaaactctactgttagtaagaaaagtagtttttactacatagactttccgaaagggtcttgggaatctgcatcagtccatggactgtacttgaaatgctggtatccgtaatagaatgttagattctcttttttttgaaattgctgtagagacaactagccagacaataaatctgtgctatatggggtggcattaaatggaatatacatgtgttattttaaaataaaaaatgaactca

SEQ ID NO: 107700 - DNA, 1024 bp, Homo sapiens
gggagtggattcccctgaccaggggctctacagaaatggccgtagtgatgggcaacagctcttcacagcccagcccatcagcagcctatgtggtcatggcttaggaactggacagagggtacgtgctacatttcaggacaagagtagcaaaggctagtgataaacaatccccattatcttccctaaatgtacttcactggggtgattagtagaattttgccctgatcacatatcttcagtgtcttctttcctgctatgcttcagcttcaaagtagaggggagcctccaattttgctttcatttgaaaagaccatcatggccttcagaatggtttttgactaatgtggtagataaactaagatgatttgaatatgaaagttggttgagatttactgcttatttattcgcctgtgcaacaggcactacccttctttgtacttatataatacatataatacattgcagagtacaagcatgttccatgcagattatatcatttgaatatttgaaatcaactccctatcaccattgccattttacagatgagggaactgagacctggaactgtgaactgacttactgaggttgtaaataacagagtccagatttgaacctagaattgtagctttaaaacttgtgaccataaatggccattcctttctttgttaaaagaaggcaactctaagtaaattggggatcctaacagacttgattctcctattcttcaggatgttttgaaataagtactttatcatttttttttctttttgaaaatgactaagtataaactaacacatctcctttgtaccccagtaataaatgctgaatctcattcttttttgggcttatcgcctgaagttccaccattataagaaattggaaattttagaagtttttctttttttaatactccaataatcaagctgtttgtgacactgtgtgtgtgtgtgtgtgtgtgtgtgtatgtgcgtgtgtgtgtataaattttcgcaaatgatgctttttatttgcctagtggtagata

SEQ ID NO: 107701 - DNA, 1053 bp, Homo sapiens
tcccaggcagcccaccgcctgctgtgcacacatggtgagaccctgcacacacatccagaaccaacagaaactgtagtgggatagttgttttcatagtaaagcatgcctcttggaaggatgatctctaggcatggttgtgaggctggagtatgagggcttgagtgatcccagcacatgcagatggctgtccctgctctcaagcactcaccaggctgccttgtgttcttctccacaggaggcagtgtcgcattgccctgaagaaggccaactggcccgaatccaaaatgttatccaggagcttcctccatcccactataggtaagaatggttgggaaaagaaacgtgtggcctctcaatgcagtgtaataccaaagagacaggctggcatcatggaaaggaaacaatgtgtggacagtagcaagtttaggctttcccaagggcattttgaagttggtgaacaggtcactattatcaaagtgagttggtgtctgaccagggacattggcagcaaggagaagccagtctccaaatcacctgcagaacacccctcagaatctctcaggaagtcattccagtgatgcatactagcctcttggtggcattcttggttcatacccagatttgtagcataaccaaatctatggcaaccaagatagcttttcaacaggggttgactgtgggctcttgagcattggctgattgttctatttgctcattagtaccatccctaccatcatcccccaccctttcatttcattctcacagtttagcccctaatgttgccacctttcccagtgttccctatgcctgcccatcttttacaagggggcagattttgatgtggtataagaaggaacttcctagcaataataaatgttgtttatccatgaaattagctccctaacaagtaccaagatccctgtagctgggagaatttttattaaaacgagcctagatgagagcctatttcaaaactgcttggaggccatcctgccctggttgaaaggacgaacaaatggccactaagagcctccaggcggcctgtgtggtggc

SEQ ID NO: 107702 - DNA, 1129 bp, Homo sapiens
gatgtagtctagcagcaacccacctacaatggcgttatgtttggagttatgaggggaagtgaaagataagaattacctacagctttgtactcagataatttatatccaaaatttgtgttttaaatttcatactccagaactttcatgtttatgagtattagccttttaagttatgggaggtgatatacttagtccattgatgttgtcacttgtcatctaaacttatgagaccttgtcttagagaatctaaaatatattgtcatatgttttctgtgctgagtttggtttgttacactgtgaagcttttggtgaaacaaaataagacttatgaagtaaaaagaccaatcatgtcgttgacaagctggctctgaaaataattcttgcagaagagttcctgaaaggcttcaccaaggggaagtattgtgaggagtgtttgtaaaaccaaggtacccaatatcagttttatgtttaaatcaataattgtttctttaaatattttgatgtgtatactttttttttaagttaacattatttggcattcagtctgagtctgttcaaccattcaacaaatatatattaaccagtaggcactatattaggccctggggatatagcagtgaatgagaaatgcaaaggtcctacttgcacagagcttacaatatgcgtgggggtgggggagttaggtggtgcagaaaatacagcaaataaatttatgtgtaatataacattccctggtagtagtgataagtgtagcaaagggaaatcaggacaaggaaatagtggtaagaatagcactgctagaaggcatctttgaggagatgatttttaagcaaagaaaaagcaagactgaatcatataaatagctttggggagaattccatgttacagtagcagaaagggcagtgccctgaggtggggacaagttggtatattggaagaatagcaagaaaatatattaggttagttgctttttaaagtagttcagcctaaatatagtggttcttgaggtaggggtgggaagggtagggaatctgccatctttctattctttctgtaggatcttgaaaatatgcttctcttggcagcaacattttcatgagattactcagcagttgagagcaaaatgggt

SEQ ID NO: 107703 - DNA, 1159 bp, Homo sapiens
taaaatataatctaagaaaaatgtttataagtagttttcttttgggcataatctcttttcgtgtctcaggggcattgaaataaaaattatttcattatttcttgagcaaaaaggaaaaggtttcaatctttatagcaagaaatagcctgattgatattaaataaacagatctatttattattatatatgggaacctgtaaatgttaaattattttagaaaaatcaatgcaagaataactgtagccattacttttctatgaaataatgttttacttttttaacttccttacagttcttatttcatcgaccattaaggctgttaaatctgctcatccttattgagggcagtgtcgtcttctatcagctctattccttgctgcggtcggagaagtggaaccacacactttccatggctctcatcctcttctgcaactactatgttttatttaaacttctccgggacagaatagtattaggcagggcatactcctacccactcaacagttatgaactcaaggcaaactaagctgcctctcaacaatgagggagaactcagataaaaatattttcatacgttctatttttttcttgtgatttttataaatatttaagatattttatattttgtatactattatgttttgaaagtcgggaagagtaagggatattaaatgtatccgtaaacaaggtgatgtgatctttcatgtgttagtatattcgaataatatacatatgagaggtatgcctgtccagtaaagagattgatttgtttgtatggctctggaataactcattcgtttatgaacacatctcatgtattacttgacacagtacctttggtatgtctgcttttctttcaatcctcattatctttagccctcagctggccagtacttattgctaaagaaagggagatcaatggagttgcctaccagcacccattctcttttagttcagctggctaatagtattggaatacattgggaaaagagtgggttaaagtcctaggtggggttctctttgttgcctaccaggagaaagcagtaggcttcctttctaagatacggactcagctggtctattttaccctgtgacatttaaatatacttttgaataagctactatcctgaggctgagggttttgctgccacttttcctg

SEQ ID NO: 107704 - DNA, 3896 bp, Homo sapiens
aagtgatgtgtgttttgccattgtggtttttctgtaggttcttaataatctacaatgaatgtgcactgctcttatggaaagaaattgaagagctccccagataatgaatttactatcagcaatgtccctcttgagttatgtttactcctgcgggtcctgactattttattgacctaagttataagttatattgacgtaagttataaggtgtgattttaggtggtatctgtggtctcattttcacactttgttttacaggtttggtgtttatgttcctctttgctgttttcatcaagatagtagagcacatcttcttctcacagactacaactatgtggttcagcacgaggcagtagaggaaagtgcctcgactgtgggaggcttggccaaatccaaagactttctctccttgttgctggagtcgctaaaagaacagtttaataatgccacacccatccccacccacagttgtcccctatctccagacctcattcgcaatgaagtagaatgtctgaaagcagatttcaaccacagaatcaaggaggttctcttcaactccctcttcagtgcctactatgttgcatttctccccctgtgttttgtgaaggtaagtggttatcttacttttatgtgcttcctggatttgtgtgtgaattacataaactgggtatttcttgtttaatcccccttttctctgtctcccctttggcagcctggatggtggagttcggctgcatctggagtgcactaataccgctcctggttggcggataggtatttccatatatgtgatgcacccgtggtggttccctctttttttctttttttttttttttttaagtatttttagtttctggggagaatcaaaatgtacttataatagaatcagtatgtagtagcttaagaggaccaaggtttcagtaaaactcagcctactgtggttgatcttaacatggttatcaggagtttccttgaatttaatctagcccttatctaaacttcagtttactttaatagaaaagaaaaatggtctggatgtcacttgggcccaaaatcttttggtacattttagtgccctttcttcacccattcagaagtacttctgcagctggaatggtccttcagagaacactcagttcttctagaaaggagacacttaaaatataattgcctctccctcccatccctaactcatacagccagaaagtcaggttgaaggattgtggaggactctgctcttgaacttttctgcacggacagcaggaccaccagtgcatgtgtgactcagtgtggcatttgtctgcagggcatatgtacaccaacccatccctgcctctttttaccagtgcatggatcatttctctctcttctgatctcttccagagtacccagtactatgacatgcgctggtcatgtgagcacctcattatggtgtggatcaatgcttttgtcatgctcaccacgcaactgttgccatccaaatactgtgatttgctacataaatcagctgctcacctgggcaagtggcagaagttggaacatgggtcctacagcaatgctccacagcacatgtgagtaagctagagggtaaaaccatgtaacactttctacatgctgctgatcatgtttatttgctttgtatgtcattcttgttcttggctttgaacatttaatttttagtttttgtcttacatggatgcttgtcatcatgctaaactgaatacaagggacattaactcatttccaccaccaccccagctccttaaatgcgttctacctttcagctgcccagtcactctagtgtgtgtaatttgtctcccaagcaatgcacttggcgttctctttcaatcttacccctttgcccgaattcaaagagtcatatattttatttctttttagaagactttaagatttgtcttctcatcttcattgccacagctgagtagttgctagctattcatctcacacttagctggaatatgattctctcattttttctttctaatacatgcagttttgttctagtaattttccttacctgtacttttttactattattttctttctaaactctctactgaatatttccctgcttctcctgtgtttaagtgagaactgtgcctgactgagttctttggaagaatttttctcattgtgtcccccttatcagtcattactccacatggctcctatgatccaaaatggctaacattaggaccgttttattctgtcacttctgagtccttcatcatacttttctttcagacccaaaccatcttcatcttcccccttttgtaatttgaacatttcacaaatttcatctagaaatttttccctagttaagtgggacagattgaggtgaccttccctttccctctccccctgagagttctcccttcaattatctgccttgatgtctgatacagattagcacaggccttcaagcccaggaactgaaagagattgggccaggctgaaaagaaacccgactgtgggcaaaggacagatttcaataaaaattgaaaatacaatccacagtactagtactgtacatcttcaggctactgatggcacatggccatgaggtgtatcatcactttaatgctggtaagtgtgagcaaggccggtggaacattttctgaactgggaaagctttagggtgctagaatttttttttttttttttaataacatatctaaactgcctcccagttcttatcctaggaaactaacctttccaaaatcaggaagagatgaattaacttagatttttttttttttttttaaaaagcttaacctgaagatccctgtccccacccaaactccattatgctggaaagaatgaagctgctgcttctgtaacttcttttcccccagagaaacctctataaaaataaaccatgaaagcagtgaaaagtctgtgtgtgtgtgtgagatgtatcgctgtgttctactgtatatcttcttacagttgtgaggtatttgaattgtgtgataagcaaactgatttcctatagttttttgggatgtaattctgcagtaaatgtcatgctagattgacaatgtgctaatttctccactattcttattaccatcagctttctcttcttgtttgttccctctagcatttccaccagtagactctgctcacttgggatggagatgacagtcaccctgcttacacactgttttctggcttacacatttatgtctgctcattcttctaagcctcttaagtcctttgacactgagttaactatatttctttgcaacctctgtttactatatagcaatgaagttaaagtaacaaatcctttctaaaactactccagtttgaccatggaattactgtattttcagaattcaggcagatgaagccttgattatttaattccttccataaaaatacagctggccttgccagatgctatcttatctgtaattgccaatatgctaacattgcatttctttctcccttagttggtcagaaaatacaatatggcctcaaggggtgctggtgcggcacagcagatgtttatatagagccatggggccttacaacgtggcagtgccttcagatgtatctcatgcccgcttttatgcaagtaccgcttatttattttcaaacataagcttaggggtaagtgttaggaggccactctatgtggaagcatgtagcatagcatgtagcacatactaggaaattattacatggtaattattgctactagcgtaacagtggtccctgtactttggaaatgtcttttgaagggcagtttgaagatcatatactgttattccagtttcagtagcttagctggtttctctagttacattggtatttgtcgaatctagtattacttgaaacaagcaggcagttatctaagactccttttt

SEQ ID NO: 107705 - DNA, 1024 bp, Homo sapiens
ttttttttttttgagaaggagtttcactcttgttgcccagggtggagtgcaatgtgcagtctcggctcactgcaacctccacctccagggttcaagtgattctcctgcctcagcctccgagtagctgggattgcaggtgcgcgccaccacacccagctaatttttgtattattagtagagacagagttttaccatgttgaccaggctggtcttgaactcctgacctcaggtgacctgctcgccttggcctcccaaagtgctgggattataggcatgagggactgtccctggccctaaatatctttttatttgctatttttcatatctgaatttatgtgcatgaaatgaccatttaatttataatacctaggtcacaatgtggaaattacttaatgaggacttgaagtatttaaacaaattttaaggaaccaacagttggaatactataagaagttatcagaagtctcaaaaatgttcacttctttaaccaattaattttactggtagaaattcatttgtacttccagaatttttttttattaatgagaagtttattgcatacttaaacagtgttacagccactatctgaggtaccagagttacagcagtgaattaattacgttgaaatctctggttcatagagcttaaattgtagtgaagggaagattgactaagaaagaaaacaaacaaaactacccccaaagttaaaaatcgaataaacatggtaagatctgtggagaaaaataagcaggaaaggagaagaagggtcgcctgtgggagtgggatgggtgatacagtagggaggcaggagggccccctactaagaaagggacatttgaagtaaagaacaagctgtactaaaatgaccaaacgtacacacgtattgggaaaatccttatcacattgttatttatagtagtggaaaataagaaacagcctgtttccaacaagagagaaatgggtaaattatggtatttctatatgagaatactattgtatctttaaaaatttctatagaaaaata

SEQ ID NO: 107706 - DNA, 1453 bp, Homo sapiens
atcctggccaacatggtaaaaccctgtctctactaaaaatacaaaaattagctgggcgtggtggtgtacgcctgtatcccagctactcaggaggctgaggcaggagaaccgcttgaacccaggaggcagaggttgcagtgagccaagattgtgccactgcactccagcctgggcaacagcaacagagcgagactttgtctcgaaaaaaaaaaattaaaaataaataaataaataaaacactggttaagttgttaaaatataggttgcttgactcaagattttattccttaccccttgagaggaaagttgttaggagtttacatgtccaattagtagcccaggtcattctgatggaacaaaataatgtgatccgtggaacatactttgagaagctccaatgttaataaattagatgatataaaaagaccttaaaagagttctgtagatggcactctcggggtgcaagaaggaaacaactgtgcctggagaagtctgaattttcaattattacgaagataaggtgggatggggcagtttttcttttatttcactttttaaagacacattttagcttccactaaacctattaagttcttacttgaattacaatgcttttgaagaagatcatttacaaaatgttcattttggtgcttccaaactttcaggctactaaggcaggtgcagcatcaatgattcactacatggttctgatatcagctcgcttggtactactcactttgtgtggatgggtactttgttggaccctcgtcaatctctttcgaagccattcagtcctcaatctccttttccttggctacccgtgagtactccagttttaccatgttattagtaaatctttagaaattatttcggtcacgtaaacgatacttttaagagtgaaaaatgaaattcttcaaatataaatgaagcatttagaaaactgggaaatccatgagcatggtgaacatataatttgttttctaaactggagtacagttgggacaacaggcataaaccaggactgtcctgggaaacctggaatgtagggtgtgttgccagtggagaatattttaattgtctctcttcaccaagtaaaggcccctcttgctatctatatttgggtaaacggtagttaattttagatgaatgcactggttcgaaaaccagtcttacccttggttggtcatattactttgatcttctgtttcctgtaacagaagtacaataagtagtcctcccttatccatggttttgatttctgaagtttcggttacctgcgatcaaccaaggtccagaaacattaaatagaaaattccagaaatatgtgacaaattatgttttaaattgtgtgctgttctgagtagtatggtgaaatttctcgccatcccattttgtcccaccaggatgtgaatcatctctttgtccaccatgtctgtgccgtgcatgctacctg

SEQ ID NO: 107707 - DNA, 1168 bp, Homo sapiens
cttatcctttaggtctcagcttaaataccgtttactaacacaagccatctctagaataggatctcctgttatttactttccatagcagcctactcttcctatagcactcattacaattaaaaaaatgattagataaaagtttaatatttgtttttcttggttagtcagcttcataagcacaggggttttgtttgtcttggttaccactgtacccctaggacctggtaaagggtctgtgacatacaccacagtgattagcggcttggggctctggaataaggcaaaattaacaaatccaagctctgtgctctgatgacattgggcagaaatagtcttttttatttctaaccctgaacttttgagaaggaggtaatagagtaactccaatagcttaaataactttactaagctttgatatgtgaggtaaattggcatgaaggtatgtatcaggggagttatatgaagctatgtgccaggctatgactgagaagagcttgagccatcttcacagtttgaggcttaagccgttcattatggcatttattcaactgctgctttgcattttaaagtaactatatattacgtatatatgctgtatatatatagtattcagtatacagtatattgcgtatatgttataggtactccataatatgatctgtaaactaagaaacggatatataggagggacctgaaaagctccttatcccctaccatgtactgttgactctagataatttttttctcctttttgggttccatcactgctctcttagaggttatggggatcttccattttcccctacattttgctcattctcttctccctagttcattcagaaagaaaatggcattgcagagtaagttttgacaagtacttaatatatttagtcagttttaaagatttgcgattgaagaagcatatttgaatagctgtgataaaaagaattggaagtgattatgcattatttccatgtttgcaaaagttaaaaaagaaacttatttatatagggatctgtcaaagaagatcggattattttttgaaacttcactaatttattaaacattaattcaccaagcaaattagaggtgaggattcaaagaaaaataaaaatattgttactgctgttgaggccctttatagtttagtgggaagtaagacagataa

SEQ ID NO: 107708 - DNA, 1311 bp, Homo sapiens
cctcccaaagtgctgggattacgggtgtgatcccaagtgcctggccaaggcttgcagttcttaatgggaacagaatacttaagctaaatttaaacatcgttttatcaaagtcttaattctataacttaatgttcatcagtaagggaatgtttaaataattttggtacatctacataatggaatagcatacagccattgacaacatgaaaatgtgtttatgtattgacctccaagatgttaaatgaaaaaagcaaggtgcagaacagtgtttaaaatgagacaggagggaacaaaatatatttgcttatatatgaataaattgtttccagaaggacatacaaactaataacaggttgcacagttggtggctaggagacaggatcagcaggtgggaagcttttcactacaagcactgttacatgttttgtgttttgagtgatatgaatgtgttacctattcaaaaatttaaaataagagctgtatagtgattttcctcctaaaatatctaaattagatggataaaacctatcataaatcatctttccttccttccattaaaatatgttttcctcctttttttgcatatatcacagaaaggatccctaccctgagaaagatcaataatatttaaggagaggctgctggtaattaattcataaacggaaatgctattcagagaggactacctctccacgtaggtagagtccgtttattcaccttcaggccagctctgcctgttcacctccaggctaactctacttctatacttgcttcacaagactagaaataaatttagctgttttttcaccaacctgaagcaactctctttttaaaaattgtttttctaggaaaatagtatattttattgaaaaaaatttggaaaacactaaaatataaagcaggacatttaaaaattgctcacaatctcattattgaagaccactttttttggggggtggggggcagacagagttttgctcttgtcgcccaggctgtaaatggcatgatcttggcttactgcaacctccgcctccttggttcaagcgattctcctgcctcggcctcccaagtagctgggattactccttggttcaagcgattctcctgcctcggcctcccaagtagctgggattacaggcgcccaccaccatgcccagataatttttgtatttttagtagagacagggtttcaccatgttggccaggttggtctcaaactccagacctcaggtgatccacctgcctctgcctcccaaagtgctgggattacaggtgtgagccattgcacccggccaaagaccacattttgct

SEQ ID NO: 107709 - DNA, 1511 bp, Homo sapiens
agtttaaatgggctctgcacctccttcttagtcattatttgttactgttttatttcttacaagcagttttaactatttaaaatgcttttgtttgggagcttgtttattgtcattacttgccctgcttctccaaacaaatttattgaagatatgggtttagctgccataacagggtggctaaaacaaaatagaaacttatttccctatttaataaacgtttaggtgggtgatataacatcagcatggcaactctttgtatttattgctcttccatccccaatatgcttcttccaaaccatggtccaaggcaggtactctaactccagttatcatatctgaccagcaggaaggagaaagaaaagagaaaaggggacagctctttctagaagagtatggcttagaagttgtgcgtattactttttcactcatcccttggctaaaagtagtttttgcaagggaggctggaaaatgaacctttagctggctaggagtcagtgcctagttaaattttatggtgatgcagaaggaacgaatagtaatctctgccatttcctttccctctgacaccacagtagaaagtaagacccaggagagcaggaaccttggctgtcatcttccacactgtatctttagtgtgaaggagagtacctggtgcattgtggatgctatgtatagatttattaaattaagtaatcaagaaatttaatgtttcattctggaaggaattgtggaaacctacagaccttttgatcatcaaaatgaaaatacatcctgattttggtggttcctgggatattgttgctaaagacttttcatttgcttattaccacagttgtatatacagatttagaactagaaggaactgtagacagcatctaggtaatgctattattttttagaagagaccaaacataaggcatacttctaaatcaaactaggagaaacactaaatgagtataattgatgtaccatctagtagagaatttagtagatgcccaattagattaacataagcttgtgtaagagaccaacaacagtaacttctgaagactgaatcccaactgatagtttgacacattataaatatgccattttatataaattattcttgccataattctgcaggttataacttgttaactcaaagctgcaatcttttccttttagtacagtaatacttttgaaaagggagaggaatatattgcaggtagtttaaaatagtgtttaaaaacttaaagcaatttgttatgaaagaagaagtagaaggtacgtagtctcttcaagatctctcatattcccataatctgtaagggtgtggtgatctaaggaagatcttttgagggataaacctctattcttgtagtagtgccagctgaatacacatcatatttctttctgatgtagttatttatttctgttgtagaattttcatctcattgattatcatctggcagcattcatcacagtgatgcttgcgaggaggcttgtatgggctctcatctcagaggtaa

SEQ ID NO: 107710 - DNA, 1050 bp, Homo sapiens
tacaggtgtgagccaccacgcctggccaagaaaagttttaatatgactcccaggtttctgatgtgggcagctaactgagtgggccatgaactaaggtcaggactataggagggaagaacacagagatgtccagtagggagttgaataatgtgtctataatttagcagtgagctctatggagagaaattatagtcttcatcatgtaggagataatggaggccatagctgcatcttagatcactgacagaaagtgtggagggagaaaagaggatcccaggatggagtcttgtggggaaagcagacagtgaaggggtagatggaggagacagcaggagccctttatgttctgtgatactggaggttatcaccatttgagttaaccatagttttctctttcaggaatggtagtgctattggccttccagtcccacctatcacagccttaatcaccccaggtcctgttcgtcattgccaaattcctgacttgcctgtggatgggagcctactctttgaattcctttttttcatctacctgttggttgctcttttcattcagtacatcaacatttataaaacagtgtggtggtatccttacaatcatcctgcttcttgtacatcactggtaagtcttactcagactttaagttcttcatgttacttacccaagaaactacctggaaagcctttctgtagaaattgtttttcttaataatttttcttttaataaaatgtttttctgctaggccacagattactttcagaaataaaatttcatgataagatggttaaattataagtactaccagaggaagtaaaaatataaatgaaaatgcagaaaacatttaaataattttttataataatatcacggaaaggttttggtatttagttttctctacaccattttaaatttgtaagtataaggtgtcagtgttactacattctaacaactctacccttttaatggctgaattaggatagtggtagcttctgtaacaaataaactctgaggcagttgtcctggttgccaggagttcttcaggggaccca

SEQ ID NO: 107711 - DNA, 1322 bp, Homo sapiens
gttgtttgctctttgaggtacatgccttaattttattaatatatgctatcaacttattgattcagtactttcaaattgtgatagaaaatcttagctgtccctaactaggattctagccaactaaaaaattctaactttgcctcctaactctagcagttctttgttcgttctctttgactttggctttgaggattcctctagataattatgttctctagataaaaatgttcttagactgtcccatgaaatccctcttcagtgtctcaggggttgctgtaggagggcttagaagggaaaatggatcaggcaagcctaacagtctaggcttgagttttcctcgtcttcttttaattagactgactcattttcctatgtgttttaaatattaagatactatgtaaaatatcatgaggaaaggaaaataaagcgttctgctattaaaaagaactgaaagccaatgaaaatgtcatttgtagatgcttctgcttgcacttagagtctgcagatggtatactgggaagaagtaggaacgttcggaaaatacctcggctcttgactgggtttggtattcttttctctgccttcactgtagctcttctatcctggtattcaaggttccaaccatggttgctttaatctgcctttctctcctcctttaacatatgtttatttagcaattaactggggggagggagggagtgggtagaaaaaagtattttccaacattttaaaatgaaagaaataattgtttatggtttgaaaagtcaccaagactattattgagtgattatttgtgacatgtttacctagagaaattatttggggaaaagaaagctttatatttctttcttggtgggaagcaagcagctggaataatttgttataaaagacctggggacgaggtatgaaaacatgaaagaactagcggatagcttataatatagttttaggaaggatatatagaaagaaggagtgtccagatgaggagaactcacttctggagtgtctatagagtattggagggaaatagataattgcttcagtattacatacttttggatgatacatttgattctgcaagacagacataggtcagctggagaggagagaatttgtccctgtttggtaggtgcttgtggtctgattggtgaagttaaactctagaatgtcaaggagctagtttggtaacacagtcaaggttgaaattgtagttccttgtcctgctgtccacctttggggagcagggatttgttcttgcaacagtgtatttaaagtattatccttttaaaaaaggaagatatattgtgtatttctggatttct

SEQ ID NO: 107712 - DNA, 1169 bp, Homo sapiens
cacactcagaagaacacactcagaagttaacttatccggataaggtcagataatatgtgaccatctgagctcacaagccatatcccttgataacaaaacctaatgttttataaagtgccaattcttctatatttcaagtagtttaagtgtgaaacattgagctggaaatgtataaggtgtgatgtttcttgtaaacttctatttgattataatatcttacagatgatacaaatcagttgacaaaagacacaaatcatcacttgcctaaagctgaacagagcttagatcagaacttaggcttttgacccattagagtctgagtagtcctttaattcgaataacgtaagtagtagacactgggaacattcgtttgaaaatcttattttgtaaggcctgcttactcagtgtttgtcgttgttttgttgcctactttaaaaatagtctactgatgtttaaatgtttttgttgtcgttcagagttgaaactggttgacaaccattaacctgggttgcaactacaggtggcactggaagcagactggttcctggacatgcccggtggaaggaggggccctagtcggcaacagctaagccgttcagctttaccttctttgcagactttggttggtggaggctgtggcaatggaacaggcttgagaaacaggtaaagaaaaaataaggctatatataattttaatgtcctttgatcagtaagactaacataaaagtcatcatgtcattcagatatttgcttattgagatttattcttgacactgtggtagaaatcctgcccttcaagacaaaattcagaattccaaaatactttggaggtaaaaagatgtgaaatggggcccacaaagtgaaagcagtcccattctttattttggctgatcatctaaattcttgttatcccctttttatctattagaagaagggagaagtgaatgaaaatacaaggtaagtgtgatggtttatctacttataagcattctttttttagagggcaaattataagtcaaattccatcaaggattttaaattgtcaaaaaattgtttggtcttaataaatgttagctgttttttagctgggttagcccatgccatcaggaggtttgataatgtagcagttcaaagagatacttttacctaatgaagtatttgctcaagat

SEQ ID NO: 107713 - DNA, 1080 bp, Homo sapiens
actagactctgagcttttgtggtattcgctttgtaaccacagcatctgtctagttcttagcaaacaataagcgcagggttggatgctgacgcatgacttcatgacttgggctccctcacttagcagtaacgtgaccctaggtgacacctcctaatctacactcatctgtaaaatggcggtgataacttgtacatggttactacatggagtccaagagacagcaagaaggatcagtagcatggtgcccgcacctagcagccgctagctgactgaggccgaaagaggaaatgctttggccaacactggccggaaggggcgggaccgcgagttaagaggagaaggcgcgccccactgcgcaggtgcaaatggtaggggttgtcgtgccggctgattccggggacgcactcgcggctggggcagaccgcggtcgcgtagctgacgtcatcgccgtgcgctgccacgtctgctcagctccgcggtaatggaggctagggatgggtgctgaagtatcaggctctggctctagctttagctctggcactggaactgcgtcggagtctgggtctgagtctggcagcccgaagcctggacaccttttcttgattctctaggcgggggctgcctgcgtccaagcagctggtttgcagcgttccaacgctgggagggagttcccttacctggggtccagtctgtaaagttgtcgccgctttctagggaccccgccccaccggctgggactcttccatgcgtgagtattactgagctgccccaaggtccggctgtcctggacctgcctcggccctcttgggtgtgcggcggagactgctttgtctacctttctgccgacttctcttagggaccagtctgttgaagtttgtggtctcctgcagtccaccacaccgcatactctcacctcttccgtcccagttttttccctgcacttttctttccctttgcttgttaatggagcaaggaccagcagcccctgcatccagcggtttgaatgctttgtttgacttggggttagtttacagccgaaggctgttaggaatagggagcatttgaaaacacgggtttttt

SEQ ID NO: 107714 - DNA, 2115 bp, Homo sapiens
aactttatttaacaccattgatcttttttcctacgtctaagtcaccccaactgttataaattcctattacaaagggatccctgctatgctaattgcaacctttggggtctaaccgtgctgtacacacacacacacacacacacacacacacacacacatgctcaacaaatttatgctatttgataagaggcaatttgacgtcaagagaagaactgtttggcctaggctctatgccaagtcttggttgtgccactaaccgtgaaacataccctctctgaccttcagttttctggctgcagacctattttcccaggggtgccagggagggaggataggcaactggtccattcgtttatcctccccaccttcccggcgcagccttctcagggaaactccgcctcaaggctggggactggaggaagggtggtggggccacggtggccatctttgtgcggggcgacccgccgcccacgtgctgcggctcccgggccatctttgtgcggggccgcgcttccgccagcgccgcagcggggaatctgcagtaggtctgccggcgatggagtggtgggctagctcgccgcttcggctctggctgctgttgttcctcctgccctcagcgcagggccgccagaaggagtcaggtgggctccgggcagtgccgagcctgccccttgggctcggggtctggccggagtcccgaggcgctcccccgcgcggccggctcccgggaagatgccgtggccgctgtagctcggagctgggcagaaggcaccggggcgccttgcggcggagagtgaggtgccggggtctctgctcctgctctggaccctggagagtaacccattccccggaattcagaatgacagggaggagagggaattccccgttcacccgcaggaggcgtggcccgtgcttggctactctggacctgcctgaaacactgaggggtcggggatgggggcaaatgtcgtgcgcgcgagcgtgtgtgtatatgcgttgccagaagagaagaggggtttaatgtctgtagcttttaactgatcctctttgtggagttcaatttgattagtagaaagtgagagtccgcgtcactatccatagcattctgagggttgagcattaagcttgggaattttccagtttcttggacacctgacagccggatagaggaacagacttgacgtgagcgtgggagttgcacacacaaaaattcctccctagcgtttcgtttccatcagtgggatgggaaggggatttctgaaagttttggtcttctgtttcttctgttggtgtggtgtcagcaaataacattcaggaaaatttttttaactctcatttacttcactttttaaaggttcaaaatggaaagtatttattgaccaaattaacaggtctttggagaattacgaaccatgttcaagtcaaaactgcagctgctaccatgggtgagttcttttctttgatgtgtctttgagagtttagttgctgtcacaggaagtattctaacatccttgagagattttggttgcagtggtcagaaaggcaaggatgtttttctatttctggggaataaaaatgctctcgcatgggaaaggctcaggtggtgtcaacctaaccactgactcactgcgggattcagtgcatgtgcatctgtttttcccactgggctgcaagcttcctgaggtcagggtctgtgtcttatttgctgttgtctccctggtgctagctgtcagtgcgtgctcgataaatattgttgaggaaataaacccatctatcgctgaatctagtcctaaatttcctgatggttatctttagaaaatgcacatcaggctgggcatggtggttcatgcctgtaatcccagcactttgagaggccaaggcaggtggatcacctgaggtcagaatttcgagaccagcctggccaacatggtgaaaccctgtctctactaaaaatacaaaaattagctgggcatgatggcacgtgcctgtaatcccagctactcgggaggctgaggcaggagaatcgcttgaacccgggaagcagaggttgcattgaatccagatcatgccactgcaccccagcctgggtgacagagtgagactccgtctcaaaaa

SEQ ID NO: 107715 - DNA, 2022 bp, Homo sapiens
aacaatattttaaatcagttatttccatgctgccagaaaattttgatcaagcctttgaatattgcccctagcatagtgctggtcaggacctcagaggatgaggcagaaacaagctaaactgtcagtgtatcttctttttctttcaagaaatccctgatttcccagggaatctagtcagaaagctgtgttacactatttatgattatgtatataacactttttctggcttgcagaactgattttgataatgttctttattcaggttgaaggtaatgaaaggttttctatctgttctcataaactaggagacttaattataatggaaataaaaatggtgtctttgtgaggagcaaagccaaaggaacacaggtggaaaattagctatttcagctattacgagagtttgtatcttgtctactaattaaactattccatataagggaaataaagaaaagaactggaatgaataaagtggtagaagtagcaataatactcccttcaaagctatgacgatttatttggaaaattttattaagtattgtaagctggagcagcttagctatgagtgaacttgcacaatacaaaaaagcagaatagcccctttagaagcattgttttcaggagactttgcagtagactgatgatatggaacactggaacactggcttgtcttactttaaaatgtgaatgggacctcgccttgtcctagagcctgcaggcactactctgctgaatttatggtatgtctggttgacaggtgtagtggtgttgagcactttattttggaagtgatcgggcgtctccctgacatggagatggtgatcaatgtacgagattatcctcaggttcctaaatggatggagcctgccatcccagtcttctccttcagtaaggtaagtacagggagagccacatgggtggatggagagtggtcctctaggatatgagcatgagatctttgtccggtgacatagtctgatggataatggtaaggatgaggactgaggtccagaaatgggtctgtgtctctattagcatcacagtgattgagcaaaaagacagaggagatgaagttgagagctggtaagtagtgtaagattgcttgagtgtctatagggctagagatggaggctagggcgtgagaggcctgagaaacctacaggaattagaggtgggtcttgaagatcttacagagcatgggaggaaggggtccaagaaagcttggagttagggaacaccttcattccaaaagtttgttgagctcctactatgtatatattcagccatagtgctgggtatcagctgtcccatctgtcaccatattccgggggcccagggtggctaaaagtgaacctgaaggtgccagataactccacacggtgtgtgtacaagccgtgcattgaagggataggctggagatagcctagagggctatgcaagggggtgatcttttagactcatcatggaagattggagtagctaggatacacctgtgggcttggggaattgggggcaaggaatgtcttgtcagtgctcaggttcatgtaaatgttgtatcggcagggatgggccttggttccctagagacaaggaaagcatttgggggtgaaggcaggaaggctagaagagagtggatggaagattctatggggtaagagtgaattgaggaaaaccccatgaaatttgggaaaaggaacactatttctgatttggtttgtctaaagcagagggaccttttatccccactttttctttatcatagtttactttctccctagacttgttttatttcctgtgttgcaagtgggcagaggccacatttgtgttgcatttcccatggtctagcctcatttctcgaaagtgtttggttccattgtttgtcatgaaactcactcagaagaacagatagaggctcccatgtaagtcagtagggacttcgtgtttgttatctatctgttgtttctatggataataaagtatgaccgtcggtatactaactttccgttcatctttacttccctt

SEQ ID NO: 107716 - DNA, 1044 bp, Homo sapiens
tggctcttactctcaaaaaaacccattgggaaataaccaaaaactggtaagacagtgtaaactcttaaatgtaatagttaaacaatgagagagctctgtgattattcagaattgggcatattgtttccttaaattggaaatcttaacagtatatatcctctagaaaaacagaatttgggggaactgaaaaagctgacctttaatgtgattctgaattctggaattcagtgagcccatgacttttaatccatagtcacttttgccttttaatgtctacaggctagactttggaaaatagggaaaatatatctttgacaatgtgacactaaaccaaggctgtccagatcctgtggcatgattgcagttgcctcttttcactgttccaagactgatttaggacgacctgtctgtttttgttgaagacatcagagtaccatgatatcatgtatcctgcttggacattttgggaagggggacctgctgtttggccaatttatcctacaggtcttggacggtgggacctcttcagagaagatctggtaaggtaggtcctttaaagaggttttattttttctctttctgggttttcttgaaataagccatagaatataaccaattatttactttttttttttttgagacggagtttcgccctttttgcccaggctagagtgcaatggcgtgatctcagctcaccgcaacctccgcctcccaggttcaagtgattctcttgcctcagcctcccgagtagctgggattacaggcatgtgccaccacacccggctaatttcgtatttttagtagagacggggtgtctccatgttggtcaggctggtcttgaactcctgacctcaggtgatctgcccacctcagcctcccaaagtgctgggattacaggcgtgagccaccgcgcccagcctatttatttttaagtgactaatttttaagttaaaaattaaagacagaaaactgtagtgtaaacaattttgtacgtgtctaataatatttacatatccatagaaaggggcagaatagtctatccta

SEQ ID NO: 107717 - DNA, 4499 bp, Homo sapiens
tgtcctttagggctttttcttttgagtgactttgattagacttacttagaaatatgaagctctggccaggcacagtggctcacgcctgtaatcccagcactttgggaggccgaggcaggcggatcacgaagtcaggagatagagaccatcctggctaacacggtgaaaccctgtctctactaaaaaatacacaaaattagccgggcgtggtggcgggcgcctgtggtcccagctactcaggaggctgaggcaggagaatggcatgaacccaggaaggggagcttgcagtcagccaagatcgcgccactgcactccagcctggacgacagtgcgagactccgtctcaaaaaaaaaaaagaaatatgaagctctgaactaatcttcagaaatggttaaagcacattcttatatagttgaaaaagatatattgaaactaattaaattctatattcttaggtcagcagcacagtggccatggaaaaagaaaaactctacagcatatttccgaggatcaaggtgagttattttctgacattttacaaagatattcttccaagtaatgtaaaatgtaagtaactttgagggtatgacaagctctgtagttcaaagggaaagctaagataacaaagaaagaaatgtggaatcacaattttagattcgagaataattcacattatttgccgaaatcgccattgattgagttgatattcaaagaagtaaagttcatccatttcagtcatttaacagatattttacatagtgtcacaaatgtgtcggtcattgattatgtgatgccaaacacaacagatgggtgtcttcttacagtccctaggagtagcttatgatcatgccacggtactctgctggttaatgcagagcaggactcatcaccatatctcttgactgccttttttatcacaccctgtggctgccaaatagtggttaagagcacagactgagactgctgaaaatgaagaagggagcagggaggaaagagaagagaaaaatggcaaaggtagtaggaggaccctgtgttgttcagctccatagtcccaaggccaagaacagttcctagcatgtcaatatatgataaatatctgtggagcagatgaatagaaaagaccatgaagggagcagggttttgtagttttagcaagtgagtccttgccagagattatactccctcttcaccctcctcttcacttcggagctagactttaggaggtaaatggattatccagctactatgtcctgtttcttaccaacttctctgattcttaaatcttgaagtcacaaattaacttggggaccatgtctggacttcaagagttttaggactcccttgaaattatgtgaggatatgtgcatttttctgggaaggagagagggttggttcatagttcttaacagattatcaaggaatccatgatgcctcacatgtcaagaccctctgctacttggaacatcactagaaattcttccacatacagtcgtcaggtttttaagccctttggtttttgtgcattttttttaaattaaatattatactgggctgtacagagcatacataacaaaggtcatgtagctgttttagtgagtcgtgactacctagcctcacagttatgagcaccagtgattatagaagccacatgaactttcctaaaagggaaatcattccctgggatttgactatagtgacctgaacaacatacccttcaagaccaaatgcaagcaaagaagggccaagtaccccccaaccctaaaggtacagaggggaccagccctggatgacctagatgctgcagtacccagtatacccctcctccgctgtcacgtcaccagtgaattgtccacttgtgcagagtcattgcattgggtcctagtcctgctcacctttcagggattgggaacagttttctaatacaggccacacagttttatgtcacgtgtttcttttataggacaagtccagaacgagatcctctcattcttctgtctcggaaaaacccaaaacttgttgatgcagaatacaccaaaaaccaggcctggaaatctatgaaagtaatcaccagtcatctgactagaactacagcagtgaacattctcactcaaagaacattgccacctgggtagaatttgagattaggtttcctgtcagtggtgaggtgaatgtaaagaaagttccatgaaccagcattagcatatatgtaaattctcctttttcaaacttacattgcttttctggccatattatgactagtatattgcactactttgaaggtttaaaccaggggtcacaaactttttccaggaagggccaaatagtaaatgttgtaggttttgcaggtcgtatggtctctattgcagttgccaacagacatgggcagtttgtaaatgaatgagcctggcagtgtttttattaaaactttattacggccaggcatggtggctcatgcctgtaatcctagcactttgggaggcgaggcgggtggatcacttgaggtcaggagttcaagaccagcctggccaacatggtgaaaccccgtctctactaaaaacacaaaaattagccgggcatggtggtatgtgccggtagtcccagctactggggaggctgaggcaggagaatcgcttgaacctgggaggcagagattgcagtgagccgagatcacgccattgcactccagcctggcgacagagcaagactccgtctcaaaaataagtaaataaaaataaaaataataaaaaataaaaactttatgggcactgaaatttgaatttcatgtaattttaagttgtcataaaatattattcttttgcctttttttttaaccatttgaaatgtaaaaatttcttagtccatgacaaaaacaagcagtgggtcaaatttggcctgtgggtcgtagtttgccaacccctggtttaaatcaatggtctcaaccctggctgtgcaatacaaccagagagcttaagaaaatgaatcaaatgagtcagaatctctgggaatggtgtccaggaatcttcatttgtttaaaacttttcaagtgattctaaggtgaagccagaaatgggaccgttggtttacagtccactctctcctcttaactctatggctttttgccttaatcaaagaaattaaagccctaaacttcctttatatgaaatttccatataccatatgaggatgctatgaggaaaagctttagacttcttgggagaaaactaagtaaatctgaggtgcatgtattatttcatacagttttaatcaggagcaagtgagcttaagaaactttgttgaataataaaaatatgaaaaaatgtgttcatttagaacaaaagttgttagcatctactgtgggaggctgcagaagcaaacaaaacttgtcccctcatcaaggagtttaccatctgctaaggtggatggaatgtacctggggatgtcaaactcagatgtccccaggggccagcaggtgatgtcaagaggtgagcaagagagaatactaacagttccaaatgttaataagagcccagtttgccagatcttcctttttattctccaagaaagactggaaatctggatttttgcaagaaatatcctaccacctgtaaatgttggcaatgatttgatttaaaaaaaaaaatactttgcatgcccaacaaaatttgagcatgggctatatacacccctaaggccatcagccagcacttgggaccttctctgcatacattatttacacagagtgaagtgtgctgcaggctgtgacatctgaattcaaaggagggcaacatggctttaggtgtgcttaaactttaaaatcagacgggccctggttaaaactctgtcttctatttagagccacactgaccttgagcaaatctcaacttccaaagccttggcttctgcatttatataatgggaataataatgtctcctgagtatattgattatgaagcttaaatgaggtaatgttgatgaaatgtttaacaatgcttgctgcacagtgatcacaataaatgctgttgctgttaatactaataacttcctttccacttaaaggataccttaggaaagccagctgctaaggatgtccatcttgtggatcactgcaaatacaagtaagatttgcaggactcctcactttcttggtttccatactgcttttgaaatagcttcactttgggtgagaactttaatataaaggcccagctggagtaaatgaaagttgcattaattcatttcactggcttttcctcagggcctaaatgcactgacctgagttctgtggcgactgtagagaagaatggaacatggttcctgcttccaaacagctgcatgctagctagtaatcacagtaatggaattacctctccatatgccccacccacccaatcattgaagttagaataaatatttctcagttaataaatattagaattattatcctggtgtgctggcatgctcctgtagtcttagctactcgggaggctgaggtaggagg

SEQ ID NO: 107718 - DNA, 1624 bp, Homo sapiens
cgaggtgggcggatcacctgaggtcagaagttcaagaccagcctagccatggtgaaaccccatctctactagaaatacaaaaaaattagccgggtgtggtggtgcgtgcctgtaatcccagctactcgggaggctgaggcaggagaatcacttgaacccgggaggcggaggttgcagtgagccaagatcgcaccattgcgctccagcatgagcaacaagagcgaaactccgtctcaaaaaataaataaataaataaataaataaaggaaaaagattgttaagttgtattgctacatgcatgtatgtggatatgattgccatagggttggttcttgaggctcaaatgaattaatttatataaaatgctgaataatgcttggcacaaggtgagcactcaaatgcagactgctattatcattaaattctgtgctttaacattttcttgttaaatcttgtctctaggggaagccagtttattaggaaccatttgcagatggatgacatcacctgttactgggagaacctcttgagtgaatactctaaattcctgtcttataatgtaacgagaaggaaaggttatgatcaaattattcccaaaatgttgaaaactgaactatagtagtcatcataggaccatagtcctctttgtggcaacagatctcagatatcctacggtgagaagcttaccataagcttggcacctataccttgaatatctgctatcaagccaaatacctggttttccttatcatgctgcacccagagcaactcttgagaaagatttaaaatgtgtctaatacactgatatgaagcagttcaactttttggatgaataaggaccagaaatcgtgagatgtggattttgaacccaactctacctttcattttcttaagaccaatcacagcttgtgcctcagatcatccacctgtgtgagtccatcactgtgaaattgactgtgtccatgtgatgatgccctttgtcccattatttggagcagaaaattcgtcatttggaagtagtacaactcattgctggaattgtgaaattattcaaggcgtgatctctgtcactttattttaatgtaggaaaccctatggggtttatgaaaaatacttggggatcattctctgaatggtctaaggaagcggtagccatgccatgcaatgatgtaggagttctcttttgtaaaaccataaactgtgttactcaggaggtttctataatgccacatagaaagaggccaattgcatgagtaattattgcaattggatttcaggttccctttttgtgccttcatgccctacttcttaatgcctctctaaagccaaaaaaaaaaaaaaagacaaagcctcttaataaatttaatggaactatacatagaacagcagctcttcctcaccctttgcatacctttaatatttttccttcttaaattggccacagcaggggtcattcacactctcactgtcttgcaggaatcacaagaagtcttcatatgtgaacgtgccattcagttggtagttaagagcattcaacttcaaatatatagaagatatttgttttagtgcaaatccatgatggagtgcctcccttttccttttttcactttttgaaaaagatgtt

SEQ ID NO: 107719 - DNA, 1306 bp, Homo sapiens
tttttaaactcctttccacaaaagtttaagtctaatgaccttcttagagaagttgagcatgcctggcaagatcatttcatggaataagcagatgtttaaagttggatttttttttttttttttttttgagtactagcaatgcacagggaccgtgttcttaggttcttagtctgtgaatctagcaataggcagtccagatttctgagtcgtactatggttttgccttgtcactgtgaggccctactaggtgtaagcattctctctgaattttaatttcctctcattaaaataggaacaaaatttgctatcctttagattaggagctgaagattcatttccctgggaatgtttcccatttagcttcaagtttcagctcaaacatcaccttctttctgactcctttcattcattcctccaggcagtaaggggctaccatagtactttgtttatgcctgtattatatgacatcactgtagttgcttgactgtttctcctactgttctgtaaacttattaatgggtgagaatctaattttactcatcttgatggcttcatgatccagcacagtgcctcacacaaagaactattgggtgggtggatggatggatggaggaatggagacagttggcttaaccagatcctatatacagattattactggctccaaaggatgagtagataagaccataagaattggatcaatgtaaatcctcacctgccctttgaagagccaataagggcatctttgtctttaaatacagcaaatgttattcagattttgtacttgtctatctgtttacctcagtgtagatgatatgaggatggtataactatgtaaattgtttttgaaaataatttgtttccccacaacttttgaaggttttatttgttgttgttattactagttcagtcccaaacttaccctttccttttcagagagctaatggccatgcttttcttcaaggaaagaataatttatttgaatgaagtgggatacttgcataacacaaataatgctttgtctttatttatttcgggagtgttatctatgtgctgtcagtgacccaccttattctactatatcagttcagattttcctagtggtcaagaacagaaactgcctctagctagtttaagcaaagtaacttactagaaggacatgagggcatctcgtggaatctaaaaaggtttcacagtggttagaaggatagaagcaagggcacctccaggaatctcagcaagaattttgactgtttccagggtgctactataatgcagttccattacctattgggctctgtctcag

SEQ ID NO: 107720 - DNA, 1055 bp, Homo sapiens
atggagcagagagttatatttacaagtcactcatttaatacttaccagatacttcttaagcatctactatgcacagagacaaggaaagtttacaagaggctcccaaacctcaaggggctgtgccgttgagatgataaacaatatgagaggcatcatacatacgtggaaggtgattaaggcaacaggagtgccaattattcatgaagacaatgtggatctggagtttagaggaagaataaacttccaactggagcagatgggaaactttgtggaggtaaaaattaatttataccatgaaggataagtaaatgaaatggttcttggagttctcaaaattcattctctctccacatgttgaaaagttttatatcatatataatgtaacaaaatgtaaaatacgtagcaagggcagtacttggtgaacctggcagggaagggaacctgctgacccctgagaaaaaaattcactgtgagggaagaaactattaggttctataaacagaattcagcaacaagggctgttggtggaagaatggtgttccaggcagtatggtgattgcactgaaatctttccctgatgcagttactctgctggcaaacacatgtcctggggacaagaaagccatatgtgaaacagtggtccagtaaaccccataacaccttttggcttagaccaagcttgtccaacccatggctcacgaactgcacgcggcccaggaaagctttgaatgcgccccaacacaaatttgtaaacgttcttaaaacatgagatttatgcatggacttttttctttttcttttctttttgttttttgtttttagctcatcagctacagttagtgttatgtgtgggccaagacaattattcttccaatgtggcccagggaagccaaaagattggacacctctggcttagactgtattgatcggagaaccttcaaaaagagcagactacagcctacagggctgggcttggtggctcacacctgtaatcccagcactttgggaggctgaggcaggcagatcacttggggccagaagtttgagaccatcct

SEQ ID NO: 107721 - DNA, 1055 bp, Homo sapiens
attaataatgcctttttttttttttcaagaacttttctctgtgtaaaagactggtgtagttatggttttacaaccatgtctggaacacattgaaggggcctaggctaggaacagggattgatatagtaggcttttctaaatctattaagtcagtgaaaataacactcaagaaggtaaatgggatatgctttaaatcttatattttccttctcctccctttttaccagcacagtgaacactagtctgaatgtataccgaaataaagatgccttaagccattttgtaattgcaggaggtaagacatttttgtttatatttttcagtcttctcaaatacagtttagaaaatgtgtaaggacttatacatcagaactactgaattctttggttggcttcccattacatctcatcaacattgatgcaaaatgtatttatggacagtgttgtgcttcacccttgatatactcaatgggcaaaacagcaaggcccttgctttctttgaattttaatgtctaatatgtatgtgataatacaggttgttgtgatagaaagtaacaattcggtggaacaatgggatctcatatggacagggtagtcaaagaaggcctttctgaggaagtgacatttgagctgataccaaagaataggaaggagcaagacttgcaaggaagggtgtcctaaatagagggaacatcaagggggaaggctctaaggcaaaacatttccttaaaagcaggataataacgtggtgagtgagggaaagagtagcttgagatgagattggtgaggactataggaatggactagattttttatggtaagaacttggattttattttaaagctctctgcctctagtatatatatgtatattttctttttaatgagcattaaaaatagaaggtacaatggtgattaccagagactggatatggggttggaaaagatgttggtcaaaggatacaaaatttcatttagacaggaggaataagttcaagagatctatttaaaacatggtaactatggttactaacagtgtattgtatacttcaaaatt

SEQ ID NO: 107722 - DNA, 1072 bp, Homo sapiens
ggtacttacattcccccagccctgggagcaagaggacagcgagacttcaagccttcacaccttagcacaaagtgtgtcagttcccacacatcactcctgtgagaactctaggacccagcatactaggaatatcttatggatcagagctgtcaccacaacggtatccattatggtaatgtggaaatcataattggcttgtgaggttaggagagagaagaaagttactgtatttgaagttcagggagcagtatttgcttctaaattgctataccaaagcagggaggaaaagacaaatgctatcctttttgttttaaatctgtaagaactaaagaaatggagcagtatttgatttatcctttttatctgattacaggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgtatattcatgtggtcctttgaaagggtattctagaaatcactggaaagaggagaggaaagaaccaggtaggcaaatggtctgtgaaacccttgggtcctggaagcagtgtgagtgtaaatgtgtagtgtttggtttcatctaaataaacaaagatgatttctttgacacttgaaataaaatacaaattcaacaaaaagtagatcagcattattaaagaaa

SEQ ID NO: 107723 - DNA, 1920 bp, Homo sapiens
atagtgacttccaaaacctttaacaagcattgcgggtgcaactgctatagaaaacactattgaggttcctcagaaaattaaaaatagaactaccatatgaccccaaaattccatatatccataagaattgaaagcagggtcttgaagagatatttgcacacccatgttcatagcagcacagtagccaggaggtgggaagcaagccaaatgtccatctacagatgaatgggcaaacaaaatgtgggggggggtgtgtgtgtaatattattcattatccttatgatcatatcattaccattccaaaggaaggaaatcctatcatatgctacaacgtgaatgaaccttgagtgcatcatgctaagtgaaataagccaatcataaacaggctgttactgtatgattctatttctatgagatatttaaagtagccaaattcatacaaacaaacagaatggcaattgccagaggctgaggggagagggggaaaggggagttgtttaatgggcatagagtttcagatttgcaaaatgaaaatttctagagatctgtttcacaacaatgtgaatatacttaacattactgaactgtacacttaaaaatcaataagatgataaattttatgttatgtgtttgtttgtttgtttgtttgtttggagatggagttttgctcttgttgcccaggctggggtgcaatctcagcttactgcaacctccgcctcctgggttcaagtgattctcctgcctcagcctcccgagtagctgggattactacacccgccaccacacccggctaattttttgtatttttagtagagacagagtttcaccatgttggcccggctggtctcgaactcctgacctcaagtgatctgcctgcctcggcctcccaaagtgctgggattacaggcgtgagccaccacgcccagcctgttgtgttttttaccacaatttttaaaaaatgaagagaaaaaaagcattggggaccccaaaaatcaaactggattgatacttagtcactagacacaacaccctaagttctgttactgccgactttggattcctgaccatgcaggaatctgtatttaataaatatacaatcttgttctgtttgcctctccataggtgttatccacgtgaccaaggaagtgaaagaagtggcaacgctgtcctgtggtcacaatgtttctgttgaagagctggcacaaactcgcatctactggcaaaaggagaagaaaatggtgctgactatgatgtctggggacatgaatatatggcccgagtacaagaaccggaccatctttgatatcactaataacctctccattgtgatcctggctctgcgcccatctgacgagggcacatacgagtgtgttgttctgaagtatgaaaaagacgctttcaagcgggaacacctggctgaagtgacgttatcagtcaaaggttggtgggattttctgattttactctaggccggcagattcttaatgcccttaaagacacatggctattgatttaggtgaaaattttaccaaagagggatgtatctcacttcatttcttggagttaagtctctagttgtacaataaactctaactggtttctaaagatgtcctggaaatatctgttaatgtgcatttcttgttctttgacaatccaagttcatgacaatcatcctggggcactataatgacctaaagagcctctcaatcaccaaggggcatctttgatttgatgtagccttgctactaactgcacttgacccagcaatatatgcctgtgaaagtatgctgaaaaggtaacggggctgggtatggtggcttatgcctgtaatctcagcactttgggaggccaaggcaggcggatcacttgaggtcatgagttcaagaccagcctggccaacatagcgaaactccgtcccta

SEQ ID NO: 107724 - DNA, 1333 bp, Homo sapiens
ctccctattagtgagacaatgaatgtgcaggtgctttgtgaactacacattgtgacactaataggaagtgtaaagccttgcacttctaaggccaaatcccagctaagaagagcaaatgatgagctgggtttgacttgcagaatttagtgggcttactactcaccaagaggcaagagatacagttgtagttatgatgatagactttggagtcagatggacctatgttgggatcccagccctgccacttattggctctgtgacctgagacaagtcactgaacatttctcaaactgcattatctccatggtcctccatttgttcatacataaaatgggctttatattcctcatagagcagtgatgaggattacatgagatgccactgatacaatgtctgcaagtagtgagtgctcaataaaacatagctagagtcgttgttttttctgattcttcttgctcctcatcctatttcctttgtcttaatttccccacaaagacaccctctccagagcccagcaattgtgagggactgatggagaagtatgtggctgctatggtgctgagtgcagctggagatgccctggggtactacaatgggaagtgggagttcctccaggatggggagaagatacaccggcagttggcccagctgggcggcttggatgccctagacgtgggaaggtggagagttagtgacgacacagtgatgcacttggccacagcagaagctcttgtggaagctgggaaagcccctaagttgactcaactgtattacctccttgctaagcattaccaagactgcatggaagacatggatgggcgggcaccaggtgagcacagccggtgggaggtgcaaggagggcaaagaataaaacagccttgaggaaatcattaagaatgttgatggagatttaaataacagagacaatagtgtttgtaaatgtgataaaaatagaaataacggccatggtggtggctcatacctgtaattccagctctttgggaggccaaggtgagagaatcacttgaacccaggagttcaagacaagcctgagcaatatacggagaccctgtctctagaatggggtagccaatccctcttctagagacaggtactgatccgtggcttgttaggaactggagcacacagcaggaagtgagtgatgggcgaaggagcatcatcacctgagctctgcctccatcagatcagtggcgcattagattctcataggagcctgaaccctgttgggaactgcacatgcgagggatctagattgtgggcttcttatgagaatctaatgtctgatgatctgtggtggaacagttttgtccca

SEQ ID NO: 107725 - DNA, 1050 bp, Homo sapiens
gagccactgctcccggcctaattgtaaggttcttattggactccataaggaattgggctttggagtctgatggattttacccagccactaactagctgattatgtgattttgaggaagtttcttaagctctgagcttaaaaggcttatttacttaaaaaagagaacaatatacttacttcttaatttttttgtgatgtctcagtaatgactggtaaagattccaaggatccctatatgagtctgctgcctttattagcgttatcttgccaagggttatacataaagaaaggcacattgttgggtggggtttggagttttggggcatgcatcatcatattttttggctctccctttccatcaaaaatacttggagacagagtttagttatttattcctgctggggcctttgctttggttatgctaacccccatcccttatccgactcttccccaggtggtgcctcggtgcacaacgccatgcagctgaagccgggcaagcccaatggctggaggattcccttcaacagccatgagggcggctgtggggctgccatgcgggccatgtgcatcggtctcaggttcccacaccatagccaactggacacactgatccaagtgagcatcgagagtggtcggatgacccaccaccacccaacaggctacctgggggcccttgcgtctgctctttttacagcctatgctgtgaatagcagaccacccttgcagtggggaaaaggactgatggagctgctaccagaagctaaaaagtacattgtccaatcaggctactttgtagaggaaaatcttcaacactggtgagtctgtaagcgcacgccctgctcaaacacggttgaatctgtgcgtgtacatccacctgcacatatatgtcttgtattcagagatcacagcaaccctcatggttttcacccccagccccctttctacccatctgctaaggatttcaagttcccttccagtaatgattctacaaagtagccaagtggatacctcaatgaatagggcagctgtggtgtttccctcttacacgga

SEQ ID NO: 107726 - DNA, 1531 bp, Homo sapiens
taattttgatgtttaaatagtttatgatattactgcaagaagccgaagttatgttggatttttctctgttcacacatccatctggtgctttttgttatgacttttcactttatttttttcaattgactctagattttttcctttctacaggtcctacttccaaaccaaatgggaaaattacctaaaacttagagggattttggatggagaatcagcccctaccttccctgagtctttcggtgtgaaggagagggatcagttctacacctccctgagctactctggctggggtggcagcagtgggcacgatgcccccatgattgcctacgatgctgttcttgctgcaggagactcctggaaggagcttgcccaccgagcctttttccatggtggagacagtgattctacagctgccattgctggctgctggtggggagttatgtatggttttaaaggagtgagtccctccaactatgagaaactagaatacagaaaccggctggaagagacagctagggctttatattctctcgggtcaaaagaagacactgtaatttccctttagggagacgtgatgttcacttctgatggattcttcttttgtgtatttccttttctgctatttcttttcagtttttccaaagtcaagagtcttaaccttgtactcagggaattttgagataacaagtcccttgggcaccttaagctcagttttttcaggctcatcctgttcttccagaatctatcccttttcttacactgaagagtcctttagctcaattgatagggtcagcgtctcgcaagcaaaaaatctcatgacctcatatttgagtcttcattttcatcatctacttgttctaaaagttttttctgtttgtctcaagttgggttcccacaaagtggactttgagacaaagatctgaatgcaagcagtttatatgggagatgattccaggaaataccgatatgagaatggggaaatgaaaccaggaagggaagagagctagtatggggtatgttaatgagcaggtttccactgtgggcggttggcactctgccatctgagtcctctgcctaaagcattcctcagaactgtcccatttgaagggcaagcaaacctggggtatttatccactgacttccatctgacactggttgaggaccactgccagggatgctaactccctggtaattcttggcttaccctttgtacaaaccaaaccttagtgtcttcaggtaaagactcagagatacttgcaggggcaagctgtaaagggcatgggaacagtgagggacatatgtggggtcctaacaatatctgctaggctggtctacctcctaaatatactctgaatctatcacctctattgccttcttgcactgaggatttttcagctggatttctgcaatccaagctactcaagtctgggagatgctgctctgagctgctctcagtactctcctcatcatggcagttaacacattaccaattttgttattgtctgtttgcttgtttgcattatttctaaac

SEQ ID NO: 107727 - DNA, 1049 bp, Homo sapiens
ccacaagtgacctttttgtctgggctaatataaagctggtctctacttattctttctggaaaaacagagacagaatatagatgtttttaaatgaaagttaaaataatgtggtttggcatattagaggcatgaaatgttctttctccataaggttttagaccgtactgtgtgaaaagcaggttcactgtgatttgtctgagtcttgggagacagaacacctatgcatgcaatgagttacaggaatctggcttattacttacagctaggcagcagacaacagaagcctgaaattcatgtgagccagtacccaaggcttaggaaagctgcctgtggcacacggatcctcatctgcacatgcccacttgtaccacaactgaggacccccaggaaggcagcccaccctgggttttatattcaaaggaaacaagaatcactgagctaaagcattgaaggatatcgtgtttgggggtgtggggtagtcgggggactggaacagattccaggatgttggattcccagcacattctacagttattcttgagaactataagccagaaagctgaaagaaccgggcccagtccaagaccttgaaaactgtcttgcactacacttatattttatgacttgttctgagaaggtaagtgtgtgtgcgtgcacgcacgtgcatgtacccatgttcacatgcaggacatacaggacagcaggagtggagagactccataatcgtgctcttcacctcaaattggaatctggcaagattggactttctgaaaatcaggtaggataagggcttcaagccattttgggttgagcactaaaatttcatgacacattctatctgatggaattctatgcaaccttaaaagaagaatgaggcagctccaaagtattttgtttaatgtgaaactcaaggttcaaaagagtttgcgtaagcctgggcgtggtggctcacacgtagaatctgagcactttgggaggcaaaagtgggaagatgacttcagcccaggagttcaagaccagcctgggcaacatggcgaaaccctgtctct

SEQ ID NO: 107728 - DNA, 1064 bp, Homo sapiens
atcattatttcctattcattgtgcatatgtcagtttcccctagatgccatggacccacagacataacagccacctcacactgtctgcccagcctcatctctcactacactttctcttgcactgaacacctggtggtgctaactacttgtacttccaagtgtacatcgggcttcctcacctgtgtgccttggtcctaaccatactctcttcccagaatgccctctctccacctgtcatccactagtcttcaggtcaaacacttcctgcttcaccatgctcccactgcacgggatataaatgtcatgaaaacaactactataggagattggttttgcaagttagagacagattagtgtcagatttcttataataacctgccaagaatgagtcagatgatctgaaaagcatatttccgtttatgtgtgtgtttactgcccactggaccgagttgctgggatcccaggactcaccttagaatacagcacatagtgcgtgtatggtgtagatgtccgtggaataaatgggtgcatgaattaataaacacgtggctgggtgctgtgggaccctaagatagccttctcaggactctgctgtctttgcttctttatttccaggactggtggaacaaggtggtgtcaagatagagccgctccccaaggaagtgaaagtctacctcctgactacttccagtgctccgtactgcagtgagtagggggaaatgcatgagctcagctctgccagggcaccaccagaggagtccagcccagtgtggtagcctgggtgggagtgaatgataagagcaaaggcatcaccggaggtgtggcaacagcccctggtctgaaccaaaactttcagagtgagtccaaccgattgctcttcagatgaggacttgggggcttcttactgtctatctactgatcgtatttcctcttaccctcaaaatttaccctctagtgggtcttctctctcgagtgatgtttaggagtgtcctccggctgcctcctttctgcactctcatttcccacttcttggcgcccaccctatgtggttctcaccctggcagc

SEQ ID NO: 107729 - DNA, 1033 bp, Homo sapiens
aatgccagataaaccaagtgaaattcaagtttcagtcttccaaccgagtttggaaaaaagaccggactaccattattgggaagttctgcactgcccttttgcctgtcaatgacaggtaagccccagtattcacctctgcaccagatgcactcacacatcaaagaccagtcttggcattagatgtgctgcctattgaggttcaatctcatcatagtgattatcatcttagaagcagagatgacagacacccggtgttttccagaacctcctgtgggaccatcttgggttggggaaattccactgtatttgttctgcatatttggtttctatgtaagattttattagaacaaagttttctcattgcatattttctcctctgtggcctccactccaactgtgtcatgggtcacattcatgggtgtggatccagaatccacatcccctttcccttcctctaaaggcatttatgtcattaaccttaccacccctgggcacttggaccacaggaactggctcttaattgtaggtgattgcagatttctttcaccagacatcatgggaattcaaaagccacacaatgccaagccctgtctcctcaccagccactgctctcttattgctcttctcttccagagaaaagatggtctgcttacctgaaccagtgaacttacaagcaagtgtgactgtttcctgtgacctgaagatagcctgtgtgtagtttaacctgggcaggacacatctccctgcattttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaatttttt

SEQ ID NO: 107730 - DNA, 1224 bp, Homo sapiens
catcatgtacttattggcacaaattcaggcagcctccagggcttcagaggagagctgctcatattcatctgacaccatgtggccacagagtggaaactcatccacttttaccttcttccaccccaggtcaaagatgggaatctcggcatcagcaacacctcgccagaagagaggctttgtgttgttcttacaataatggtaacactgggtggggcagcggcccatggtgacaccagaatcttcagtggcacacgaaagggaaagagcttgagatatcttttgaacttaagagtcatccctttctctaagaactgacccccatctagaagatgggcagccccaattgtactgcatgaccctgtcctcagacccagcttaatggaccagaagtagacagctgactgaatctggacaaggtagatttccttcctgaaagtctgaaattatgactaagaggcagccgtacttgtcttctggttgttggaattgttccatgtgaactcaggagctgagggcaaacatattccaccatgagaacagagaaacagggaagactgctctgttggaaaacagaaacatgttgcagttctcctaagagaaacagaaacagaagatggtgactgggtccctgacagcttcctgctttccctgatggctttctgatctagtcccatattaaaatctagtggcatttctgactttgaattccataagacacccctgtgtccttataaattctcctttgctttgtcatcataattatcaacattgtcaacattatcaacaaaaaagataaaacttcctgaacatttactatgtgccaagtaaagttccaattagcttacacaaattatcttatttaatcctcccagtgaatccatgtattacttcattttacatatgaggaaacagggacaaagaaattaagtaacttgtccactacagtcagcaatagataaaatcaggattcacaccaaggccatctgacttcagaatctgagctctaaccaccatgttatacagtttagcctgctcacgttggttcttagcacttgcaactaagacgtattagctaaatagggctcctcagtctggccctactctgcctaacaaaaattatctgccattttccccagtgtgctgaagccagcattcccctaaaacatactatggtcaatgtcacctccatgcctttttgctccttctccttcccacccaccccca

SEQ ID NO: 107731 - DNA, 1055 bp, Homo sapiens
ataattgtcttattcatctttatatcccctgttcttggaacacatagtctgtcctgaataaatgcctattgaattgaatcagctcaacaaatgagaaaacttatgtttctttccttttttctttcccagttgttttttattgtgttctgccttcatgtttgtgtatttccttataagaacataccattttgacagacaatacattttttctttccttttctatcaaatctggacttacacaagacacaacttttcattgttgtgttctgatcacaggtcctatcctgtgggcatcaatgtcactattactgcaggccactattactgcagtgtaatgtcactattacatgcacccatgattctctgacacgtatgccaccctggcaatgtactcaaatttccagcagcaatagatgagcttgtatatgcacacatgtaaactcccaaaagtacctggtaggatgttattaatatactgtagagaatatacaattcagagacacactgacctaggctttaatccttattcacatactgactagctttgtgaccttgggcaagttccttagcctctctgagcctgctgcttctattaaaacaaaaaataggtatagtaagataacataaaacaatagctgcttgataaatgttagtcccctctgctgagatagcacatatgtggattgacaggaaagcaggctgagtgcagtctggacagcaggacaagtgaaccatagagttaatgggtctgcctgtctctttaatgggtcagggccaacctatttggcaggtctcctaagaaagatgagctgctttgaaattgtatcttgggcagagctttggttgcttcttcatttctatgcttctgacttccctgcttacagctggcagggacagctactctggaagctcaggggctgcatgtctgtgatagaaggatgagcagctgctgcttgttaaagtaggggggttgtttgggaggcaggcaagtgatgtaaaaacagtatatggaaatccccaaaccccactgttaaaatgatgtcaggggtccaaat

SEQ ID NO: 107732 - DNA, 1015 bp, Homo sapiens
tctgccttctactttgtggatcttcgccaggcatacttgaatcagcaaagaggggtttgcaggtcttgtttcttgaatatctgtaaaaataactgctttagccttttttggaggatatttttgagaaatatgtatttctcaaacacacacatatgtattatatatatatacacgcagagagagtttttacttcaaaaacttttaaagagtaaataatatcatgaataatttcactaatgtttttagttaggcaaacctagaattttaaaatgttgattttgaattttatgactgatttggaataattctggcaattagttaattactcatctgaggcattcatttctagtggtcttaattccctgactccatagatctggcatgatgtttgaaatctgactttctaaaataaatatttttctgtaggtggtctgctgtgtgaataaataattcctgaagaatgaagaagattaattttgggagttctttgacgaactttgatatgtggaaaaagtatttataatttattgtaagaagaaagtaaaatattactagtggaagatcttcagttgtgtttcttttttgtgttcctcatttgctcacgtggctttttcccccaaaggatatataccaacaaatcttgtaacataaggttcttatgttcttattactatgtcattctgggaactctggatatctgttgtcaggagaaagcagatactgacctcaaccaatgaaatctccagaattaggtgcatagaagtaaaataaccctttaccaattcagaatcagtgtggtagccatatcatctcattcaacactctttttttttttttttttaactttcttaaaggtaagaacaagcctttagtcttattatttaaaccattattgttattctttactagctgtcttttggaaaagttagtttagattttggaccagattagggtaatttggcttagaagatctcaactgtttggcattatgaatctgtacatgggtagttacatt

SEQ ID NO: 107733 - DNA, 1125 bp, Homo sapiens
gattttcctgaaacctgttccgggcgttttggtacccagaaagtgtgcaacgatttgtacactcggagattcactcaacgttcctgcataaaatgccctacaaaaatgatcttttctctccaactctctgggcaaatccaagttgggcgaaaagaagtgccagtttatcccatgcttgtttttaggttttttgttgttgttgttgtttgttttttttaacttctgcgtcaaagcattgcttatagactgggtccgctggctcctcttgggccaataaaaccccagtttattttaacggcttggttgtccattttatgttttctctctctccacgctccttgagttccttaagttcctgttctacacatttttgtagccttctgagcacctattctagtgctgatacatatactaggcgcttcaataaataaatgtttattgaatttgccgtggcaagaactgtaaccagctataagcatgattttttccaattttgccctctgcaatcccaggtttttcacctgaaccttgcattgctttcagcaatgtggtgttgcctctgggaatcccagtctcctttgtgtgggaatctagggtacacattcctagatagaggctgtgtaatgattgctgacatattctggccagtgtttttctgtatttactcttggttttgtgaaataaatcaagttagctcctgtaaacacatcaccatgtttttttttcacgggtaatttgagaaggaggacaaacatctccccaaagtatttattaagctggttgtttctttgatgccgaagtgtctcttttgcagaggaattgctaaatgtttccatgtcccttgctaagaacagaaattcactcagagtagatcaaataaaagtttggattgttataaaacaatctcgccgctagtcatggacaggaagcgaagtatagccagggcggatgagaacctggatggggaaaatcagaactaagatgctgtgctctcctgctttctttctttgaccttatgacctttcaccttgttagggttgccacatttagcaaataaaaatacaagaggcaccgttaagcttgaatttcagataatgaataatattttagtataaatttttgtcc

SEQ ID NO: 107734 - DNA, 1050 bp, Homo sapiens
gagtatgactgggctgaaccagagagtgggaacagagggagcagaaagaaattagatttgggttgggttttacctttaatttgcaaaattatttctatcatgactctcttgaaacatttgggaatggttttgttcagactttcagaatgaaaatttttctattactttggcacagtgaggaacgcacagcggaaacatattcttgcagcccatcagatcatccacagttacacggaaagcatggttcaaaagaaattaactgagggagagcaagatgaggcctcaaatgctgccatgttacttgagaaagaaactcaaaatgagaacaacagctaaggtgagtttgattttccaccaggaaaaaaagcagagaaaggaagaaaagcggcattgttcagctttgtgctgtgctcaaacaatcataatgtgaagattgctgtttaagaaatggaggacttccacttaaattggcacatttcctctagtttatgttatctactgttgagattattagaaaattagagttgatattacagcaattagactcttgtgatacaaaaaagaggactctaaattatttttatgggttcttttagcatgtgtgtacctcgtcaaatgaagctatagaatgtgtcagtgttacatataaacaatcttgttcttatggaagtagacaaggtatgccctaatgcattgtgctagctgtaagcatggcatgagacacagagcctgcccaattctagctcagacaccttctgcagtgcccacaaggggttggtcttgggctcaactaaaggctgtcatactcatgagactaatacagaccatatttggcatgaatgtacttagaaaaatataagacaggaaacagcttccagcaaggcaacatcagacatttctcttcctgtaggagcccttgccatacccatgcagaacacatagctgttttctttagtccttagtttacggagtgcagatacaatacaaggaaaagaggttcacaccgggtgggtacaggagctgccctggcgtaaaacttcacaccccagg

SEQ ID NO: 107735 - DNA, 1692 bp, Homo sapiens
tctaaaatgctatagtgcaattactagcagttactgcacggagtgccaccgtgccaatagaggactgttgttttaacaagggaactcttagcccatttcctccctcccgccatctctacccttgctcaatgaaatatcattttaatttcttttaaaaaaaatcagtttaattcttactgtgtgcccaacacgaaggccttttttgaaagaaaaatagaatgttttgcctcaaagtagtccatataaaatgtcttgaatagaagaaaaaactaccaaaccaaaggttactatttttgaaacatcgtgtgttcattccagcaaggcagaagactgcaccttctttccagtgacatgctgtgtcattttttttaagtcctcttaatttttagacacatttttggtttatgttttaacaatgtatgcctaaccagtcatcttgtctgcaccaatgcaaaggtttctgagaggagtattctctatccctgtggatatgaagacactggcatttcatctatttttccctttcctttttaaaggatttaactttggaatcttccaaaggaagtttggccaatgccagatccccaggaatttggggggttttctttcttttcaactgaaattgtatctgattcctactgttcatgttagtgatcatctaatcacagagccaaacacttttctcccctgtgtggaaaagtaggtatgctttacaataaaatctgtcttttctggtagaaacctgagccactgaaaataaaagagacaactagaagcacagtagagtcccagactgagatctacctttgagaggctttgaaagtaatccctggggtttggattattttcacaagggttatgccgttttattcaagtttgttgctccgttttgcacctctgcaataaaagcaaaatgacaaccagtacataaggggttagcttgacaaagtagacttccttgtgttaatttttaagtttttttttccttaactatatctgtctacaggcagatacagatagttgtatgaaaatctgcttgcctgtaaaatttgcatttataaatgtgttgccgatggatcacttgggcctgtacacataccaattagcgtgaccacttccatcttaaaaacaaacctaaaaaacaaaatttattatatatatatatatatatatataaaggactgtgggttgtatacaaactattgcaaacacttgtgcaaatctgtcttgatataaaggaaaagcaaaatctgtataacattattactacttgaatgcctctgtgactgatttttttttcattttaaatataaacttttttgtgaaaagtatgctcaatgttttttttccctttccccattcccttgtaaatacattttgttctatgtgacttggtttggaaatagttaactggtactgtaatttgcattaaataaaaagtaggttagcctggaaatgaaattaaaattcacaagtgtgtggtctttatttcagtacccaaccctcttccttcaccctactattttgccgctgcaatatgtagtcacatcaccatttccattcctctaattagggaaacattaatctttgttatacagaacaagatatcaataccacttcttgttctttccaatgattttattccattgtgtagccccaagaggtgcagcttccaccttggaaacctttgga

SEQ ID NO: 107736 - DNA, 1734 bp, Homo sapiens
tgtccagatttttttctaaagttacttcccttggaaagatacacttgagaggacattgtagttaaataatgtgaactgtaacagtcatctactggtttatttttcatattttttaattgaaaattgagcttgcagaaatagccacattctacacatagttctaattttaaatccaaatctagaatctgtatttaatttgttttttaacctcatgctttttacatttatttattgatgcatgtcagatggtagaaatattaaaaactacacatcagaatgatacagtcacttatacctgctgactttataggaaagctgatgatataaatgtgtgtatatatgttatatatacatatattcaatactgcctttttttttgtctacagtatcaaaattgactggttgaagcatgagaagaatgtttcccccacacccagttaagagtttttgtgtctgttttctttgtgtatcagtgaacgatgttaagaatcagtctctctttttgaagaaaaagcaatattccttggaaagcaaggagaattgaaggactatgtttgccgtgaggaaatagattttcatgactagtttgttttatacttttaaggttggcatctatgtgggccttatatactctaaaatgaactttagtcaccttggtgcttatgggccattacttgacctatgaatctttaaggcacaatcagttgtactttacatttaaagatcacttgagtgatggccgcctttccctcctacccgctccttccccacatgccttccaaggttagctggtaactgtagggctgcagagctgagcccatggttgtgtgtaacttgccctcaccctcctcattgccaccttaggtcactttatgggtctcgtcctccagagggttcggaagtggagtctgttggcagccctcctgcaggccctagcaccctgtcctgctccttaactgtgtgtgtgactctccaagagagttgtcctgcctgctgaagtgaaccagtacccagaaagacaactgtgagccatcttggttttcactcgctgtttagctgaggtcttgggccacaaaaggggtttcacaaacctctggatatatcagagtttatgagaaaggaaacatgctcagtcaaaccaaatcaaacaaattgaattttatgttttataaagtgcttctgaaagctaagatttgaaagaagtctgaaatcaaagtatttggcagcataactccttaaaggtagtggcgttgatagaccattttcagacagaatttataaagaatctgaaaaggcaggtctgtgatagagaaatggacctgcattcagatccaactgcccagcaagcgtttggatgcagacactgctctggacgtggtatactccccagagtccataaaaatcagtgcttattttaggaaacaggttgccccccacaactggggtaaaagaagagagaaaagtcacgcttttctctcatttcattgtgtgtgcatgtgtgcgtgtgtgtgtgtgtgtgtgtgtgctgagatgtgtgatttttctttctcaaggatcatggtgggatcacagaactcttttatacaagtgagatccaggtctctgaatatctttttgtatataataataataaaaagctcctcaccaaattcaagcttgtacattatattttctttctgtgtttttaaatttaagttttattgttttgtatgtaaatatgtggacccaggaact

SEQ ID NO: 107737 - DNA, 1042 bp, Homo sapiens
cagtccatctttatgatgggattgtagagattatgaaatgtaactttactcagtcagtaagctgggtggtcttttaaacctactattgagtattgaatttatagaactttgcctttttttgttttactttttccctctctgtactttgtcttcctctgaaaaagagaactctgttcttctcagcaaggacatgtgtgatttgattttaagtggagctcattgcatcaggcaaaagtttttttgatgaatgtctgtaggactgtgactttcgatatcaaagatatttataatcaaaataattagcgttaaaattatgttcattaagtgatttgaaaataattcaagagaaaaatatgagatcattacaggtctgaagagcatgggtgtctatcaaattttattgttcagaaagtgaatttgtttctggttttatgctcacttaaaaggcttgtgctttttactgtgatcatgcaagcagtcgttgaatttatccaagaaagaggagactggttttggcaatgtcacaagctcacaggctgtagtcagtgaaaggacatctgcacattaatgccaaataggattttgctaaagagcaaattaacataaatgggctggtggccatgtagatgaggtaaaactgatgtcagccagtgtagttaatggctgccgtggccagagctgctctctccatgttggcatgggtgctgatgtagtggtcaaacagatagataaatttctgatgatcagtgcctcccataagtcctggggaagaccagaatgacagttctacctgttatcttcccatactgaaaatgagaaggaaatgctgttggatgatggtcatgcataggttctgagtgtcatcagagcatgtgacatgctgcaataagcatgggtttgtggtgttccaggttttctctggattttttttttaatgcagcctgtgcatgaatcatgaaaatgaacattttatctgagaaaggcttggaggaatctgtggtctagacaggaattgatgttaggttattgatgcacagaatgt

SEQ ID NO: 107738 - DNA, 1067 bp, Homo sapiens
aggcggtcagattacttgaagccaggagttcgagaccagcctggccaacatggcgaaaccccatctctactaaaaatacaaaaaaaaatttagccaggcatggtggtgcgtgcctgtttaatcccagctactcgggaagccaggagaatcccttgaacccaggaagcagaggttgcagtgagctgagattgcgccactgcactccagcctaggtgacagagtgagaccctgtctaaaaaaaaaaaaaaaaaaaaaaaacaacctaatgtttccaagtgtacttataaagtgcatgtaaaacacaaaaaggctcatttgatttgtctaaaatatgttattttactaatatgccaacaatataaatagtaaaatgtttaataattttgtagctgagaacttgaaatgtgttgagagcaaataaggaactgaattttaatctttaacgtcaattactttaaataaatagccttatgtagttagcagctactatattagagaatataaatagaacatttctgtggttgctgctgggccagatagtgagcatttcaataaatcagaagaatttaattttttatagacacacagatctagaatactaattcatggtggcagggcctttggaaccctgtctcctatgtttattttctgtcttctcctcccaacccatttccttgttttctactctctttttatttaaatcctttggcagtaggtgtaaatggagaccttccattcactctccttcctgttcctcatttgcacctttgatcaaccacatttgggacagggagtatggacaggaccatttgtgggcggggggtggggggatgcagacagcaaggaatcaaggcaagaaattctgcgtttatgacttgaacatttgggtggggcagtttcctcagtattgagacagttgaccattaatccatgactccattatctagccaactcttacagatctcttgagaatctgaaaaaaacaaacaaacaaaacaaaaaatgctgtagatcctgtcctataaaaagaaattatgataccagatatagaattttacatatgaaaa

SEQ ID NO: 107739 - DNA, 5263 bp, Homo sapiens
ttcaaagaagtaagtacagttgacagagacagcttcccccatgcagataaaaagcctatttcaaacttgtaaaaagtaacaaaaataatcttactgagtaaagaattggataaagacattttcagttttaataaaagcagtgacactttaaacagatgtttctcaaatcctttttccactagtgtctagataagtcttatctgccattggctcataaacagttggataggttggtcagtacatccagttgtacatacatacacatacagacacacattctcattcatattctctttgctatgacaccaccaccttttaaaaacataaagaatatgtttgtacagtatttcctgtagtcaaatattgacatagtaggacaggaaaacctaatatatttaaatcaatgaaagatgcagatatgtcttattaatatacctactccaaaactttggccacatctttccccgagatatttttagttctcagacataattttagtagataatgcctttgttatatatcacagtacttctgtgggctttttctgtaagttgattactaactcagttagctagtttgagatataggtttgtcatgtgggtttttttttcccctgttaaactggtagggtttgttttgttttgttttgtttttgagacggagtttcgctcttgtcgcccaggctgaagtgcaatggcacggtcttggctcactgcaacctctgccttgcgggttcaagcaattctcctgcctcagcctcccaagtacctgggatcacaggtgtgtgccaccacgccaggctaatttttgtatttttttttaaacttattctttttttatgattattattatactttaagttctgggatacatgtggagaaggtgcaggtttgttacataggtatacatgtgccatagtggtttgctgcacccatcaatccatcatctacattaggtatttctcctaatgctatccctcccccttcccccctaccccgcaacaggccctggtatgtgatgttcccctccctgtgcccatatgttctcattgttcaactcccacttacgagtgagaacatgccatgtttggttttctgttcctgtgttagtttgctgagaatgatggtttccagcttcatccatgtccctgcaaaagacatgaactcattctttttttatggctgcataatattctgtgatgtatatgggccacattttctttatccagtctatcattggtgggcatttgggttggttccaagtctttgctattgtgaatagtactgcaataaatatatgtatgcatgtgtctttatagtagaatgatttataatcctttgggtatatacccagtaatgggatggctgggtcaaatggtatttcaaattctagatccttgaggaattgccacactatcttccacaattgaactaatttacactcccaccaacagtgtaaaagcattcttgtttctccacatcctctccagcatctgttgtttcttgactttttaatgatcaccattctaactagtgtgagatggtatctcattgtggttttgatttgcatttctctaataatcagcgatgatgagctttttttcatatgtttgttggccacataaatatcttcttttgaaaaatgtctgttcatatctttcgcccactttttgatgggattgtttgtttttttcttgtaaatttgtttaagttccttgtagattctggatattagccctttgtcagatggatggcaaaaatttttcttattctgtaggttgcctgttctgatgatagtttcttttgctgtgcagaagctctttagtttaatttgaccatttgtcaattttggcttttgttgccattgcttttggtgttttagtcatgaattctttgcccatgcctatatcctgaatgatattgcctaggtttccttctagggtttttatggttttaggtcttacgtttaagtctctaatccatcttgagttaatttttgtataaggtataaggaaggggtccagtttcagtcttctgcatatgcctagctagttttcccaacaccatttattaaatagggaatcctttccccattgcttgtttttgataggtttgtcaaagatcagatggttgtagatgtgtggtggtatttctgagggctctgttctgttccattggtctgtatatcttttttggtaccagtaccatgctgttttggtgactgtagccttgtagcctttgctgatgccgccagctttgttctttttgcttaggattgtcttggctatacgggctcttttttggttccatatgaaatttaaagtagttttttctaattctttgaagaaagtcagtggtagttcgatgggaatagcattgaataatctataaattactttgggcagtatggccattttcaccatattaattcttcctatccattagcatgtaatgtttttccatttgtttgtgtcctctcttatttccttgagcagtggtttgtagtcctccttgaagagatccttcacatcccttgtaacttgtattcccaggtattttattctttttgtagcaattgtgaatgggagtttgctcatgatttggctctctgtctgttattggtgtataagaatgtttgtgatttttgagattgattttgtatcctgcgactttgctgaagttgcttatcagcttaaggagattttgggctgaggcgatggggttttctaaatatacagtcatgtcatctgcaaacagataatttgacttcctcttttcctatttgaataccctttatttctttctcttgcctgattgccctggccagaacttccaatactatgttgaataggagtggtgagagagggcacccttgttttgtgctggttttcaaagcgaatgcttccagcttttgcctgaaacgttcagtaccgtattggctgtgggtttgtcataaatagctcttactattttgagatatgttccatcaatacctagtttattgagtgtttttagcatgaagggctgttgaattttattaaaggccttcgccacatctattgagataatcatgtggtttttgtcattagttctgtttatgtgatgaattacgtttattgatttgcatatgttgaaccagcctttcatcccagggatgaagccgacttgatcatggtggatacgctttttaaggtgctgctagattcggtttgccagtattttattgaggatttttgcatctatgttcatcagatatattggcctgaaattttctttctttcttgtgtctctgccaggttttgctatcaggatgatgctggctgcataaaatgagttagggaggattccctctttttctgttgattggaatagtttcagaaggaatggtaccagctcctctttgtacctctggtagaattcaattgtgaatccatctggtcttgggctttttttgttggtaggctattaattactgccattggtctattcagagattcaacttcttcttggtttagtcttgggagggtgtatgtgtccaggaatttatccatttcttctagattttctagtttatttgcgtagagctgtttatagtattctctgatggtagtttgtatttctgtgggatcagtggtgatctcccctttatcattttttattgtgtctatttgattcttctctctttcctttattaatctggctagcagtctatctattttgttaatcttttcaaaaaaccagctcctggattcattgattttttttttttaagagttttttgtgtctctgtctccttctgttctgctctgatcttagttatttcttgtcttgtgctagcttttgaatgtgtttgctcttgcttctctggttcttttaattgtgatgttagggtgtcaattttacatctttcctgctttctcctgtgggcatttatttagtgctataaatttccctttaaacactgctttagctgtgtcccagagattctggtatgttgtgtctttgttctcattggtttcgaagaacttatttatttctgccttaatttcgttatttacccagtagtcattcaggagcaggttgtttagtttccatgtagttgtgcggttttgagtgagtttcttaatcctgagttgtaatttgattcactgtagtctgagagactgtttgttatgatttctgttctttggcatttgctgaggactgttttacttccaattatgtggtcgattttagagtaagtgcagtgtggtgctgagaagaatgtatgttctgttgatttggggtggagagttctgtagatgtctatctacagaacttggtccagagctgagttcaagtcccaaatatccttgttacttttctgtttcgttgatctgtgtaatactgacaatgtggtgttaaagtctcccactgttattgtgtgggagtccaagtctctttgtaggtctctaagaacttcctttatgaatccggatgctcctgtattgggtgcatatatatttatgatagttagctcttcttgttgcattgatcccctaatttttgtatttttagtagagacggggtttcaccatgttggccaggctgatctcgaactcctgacctcaggtgattcacccaccttggcctcccaaagtgctaggattacaggcgtgagccactgcgcccggcataaactggtagtttaatgcagaatcttattttcactcttaccaataaaatagttttgcatacaaagttaagagtggactctaacatttgtgtcttaaccttctatagaactgtcaagtaatccacctctggctaccatccttattcctcctcatgctcggattcaagcagctgcttcaacccccacaaatgccacagcagcgtcaggtaagaacgttctaagtctcttctataaaaacatattctgggctgggcatgatggctcacacctgtaatcccagcactttgggaggccgaggtgggtggatcacctgaggtcaggagtttgagaccagcctgaccaacaaggtgaaaccttgtctctactaaaaataaaaacttagccaggtgtggtggcaggtgcctgtaatcccagcttctggggaggctgagacaggagaattgcttgaaaccgggaggcggaggttgcattgagccgagattgcgccactgcactccagcctgggcaacagagcaagactccatctcaaaaaaaaaaaattctgtttttcaaaaagatatgattacctttcatttcatttgatgagtat

SEQ ID NO: 107740 - DNA, 1041 bp, Homo sapiens
gaacccaggaggcagaggttgcagtgagccaagatcacatcattgtactccagcctgggcaacagagtgagactgtctcaaaaaataaaataaaaaataaaaaaataaagtatatgagaggctctgtgtaggttacctgtaaatactatgccattttatgcaagggacttaagcatctttggatttgggtatctgaggagggtcttggaacaaatcccccaggataccaagggatagctgactatacattacatattcttgtccagactaagacacaaaactgctgtggccttcaactggcattcagatacacagaaggataggtgatgtggtaaaagagagtaaatatatgggagaaaatggacagcatgggccataaggagagggaccacagaccactgatactcagtttattttaaagattatttttaacagctttgtcaaaatgtcttattaaaaactccggtcctcttttcatttttaggtttattttaggtatcgagcacatggttattgagatgttttcatttgacagtgcccctgtcctaagtggttgcctttcttgccagattgttttttcagttgttcttgtcaatttctgttgatcagacaaaggacagttgtctttttatctccctatcctgggaccttacacatttcatgttcaatattgttggatggatatgtgggtgggttgatggatggttggattttaaagaagcctttctattttagatgcttttaattgagaatggtaaatctgaatttctttagaataaaaaccacatattaatgcttttttttgtacctggagccataaagttttcagccatcacaattgctagcaattattttgctttcctgcatataagattatgggttaaaattgaactgacttgaagtaaaatggcataggagctttctgttccttagtgagaacccagatagctaccaagtctgattgtgagaaaacagtatctcctagaacctgataattagggcagtatcttcaactgtcttcccaggcaagactatttgatg

SEQ ID NO: 107741 - DNA, 1078 bp, Homo sapiens
agggatatatgtttcatttttctttaatttcaaaggcttctcgtctgtttatttctatccttacctttttatttttattctgtaggtggccataatttagaatgaagaatatttttatagtttttgtatttattagctttatttaagacacaaattagtagaaagctatctattcctttaagtagattaatttaattgaatttttcttcaatatagccttcagttgactttttctttgtcttaatcattcttaatgaataatacatttttttctccttgattaaaaccctggaatattcattcaagtgggggaaatctggccacattcatggtaacacctacttgagaaaaaaaatgcaggacattttatcaaattctaggtattcaagaatttcttcaaataatggtaggctctgtttattggaaataataccaaatcagtagcatttatagacctagagtaaatagctcttctttctcttctgtttgattgccaagttttcgaacagtgctgctcatcattaacaattgttcggctaaaaaaacaatgcaaaagaggcaatcttttatttactgccatagcagtgaaaactttaaaatttaaaaaatatttttctagttgtgcttgccaccagaactcagcctttcccatgtgcctgtcatattttgtatgcatgtctgattgttattactttatgattagcatatatagatttttctctgagcatttctcatataatctttaattagcaattcacccctgtgaatcatatgcatttaactctttccattctagaaggtcctttcccaaatgcaaccatgtttctgtacatggtgggaattaagtcattattcacagggtatttgcttagattcttaaaataaaacattaattgttctttccctttttttgtactgcaggtcttccgaccccgaactccaccggaggcaattgcactgtgtagccgtctgctggagtatacaccaactgcccgactaacaccactggaagcttgtgcacattcattttttgatgaattacgggacccaaatgtcaaactaccaaatgggcgagaca

SEQ ID NO: 107742 - DNA, 1028 bp, Homo sapiens
cccagcactttgggaggccgaggcgggcggatcatgaggtcaggagatggagaccatcctggctaacacggtgaaaccccatctctactaaaaatacaaaaaattagctgggtgtggtggcgggcgcctgtagtcccagctactcgggaggctgaggcaggagaatggcatgaacccgggaggcagagcttgcagtgagccaagatcgggccactgcattccagcctgggtgacaggaagactccatctcaaaaaaaaaaaaaaaaaaaaaaatatatatatatatatatatatatatatatatcggaaataagcttataatactggtttattaatagctttaacacaaaatctttgaaaataagaaatttttttatttaaaataactcagcatccagccatcctacatttgaatgttagtgggagatatttatttctacttttggtgctacttttaattccacttatgtgctgccatattggtgcaaaaacattttggattagctagcaaaataaatccatatactatcaaacagaagcaaacttgccttcagggataaaatatgccaatactgtttaatatttttacgaaaattttctgagttttcccactgattattttctttttacattctgtatatgattatggaccttgggagcaagagaggggaccagtaacagtggaagagctaaacatttcaaattcgacagtaactctaaggtttccttgactgaggcgagtcagagtattcaaaagaataaagataaggcaggttttgaccttacaaaaaggtttctttgtaacataaccaagaaattgactaaggcctttctttatgttccgaaataatttcctaagagcctactttacctaatttctcaattttcatggaaaatgtctttttcaataataaattaaaaacaaatacaatcctcttttcactgtagacagcactcataaataatctctggaaagtctaatgagctctgtagttgtaactagttctactaactgtcagcataagtga

SEQ ID NO: 107743 - DNA, 1691 bp, Homo sapiens
ttgttagttggcccagttgagtcttattttgtgctctcagttctttcagtctggttttctatttttgtccacctggttgtgttttagttcatgagagaatttattctgatgggccagattttaatctgtgtactaaattttagtctgcagactaaaagtaatccgcggattatttatttttgaaaaatatttaattcccccactggaaactatcctaaaagaatgttaaattctcttagaatagccaggggagttcacagatactggtgagttctgccattttttgttctcaatacctagacataatagaccctgctacctcccttgcatatttggctccgttgtgcctaggtgttggtatacattactatgcctgtcacctgtaactgtgactgtcccttagttgtattgttaattttatatattttgtttagcttttggtgggtgaattgggcatatttgcagatggaactgtgtttaatttgtagtgctggaagatgtaggatttattttttcagagagtttttccaaagaggaaaaaatgttctctatttatttttcctaagtaccgggtgcaagggtatgagcgggcaaagcccacaatagaaaaagtaagttaatacccgcactcctgaggtgatatgtcaatttcctgatgagtcctaagataatgagaatgtcagcaaagaaacatcttttagcagagaagtcaatccaaaatggagaataatccgcggtggcctgatccttcttagctcacacaaattgaaagtatctggcttgaaatctatagtaatataacttaaatatatttattactttcctctcatcactaataacttagcaaaaaaatgtttatactgtgtaactggaacacattaatagagaaaaaagtagcatattgggaacttgaaactttaaaagcaggctaatatgccccctcccagccatgtctgtggatgatgaatccaggtcatagaagaccattttactttgggaactttacttctagatttcattttgattttaactttttttggttttgtatttttttaataaacgcactggcattggaacataataaactaaaattaaaatgtttctttactgtgcctcaccattgcacaatcaaaaaaaatttttttgcatacactgtggtgaaataatttttaaaacttggacttgctactgtgaagactgatgtttaaagtttataactgtataaacattttctatgtccccccccacaccatggatttcttataacattggatatatttttccttgctggactattctcttttggattgacttcccctgtttggattatttcactgcattatcatctttaggattcgtcaggaacaggacatttcacctcaggagtgcgggtatgtacttaatttttttttcccaaaatttcagggcaggtctataaaacttgggggaaatcttctttgagaggctaaataattactcattcttgaaatgtaatagtaaacaatgtaagtagctgtgatttctgtttttattcactgtatggcataggtttcacttatagtatatttagattgtcagcctcttgggtgattcattgacatctaggctgaagtttaggaattgtggggttttaaaattattatttctattacaagaataaatattgatgaagatccatgaaaccaaaggtc

SEQ ID NO: 107744 - DNA, 1721 bp, Homo sapiens
gtaagacataattttcagattgcttgtgggaggcaaaggatgaggttggggtggatttgaaaagaagacaaaattctatttttaatttatcatttattctttaaatcttgtatcttctatgtaaccagtgctgtgctgggtaccataaagcatgcaaaagaagtaaaatatatagtctttgtccttgaaaagctgacagttgaaaagcttagttgaagcaagtattgaataatgtgagatactatgtaaccgtatacttaattctgtgctgtaagtgttcagaggtgttccacatggctgtaggtgttacaaggcagacttccagtgaggatggtggagggaaaaaggaacccccacttagggataatacatgaggtgggatgttgaaggggaggtttaagatttgcctaggtgtagaaaaggttaggaattgttatagcctgggtgaatatctctcaaggtggagagagctgaatgaaaagaaaatatttctatattcataggagagccaacctgactgtaataattgttttgtgaacaatgaaagattaaattggataagcggacatttggcaaatcccactcctgtgtaggcatgtagtactatttcatcagcacatgatgtgagggagagaaattatgttacatagttaaatgctgatatctacatatatacagccagtcatttaacatcgttagtaggtgcttagaaactgcaactttaagtgaagttatgcacaataggtcctcaaataatgttggttcattcagcgttgatgagggaaaacatttggttttattatacgtttcactaaaagtcacagttttcaagaacctatcaatgacattaaatgaagatttactgtataacttttcttacctatagtagaacttgggaaaactcgataaggcttttaattagtacagctgaaattcactggatgttagatttgtcatggctaaggaaaggattctttgtgtttcttatgctcaaccttctttacctgaactggtatcttaacgaaaaggcttagaaaattatgcagtagacttgagctgaattcagtttgtgtatcctaccctgttagatgccaacttcatagatagcaattttacttgggaggaggactctgaaagttgttttcagtagcctctggtaatcatttttgatagtacttaaagtgaattggattaccttgtatgtcagtgcatcattagatcaatgtagcaaagcatgtgaaagactgccaaagaatatatgtttttttttttttttttttttttgagatggaatcttgatctgttgcccaggctggagtgcagtggcacgacctcggctcactgcagcctccacctcccgggttcaagcaattctcctgcctcagcctcccgagtagctgggattacaggcacccaccactacacctggctaatttttgtatttttagtaaagatagggagaatattttaaaaaatagtatagactaatttgttaagtaattattgaattatgtgctacatatgagcacttaagtagacttgatttctttcttagttaacataattacctattcaacaatccatggcattgtctcacttttaatcctatgtttaggtttacaaattgcatataatttcagatgattaatagattacttgagagtcaatattggagttgctctttaggagtattcatggtttattagtttttaaaactggat

SEQ ID NO: 107745 - DNA, 1580 bp, Homo sapiens
attcttgatgtttttatatcttatactaatgcttttcaaacttgaatcgtctatgtaaagcacatttatttaggtttccattcctgtaccatgtgtagaataatgactcagttctcccatcttttttgtctattaaaaggactgtgaacctttcattcgtctggtgttttttgacataatttggttttcacttcatacacatgcattatgtaataagtgcacttatgttggttcctcatttgtgcatactagagtgggtgttactgggattgtaaacaaaaaagtaaattcagatgcagaaattttattgtttttctctgtcatctagatgattgagaatatgcttgtgttggtttttttaaataggttattataagaattaaaatgcaaaacttaaaattcctagagggaactcagactcctttccctaccactgtgatagtggacagcaacttgagaaatgctcttagggtaagcagccaattgagtcatttaaaaaccatatagaatgtcctccaaagagaagaccattttgcccttggagggcaggtaaacaggagtctggaaacaggaaccactttacctttgttgctgtcttctgttagtcctatctcctgaagctgtggacatgtgaaccctggtttcctgtgctgcagtgttgtgcagctatatccccaagattgggacctggtgttctaaaaaaaaaaaaagtagacagaaataaagaccaaaagagaaaatgtcttttgtggaaacattgaggtaaggggatacaggtgtgtaaaagaaatagcagaaaaataacactgagatgatcccagtgtggtgtatggcagaaatcttgagaattaaaaactccaataagttgccctgggctattacataaatagcaatagccagtgcaacataattcattaataaagcacttgtggctttagtaggaaaggaaataggtgctaatattctgaaacaaggattattattggaggtgaggggatgaagacctatgccttggtgtacgctgtacactgcaaagaagaaaaacacatggaaagaaaaggaagtgatgcaatagtagattgagaattaagcagagacagagattggttggaagaagagaagaaatttaaattctgcatttagtatgtgcaggtgtggttaaatgatgggctattatatacagagtgagaatctagtttaaacactgctcctaatgtttatgcctcagcttttttcttttgtaagatagcgattatctgctgtgtcttttctcaggattattttgaaaatacagccataatatacatataaaggattactttagttttgaataaatgtgaaggatgtagcactccaatggagttttctgatttgtcttctctgtctccactgccctgaccttagtttaggccaccatcatatcatagaattattaaaaacaacctcctacctcctgatttccatcctttggtttcacatcattttaatccatcctcctcatttctgtcaaagttggcttttttaaaaagcacatgtgatgctgtcactcctatttaaaattcttctctgattcctcatag

SEQ ID NO: 107746 - DNA, 1144 bp, Homo sapiens
aactaaaacaggtttctcattgttcttaaactattttgagatcagatagttgcatgaatacaagcagttctgcatgtaaagatagttgtatagatgtacttgagtgtttcattgactttatatagtttcatcctcattgatttcctgtagatagtttctagcctggttttttatttgcaaggtaagggcagtgtacttatatcattaaagtacagaatttgatttaggagtaggatcttatataaaattttgacaacctaaaattcagaagtttatttacatagaggtgtatagtttaatatcatatagcatatcatacatttcaaacattttctttattcttttaaactgttaaaacatatatcttattatagatggcattttgtgtttttcctctcttgtttactttcctactggcattttggaaacaagattagaaagcaaatgtaatcttgctgggagtatacattaaaaacaattgatatgttaactggatgtcactagcctttggaaaaacccaaccttaacattagatagaaccagttctaaacagcatagttgctaatgtaccagggaacttttttttttcctttggtatttaattggaatgattttaaaagagattttattaaaaagtgttttcaccttagtttgatttgtgagattaagtatgaacagaaaaaaaatagaatttctcagtagggtttataagtagagtgaatctctagcttcttcattttacaagttcagaaactctgaccaaagattcaaagtgacttacccaagattacatggatggcttgtgacaaagccgggattaaacttctgtgtgtgtgtgtgtgtgtgtgtgtgtgtgtgtgtgtgtgtgtgtgtgtcacgggttaccaatgatcgactttataatacgtattttaaggagagacttactgtattttaaaatgtacatataacaattcattttatatacaattaaattcatttagttatagatcttttataattcgaggtgaagtcatttagggctataggtgaaataatttaccctctgtagaatcaaagtatgtttctttctctctctctctcttaatcagatatattatgattccagttactttttcttcaagttcttataatctcattatct

SEQ ID NO: 107747 - DNA, 1090 bp, Homo sapiens
tctgttaagaagtcaactgttgataccctgtatataccctgtctataatgtgtttctggcattcttgaagattttcactttgtgagtggcttttatcagttgattatgagtttttatagtattctttgtatttgtcctcattaaggttcattgaacttcttgtgtttgtgggataatcatggtttttataaaatttgggtaagttttggtaatgtttcttcaaatagtttttctgcatctgccctacttcccaccccatacttcccaccatcagactcaagtcacatgtgtacatgttttttccctccatgcttcagctttgatagtttctattgctatttttttaattcagtgattgagtttcttccctgtgtctaacctgttaatcctctcctgtgaagttttaatttcacatactgtattttttaactgtacaatttccatttggttcttttttatatcttctatttctctccttgttataatagctattttaaagtccttatgtgccaattctgtcttctctgtcatttctggatctgtgtctgttgactgacttttgattttttctcttcttatattttcctacttctttaaaaatgttgaattttgtttgtcagccagtttcttagttgtttacacctggagggcagtttcagtgttcgttatttcatcacagctagatgcagaagtctataatggccttttaaaaaaataataataccatgcaagcctttgcatggcattctattaagtatatttcacaaagcattttaaaataagttttagattttttatactcaattttatcttgtttagccagttagatgactgtttcttcatagtattcttctgttgctaaagacctctgttattaacagtttaaaatatttttttccaacttttattttagattcaggggtacatgtgcaagtttgttacctgggtgtattgggtgatgctgaggtttgaggtatgaatgatcttttcacccaggtactgagcatagtacccagtggttagttttgcagccttctttcctgctctggttgtcctcagtttgtattattgccgtctttatgtccatgat

SEQ ID NO: 107748 - DNA, 1178 bp, Homo sapiens
atgatagtgattctattgtcattagactgatattttgaaacagaatacatgttttctatttagaaaaatttgtccttttgaggatatagcagccaatctaacacaacccaacactccaaattccatatgcagaaaataaatgaagatgtttaggtattcaaccatttatacaatgattatgttgtgttatataatttcatttttaaaacctttattgaattcattatctataagcctagccatacatccctttagtctttcaaggtgcataccacattaactacatgcgttaatttagtgaacagtttttactaggtgctgggcaagaacttagaggtttcttgccttcaggggcttcagagactgatggatgggaggagaggaactgagggcaatagggcaagcccagtattattccagatgtctgagcagaatacaaaggcagaagcatttcactcagagtagtgctgtctggaaagccttcttaggagagctaaccattgagctgaatattgaaacatgaaaaagtatttaccagatagggagcggaagggagtggataaatatttagtaaaactaggtttggtgtgtttctttatggttgtcgcttaaggttctgcctggtggggttgatagaatatgagtttaccaggaaggagaagactggagctgttgacagtggccagatcacattagcttgtaagcagttggaagcaattgcaggattttaagcggagtagcgacatttctaataggttttcttttacttcgctcttaaaggctacacatgcacctctattgctgaagtttggcgacctctggtgttgaactataaaataaacaacgttgtggaagaaatactagcgtttcagagcttgtcagttgctttttgtgaggtgcttcttgggccgtagtacttctttgaagacagtaattatcaactcataattcctgtgttgatatttttcagtgtttggataaatttctaactaggtagggccaggaacagataaattgattgatttaatagtaaggggatgaacaacatccccaaaggggtggggcaggctgatcttgatgctttttgcaacaaatgaaaagatcatgagttctagtaatagataactgagaatatgttcccttcccattggtgtgataatttttaaaattcccccctc

SEQ ID NO: 107749 - DNA, 1035 bp, Homo sapiens
aatgaagtccaaaacagtcttgaaaaagaataaagttggaggagccacttttttttttttttttttgagacagagtctcgctctgtcacccaggctggagtgcagtggtacaatcatggcttactgtagcctgcaccttcttggctcaagctgtcctcccaccttagcctcctgagtatctgggactacaggcacacaccaccatgcctggcaaatttttgtattctttgttatagataggttttcaccatgttgcccaggctgatctcaaactcctgggctcaagaagtgatccacctaccttggcctcccgaagtgctgggattacaggcatgatccaccacgcccagccacacttcttgttttcaaaacttactacacaactgcagtaatcaagacaatgtattactggcgtgaatgtagccatacagatcaattaagtagaatggagagtctagaaataaacctttatatttattgtcaattgatttttgacaaggattccaagataattcaatggggaaacaatagtctttttgacaaatggtgcttggacaactggatccatatgcaaaagaatgaagttggacccccacctcacaccatatacaaaaattatatagcttgtggagaaaagggaatccttgtacactgttgttaggaatgtaaattagtacaaccattatggaaaactatatggaggttcctcaaaaactgaaaataaaattacagtatgatccagcagttccacttctaggtaatctatcctgaagacttgaagtcagtatgtcaaagagatatctgtactctcaagttctgttcataaaagccaagatatggaaacaacgtaagtacctatcagtggatgaacggaaggaaaaatatggtatatatatatccactacagtggaatactacttagccttaagaaagaaggaaattctgtcgtttgtgacaacatgggtgaacctggaggacattatgctaagtagagtaagtcaggcatagaaagagaaatattgcatggtcttacta

SEQ ID NO: 107750 - DNA, 1073 bp, Homo sapiens
gaacataaaaatcaaccatttaaagtcttaaaagtgttcctcagaatttgcactgacttaaagcccagtgtctgggagagattgaacctttccttgctgctcctctgtaagtacctactaatatgcagacgttgtgtcactttgacttatttttaagtaagataaatagatagtcctgccatagctttggtactgtaatcctctgtctagttatttgaagacttgaatacctgaaatttgataataatagactttaccctttattagaatattcttattggtctggtttcctctttggtaagtttaacatttaattaaaaagtacattaaggaagtttgatgactttttctctgttttggattgtataatcttttcctgtgatatttactctgtgatcaaagtaaaattagaaaacgtatacaaacacttttcagctcaagctatgaagtattaataaggcttcgttttcttttctctttagatgtatggtctgctggctgtgtgttggctgagctgttactaggacaaccaatatttccaggggatagtggtgtggatcagttggtagaaataatcaaggtgagaaggttgaatcagaatatttgaactggaaggaatttttgtgctactttaataatatatatcacacatgtacacatacgagaaacttaaaaaatggaggaagcaatccaaggtcacgtagcaagttcagctataaagtgggtataagaacgcccccccagccttttggtttttatttgagttactcttctcttgtatgatcctagaaaagctattatgtatatctgatgcaagaaaggtatatatctgttatttaaagtacttaaaagcaaaattagactataagctcactaaaatgtatgtaagctgaataaaagcagaagctgtgtctgcttttgctcactgtatactccctgctcctaatactctgtggagcacataggagatacttgtatttggtcactatttatatttattcagtatttataaaatgaaagaatgaatgcctacctgtctggctagatcattgatagaaacaaaattttgactt

SEQ ID NO: 107751 - DNA, 1070 bp, Homo sapiens
gtgggaggatggcttgaggccaggaggcagaggttgcagtgagctgagactccaccactgcactccagctcggtgacagaatgagaccccccctctcaaaacaacaacagcaacaacaaaaaatagaacagaccttgtgacagtttttttgtctttttgatataaatagaaattctctgatacaagcaaacaccctaatcagaaacacattatcattttttattttgccaaatggcaaaatgccaaagcacattttgatttctgccaagaggccagcagttttacccaccatttcctttgtaccctcagtacaaatgttaacccagtgaaggtgtattcttatgaaaagagttttgccctctgggacatctagaaatgtctagaggacccaggtgcaaagagtacaaagtgtcctctgtagaccacactttgacatctgctttaccagagggtagagagcataataatgtgtatatgtatgtgtatgtaattctcagagtcttagtatggctgtggtacatggcatatatgaatggacagatgaaaaatagtacaaagaatattttgcttgtggtcgacctgggtttgagtgtcaggtcacttgaagtaaagtggagattactgacagttcttttctgagtggctgtgaggcttaaataaaatgttagtgaaaatactgtagaaatgaaaggtggtattcttttgtggcatttttagacttgactctccccaagagcaaatttcagccccttgtctttgggtatgtcattggattttccagctgctttacattttattcaaatatatgatactgattatctgtatataagatactggtgtgagctgtgccagaaacacctaaaataaaggcagtttgattgttctcaaaaagttaacacatcatctcacacattaaggaacagttatataaacaggagtcttttgaaccctagcaagcctaggtttggcttcccattataaacttaggatacttgcctcttaagactgtaatgtttttaaacagaccctcccaaaaagtatactaatattgttacatttttaaatgtttt

SEQ ID NO: 107752 - DNA, 1017 bp, Homo sapiens
tataaactagtgcagctgtgagagtagttttgttagtttctgtcaaaattataaatgtatatactccttcatttaacagtttaacttttaggaattatttccttaggaatacatatttacaatacagtgtatatatagggatttttattatagcattgtttataagcatccattagtaggaaaatggctaaataaattacggtacatgcagagtaatacatgcaaccatgaaaaagaatgaggcaactctctgtgaactgaaagggaatgatgtctaggaaacattaaatgaagaaagcaagatcaagagtatatgtattgtatgccaccttttatgttttaaaaacatacagaatgtgactatatatatatatatgtacacacacacatatatacacaagtacatgtgtggcttatttctgaaatggtacgtaatccataatatttgattgcctgagaaaggatctttgggaatataatgtagttgggaaactcactttttcattgattgtattttagtattgtttgaatttacattaggtatatatactcctttttcagtaagaactaaattttttcaaaatattgattattatacattcctgtgtatctttttaacttcacaattaacctcaattcagggatgagataaaaaacaatgcagtgttttcttcattttcctctataatttaaccttttattccaccctttttcctgcaaatttcatcaaactttctgcttttaaaagctcatttcttggtaatatactgtgaatttgtaatacaactttattctttccattttcagttttcagtactttgtgcctctctgatctaaccttttaacatgtagtcaagcctacattcccatgtaactcaggcagttaccccgctacttcctcactggtgtaatcacctaatctctctcctcatggtccctaagacatctttacataatttggattctctccaatttaattttttcacccttgttacagattcttttcaccatagctct

SEQ ID NO: 107753 - DNA, 1032 bp, Homo sapiens
cctcagcctcccaaaatgctgggattacaggcgtaagccaccacgcctggctaacaaattaaattttgatgatgacttgaacatgacaccagtcagcataattagaggtttctttgcagccatgttgagctctttggtcgtagacatggactgggcagaaagctgaactcaaccagggttgtggaaaaaccacaagctttttcttagatatttttggctttgtgggctatctagtctctgtcacaattactcagttctgtcactgtagtccaaaagcagccatagacaatacttaactgaataggcatagctctgttccattaaaagtttatttttaaaaacaggcagcagactattcctgttgtttgttaactctcgtgttagagaggataatgatggaccgtggaatttaagcaggctaagaagggaagagaggagaacataagtgcgtgaagtgtagagagaaggtagtagggtcaatggcatgatgtttcactatttcctaatctctgctctactcttacatgaccttatgttttgaatatagttttctctctctgcgtgaaatgcttcttttatacacagtttagatgtcatctcttttatacttttatttcctctgctgtggccactgataatatggaaaatgctcagtaaatgctgaaaattgaaattctccacttcagtttgataggtaagattatttcaaattgggagattgtgaaagtttgtttatccacagtatttctcactcagtagccaagcctatgcttgaacatggtgattctcaactttgttttctgcttcaatttacctgatactggccacatgaacaaggtaagggcagtgccctgctcttccttcctacttggtgcttaagttagaatgcctttctttttctccactggtgttgttgagttggtgtctttatgctgcagagcatggatatttaagcataggacctgtaatgagcttgtgagtatggtaacacgttgccttataggttattttttaaatttcagttaattatag

SEQ ID NO: 107754 - DNA, 1062 bp, Homo sapiens
cagatttcatgcatataatatctaatgttcttagatccataatacttgattcctagctcagtgttcttgttactttatgtaactgttttttagtataacagtttttagccattttctattaagctttttttttacagcaaatattgcctgacaacattttctattaaactttatttagattatttccatagaaagtctttttacattacagtgcctattatataggaagatgtcaatgtattaagcccgaattttgatataaatacctacagtcatataattgttgtgtatatacacatgtattacacaatacgttttaacaactatagttagcaaattggccctttattgacacttgcttttcagttgctttttttttttttcagtttaaatgatacctctggtttactagggattgtgaaccctcataagtattagagctttttaaaacctaccaaatggcctgttattatctttattctgatctgttttggcatgtgtttgctttttcctgtctcttcctaagtaaaattgtacagcctctgttaggttcacaagtacactctttgtaatgaaattttgcatcttcattttgttgttgttgttgttgttactagatacatcatgatactcctgggtaagaattatttgttccataaactgctggattacaatagattcatttgaaaaaaggcctcctcccagagttcttaaacattttctctttgattacttactttaatgtatatagcattccttatatgctaggcactgttttaatgctttataaatattaactcatttaactcttaagaagttgaagagcagaaaagaaagactatcaaaccgtttgaatgcaaggcatctgatggcttacttgtctggttttggtttggtggaaagctcctgtcatagtcagctcttgccctgacttaatcctgcattgggggtgacaactgactgcctcttatctgtatgccccagaggataatttcctctctgctgctgttctcagtttcttacttatcttaaaggttcttacagataaagagcaattagaag

SEQ ID NO: 107755 - DNA, 2070 bp, Homo sapiens
tttctattttttttttattacatgcataggtttgtgtatagaccatgatagtaaagatacagaacatcacaagtatcctcttactgcccttttataaccacattgacttctctccctgccattactccacccctaacacccagtgtaacccctggcagtaaccactaatctgtttaccatttccaaactttttttctttcaagaaggttataaaaatggaatcatatccagtatgtaaccttttgggctagctttttttttttttttttttttttgtctcagcataggtttctggggatgcaaccatgttgttgcatggatcaataattgtttcttttttattgctgagtagtattccatggtatggatatactacagtttgtttattcacccagtgagtgacatctgggggctattctaaataaagctgctttgaacattcatatgccggttttaatgtgaacgtaaatttctatttctataaaacatatgcccaagagtgcaattgctgggatcctgggtaagttttgaaggttgagccaacaggatttcttgacagattaatgtgaggtcaagccgggcgcagtgtctcatgcctgtaatcctagcactttgggaacaataattgttattgctaataatagcacttagggaggctgaggttggaggatcatttgaggtcacgagttcaagaccagcctggccaacatggtgaaaccccatctctactaaaaatacaaaaaaattagctgggcatggtggtacacgcgtgtaatcccagctactcaggaggctgaggcaggagaatcacttgaacctgggagacagaggttgcagtgagctgagatcatgccactgcactccagcctgggcgacagagtgaggctctgtctttaaaaaaaaaaaaaaaaaaaaaaaaagtcagagagaaagaggaatcaagacttcatggtttttgacctgggcaactagaggagtggaattgccaacagctgacatggggaaagctatgggtagagcatgtttaaaggagatgaaaaattttacttataacatgtcaagttgatgtatattagacacagaaaaattgtcacataagcagttggttaaaagattttggaattcacaggggtggtctggtctagagatatacaattgggagtctgatcagcctttaaagccctgagactggaagaggtgatagaggcagctgaaagaggtgagagactaagttctggctacttcagtgtttaaaaaatagggagattatgaagaactagcaaagaaaactgcaaatttggccaatgaggaaggattaaaaagcaagataatttagtgtcctggaaagtaattggagaaaacatttcaaggagagagggagtcaaccaatcatttttgtgtaaaccttagttgtagcacaaaggcatattctgcacagtaaccagaggttttagttgtgttgtattccaggggatatataggctgatgcccccgtttctagtttctcctgagtaaggagaattttcgagttttagtttctgtattcagaaagcaaatggtctaagagacaagttgaattctacctgttaagctccaacttaacactcttttcatgaaaaaagtgaacactcttttcatgaaaaaagtgaacactcttttcattaaaaatctttttaatcttcctagttggaagtattctttctgtttttagaattctccatcctttttttttcttccagggtcgagggagagacagggtctcaccctgttacccaggctgaagtgcaatgtcacaatcatagcgcactgtagccttgacctccctggttaaagtgatcctcccacctcagtctcccgagtagctaggaacacaggtgtgcatcaccatgcccagctaatttatttttattttttgtagagatgcaatctccctgtgttgtcaggctggtcttgaactcctgggcccaagtgatcctccttccttagcctcccaaagtgctgggattacaggcatgagctgccacacccacccacccacccacccctttttcgataactctagtggcactt

SEQ ID NO: 107756 - DNA, 1067 bp, Homo sapiens
atttaggcagtttcttattaaggtgaattttagaatgaggggcttgttcaagatggtgatgttcctgctctgtcatctgtgaaatttatgaccctcaatttcactgcctgtaaaatggggacggtactaatacagcaatgcccagcccagtgtttggtacataaaggaactcagtaaacattattgtgctgccttttttctcttcttcagtgttttgtgaatcaaatggaacaaagttttatgacaacattttctaagttttaaaactccttataactaaactctttgtttttattcttaaggttgtaagttactacacactgctatacgtcaaattttttccccctattggttttatactctcttaaatttggtaattctgttttcaggcacctaattattagtattttatatagccatttaagtcacttgtaaaaaatctatttgctgataaaaccgatagaaacttgaaagaaatagtaatctttgtgctatgtgtagcactgttctttaagtcatggaaatttgtagttttcaagtggaggctataattaggtggaagaaaagggaaggacagctacaagttggataggaaaagtgttacattgccagtacagctctaagaaagtaacagcatggcaatgggagtcctcaaaccaaagttaccaagtcagaggagttcagtttttcctgggaaaaggtctccattaagtatgcctgctgttctcagtcatataggctgggaatctttgcctgtccccagcaagagaatggatttgataggtcagcagttgggaccattgataatgatgttccttgcagtgggaaacctgagaggcaggttttcatacaaagtttcattaaaactttcatacagagtttcttaaggatacagactgttttatgctgcttttatagtttctgaagagcctaggtaggttaaatacatttttaaaattttaatggaattttcagggaattaacaaagattgatgtggaagaactgtattgagtttgctgttaaaattatatatagttttattgcctccttgattgttccactgaga

SEQ ID NO: 107757 - DNA, 1028 bp, Homo sapiens
attgggattttatttataaattaatataggaagaactgatatatttgtgagcttgaattatcttagccaggaataagaaatatttttccatttgttcaaatctacttttatgtctttcagaagttttggcttagtcaggctttagaaatttcttaagtttattcttaagtattttattgtttttgttgctattgtatagtttttcttgttttttattctacatgttaaaaagtgatggactgctttataccaagctcggtttttttccttgtatcacccttcctttgtggaatttaagtattctttgttgtggccaaaaaataaaatttgatatattgacctatttgtttctcttgattatcataaaataggaatttctctgacaacttaaaagtctgtagttttaaaatctgtgatttacatagctgctgtttgggattgccttaaattattaggtgtttccagcagaaggttgaaataggatcttctccttgttcaattaaataaaccaacctgcgaaatctcctaatggcagtgagaggctttttttttttttttttttttggtgaatagtaaagatgagagataatggtcaaagataaaaagaaaaccaagaataattatccctgtgtgccaggagtcacataaactgtacctaagacactgggctttttaaaagaatttctggtataatcttcatttcagtggtattttatttttttcccactgttgtccatcatactgtgacagagtacttaaactatcttaacttgggcagtttggaagtgcttgtgataggaaatatttgtgttgtggggataaagattgggtaggtacctaattaatgtaggagacctgtactgttgtaacagggagaacatcagtcaatcccaaacctccttatggtttgttgaggctgactgttccaacttgaaaatcagtaagttgcatgtttattagtgatcttggcttcatttactattcatttctcctttgaagtgagtcataggtttcaagtctcctgccta

SEQ ID NO: 107758 - DNA, 1397 bp, Homo sapiens
aatttaatcagtatttgaaaatgtatggtgtcccttgcagaaatggaattaatgacaaaactcgtagttattacctgctattttattttccatagttaattttaagaggttcttataaagttgtttggaggtactctatcttcgcaacagttaaaattgtaatattttaggcatatctcctcctcctattttgttatacagaaaagctttagctgataaacagattgcattctaaaagttcataaactattttggaacttagaaagtattttttcatagtaagtttagtaaatatgtaaatgcgaataggttcccaggctatcctacaaaagcctagtgaagccatagttagctcaaatatctacatatttacagtgacacataatagaaaataatatggcaagaatagtagttaacaccagaacactgttaagaattagttttgaaaaattttcttctatgtgtgattgatacagggatttaatcagagggaggtcaggcgtagagacttgcgggagtctggcaggcctttctgtgtcctttcaggtactttataggttgctggcatttctttgttttgatattggtatacagcagaaatgctatctttttgcttaccggctatggttaagattgtattttaggttctgagtggaatgaaaatggtagaaaagaaattgtttcctcaggtaaaaaagataggaaagaacaatggaagacagagtaacctaggatgtgtgtttgaaaaagaaattgtttgagatagatttcattgacacacaaataatgcaggtttaagggaataggggtagagtataacatgcaaatgattcctgatggaggagagcaaaggtgttgataaagtgttttgggttagcaatccttatgctggtcagtaagtggttttggatatctttggaagctatttagaactgggaatggggagtagaatgctactatggtatttttatatgaactgtttcagtattttttttttcataacatggtacatcagctcaccaaaaatatttaaatagcttgatatacatttggagtgttttttgatgtattaaactattattaagaaaatatattttttgaatgtatgaaaagtaaaagtaaaatattgtactttagctaattcaacagatgcctaaaactattatgtgatgagagagatttggtttttacattccttttttttgtttgtttattgattagaaaaaccatgcttcctttttcaatttccaaaatgtttcatatttagaagaaagcagtccaaaaagaaaatcaggaaatgttccttctattcctacaaaagtagcacctgttgttaggctatgtattattacttagtattgtgataaatctgttgaagtgtttaaatgtttgctatc

SEQ ID NO: 107759 - DNA, 1043 bp, Homo sapiens
atttctggatggagaagctcatgtttcttaattgcttaagaagttaagcaatttggataattggataagctattacttttaaattattgctttattttatcttgccatttgattcttccttctagagtggatagagggaccatttacaatataatagcgaaatgcatatctgtttttaaagttagaactggaaggccagtaagataaacaagggtcctttagggcaataccttgagtaaaatagcaaagcaatttttttgtttgtttcaagtaattgctagtgaataaggagtatttctatacttctgtatattcagcatttttctttgtgttaggaaacaagatgataattgtttaatgcagtgataggaactgctgttctgctgagttatcacagactttgggttttgtcagttaaaacaaattttgagtgttaggttttgttttttaacaggtgttgacattaattttatttctatgtttgggaacttgtaaatttgtctgacattgattctaaaacttttattgtagcatattattttgatatctgtgtatccaagcttttttcctaaaactgctagatggcatagatctgctttttttttttttttttttttgagtcggagtcttactctgtcgcccaggctggagtgcagtggcgtgatcttggctcaccgcaacttctgcctcccgggttcaagcaattctcttgcctcagcctcctgatgagctgggatttcaggtgcccgccaccatgcccacctaatttttgtatttttagtagatacggggttttgccatgttggcccggctggtcttgaactcctgacctcaagtgatctgcccaccttggcttcccaaagtgctgagattacaggcatgagccactgcccagccagatttgctttttaaattaaatttttgtctctgagtcatttagtaattaagttagtcatggtacccccttctcttagatactttaattggcgatactctgggggtattgcaacaacaaaactgatgatcagaattagtttaacaac

SEQ ID NO: 107760 - DNA, 2023 bp, Homo sapiens
tgtattcccagagttcagggtaatgcctgtgtagttcattgtgtattcccagagttcagggtaatgcctggcatataacaagatttcagtaaaattttttttgaataaatgaatagtgggcactcagtatttgtggaatgattagatgttctatttggttgatgaaagtgaaatttattctaagtgtttacagaagaaggttagggttctatagctgttttgtagtatggctagttcattgtagctccagtaatagagttaaatttataggcaggttggaatttcagaactttgttccctgatacatggtaggtgcttattaagtattgctaaatgaatgtcaaaagaagctaataaagtgagtggggttgggggaaacctagcttgctgtgagattctggcctaactggcatagccttttgggtgaggaagttgaactaagatttcagagctctcttgctttctcactaagattcacctccagggactttgtgtttgtaagtatattcctttggaattcggaagttgtaaaaaagtgaattggatgaaacttgctgtaggattgcttttttggaatcaaaactgttgttgaatgttaattagcaccacagctttgtgtgaaggcttttagacttgagtgataatgagattcattattagagacagtgtgtgttaggtgttccaaggcttccacttttattcatccagcacttgagaccgactatatgctaggcattctgctagactcctgaagatacaaaagtcaaatagggcagtaacgaagagaagaagatataaatgtttgttccagagtgctgctttttgaggtttggggtttcccaaaaggcaggggaatttattttattgagtatttttggttttgatttaatttaaattaaaagtgaatatgagccattaattactgagaatatgtttaatcagaacataatttaatatcaatttgctattgagtcagtatgtatgtatgtatgtcttttttaaggaattagcatttattgagtattatatcttacactcttgacatgcattctttttttttttttttttgagacagagtcttgctctgccactcaggctggagtgcaatggcgtgatcttgactcactgcaacgtgtgcttcctgggttcaagcaatcctcctgcctcagcctctggagtagctgggactacaggcgcatgctgccatgcccggctaatttttgtatttttagtagagacagggttttgccatgttgcccagtctggtcttgaactcctgagctcaggtaatctgcccaccttggcctcccaaagtgctgggattacaggcatgagccaccatgcctagccacattattcttttgacacagtcctcataataatcctgagggagaagcattattacctgtattttacaaataagaaaattgagtttagagaagttaagtaatttgtttaaagtttacagctttataagttgtggatttcaaaccaggtttttttttttgatactaaagtacattaacagcaagacatgctaaagattactgcatcttgagatgtaagaatttctgtatatttactctcaggagactctataactccaccatccaaaattagcaactaattaccgctagtgacatgtggctgttgagcccctgaaagttggctagtccaaattgagactggctgtacgaataaaatacacaacagattttgaatacttagtttggaggggaaaaattcattaataagttttacattgattactgaaatggtatgatttatattatatttttacatagtagttaaataaaatatattatcagtataaaaaagtacattagctttttgtgatgcttctcaaaggaagttattatagtttttttctttgtctgtagataatgttaaataacaagatgtattgactttgaatactgtactgtaactgttccccccaaattgaatctttggctttttaaccagagtatttaaaagtacctttttccttactaaataaata

SEQ ID NO: 107761 - DNA, 1002 bp, Homo sapiens
gtagctggtattacaggtgcctgccaccgcatcctgctaattttttgtatttttagtagagacagggtttcaccatgttggccaggctggtctctacctcctgacctcaggtgatccgcccaccttggcttcccaaagtgctgggattacaggtgtgagccactgcacccggccagcactgatttttgtatgtaaacagttccatattgatggacattagggtattaaatagggaaagtttgatgggaccagatacttggttcttcttgtggcacttaaactttaaaatattttgttttcatttttatcataaagatattttaccacggatactcaaaacagtatagaagtgcacataataaaaagtttaaaatgttctctgattcccatctgcccacttttcctctattcatatctccagaagttactactggttagttcaagactttttattaaaggcatgtgcagcatttatacactgtgaatgcttttttaaaaaaattgggatcatatcatgaatattctgcaacttaattttttaaacatagcattattagttaaccttttaagtttggctaatgagaaaagagtcctgaatataaataagattttacaaaatgattttgggcctttttttctgtgtcattgatactacatacatattttttgcatgtttgtatgcttcctaaatcttacagtattgtaatctgctctaaagtccagaaagtagggtatatattcctctttactttctctgtaggctcaaacttatgtttcgaaagaaattgagaaaacttttattgttgtaatcaattatggtttaatactaaaagtaaatccagatacagttgagatgcctaccagcagagttgaatgtaagttccataaaagtaggggaaaagccttctgatcttgttcatcactgggtccctagcacctaggacagcgactacctcctcattcttcccattctctgtatttgttttacgttttactatataa

SEQ ID NO: 107762 - DNA, 1422 bp, Homo sapiens
attgtattgtgggggagttgtgaaactgtaattttttttctttttttttttgagactgagtcttgctgtattgcccaggatggagtgcagtggcgtgatttggctcactgcaatctctgcctcccaggttcaagcaattctcatgcttcagcctcccgagtagctgggattataggtatccaccaccacgcctggctaatttttgtatttttagtagaagcagggtttcataatgctggccaggctggtctcaaactcctgtcctcaaatgatctggatgctttggcctcccaaggtgctgggattacaggcatgagccactgcacctggccgaaactaatttttacaagacctctttttgggtctttaagatgatgtttgtttgtttgatatgttagtatgtcagttctagagctttcccagagagggtgagaaatattaataaacaatagggtttctattgctaaataatacaacttcttttttttttaattagaggaaagagtgtcgtcgtcttctccttcttccttctaccttcttccttcttccttcgtcttccttcttccctccccctcctcccaccttttttggagacagaatcttgctctgtttatcagattgtagtacagtggtgtgatcttggctcactgcagcctcaacctcctgggctcaagcaatcctcccacctcagcatccacattagttgggtccacaggagtgcgctaccatgcctggctcatttttgtattttttgtagagacgagattttgctatattacccaggctggtctcgaattcctgagctcagtccagccaccttggtctctcaaagtgctgggattgcaggtgtgtgccacctcacctggccataatacaaattcttaaatagtggtcgaatatgactttctgtatttggttttgaaaaataaattgctttccacatatcagcatggtatttccttctgtgattaaatgtgtgcattgtgagatgtttggctggtatagggtacaattcttagacatggaagaaatttactttctctgtaagtagcaaatacttgttatgcccttcttgaaccaagaggatttactaaagaacaaggtataattctatttaaattcagttgaacatcaggaataacttttactgagagactctgaggcctttaaaaaatatgtttatataggccgggtgcggtggctcactcctgtaatcccagtactttggaaggttgagatgggtggatcacttgaggtcaggagttggagaccagcctgagcagcatggtgaaacctcatatctactaaaaatacaaaaattagccgggtacggtggcaggtgcctgtaattctagctactagggaggctaaggcaggagaatcgtttggacctgggaagtggaggttgcaatgagccgatac

SEQ ID NO: 107763 - DNA, 1090 bp, Homo sapiens
acgctttactgtgtagcccttatattagaattgagttgcaggtgtgagataatattttggagaaacagcaaggctgggaaagtcagagattttattccagcagcagagtctaaagagtgggagagctctatttgtgtgtgcactttatgcatagagaaggctgtgaaacatgcatatgttgaccctattgtcacagttccatacttttaaataagacccatgaagttgagacagggttggagatgacagacaggatgtgagattgtggtgcttcttgtgatgctccaccctataatggagaatggaggggcagaacgcttgtgtgggtgagacaagagtgtgtgttggtactaacaggaccaaccgggttccccggatattgttcttctaagaacataatcaccataagtaaattaatttgttggaatgtttatcattttctagctgattttttgtgtgtgtgtgtggggtggtggtggtggaaggggagttttccccgatttcaagaataaaagcattttcattgttcagaagaagagcattttcattaaagcggaggttgcactcttggcattttatcttgagttatacaaatcatccttggttatacaaatcaaattgcttttgaaatttgttgagtgtaatgtataaatgtatatttatataaaaacctatgtgaatagaacagcaaggaaaaactgagtagagttaaagaagtttgttttccctgagattttctgcctttaaatttatataaaaaaggaatattccattttacgttattgagttttctatttttttaaatgagctaatactcagtacataatggacatttttagtaaattattccaatatacttgtgtctgtaatgcatttgatgtggtataagatttagaaacacaatttagttcggctggcacggtggctcacgcctgtaatcccagcactttgggaggccgaggcgggtggatcacgaggtcaggagatcaagaccatcctggccaacgtggggaaaccccgtctctactaaaaatacaaaaattagcgggggcgtggtggtgtgcgtctgtagtcccagctactcaggagg

SEQ ID NO: 107764 - DNA, 1277 bp, Homo sapiens
ttgattgagatttgttttgtcatagtgccaaatactaagttaaatgttgtcactggctcattacatttaagttcaattttggagtgctactgcattcattacctgttaaatgttctggcgggttccttaaaaaggacgatttaaaacactctagcgttagtttccatcatatttagataactgtggatttagttagaagaatgtggatttagtcctttccattttggcttttgcagatggctatggtcctagaaataatagggatatttgggctgtgttcagggttgtggatagactactcttgtcctgggtttgtgctgaaaagtatgctcttgaagtgtttaatatatactaagtatctaatgttccagtgtatctctatttatggagaagttcatgtggtatttaatgatagcttgtttaaacatacttgcagaatttaacaaaaatatctatattgtttccttattgtgggaaagaggggcatcatgagggcaaagacaaattaatttgttgcctagaagaactgagagaactaaagaactgagattttaagaacccacacacacgcaaaacatgatgttatgtgaaattgattatattcttaggcaacataaaatgatcacttttagttgaactcaagatttcaattcatgttggctttgggaactagcctgaaacagggtagtctaggtaatagctgaatgggagataatttttgaaagttaattttttttttttcttgtggcttgcaagtagagaatgcccgggtaggtaaagaggaaagctgattatgcatctttcagggaagggtcgtgctttctaagcacttcatggagtgatttgaaaaatattttaaaattccggggtaattttcagctatgatgatacaaatcttataatagctacttaagagcctcttgtggtactggagtgtttgtatgttttacatcttggtaatatagtttgaaaatcagtcagtctatttcagctaattgatttattagctttatttcagagatctgtaatgctagattataatgctacattttgggacttttcattttcttttcaggattttctttgaaaatgactcttgaattcttggtaatacagatactaactaaggatggagtaactcttgtaaaatatatagatgaaaatgtttaattccgattaccatataggtcaatttagaattttaaaagttggagtttagtgttaattatgtgtttttgacagctttgactttaaaagcatttaaaagaaaggggagt

SEQ ID NO: 107765 - DNA, 1077 bp, Homo sapiens
ttgaggtcaatggagtagagtttttcttaatagataaatgggaccaaagtgatgaagtgacttgctcaagttctcttagatgttgctgtggctaaaatttattcatctgtacccccaattttttttaattgaatgcatacttcagaccaggcactgactgctaatccaatgttttttgcttctccctgtcagtcacttttcttctgaactggaagtgttttgagggtatatgatgttacattcaaatggattggccattttgaagccagttacaactaaggcagagtgttcaccaaattgtggaaaacaaaagcagcaaacagatcaacttgaccagaaacattcgtgaaagaaagacttggtcaaatatttcaggttatggccacaggcaggagacaacctttccatctatgaggaaacccttgtcaagttgtacactggttttattgatcacagataaacacatagctaacatcataaacaacagtaaacagcaagacattcctaagaacgataagatgtaaacatctgcctagaagatgacactatagttaatccataagcatagattcccatgattctatagaaaagttcaactcaactacaaataaacactatgcataagttctaccctagtttctttcagatttagttatgaggctatgtaattattttcctgcttaaatctggataataatgcagtcttaagacctctgtaaatatatggaaagtttaaatggaaaagaaaacttgttcatgatgccatgggaactctatggaaaagaacatattatcgagataattattatgggtattttctccctataaataatgactgagtttaaaatgtagctttggaaactttaaaagttgaactaaagaaagatgtgaaataagtttttcttcttgaaaattaagcttattttatactagaaagctcccaaaattttagtattttgtgttaattttaacccctttgtaaacctgacaatgatttcacaagttctttctaactttgagagtctacaatgatcttgctgaaaagctcctttctatttgtgtaggtctcaaatattt

SEQ ID NO: 107766 - DNA, 2068 bp, Homo sapiens
gctatggtcctcaggctacggtcctcagtattctagtatttgagtagtggaggtaaatccaaaggcgactggttatattttacttctaaatgtgtgctgaagtgtctcttgttcaaaaattcttgatatttagagcttcaagttaccacatttaaaagtaaagacttggcacggtggcacacacctataatcttagcactttgggaggccgaagtggatggatcatatgcagtcaggaatttgagaccagcctggccaacatggtgaaacctcatctttactaaaaatacaaaaattagccgggcgttgtgacgcacacccatagtcccagctaactccggaggctaagacaagagaatcacttgaacttgggagacagaggttgcagtaatctgagatcactccgctgcactccagcctgagtgagagtgagactgtgtctcaaacaaacaaacaaaaaacaaacaaaaaaatttgcattgtaaattgtacctcaaatttgagcagtttttgtgtttgtgtaaattaaagtaaaaagcagtccacaataatgttttgtaatactgcacaccagttctaccagattttgtaactatcagatttaaatgaaaaaagagaaggaagaggctgattgctggagtgttaaagaaatcttggccgggcgtggtggctcacgcttgtaatcccagcactttgggaggccgaggcgggtggatcacgaggtcaggagatcgagaccatcctggctaacacggtgaaaccccgtctctactaaaaatacaaaaaaaaattagccgggcgtgatggcgggcgcctgtagtcccagctactcgggaggctgaggcaagagaatggcgtgaacccgggaggcggagcttgcagtgagccgagattgcgccactgcactcccgcctgggccacagagcgagactccgtctcaaaaaaaaaaaaaaaaaaaaaagaaatctttagaagccacagggctagaagagaagtcaccaaacacctagggacagtcctaggcctagaaagccctttaaagtaatagtgaattgttttaaaattaagttattgagtggcctactgactaccatccaaaaacctttatcaccaaatttgttcagtgtttgctattgggagattgtccatatccctccgtaattaagggccagcaagtaatacgatcttcttacagccaaccttgctcttcccaaagggagaaagtaatacatcattaacctggaatttgtgatataacaggtagccttggttaatgtttaccttttcactatgtaaaaaagaaaaaacacacagcaaatagtgcaaataaaatttggtcttttaaagcattttagcagtagctatgtaaaaaaagttaatggttattattcctaaattttcataagacccttggtagacaaaactatcggttatattatgtatatatgaggttagttaagctgcatttagttaggaacatttaatttttacctaaatgatccttttttcatccagaggtagagattttattgtcattatgaatgttactccccatttagtccaaaatagtgagcttttaagttgtgccaggtacttaacaatagtaaaagctattgtatagatttttattcaatgtgacctataatacatttctgattccttctgtattgaatgtcccagtttccatattaagtgctatgccctgtataacattaatgaatttaatagtgtacaattttgggccaggcatggtggctcacgccagtaatcctggcactttgggaggcagaggcaggcagatcacctgaggtcaggggttcgagatcagcctggccaacatggcaaaatcacatctctactaaaaatacaaaaattagccaggcgtggtggtgcatgcctgtagtcccagctactcaggaggctgaggcaggagaatcgcttgaacccaggaggcggaggttgcagtgagccgagatcatgccattgcactccagcctgggagacagagcaagactctatctcaaaaataaaaataaaaaaaaaattgcgtgcaattttgtattttcat

SEQ ID NO: 107767 - DNA, 4290 bp, Homo sapiens
aaattcgttagttattaaactgtaacttaaacaaaagtacttttatattctcagagatacttttctttgtataatctgaaatcttataaatcacaagatagtgttatactgctttagttcgtagtaactcccataatgctttattttatttctttcatctgttttcaagaagctaacacattttaggggatttattatcggtctatgactgaccaacttattgaatgtatttactttcctcaatcattcagagtaatgtaccacaaatttcgccttttttatacttactacaagatcaaaaaaaaactacatggttagttgagatatcaggaaaaaaatagaagtagaattcattgtttttcctttgcttggaccacatcttttaattttggtcccttatgtgataaacacacagtatttggtgccagaagaaacttaggcagagtatagagcttgagattcctctccagagaggtgattggaccaaaattctagatgttctggttatactgcaaccattgtgacagtctttgtcttagagatttgcagtatcattttaaggaccagctagaatccagaggcacagcaacatctgctttcctctcagctctagctctgtttttacttaactgaagggccacagtcgaggagcactaacctaggaatcaaaagggccagatattactttcagtttacctgacgatgtgtaattgtatgagaatcaagtgagatcatcagtgaaacagatttgaggcctgtagatttacagtctttggaaatgtaaaatggcatttatttctttaaattttgccttcccagtacataagaacaggagtgccaaaagtcatcccctttctgaaaatttttcgtatactaattctttaagataattattaaaggagtttttatgttgttttgttttagtctgtgactgtagggtagtaccaagggggtggcttgggtaatagagaaagggcacctcaggtgtcctaaaatctccatcagccattgccccaagtctcccagagaaaagaagctaggtacacagtgtcctttctgtgcctgctccctttaagataaatgtcctggttacctctttgcacccagattctacctttaagaccttccagtaggcttatagacagctatacaagcaagtactacttctgcttaagattcataacagaagatggtgtatgacatttctccagaacactggagaaagggctgaaaaagaaattgattccttgctttgtaatgattactttctattccttcttctctttaggagtctactttgactgctgtgtcagacaaattaaatttgtggacttctgtgggaagtatcgcctcccactgatgcactacttgtgttcaccagaatgttcttccccttgcagttctgcctctcacagctccacttcccagagtgaatctgactcagaagatgaagctagtgttgctgcacgcagaatgcagaaagttcttcttggttgaacaggagtgcacagtgttgtgaaatacttaaaaaactgagcaaaatggttagacaagaaaatagagcttgaagttcactagaaatcttatcttcatcttaagtgttcatcaaagagtctgggatgatataaaacattttgtgtttcatctacccattcagcaagaatgagtccagtcccatgtttagattattttaacataatttgtgaatgatagtttcacatttggctgatggtttgcagttttcactcaagttttgcatgaatcacaaagcagaatggtaccttttgaagagcagttctgcaataagtcatgagtagtataacttttggacattgagatggagaaagtgagaaattatcaaagctataattgccagagttgcccttgggtttaggtagaacactgtataccatatatactatataccatatatactatatataccatatatattatatgccataaacaggattaaccctcccttttctaattgcctgtatgtctagattacagaactattcaaagaagctcacagatggttacatgggacaaacctttctgacaaactaactggtaaagtaaggcatataacatttacatgagatattaaaactttttcattattatcctttgttctatatgattgctattaaccttatgtaatctagcaatgactgttatagtgccttaatccagcaaggatataaaaatgtattcaagaagtaatgccagagcaacctataacctgacataccatgcagaacattgtaaaatattctttaacagaactaggtaaataactgtgtatctaatatccgatctcatggccctcttaacatttttttgtttaaatgtgcactcatcccttataagcacattacttttacacttaatggtaggccacaatcttcatcaatctgttcatcataagacagagtaagaatttttaacagaaaattctaaaagagatagaagctaggaaagcttctttatatcttgcattaaatgggtagggaaaaaatatgactctcacccatgtcatgtactggaccatctttctctactttttaaagaaaaactaatacaactagaaaaacatcacaacaagccaaataaaaatggagaaaaggagtcattgtccttatacctaatggaacagtttccagaactactttaactatggaagcatttttgaaaataaagtattaataaaatagaaaaaaattattaaatatattgtatccttaatgtatagcaggaaaatagtttcacaaattaattgctattagaaattaccaaatttttattaagtactttaatatgcaatacaaattgaataatagtacaactataagttgatataaagtaagtgcttactggtaatcattaaataactaataacatgacttgttggttaatgttaaacctacagtaagaaatgttatacagatcagataggcattagaacatcaggtgtaccttttctgatttctggcattcatggcacaccatttcttaaaagcagattgttgtataataacatatacatgtattagggtttttttcatatatattttttattttagaagaaactagcataattcagggtttatgtgtttatttgtatattaattcatgaaacatgagagtttcatgaactgcagatgtgaaacgctgctatagaatgaatcccttcacctttaccttgttataatgtagtaagattttgttttccttttgactcagaaattttctatgtctatagaggtaatctaatatgttcctactgcctagaagagtaatacataggtgattatatcataaaatagaggtataaagtctttgcttacttctccatgtgggccacagcaagctgcagactgtacagttatgaaaggtaaagatgacttaggctgtgcctaagtgacaaatgtaaaatgttttgtaaataagtgacttacctaagatacataagatattttcatagaaaataatgtattcatagtaaaatactcaaattgataggaccaattttttctggcctaaatgcttatgcctacttcctaatcaattaccagcttgacttaagtaactgcttgagtagtcttctaagagttagtcttcgtaaaataaatggataggtatgtaaatatataatcttacataccctttccagcttcctagaaaggtctactgcttcatcttttacagatgtaaataggtccaaccagagacagtttctggcctttgcatataagaatatagatgtataccacagtattatttcaacaaaatgttatggttctatgtatagttgaaaactctatgatcagcatacaactgtcttttggtaatttttaatgaagtctacatttagccgtcggttttatctttcttaaatctttgacctaaacttttgtaagagcagctaataatttctaagattttccctgtttctttttcctacctttccttttctcataactgattggagaaattaatcagaagtcaaatacaagggacttcataatctagaaaccagataatcagctcccaagtcatgtagctaactatgcatttaaaataagtctgtctctttagttcttaagtcatatatttgtttgttaattacagtaaatgaactttaattggggtttttaaaagacagaattagcgaagtctaatttttataatgaaataagtttttgatattgctctacttggacgattttagtgaccaaaactatggataaaactgcctaagcataacattaatatatttagaatggc

SEQ ID NO: 107768 - DNA, 2117 bp, Homo sapiens
acaagccctctcctccaacctgaagtgtactctttcttcttgtctaaatgggctaagtccatagcccagctgaagtcacagccctttggggaagcctgttccattcagaactactgtggcctttttaaaacttttatcttccttttcattcaactcctaataccatttatggtttgtctctcttattttggtattgtaatgcctatttttggccttgttttgtgtttcattataatgttatctaacattggtctgtctcgtctgcttagctatagtataagctccctgaaaattgcattgtttctctagagactggatagcacatagcaaatcttaagtaaaacatttgctgaatgaatagatgaaacgtgttttttgtagtagacacaatggggtatctttttcaactttatttacttttttggttttgttcatttatttttgcagtttagagtgtttatatcttggaggaaatttcattaaagaaatcccaccagaattaggaaatctgccttctctgaattatttggtattatgtgacaacaaaatccaaagcatacctcctcaactttcacagtgagtagttccaggcatttgtatatacgcagacatctatgcttagtaattattgtcttgtattcactcacatgtttttatatgtagaaaagaattagatattctcaaagtaagtgatatgttaattatagttctgaggtttgctgcaagctgagtttttttaatttcacttttaaatgctctggtttattcttcaaaatatttgttcagtctattttctgtaatcaaagaattgagtattagcatacatttccctaggttttatgagacttttagtgattttatatttgatatgaaacatttctatcctaattaggctttataatatgaaggatcttaatttctgttgcatttgaaatctttcctttttttagatatctgaatgagaaagcatgcccactgcccacccccaaatcttcaaatctaggttttacagcagttagcacatcagaacattctctaagtattctaaattcgccaagattgcaagggcaaaagtccttcatgacatttacaaatctgcactttgatctagtttcagcacctttttattttacttcaattgaccttaatcttaattgctcattcttaaggggaaatcaagttctgtatacacacatatattcaatatttttgatagttacgttgtttactgccattgatttttctactacatttattctaggttacattcacttcgttccctaagtcttcacaataacttgctgacatatctgcctcgagagatcctcaaccttattcatttggaagagttgagtttacgaggaaatccattggttgttcgttttgttagagatttaacctatgatcctccaactctcctggaattagctgcacggaccattaagattcgaaatatttcctacactccctatgatcttcctggaaatcttcttagatacttgggttcagccagcaattgcccaaacccaaagtgtggaggtaagttaattcagtattcatgtttcccacttatttagctattttttaaattaattaagtcttctttcagacaaaagcagtctctgtttctgttccctttattttttcactcatttatgagaaagacatttcactctgggttttttaaaaaattctttttcataatattttaggattcatacataaggaacatacccaggaagtctcatcctgtcttgacatacgataataaatcaagatggtaaaatgagaggaaacacaaggaagtataaacagttctaattgtttaaaaactgtttctaaaatgtttggacaccttttattatttatttatttatttatttatttatttttgagacagagtcttgctctgttgcccaggctggagtgcagtggcgcgatctcggctcattgcaaactctgcctcccaggttcacgccattctcctgcctcagcctcccgagtagctgggactacaggcgcccaccacaacacccggctaattttttttgtatttttttagtagagacggggtttcaccttgttagccaggatggtcttgatctcctgaccttgtg

SEQ ID NO: 107769 - DNA, 1008 bp, Homo sapiens
ggtgtcattgacctctccagatttagcaagatatctatgttttctataccctattaattctttcccctagtggcaaaatctttttttttttaacgttttctgaagcatcactttcaaagtataacaaataagtagatgctgaaaatcttacttatttttatgattaacttccttcccctcgagtaaattaggttatcaatgtgaaccatgcggttgtggatgtagttactttccatcaaaatgtggttattcttcagcaaataagtgtaattgtttggctatagtatatgggcaaaattttttttgttacataatgctgaaaaagtaggtataattcatattctgacttatttttctgaatcataccttttattcttctcagttaggttagatattaattgaggaagagcttaatagcttatcactcaatggccaatagactttatttaagtaaacaaaagcttctggattgtttggcaaatccagtatgctagatatttggagagtaggtttgagcacaactgagtttcattggtactcttctacaatcttttcttcttaagtaatgccttcctttttctgttcatgatgcctctcaccatctgtttgatgtggttttgaaagattgagataggagggtgtgacaaaacaaaagctaaaagttaatgctctcaaatgttttgaagttagtgtacagtaggttgatatgttagaaaggagacagatgactcaaccagatgatagaatgcagtaaagtttaaatgaaaatgcttttccacatttagagtcacatactgagcttgtcactggctctcaacatcgtccctctgactttttttattgccttaatttggggcaagtgtcaagagatgatgcatctatttgtatgtctacttttgaacatataggtaccttataatcctgtggtgtatgttagtatttgtcatttaatacaaagatgctacttcaagaaaactttctttatccacagatgttcttatctttctg

SEQ ID NO: 107770 - DNA, 1933 bp, Homo sapiens
gtgcctttgagcgtggcgtacaaggtgctctgatctaacccttgctttccactacatttgcagcttcctcttctctgtggcagtaccaactaccatttgtggagttcagtgacctatgcattttcccacgtagagaaagcagcttggagttgctggtaggcactcagtatgtgttgaatggatgcagtgcctctgtacacgtgctgtttcccttgcttggaatgtttccttcacctggcaaacgcctatcatccttcaaaagctatctcaagttaatcatctctgtgattccttttttactactccctgcacaacaatttttttcgttactactccctgcacaaaaaagtacagcctatgctgtactttctctgtgcttcattcatcttgcctttgcatttaccttattggatatgattccttgtttacaggaattatctgcttcacctactagattatgcagtaaatatgttaaatttaactttaggaggaagcagagaaacaggataataaaagtgcccggtgggggagtgggaaatagagccaaatgtattgtacaaaacgaaaaagaggtatcttccatctgtaagatattttcacactttattgtattttcagagataacagaacgttaaaggtagaagggacctcagagttaagtggagcaaaagaatattggcctgggaaggccgggcgcggtggctcacgcctgtaatcccagcactttgggaggccaaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactctgtctcaaaaaaaaaaaaaaaaaaaaaaagaatattggcctgggaaaaaagaactcttggtgctccagccttaggcaagtcacttgtatcctaactgtagcgtatcctaactgtagctttctaatctacaaatgaagcatttgggcaagatgtctcttcatttactcttcaatagatatttattgaatacctgccctgtgtcaggcactgtcccaagtattggggatacaatggtgaacatgatccaggagacagacattaaacaactaactatgaacctcattatttaattacagtggttatgagttctatgaagacctacagaatgccttgagacaaaatgacagaggcacatgggaaagcccagaggcaaggagggtaactactaaaattctgaaagaaggacattgtactgggaagtgagcaagagggaaagtggcaaatataaatttgggcaagtcagcccgtgtcaggtcttgaaggctatgataaagtttggattttattctaagtgcacatgagagagttttaagcatgtgtcttgttgctatgcaagaatggagtgaggagagggtgaagagatagagattttgagggctggtttgaaggaggtcattgtaataggatgagagatgatggtagcctataccagcttgatactaggagaaatgctaagaaatggaagatttcgagaaaagatttagaggtaaaattgacagcccttggttccttctaattttaatgttgcataattccagccttggaattttcttaatatactaacaggaacccagggaaagtattatttccatcacatggggagaaaagtaggcaaaaatcccatttatttaatacttacaatgcagtagatcctgtcataggtgctaactatgctttttaatactcacaatgatgccataagatgatgtgctcccatttttcagaggcagaaactgaagctcag

SEQ ID NO: 107771 - DNA, 1097 bp, Homo sapiens
agcgcggccgccgaaacccggtccggctcagatgacaatttggcagcctctgggtgtctgcctcagttctgcgcagcccatgctgcgctcttgccactccgcgccccgcgcctcgtgaggcagagcccgccccggagcggcgcgcgcaccccaggactcgcgtcgcgtgactcggccaaggcgcgcagggtttgcgcccgcccgcgccacttccgactcagccctcggttcaggttccggggcgccgcagagctcccggcctctggaccgcgcgcggcgctctggggaatccggcgccacgcgccgtgcggtggccaggatggaggaggccggagcagcggtggtcacggccggggaggccgaactgaactggtcccgcctcagcgtgtccaccgagacgctggagtctgagctggaggcgcggggggaggagcggcgcggggcgcgggaggcgctgctgcggctgctgctgcctcacaaccgtctggtgtcgctgccacgggcgctgggcagcggcttcccgcacctccagctgctggacgtgagcggcaacgcgttgaccgcgctcgggccggagctgctcgctctgcgcggcctgcgcacgctgctggccaagaacaaccggctcggcgggcccagtgcgctgcccaagggcctggcccagtcgccgctctgccgcagcctccaggtgctcaacctcagcggcaactgtttccaggaggtgcctgcctcgctcttagagctgcgcgcgctgcagaccctgagcctgggcggcaaccaactgcagagcatcccggctgagatcgagaacttgcagaggtgagcgggtgtgtgccggagggtggggaggcctcgggcggtgtccgggaaccctggggcgccgggcctgggcacctcaacgtttgtcacgtaactatttccaagctttctctttaactgtgcggtagtgagttctgcccaaccatctcagcaagttgttgtaaatacctagtatgttcgcatgtgtgactgtttggtgtgttgtgtttggcctatgcagattctcgaggcattttttctgtcttccttattgaatctggggcgtgatccaaactgag

SEQ ID NO: 107772 - DNA, 1074 bp, Homo sapiens
tctaccctgcaacattgaactcccaagagcaaatccacattcctcttgagttctgcagcttctgtgtaaatagggcagctgtcgtctatgccgtagaatcacatgatctgaggaccattcatggaagctgctaaatagcctagtctggggagtcttccataaagttttgcatggagcaaacaaacaggattaaactaggtttggttccttcagccctctaaaagcatagggcttagcctgcaggcttccttgggctttctctgtgtgtgtagttttgtaaacactatagcatctgttaagatccagtgtccatggaaacattcccacatgccgtgactctggactatatcagtttttggaaagcagggttcctctgcctgctaacaagcccacgtggaccagtctgaatgtctttcctttacacctatgtttttaagtagtcaaacttcaagaaacaatctaaacaagtttctgttgcatatgtgtttgtgaacttgtatttgtatttagtaggcttctatattgcatttaacttgtttttgtaactcctgattcttccttttcggatactattgatgaataaagaaattaaagtgatggttttattggtttcctttcccccaattaaggccaaataaagtcgtgagaacattacccatttacttcctaagagtggatttgagtttcaggagccttaaaaaggactgaagagtttctcctgggactacagcttggatggaaagtttactcggggactggtagaacaagtttctttgaaaggatcatggatagtgggtctggagtagaaggtgatgacaagtcagaaagtgtcttagtcccttcaagttgctataacaaaatgcctcagactgggtaattataggcaacagaaatgtattgctcacagttctgaaggctgggaagcctaagatcaaggtaccagcagattcagtgtctgatgacggcttgttgaagcttgcctgcttcaaagaatgcacctttttgatgcatccccacatggtgaaaagggtgaacaaactcccttaggcctcttttataagggcacttacccat

SEQ ID NO: 107773 - DNA, 1254 bp, Homo sapiens
tgccaggcactgttgtaagagatggtactttattactgtggttttgcagttgaagacattgagacacagaagatttcataatatgcccaaggtcacccaaaaagtagcacagccatggttgaagctcaggcagtctgcctccagaacctgttgtacttaacacttctttggacttgttggattaagaacatcttgtagcatttccatttaacatcattttcttcatccttaaaatgggaaccataatgtctgatctgcttgtttcataggagtccaaatggagtcagcttaattcagtaaacagcccctgcatgaccatgtcatgaataggccatagttcttgttctcaaattgttcattgtccgtggaggagcccgacaagtaaacaactaaaattcagcataagcttgtaaatgccaatgctatatagtcttgaggaacagataaattccaacagttgtttaatatttccatgacgcctattttctcttgcatctcaaaggaaacagctgaaaagaccaagagagtgagcaccaaagagatctaatgaggaggcacagaccagtgtctggatcccagcatcttctccacttcagcgctgagttcagtatacacaagtgtctgctacagtcgccaaatcaccagtatttgcttatatagcaatgagttttattttgtttatttgttttgcaataaaggatatgaaggtggctggctaggaagggaagggccacagccttcatttctaggagtgctttaagagaaactgtaaatggtgctctggggctggaggctagtaaggaaactgcatcacgattgaaagaggaacagacccaaatctgaacctcttttgagtttactgcatctgtcagcaggctgcagggagtgcacacgatgccagagagaacttagcagggtgtccccggaggagaggtttgggaagctccacggagaggaacgctctctgcttccagcctctttccattgccgtcagcatgacagacctccagcatccacgcatctcttggtcccaataactgcctctagatacatagccatactgctagttaacccagtgtccctcagacttggatggagtttctgggagggtacacccaaatgatgcagatacttgtatactttgagccccttagcgacctaaccaaattttaaaaatactttttaccaaaggtgctatttctctgtaaaacacttttttttggcaagttgactttattcttcaattattatcat

SEQ ID NO: 107774 - DNA, 1013 bp, Homo sapiens
tctcacctcacatcaattaaatcagaatctctgaaggtggaactagacagctatcttttcaaatgttctccaggacattttgatggtatatgaatgacttgagagtcattgtctcagagaaatctccagtgtcaggatccaagttttcaccataactttttttgtagggccagcttctggctgggatgtgctaagcagttaaaggaacaaaggccagagaggagttggggtagattgctttgttacaatgtgttaccttggaggtatcaattacacagggccccttcatgccttcatactcagaaaatgtgggtaattcacctctccttccacaagttaaatgggagatgaattgagagcctctaggtagatcttggcggattcctcactggcttaccacagctgctactgctctgagctttggttcttcttgcaggaaagaatcagaagggggcccagacccagacagaggaggagatgaccagatatgtccaggagctccaaaagcatcaggtgagtggcagcctccgtgctggttcaggtgttgctgttgccatcaggccctataccattcaaacactgcccagtgccccaggagaccaaggaggctctctctgctcaatacagtacatcttgagtgataccccatcacctgtactatcaaactgtgatacagacagttccctgataaagtcctcacagggcccagtaggtctcaacacatataggttacagctcggtgagtggctgcataaggcaaaatcaggcaggtggtgatttgcaaatgaggtggaagtggtttgcaaatgagcgtggtttaaggaagtgtgtatcctgtcatgaccagtgtccagacccaaagactgtgagctcctgaaagcaggctctgtaacttgctcatcattgtacccttgcagtctcacagggcctggtatgtagtcagcactcagtgagcatgaaagcagtggatttgggccacagcagaaaggatttaagttcaacatcagtctggc

SEQ ID NO: 107775 - DNA, 1049 bp, Homo sapiens
ctgtgttttgtttcaggggactctgtgttgatgctctcattgaactgtctgatgaaaatgctgattggaaactcagcttccaagagtttctcaagtgcctcaacccatctttcaaccctcctgagaagagtatgcctaacctaagaaatagagagctgtagtgaatggaggcattttgtaggagccaagatagagaggattggtggaactctccagagctagctgagaaaatccccttccatgattctaaactgggccccagcccattctccccatggtgaagttagggccccacattctttaggttgatggtagtgtttgctcagatatagtgcttctgagggacaggcaggtcttgtctgggaaaaaagggtaaggtgcacagactgtagcaaagatgccctgttccaccctcacagctaaactgttgccccgtatttctggcccaacagagtgtgccctggaggatgaaacgtatgcagatggagctgagaccgaggtggactgtaaccgctgtgtctgtgcctgtggaaattgggtctgtacagccatgacctgtgacggtgagctgtgcttcaagcagaaagaaaaaacagcaaggagagagcttcatgaaatcagcatgagagaagttggggtggggatgatggagaagagggcggtggctgggagcaaggaacccaggcagacccacacctgtaaggttggagccccaagtggggagctttgagggcagaacatttatcccataggcattcagtttgaaaatcactccagaggcttggaataagagaggaccaagaccctgggcaaaagtaaatgataatggaatagtaacattatggaaatagtaacagtgaaagtagtaataatggaataataattaaaaatagtaattatttaataattaaaacattaaaataaaaacaataattattatttaataataatcaaaaataataatggaatagtaacagtgaaagcaaatactcagcaaaaaccatgtgccaggctctcttctaagcactttacatattaacccattgatc

SEQ ID NO: 107776 - DNA, 1037 bp, Homo sapiens
attctttgctctagtcttttctatattctctaagcttttaattggcatattttattttcatattttatcagaaaataacacattaacttttttatttaaataaaataccacatattaggagaagggaaaattcctctcgaaaaaaggaggggatcacaagaatcgtcacgatgtcaaggcactggatgaaatatccaaggggcaggacttcagggattgcttaaggagaaaaaggtggggtggtaaatggcctttcagagatggcacagacgtggcatacatattaccattaccctctcccttacccatgacagacatttctaatcaatcatagaattctttcctactgaacttggagaaggtttgaaaatcctactcagcaatattctaggtagccactagcaatcagagtctatatgagatgaaagctatttaccatccctgctggatggtaaatcagtccaatttgacaaacattgacacatctttagccaaaattaagataattagaagacagagtttgggactgtatgaaactgacaaaaacaacatagggtaatagatgatagaactgggttagcaaatggatgaaatgtcaggaaaatagcacttacaccagattttggcccaagtttctaagctctttggatgaatctgaacaccttaaagtaagccagaccttctaacattggcccagtcaacaaaaatataacgagaattttcttggctattctgatgaagtaaacagttgctcttgctaaagttctaagagctgctgctgtcatagataacagcttttgcattagcctggcaataacttgctaatagaatgctctttgggtagttggagtacaaaataattcccataaatcttcatttcctgctttggttggaggatttccatttaatcttttcacagactttagatgctcatttggaagccatcaccaataaactattcccaggattagtctgaatgtatgacccccatatgtcccttgaataatcctggacaccatttgtgaccaactaagctg

SEQ ID NO: 107777 - DNA, 1042 bp, Homo sapiens
gtgtgaaatcactcagtgaactggaatgcaaatatgaggtgtgaggaggctgttggttgacttaccaggctgtgtggcccaaggtctggaatctattctaggcggcctgcaagacacacacccctcccaacccccttccacacagggaaaacttatccctggtaggaagttcccccagcagcaatttcctgctggaggtagaagagcatccagtgctctcacataattcccaggcaaactacagggaagaaggcaaaatagagaagtactgagatgtgaaaacagagtgcgttgggggagaaaagaggctgtgaactcacagtgtatggaaatggttacaatgaaaagagtgaggggtaggtatgagctaggttacatttcatggctccaggttattaaggattattatcttttaattattccaacctcctggtgcctggccaagtaagatttggcaagtttttaatccatttaataataatatacctttaacaattgatgaagaggtacattaaccctctccctatgggaattgtaatttggattttttaaaagccttttatcttgtagttaatggtgcttgctgtttaaatttcttccttgttaactctaaggacagtctgcaaaaatggtcacatcatgatatttacagtccttagtgacaatctattttagtaaacttcaaatcgctaaaattgtacaaatattgttgaactttttagaaatgaaatttagaaaataaattgaggcttcttggtgctttctgcttttctgcgaccataaatatttaattcagcatatttttaaacaatttaatcactttacaaatcatgttgatatttgaagaagccagagcctctgtagtaaaccagaatcagaggtgctctccacttgggaaaaggtgattgtcatcagtattaatgccagtctatgtcaatcccatttggttagattcacaaagctattaacaaaagtcataaaggagcctgggctcagtggctcatgcctgtaatcccagcactttgggaggccaagacgggag

SEQ ID NO: 107778 - DNA, 1212 bp, Homo sapiens
atggggggcggctccgcttcctaggccgcgggacgtcttttcctccaggttccagtcccggaccttcccgggccccccacggcaccgcccacctggccaccgccgcagcccgcccgggccgccgccagccagcagcccctcccggggtggggtttcccttccccctacccctttgtggcagggacccacgggacaccccctctgcctccgctccacgtccagggggccgaaggggcgccggacgagggaccgtgcggagagaggggttcggcggcgccaggactcccgcgggctccccggagcaggggtcggaaggagggggagcgggagccgcgggggccgctgcagcagaagggggaggagaatggggaggagctgggggggcaggcaggcggggaaggagaggtcttaaggggcggcgaggggaggtcgcatttcctccgaggctggcgatcggcggagctcccacctccgcttacagctcgctgccgccgtcctgccccgcgcccccaggagacctggaccagaccacggtgagcgcagggcgcacggcgcggaggccggactcttcgggcggccgggggtgcttgggcggccggagcgagcctgcgggacccgagcaagtttcccaggtcagcgcggggcccggcgccttcagactcgctctcttctctcttccgcagatgtggaaacgctggctcgcgctcgcgctcgcgctggtggcggtcgcctgggtccgcgccgaggtaggcgaggggccgaggagtccgaactcggtccccggggcctcttgggtctgcgcgctgggcgggtgggcgcgcgtcctggggatgctctcccggggtggcgctgggagtttcggtccttggggtgtgctggggtggagctggggcagtaatgctgcttacgaaacttaaatctttaaagcaggaaaagtagttcgggccgtaagcgggagccccgccgcggctaacatggagggagagcggggaggaggagaggggacgggctgggccgacggggacgaggcggcgactggagcagcagcgagttcaaaaaggcgcctcagttccgtccttcacttcagaggagactgagagtagttggggacttttccctcccaagtctgtctcctgggggcgggggcagaggaatcgggattcttcttttggggcaaaattaattttcctttctctcttttaaagtgagatc

SEQ ID NO: 107779 - DNA, 1053 bp, Homo sapiens
tagaattaatgcataccccaaaaggtacccaagaagcttgccattttctcttctagcacaaggcttgagtgccatgctaggcttttgggtttttgctacgatgaggcttaaatccactctctgcttctactctgaaatattcctgagctgttatgttaaccttagaagacacagctacattggaagttaagtccactgactgtaatatacttgatgggcacttagttgttcaattattcagtattgttcaatattcaataaaaacatgggaccaaattttgagaagttagatgaatagctggaatctgatgatgaggatggattgataaaagaacaagtagatggaagaagttggaaggaaagtaggtttgtaggtgaaggcagcaaaaatcagttaattttcagtaaaatagtgtaacttagttgcacttaaatattacacatctacaccagaaagatacattctattcacctcttcattattatttatcacagggattatgatcaagaacagtttgctgataaccaaataccactgttggtaatagggactaaactggaccagattcatgaaacaaagcgccatgaagttttaactaggactgctttcctggctgaggatttcaatccagaagaaattaatttggtatgtattttcactaatgcatgcttgtattattatcgggtaaagacaaaactgaagacatattcaaataatatattctagtgaaagaagctttatacttgaaatcaggctatttggattctagtctaaacgtagtcaagattggaatcaacatatctagactgagagatgtgcacagtcacttcagccttttatgttggtctgttggaatgttccaactttattctatgaataatttaaatcataggcttctttttttgaaacagagtctcgctctgtcgcccagactggagtgcagtggcgcgttctcagctcactgcagcctctacctcctgggttcaagcgattctcatgcttaggccacctgagtagctgggattacaggcatgtaccaccatgtccagcta

SEQ ID NO: 107780 - DNA, 1084 bp, Homo sapiens
acttctttactatttaatgtctcacccactctcttatagtggcatatttcttttgctctaataactaaatctcttacaggtaggaagcttacataactaatcattattcaaagaactagaaaattagacatttgaatagattagtctcagatgatctacaggacactattttgtcagctaaagaatagcaattgtatcaaatcagtactattttagtagattttcattacctaatattacttttagtgagtataagtaatatatgtatgtactggtatctatggcagtactgtgtacagtgaagaaacaacataactttttgaatgaataatttcatatgtacttgaagtagttttgattctcttgattaataaagtggttctacaggtaggaacaggcatggagtaggcactcaggaagtgttgaatgaagtaaagatctgctaaaagtttaatgggatttcgtcagcccttgtaaaataaagagttataaaactgacagagaaaggtttatggctatttataaatatttgtagagaaaattttaaaataattgtctctgagttgttagtcatactagaatgctagattcattaagcaacctaatgcttctgtttactaagcttcatttggccaattgtgaaatgaagaggaattgttaagggattaacattgttttctctgattattttaggtattattttcgtacacgacttaacaaataagaagtcctcccaaaacttgcgtcgttggtcattggaagctctcaacagggatttggtgccaactggagtcttggtgacaaatgggtgagccaatttcacaattggtttgaaagattgtagcaatcacaggaatgtacttccctgaataacactttgtaaaatgtttgatttgcaaagatttttctttcagtgtatagattatcttttccttttaacagtatctttcacaaagcaatagttttcattttgatgaagtctgattactcttcttttcttctatggattgtgcttttgatatcatgtctcagaactctttgcctaatcctagatgatgcaggttttctcttatgttttcctcta

SEQ ID NO: 107781 - DNA, 1033 bp, Homo sapiens
actatccttagtttcctaagaaactgaacataaggatcactctatccaaatgcacagtccatattcttagcgataactttcttcccttaataccctacattcttccctctctaatagcctaggctagtaatccttcagaaggaaataatgaagtgtctttacttctctcccttaagattaagatatattatcatatcaccctgactcctttcatctcagccccaccttgattcttctagcacatgttctacaaagcaataactctcagcccaaatgaaagagaaagaataggggaaaagggtactcaaatgcccttaaaagctcaaaagtcttacctaaagatcctcagtaaagtcttccctgtccatctaatagccaacttaggcctttgtaattcttttactcccccgtccaaaattctcacccatagttttgccatatttatagcctggggaaaaggaaagggagaaaatatatgccagttttttgccctaaaatggagattttattctgcttaccaccagtctttactgtcagattacctgagtgcaaattctgacttaccatgtgcccaaggacaagttactctacttctctgaactttagttttctcttgtgtataaagataataataattcttcataggactgttctgaaaattaaattagataacacatgtaaagcacaatatttagtacattagtactgaataaatattagctgtagtctttaatggtggttctttattcctttttttaaatctgtgccactgatgctgattaaaacccctcattgaggaaggaagagtgggtacaattggatattagggcaagtgtcagatctctattagtttcagacaccagaagagatgcaggtttatctaagctggctggaacaagtcagctatagcttgtacaagccctttagttacacagatggctataaaaactgtagaagccagctaattctacctcttctgcttttctttttcaaattgacacataccacctcttgaagatggaggaatcattgg

SEQ ID NO: 107782 - DNA, 2540 bp, Homo sapiens
tgggagaccgatgcggaaagccgcgaaggcaaaagacccgggctccgcgacccccacccgcgcgacgacgccgccgccaccgcgtcgtcacacggagcaaagtcccctgggaagtgtagtcttcaggccctgggagggacttcagccacgggccgaggagccaggaagttgagggaaggaagctaaggggagggttactgggtaactcaaaagtgtctggagccccagaggtagggtaagccgctcacctgagtctcccaacaccagtaccttcacccgatccagggacgccatcttgccactgccttccctgggttaacgcctgttcctggattgtaagccaatcagagttgggcatggagggcagagccttcaatttcattggccactcggagcgtgactgtcttgatcgaaggtttcactgaactcattggctggtctggtaaaaggtagcggggtgcttccccagctggtcgcaggaatagtgcgttttctttgtcgcgcaaggggcgtggttcatttaagccggtagttgaagcgctgggggcagctgtagtgggagtgttccaggattcgccttggtaaaccttgttccctgttccttgttcggagttccctggccgggcattgcatttcatgatttcttcttcctttcgctccctcttaactatcctcccctaatgaattaccctgttgccttggtcctcttggtcctccaaagaaccattgaccccggagcggcccgtgtgcgacctcgggtagggcgggcttggctgcgccgagtgtggccctggacccaactgggagagtccgagggagtttggggtctcggagtctcgcattggggaggagtgcatatcaccgaacgcgtctcgtggagggcagctgggtccggaggtttcgcggtagtttgccgctgtgtgtgtgaaggcgtggaaagtgccatgaaatgtggtaacacaacaccgcagttagatgtgtagaatcccaagttgttctagaactggagtggcgatttactgaagtaatctaactggtctcttcgcatccacttttcttgtttttttctccactctgcagtcagtacaatcttttaacatcctgaatttgatccacgcacctcccgcttaaaactgttttaaatttaagaagagagtgcccagtagcctgtccgattctaccttggaaacaagagtggaggaagtgaagcagggggaagctggcaagatgagccatgttggaacaaaacgtgcctaggagacatatggaaagttttatggaagtacttgtctggctatgctagatgctggaaattaattggtgaacaagatgaagtctggtcttagagatagacatggagaaagtacaagaagggggaaagagccatggaacacgtgaaaggggatgattgtatgctacttaatggggagtctgggaaggcctccatgaggaaatatcatttgagacttgaaggatgattaggagaagggggtttgggcttagctgtaggggcagaaggaacagcatgtgcaaagccttgggatgcagggaaagcacatgtggctcatggaattgagaatatgctggtgtggctggttatgaggctgacagggtagacagagggcagagggtgccttcttttcaactttgtttctctggctccgtgcctggtgcacagtagtccttaaatgttgatatgattaaaatacacgtgggtctgggctggggtagggaggtgaggctgggatctgactcatggactatggagatcaaaggaagaaacaaaggtcctaggaggtcccacgctcagaagtctccagagaccagccatactccttccctaataacgccagctgctattcggcttcagcttattgtttccatgtgggaacatgggctcactttttcctcagatatttccaattttgcaagaggagctggaagttgaaatttatgtgaactcttacaatttttaaatgttgacaactaattcagaaaatttttgaaacattctttgggtgatacaatgcgtggggggctgccagtttgagaactcttacctaagacctctagagattgagtaaggagattcagcgtgagtgggaagtgatggaggagagaaggtagtggtcaggaaggaggattttagaatgcagagattttgaacaaagtggcacagcttgatttcattcctgagctctagtttcatttgttcagctacctgctgggcatattcagaggaatatcctatggtatttcctcaaagacacttctaaaagtgatttcctcatttcttcctgctcctcgtcaggggtcacctatttctcatggcagtacttttcctagctacgctggctcaaaacagagagctatttaagatttttcctactctcatattctgtatccaatatattttgttgggtccttttgatttttttttctgtaataactttcattcattctgttctcttcttgcaatttttttgccttcttagtttagattttatacccccaatattccacactgcctccaccttcac

SEQ ID NO: 107783 - DNA, 1031 bp, Homo sapiens
ggatttattatgaatgccagtacttaattgaactcttatgccagccctgaaagcagaacactttgcattaattatctcactgagttcatacattaactgtgtgagcagggcaccattaatcactttttttttttttgagggtcctgtcctgtcaccgaggctggtgtgcagtggctcaatcatggctcattgcagccttgacctcctggctcaattgatccacctcagctggtactacaggtgcatggcaccatacctggctaagttttaaaatttttgtagagatggggtcttactatgtttcctaggcttgtcttcaacttctgggctctgacagtcccccaaccttggcctcccaaagtgttgcaattacaggtattagccactgtagccactgcacttggcttaatcactttttatatatgaagaaactgagtctgagaattttctgaggtcagggggcctaagaaatactggaactgagatttaaaccccaaaactgttggattgtaaagtcctcatatcactcccttattttagtcttcacagctccctagggtgttttaggcaaaggaaacaggctgagcaataagtggcacagggacctctccatgcaggatgagcattggcaggatatataatagggacttttgctgcatagtagagtcacctaaagagctttaaaaatttgtgtgatgcctaatctggctgccccagaccacctgagacaaaacctttaggagtggggcccaggatcagtattcttaaaacgttccctagatgattctgccttacaaccaggcttgagaactattagtctggggcatggcatgtatggggcagggaaggagaatacaatagtaggaaataatcctggaaacaggttatgttgacatttttctgctgttctttgttgaatgtttctgaagccatatgttgtgttctgacaactgttgaggatgtaaaacaacaaaaaatgaaaacggggttcaagtacaatgtatagaccaaaccgaaaaggagagaaaagt

SEQ ID NO: 107784 - DNA, 1705 bp, Homo sapiens
ttgtgtttctcttctgaagtaaagtagacttgacgtaatatattgttttataaataaaaagttactttttaatcaaacacactatagatcataaaagtagccatttaagaaatatgtaaagctttttgggtgtaatcttttgtgcattctagaggaaaatcttgttctgctctgttaaatgcttaggtattagaaatctttttaaacactttgggtacttttctggcactgcaaggatagtggatatgattaccatgttcttatacctggctaattttctgtttttttttgaattcagtatatttaaagttggagttcgttgctaaagatggcagacccagatgtcctcactgaagttccagcagcattgaagcggttagccaagtatgtgatccggggattttatggcattgagcatgccttggccttggacatcttgatcaggaactcctgtgtgaaagaggaggatatgctggagctgctcaagtttgatcggaagcaacttcgatcagttttgaataatttaaagggagacaagtttatcaaatgcagaatgagggtagagactgctgcagacgggaaaaccactcgccataactactacttcatcaattatcgtactcttgttaatgtggtaaaatataaactggaccacatgagaagaagaattgagaccgatgagagagattcgaccaaccgggcttccttcaaatgtcctgtctgtagtagtactttcacagacttagaagctaatcagctctttgatcctatgacaggtgaggtttatccagtttgtgaatctttaaaataaagtgtgtattaccttttttcttaaattgattcatctaatttttaaaccatcatatatattattataaaagtgaatggatcagtgtaaatcacagcatacagtcagtcttactgtcctgtttggctgtcgcactactttgagaagcctttgcaaagcgtttctcctttacaagggagtttctcacttatggccctcctgcctctgcccaccccaccttgtttacaactgcagcctaatctgaagggttgatttctctaccactttgaggctgttctaattttatttttgacctctagacagttgcaatacagtgtatttaaatgctttgttagtggaagtagaaagtggtatcaggagtatataactagggcatataatctggatttggggaaggcctctggaagaagttaacatttgagacctaaaagatagtaagagttagctagatgaaataagaggggaattctttccaagataagacatttagtgtcctttagatacacattattgttggaagaaaattgtcaacaagatatataattggcctgatttgattgaatagttttaaggatttttcataacacaatttagaaagcatgcattatctgaaaatacaatatgtctagcataaacatgagaaactttaaagttctgagttatatagttattttatcttgttatctgtttacacaataaaaaagagactagttttgctaaatactcgatcaattttgtcttattttctacaggtaaaaatctatagaaggactcagtgctattaaattagattaagtccctttgttatggttgaattcaggagtataggctactttttagttcatagatctgcttttttaaaaacttcgtctgaaagtttaaactttgacccatgaa

SEQ ID NO: 107785 - DNA, 1029 bp, Homo sapiens
tcataagattgtccaggaaagttatgcatgccattatctcttgcttagattttgcaaagctctcttaggtagtttccttgctttcactcttggttcccgtgtagactatttgtcatagcaactagtgatccttctagcatatcagagcatgccactcttctgttaaaaatcctccagaggcttcttctttccctcagaaaagtcaaagtcctcaacagaatttataaagtcttctatttgcttcctccccaatttccccttttggagactatttctatcattattcccatgttcacagcagccaccttatttgtgctttgtgtgcaccaggcatgcctttactttatttgcctttttgcatgctattttcccttgtccaaacatttgcatgacttgctcccatctttaagtctctgcttttacattgttatatgagagaggcctaccctgagtttcctatataatagagcaacacccctttcccttcaccttcttccttccctgctttttttcccctgtaatacttatatactatggatgtgatttttttgtgtcttgactacccccaactagaatgtgagggccatgaaagtagctcagaagatgattggctggacttgggaaggctgaatgtcagaagccctggggatatcaaacccactgttctggggtgagagctctgcagcagcagacatttgatcttccctgtttccttggccagccttgaggacatgggctgcaataggagtcccacttgagcacttaagcaccctgtgccatatcaaagcatttgagcttattttgattttttaaaagtttgtgggaaaaatgactgaataatatttcagttgcaactgatacctttgacaaatatttgtcagtgaattgtgggcattagctgatggcttattcattttatatactggactgaagagagaaaaatataatgctaagtaatgactaattgaggatttgactaataatgtcttctgccctagtgtcacgtatctgtgtcctttttgtcagtta

SEQ ID NO: 107786 - DNA, 1050 bp, Homo sapiens
gacaatgttcaggatgactagaaactcttggttttaggtatttatttggctttccccataacgtaggcccaaatgtgtaatgtgaaaacaaaaaagactaaagctgccaggaaagggtacaagttgtggtggtaagctgtaaagaatttggctttaagttaaaataaatacatattagaaatattgtgattaaaaactatgctgaagttagggatgaaattactttgaatacatcaaaaatgatagatggatagatatgtgatgaatagcaaaatgctaattgtagaatctaaatggtggtcacatggctgttcactgtgaaattctttcaacctttgtgtatatttgaaagttttaataataagatattgggggagggtggaggtataaactatctgctaaagtcttctctctgacctgagatacttgttttctctgtaggaactttccgctgtactttttgccatacagaggtagaagaggatgaatcagcaatgcccaaaaaagatgcacgcacacttttggcaaggtttaatgaacaaattgagcccatttatgcattgcttcgggagacagaggatgtgaacttggcctatgaaatacttgagccagaacccacagaaatcccagccctgaaacagaggtgagtgtaggccctgtgctcttactaagaacacatttcaacctgttcttgttttaactacctgtaccttggagaacaagagtgggtaatttactaggagactcaagactgtaatgttacgtaggttctcagttgtgccacatttgtctgattaacgtgtgcctgtgatgaaattcgtttgttctaaatgcagaacactgtggacttcaggcaaaaatctttaaatatttaggtttgacttcaagtactcattctgcttgggactgcagcaactcagccaattgttagctaatcctaaattagttgtgccgcttggggatatttgaattttcctagccagcttctgaaggctgaaggcctttaaggaattcagcattttcttttttgtttttgaagcattttaatca

SEQ ID NO: 107787 - DNA, 1042 bp, Homo sapiens
aattttaaaatttgtttgacttatggtcaaatgtctgctgcctcaaactagaataaaacccatcttgaatttctatgacagaatactaaaaacaaaagactttttaaaagtactcttgtgttaacatttattttaattctgttcttttctctctagctttcttgtttttctcaaagtactcctcataccttcataagacagtctttgtagtcaatgctaaagatagagaatagagaaaaactctgtgttcaggattatatataaagagaagcagtaacctcagagtgagtgagtcatttaagtctgaatcaaggaaagataaggatgtggttggccagatcagagaaatatgcctattctgtctctcccaggtgggtttagctaactcagggagaaacattttggggtggcagatatatagagcaggctcagcacatcaagatggggatgttggctgaggatagaagaggcattgaaaggagtcagagagacaaatgggtgtgagaggagaggccagaatgtagaataagcacagaaacataaaaaaccagatcagaccaagagaaaagagaaagtaaagtgaatgctgaagaagagaaaagttcgaaaagccaacctatacaaagtaagcagcatcatattacagtgaaggcagccacatagcctttaaaagaccacacagaacagatagaagatagagaatgactagggacagttaatggttaaattgagatgaacaagaaatgatacacaaagtaacatcaatgaatgcagaaagaaatagcagagagaaaccagttatgtgcaattgtagcataagacttcagaatatagcaaaaaaaaaaaaaaaatagatggattggatatatttacagagagatgcctcataggtctagacttagagtggagagcaaataactggtagaaagtaggagcagtgaggaggcaaaagaagtgattgagacatggaacaggtagaacaggcaccgggaagaaaaaggctgtgggagaaagtggtttacaaagtagccctgggcacaga

SEQ ID NO: 107788 - DNA, 2575 bp, Homo sapiens
gttagagaactgcaagattttactttctaagttttagtctaagttactgcattcaagactttgagtgatgatggtttaggagtatgtagaaaatgggaggcaaaaatggatgacgatgactcaagctggaaagtagagaggaagggtgtctctatttcttgctgaattttatcagtgtaacaatcaatgtgccgctactcccaagttaatatatcattactaacatatcacgtgagtttggtgatatgttagtgccaaagaataatcagtagctgaaaaccacttgttttttggcgtttctcctagcctcttttcccttcataattagcatttagtatatgtatatactagaaattgtgaaggtaacgtggagtttggtagtgatggtaaagcagctaatacctctactgtgattctctttgatatattaattttaataagaaaaggttttccaaggcaaccatactttaccctccttcttcctcactgattagcctgccatgttagtttttttgacggagtctcgctctgttgcctaggttggagtacagtggtgcgatcttggctcactgaaacctctgctttccgtgttcaagtgattctcttgcctcagcctcctgagtagctggaattgggcgcaagccaccatggccagctaatttttgtatttttagtagagacggggttttgccatgttgtccaggctggtctcaaactcctgacctcaagtgatctgcctgcctcggcctcccaaagtgctgggattacaggcatgagccactgtgcccagcctgttgtgttatttagattgaagttgttttagattatacagtagttaggctatactactacttaataaatttgttttccccaacttggcttcttgcctgttcttaaagcagccttcttttctttgaacttaggaagaaaactgaataaaataaaattattattaaccaacattatatattaagctcataagtttaacattctagtttacagttcctaaaatgatagaatatgaatcatatgggccttaaataagttatctggtctacttaagttttgtaaatatttatttctgcataaaataggatagtatgttgtcatgtctgaatttatcctaagtttcttgatagtagagcagactctatccagtgaatgtatgaagtgggtcttaacacttgattttcctcaaacttcaagtcatgttgatatctttcacaattgtatcgacttcaatcatgttctcattactatactgaagaaagttctaattccttttgattctgttttccttaaacagttctcttttccactgctgccacctcctacagtttttgtttatttttgtctttttctggaccatctctaattgtaatatactttacttgagacatagtgaccagaatgatacatgttgttcatgcatggattcaccattgatttgagttttatttccagtatctttctggtttttacttgagattttgtttgttgctttggttctggaagcatgttaagaccaaaaacttctagaaacacgtagaggtactttttaggttcttctgtgccttgaatccaatagcttggatcatatctttcagtatattttagattatttttctgcaggctgattttcttgcacttgctgaaatagaaatagatctgctacttttctgcccacgtatacaaccttcagctcttcctatatttttttgctgcaacttggcctttcagtacccacaattgcttagcatcaattccgtgaatatagtttcccagtatacatcttctttgtaatttataactctgttgaaaaaggctgttcctagaaccactgtttctactttaccatccagaaatttgctcatttatccttgttttttgttttctgtcttcatctgtaacagaataattcttttttctccaaacctctcaagacccttgtcagaaatctgttacgtgtgacttaatttagtttacaaaactaattttctttttccctaatttaatacttaaacattaatcaaaatactgtgttgatattattaaactatttggaacattcttttagaagcaattattgtcttaaaggcttgcatgcattccttaccttcttttctttctgttgtagtgctgcattggcagtaagctctaaggaggaggttcagcctttgacaatattttgaagtagttaagtttgattttaactctcattttgacagtcatgttatcaaaagcctcttttctctgacctaaacttttaacttgtctgcttctgtttccctttctctctcttatctgctcagtatctcattttaggagttctgtgccttctaaaatgtccagggatttagctaattcattttaatgtgttaatgagaagatgctttcactttatccatagtcagaattgaccatttctgagtcttctcttgatgacgatgatgatagataacactattctaagtgccaggcccattctagacacttcacagacattcacttaatccccacagtaatctagtgaagtaaatactattttccccctttctgtacttgagaaaattga

SEQ ID NO: 107789 - DNA, 1561 bp, Homo sapiens
tgcttcatgaaaataaaactcacatttattcactcatttgtcagatgtttattcagtgcctaacagagtggcaggtactatttaggtaaatgggatatatccatgaataaacaagataaatatctgttgtggtagaacctacatccttggaaagggggtgacaaagacaatagatgtaagttattcattatgttaggaaataagtgctatgggggaaaaatagagcattgggaatgtagggataggatacatttaaaaggtaacatttgaataaagacatgaaagatggaagggagttagctgtgtgagtacctaaaggaaaaatattccaggcagagggaacaggtaatgcaaaggccctgaggtaggagtgtgtctgatatgtacaaggaataccatggaggctactgtggctagacaagaatgagcaggggaaagaagtaagaggtagatgatcaggaaggattccagatgatgtgggaccctataggccattgcaaagcttttggcttttaccttgagtgagataaagagccatgttttgattttctgttatgccagctactctagtcgattcttcatagacattatcttatatgtttttattcagaaccttagaaagtagatgcttttatcacctcattttacagaaaaaggtattgaagtttagagattaaataacttgcccaagatgcttgtgtgtagaagaaccaggattcaaatctatgctataatactcttaaagccaatgtacttgaccattatgctacttaagctccagtttgtaagaaatattttgaatattttatggatagcagctcaaaaatggaaccagtgaagtctgttattttatcgtattatttaaatatatgttaaaatattgtctatatgctataaagaaatgccatttatatttaaggatattgactttctgagttttactccccagggggcatagatatggacgcatttcaggagcgtgaggaaggccatgctgggcctgatgacaacgaagaggtcatgcgagcactgctcattcacgagaaaaagacttcctctgccatggctggttcagtgggggcagctgctccagtgaccgctgccaatggcagtgactcagaaagcgagaccagtgagtcagatgatgattctccaccccgtccggcagctgtggctgtgcataaacgagaagaggatgaagaggaagatgacgagtttgaagaagtagcagatgaccccattgtcatggtggctggccgtccgttctcctacagtgaagtgagccaacggccagagctagtggcccagatgacaccagaagaaaaggaagcatatatagcaatgggacaacgcatgtttgaggacctctttgagtgagctttccctaattctttctcctttctctaatgctcagttcaaaaaggaatgtctcatctttgaagaaaagtatttaagtggctttctgcccctcttgatgtaagcaactgtccatccttgtgcaaagattgatggtagagagtttgacttttatgccagaaactttcccagcaaggtagggtgc

SEQ ID NO: 107790 - DNA, 1048 bp, Homo sapiens
atgctaggatttttgggtgagtagaccctcagttaagtaaaatgaaaaaatccagagtttatcattttctcggataaacgtctctaaatttatactcaaaatcaatgggaagatataatttaataggtaactacctccctttcagtgacatctaataagactcaatagaatttatattactttatcagataggtttgtctcttgagtggcacaataatctggtgaggagagacagtcagtgacagaaggaccaaaaatgggagccctgccgattagcctctgaagctctagtaagggcaggctcacacccaaggttggtagatacatgtagtcactgtgtttcttgaccccaggaaaactagagtcaccaccacacacagcccataagtgatgatggaggaacttggtttccctgaatgcggttgactatattcgtgtatctcaagtgtcagctgaacaagtgtcccaactttcccactgtcctttaagatttaaatagaactttttatcctaacatgttggactacttcttctagtatcatttcttttgggagatgacagttcttttttgcaggtggtaggggaccggggagagtaggcagggagcttgtatcctctggcttcgcctttctgcttccctggttttccatctgtcctctacaccacctgtcctttactccccctagtaccatcaacacaagtttgtgtagcagatcttccctgaagtttttacagtagtgagcaaagggagcggggcaatgagggggatttttgtttctatgttcctcttatttttagttgacacaataattgtacatatttgtgggatgcagagtgattctttatctcttccaacttttaggctcaggggtatatgacgtgcaggttttctgtataggtaaattgcgtgtcatggagtttagtgtacagattattttgccacccaggtaataagcattgtatcagataggtagtttttcagtcctcaccctcctcccaccttccaccctcaagaaggccctctttgtgtccatgtgtactcagtgtt

SEQ ID NO: 107791 - DNA, 1034 bp, Homo sapiens
ttggctctttctgctacaaaagaagcaaactaaacagtgaacaagataagtacaggtacttttaaaacatctaatgcaaaaatgggttgggaaggggaaagagttatgaaattttacttcttcctttgaagagctaaaggaatgaacctattttggcatgtcctcagggcaggaacaagtaccttagcttctcctcagaaagagcttcatgaccttctgagtatcagaggtggcctttcctattctagttgcaaagcaggtaggcctagtacacaatccagtttcaacagtcaaccagtcaacccacgtttcccataatgcagaagtgcataatggcctacctaatgtaaataagtctgagcaattagtctggaaagaaggctggtgccaggtctgaaaatgccttgaatcattggggcatacaggatggttgtacagttttttgttaatgttttaattatttaaaaattcattcaataggaaatatatatggtaaaaaatgaaaactccccagcccaccactatcttactacactgaggtaatcattgttgatagtttaatgtgtatcctcccagaccttttctaggcctttagaaaccacacatacatactacagtgctttttacacaaatggaatcatatcatacacattgccatttggttttgaaatatcttggagagctttccattcagtatgtttagatcttcattttaaaaaacaaaatagaattttatagttgtataatggtttacgtaaaaattcctttattgacgggcatttagatagtgtccagtttttcactattacatgctataatcaattactcattttcattctcttcgagtatttctacagaatagaatcataaaaaagaaatagccaaacaaagggcatgtctattttaaactctgatatatactgctaaactgctcttcaaaaagattgctggatgattttaagcagaggagtaatttgtagtattgatactggattggagtttaaacctagagattattaaggccatttcaatag

SEQ ID NO: 107792 - DNA, 1022 bp, Homo sapiens
taaaattaggatttaattatataaaaaaagaaagttattacttctccattaagtaaatctggaacctaaagattgaagattctgtgtgttgccagaatcacaactcgattagaaaggttaagaggtaaaaagaatgaaatggaataggccctctctatttctatggctaacctttgggaaaaaaattttatagtaacagaagcttcttcattagccacctatggatagattttaggctgagtctaattcacagtgattacccctctctaagaaccatgggggaactagtcactcagcttgatagagattgttaggaaagggggaaaataaatctggaaatcttggataaaaatcactagagaagatgttagagaatgtcctacaaataaataccacatataaatattctttaagcgtttggtagaaagttggccaagatgacccctagcaggtgcacaaactaaattggggtgggaatgggagtgaggacaggtaaaatttggaagcagcaagagcttcccaggcaaagtcaggaccttttggggaatgcaactggaaacaggggcagtgtaagaggaaaagagctcagcactacgagtccagagtgtcaagcccaaagagtccaaaagctgaggttctggctttgccaagataccaacatggaaggtaggagtgcatagagatgactggggaatcccaggtaaccaaaagattcaggctcagaggagccattagggcttcaagggaagctttccttgtacacatttcaggattatttggcccctatattaacaagtactttttagcttcaagtaaaaaacaatctaataaaaagcgtggcttaagtaaaatggaaatgcgcctttctctcaagcaatgtaaagtcgagcagttgttagtccagagctcgtatagaagcaccacaatgtcagagaatcccacccttattcttttagatgccaacatccttagcatctagttttcatcttcagtattgcttcatggtcacagttaattgctgc

SEQ ID NO: 107793 - DNA, 1049 bp, Homo sapiens
ggcggaggtgggcagatcgcttgagctcagatgtttgagaccagcctgggccacattacgaaacctcatctctacaaaaaatataaaaattatcctggcatcgtgacgcggtgcctgtagtcccacctaggcaggaggctgaggtgggaggatctcctgagcctggggagatccaggctgcagtgaaccatgatagcaccactgcactcccacctgggtgacagagtgagcgagatcctgtctcaaaaacaaaaaaacccaaagagttagagtatttcatttctaaagtctcttttatttctaactttttgagtctagaaaaagtgaatgaaagttcgcatgcctgatttgacgatatgatattaatgttaagaatcatcgtggggttttggtgtattttgccatatttaagccagtgaatgaagtgaaggatagactttggttctaattaattatttctgtattttctttgtagggattaatcaattcatgacagagacagtgaagaattgtaaaagagacggatttgttcagaccattttgggaaggcgtagatatttgccaggaatcaaagacaacaacccttatcgtaaagctcacgtatgttgaaattttttaggaattttaacttaacatttcaatgacatgtactttttcagcagagtaaatactacaaatatccgttttagggattactggcatattaattggattttctgtatagacaacgtcaaccattggtttcattaaggacttctgaagtgatggcacatgccagtatttgctgaacagagtctgggggattaatgtaaacatgtgtttacttaataatactttaaacatgttctgttgcagtaaaccaattatttattagcttaggtactaagttgtaaataaacttaatttttacatttgctaattattctttgtttcctataccatatactaatttatcatatcataccaaattgctaacattcctcagagattagccagtcactaaattttgattaatttttggttcattctacttgtttgcttattttaaa

SEQ ID NO: 107794 - DNA, 1034 bp, Homo sapiens
ttaaggttcttttgtttttattatgtctgaacttcttatttatagtttgtcttttcctccacaagtaacaactcttcttatgaaagggcaatgagtcttttgtgagatcagttgcaaatatttttctaatttttctttgaccctgcttttatttttttaactttgtttttgttttgtcatgcatatctaatccacccatttctaatctataggtaaattattttaatcgttttaataacttgctcacctgttgaccacttgatttttttcactgaatgactttgttattgtcaaatcagggcacacatttctctccagcccacttaacatttgcacacattggacaccagttttttcattaattaattcattcaacaagcatttgttaagggcctattatctatcagcaactgtgcaagcttttctgtagaatgaaaaggaaaattaagcttcctattcttaagtactcagagcaaaataagagaggcatgaaagcaccattttggattatgtgccaggtgctgtaggaacactgaggaacacactccacggtgggcagatgtcagggtggctttacccatattatatatacttgaaagctacatggaaaaaaatgacctaagatacagagctgaattccatcatattaagaggaaggttttaacttttgacatgtgatttcaaagttctaagttagaacaaaatttttgtcatcctgctcaattatatgatatagaacttggattgtgtgatatagaaactttgtactagcttttctgaaatcacttctacttcaggtggttcaatactggctgctgactactctcagcttgaactgaggatcttggctcatttatcccatgatcgtcgtctcattcaagtgttaaacactggagctgatgttttcaggagcattgcagcagagtggaagatgattgagccagagtctgttggggatgatctgaggcagcaggcaaaacaggtgattttagtgaacatggttaatataaaggagaagaatttagtgactcaaa

SEQ ID NO: 107795 - DNA, 1486 bp, Homo sapiens
cgcctcacttcttttgatgatgaaagaactaaatatacctaaaacctcacaggcccatctttattacagtagcttagcccaaattagccttagtggaggagtccatcttcattttcagacacatggtttgagtttgctgagacacacttgtttttcaagcctactgctaaactggatcggcctgagcattgtaggaatggaatagttacaactttcctttctttgaaagctactgctgttgttgctaccaaaaatgagtcctgttacaattattctttccttctttcctgggaagaccactgaataaatattaaatgaaaatgagtgaggttagaaatgagctttgtttttttcccttttcatttagaggtacataagtgtctttgaaaaaaatcaggaaaatattctcattgctatcccattcaggtggcatgctggttactagatccagattctcaggagccgactcttcatagcatagttaccagttttcttcctcatgagcttccactcctagaagggatggagaccagccaagggattcaaagcctggggctaaatgctggcagtgagcattctgggcgatacagagcatctgtggagtccattctcatcttcaactctatgaatcagctcaactctttgttgcagaaggaaaaccttcaaggtaaaaaccaagtttctggcatttttatgttatagattagagatagagatttagccactctttatcaaaaatgggtaaattacacatttatgcaaatcctacctttggattgtctagtgctttttttctgtaaaaggccagagagtaaatatttttggctttgtaaactaaacaatctctatcacaaatactcaactctgccattgtagcaaaagagcagctgtagacaagaccaaaacaaatggctgtcttccaataacactttacaaaaacatgcatctaatgttagtttggccataatttgctgacttctggcccttgtgtgaagaagagaattacaaaatcgcatttatgcagttgttggtaattttgtatttgaactttatcaaaggatttttattcacccttagaagacatccttaatggatttcaaaaagttaactcttttctttttggaactattaacaaacagatgttttttcacagcaagggataatcatgagagtctcttttttccctcatgacaaataacatgaatttattgtcattgttatctgctggcccagatcaagcaccctgactacagagagcttaacggatgcttatggtagagatgtgaagtagaacaaatttggcttcattgtgaggagtgaccgaatttattgactaatcaataggtactagaaaatagatggatgaattcatacagactagggtttggatctgggttatccacttatgagctgagggactttgggcaaactactgaaactgtaagtctggttcttataaagttgttctaaggattaaataagatag

SEQ ID NO: 107796 - DNA, 1053 bp, Homo sapiens
agggctcagtaccatgttacagaggattggtaactagctgaatgtcttggcctctattccttagcaacctgctgactatcctcctttctgttttccttttctttttcctgttgcaagaagaaacagaaacaaagttctctgtggtctcccctttctcattaaggtactgattgccgggcgcggtggctcatgcctgtaatcccagcactttgggaggccgagtcgggtggatcacgaggtcaggagttcaagaccagcctggccaagatggtgaaaccccatctctactgaaaatacaaaaaattagccaggtgtggcggtgggcgcttataatcccagctactggggaggctgaggcagagaattgcttgaacccgggaggcagaggttgcagtgagctgagatcgcaccactgcactctagcctgggtgacagagcgagactctgtctcaaaaaaaaaaaaaggtactgattaatccatattgttgaggagaaggacggaagatggagagggatttctgaactcctgtctgactgttataaaaatgatctaaggaaccactggtctgccttaatgtattaaaccctaagcaaacgagaaattctgggtctgattttactaaggaatccttacaagcccttaagaaggaaactatgggctacaagagggtgtgttatatgtataataggtttcatcgtgaagatatgtgcttatgagggagtactgcggggaagatgagaagagatagtggtaggaagggaggcactcactcttttttttttttttttttttttttgagacagagtcttgctctgtctcccaggctggagtgcagtggcgccatctcggctcactgaaagctctgcctcccaggttaatgccattctgctgcctcagcctcccgagtagctgggactacaggtgcccggcaccacgcccggctaatttttttttttgtatttttagtggagatggggttccactgtgttagccaggatggtctcgatctcctgacctcgtggaccacccgcctcggcctcctaaagtactgg

SEQ ID NO: 107797 - DNA, 1050 bp, Homo sapiens
gctctgttgcccaggctggagtgatgtggcacagtcatagcttactgcagcctcaaactcctgggctcaagcgatcctcctgccttggcctcctacagcattgggattacaggcatgaaccaccacagtcagccattttatttattttattttatttcatttttttagagacagagtctcacctggtcagttgagctagagtgcagtggcacagtcatagctcactgtggcctcaaacttttgggttcaagcaatctttccatctcagccttctgagtagctaggactacaggcacataccatcatgcctggcttttgtctttaatatgaaggttgtatataatggttttttgtaatataatagttttagttaatgaataatacttcttccttttaggttacacctatgtttgaggattggactactattgattggtatcgatttttctgtttatgggagaagttgccaacttcaatgaaaagggtggcagagctagtgggagttgaagaggggttcttggcccgttgtgtgaaaggaaaagtagtagccagaactgagagacagcatcgacaaatggccatccataaaaggtaaacgtcaaggtctctgggctctccggtatttaacacagtgtcttgcatgtagtagacgcccagtttattgtagtcactttcattgtcaataaaatcaaaattttggcagagtataagatttttcagttttcttttttttcattttctttttttttttaattttgaaatggagttttgttcttgttgcccaggctggagtgcaatagcgcgatctcagctcaccgcaacctccgcctcccaggttcaagcgattctgctgcctcagcctcctgagtagctgggattacaggcatgtgccaccatgcctggctcattttatatttttaatagagatggggtttctccatgttggtcaggctggtcttaaactcctgacctcaggtgatccacccgcctccgcctcccaaagtgctgggattacaggcgtgagccaccacacccaacaagttttctgta

SEQ ID NO: 107798 - DNA, 1065 bp, Homo sapiens
ttattggaacacagtcatgcccatttgttctgttgctgctttcatgtcacagtggcagggtgggatagttgcagcggagacctgctgttttccacaggaacaggaaaagtttgtggacccctggtctagaaaataaggtagaggtatactagaggcagcagattctactctttttttgttattgttgttgttgttttctcgctctgttgcccaggctggagtgcagtgatgtgatctcagctcactgcaaactctgcctcccaggttcaagtgattctcctgcctcagcctcctgattagctgggattacaggcacccaccaccatgcacagctaatttttatatttttagtagaggcagggtttcaccatgttggccaggctggtctcgaactcctgacctcaagcgatccacctgcctcagcctcccacactgctgggattacagacatgagccaccgcgcccggccagattatgctgttaaagagatagactgtgatgactcctttgtcaacagtcataacaatagtttcaaaaatcttcagaggcttgaagcagactctcaaatccatttgtaagtgaacacgtataatattttcgttatatatcaataaatatataaaaacctcctttttttaggtcttacttttgaggagagggatatcattgaaggagcctttcgtcaaggtctcattcgggtcttggcggcaacttctactctttcttctggggtgaatttacctgcacgtcgtgtgattattcgaacccctatttttggtggtcgacctctagatattcttacttataagcagatggttggccgtgctggcaggaaaggagtggacacagtaggtaagtgagtttgaatttaattgtagcagcattgctgaaggacagtgtctacttgaaatttgactagtgtctggcaacctgtttctcatcatgctgtatttctttattatccaatgcactagtgtcatcattttggattcacttaatatttatagtgagtatgagttataattttctttttttttttttttttttgagacggagtctcgctct

SEQ ID NO: 107799 - DNA, 1067 bp, Homo sapiens
cactttggcctcccaaagttctgggattacgggtgtcagccaccgtgcccagccatatatttactgtttatgaaaagttttacaagttcaaaaatccaaaagtctggaaaatttttaaagacaacatataagtatgtaaagcttttactgcatataagaaagttaaggctgggtggtggctcatgcctgtaatctcagcactttgggaggccaaggtgggaggattgcttaagcccaggaatttgaaaccagcctgggcaacctagggagaccctatctctacaagtgaaaaaaaaaaatgctagctgggcatagtggctcgtgtgtctggtcctaactaaccaggagactgaggtaggaggattgcttgagcccaggaggtcaaggctgccatgagcagggattgtgccactgtactccagcctgggtgacagagtgagaccctgtctcaaaaaaacgttaagctcttactgggggagaagacaaaaaacagagggtactatttaattagctaccagattaatgccaaagaggcaagaataatttcacagaggagtaggctttttcgtgacgggattggtgaaaccctctgatactgctactgctggttggtggtacacaccttgagcaagggttttgattttggggctttgagtggtaatcagtatccgtaatactctgcttcctcagcaggttcctttgatcccctcctgtgggcttcgtcttacccttacacagtttcctaaactttggcgcacattggaattgcctggggagatttaaaaattcttcatgtccaggtcacatcccacaccaattatataacaatgtccaggattaagaaccaggcatcagtattcttaaaagatctccagccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcaggcgcctgtagtcccagctactcgggaggctgaggcaggagaa

SEQ ID NO: 107800 - DNA, 1042 bp, Homo sapiens
gaggcaggagaattgcttgaacatgggaggcagaggctgcagtgagccgagatcatgccactgcactccagcctgggcaacagagtaagactccatcccccaccaaaaaaaatattagcggtgatggtgagagaggaaatgtagttgtacctttaatttaaataaatagttgtttcctgatatataatataaacatttaaaaaaaataactgatcttgtagcgttttctttttactgggaaaagattttcttatggtttagtttacactaactgctagtgtgcaagattaacttttttgttaaatggtaggtataatatatagtagagtgaaaatattatttttgtagtctgatagatctacctctgatacttaatagagatacttgatatggctgagatagtagttgaatcacaaaacctatctgaacctcatatcttcacctgttaaataggatattataatccctatcttgaatattgtaagaattaaatatgatttttaaaaattatctggcatctagaaagttacttgataaataagtaccctcccatactcccaaatacactttaatcctgaggttaaagaactgactcatgtacattggtggagtgaggcatctgctgtttttgtgcagagttgtgcctctgagtactaaaacagctaagggtcattttagaattggaaatagaattggaaattcatgtgtttcactaactacctaggtatgcatttgtagtttctgcatacttggtatggaatcttgcttgctttgctctgtgccccatatttcgcctggctatgccttggttacttcaatacatttatgtgtgaacacattcatttgctctcctgttaatttttttcttcttttaccatgtctgtgcctccacccttttgaaccacttatatttcttacctggattattgaaatatttcctaattgttctctctgcttctgaccttgtccctttcagtctgtgcttacaggagctagtgatctatttaaaatgaacatcagatcatgttacccttcttctcag

SEQ ID NO: 107801 - DNA, 1035 bp, Homo sapiens
cagtgagtgggcaacagagcaagactccgtctcaaaaaaaaaaaaaaaaaagggtatccacatggttcatacacatgaagtgatgctcagtagtctcattggttatcagggaactgtaaattacttcttcaaagaaatactggctgggcacagtggctcacacctgtaatcccagcacttcgggaggccgaggtgggtaaatcacaaggtcgggagttcgagaccagcctggccaacacagtgaaaccctgtctctgctaaacatacaaaaattagccaggtgtggtggtacacacctatagtcccagctacttgggaggctaaggcaggagaatcacttgaacctgggaggcggaggttgcagtgagccgagacaggtccattgcactccagcctgggtgacagagcaagaccctgtctaaaaaaaaagaaatactaccacgtactgtctataactgccaacattaaaaagattgacaataccaagtggtgacaagattatggaacaatagaaaacacagattgtggaggtgttactttggaaaacaatgtgggattatctactaaaattgaagatcttctgtgactcagtaatctgtggctcagtaattttattcttaggtatatatcctaaagaaatgtatgcatgtgtgtaccaaagggcataaccaagaatattgttagcaacactaattattaatgtattatatatcttttaatgttcttttcatttgtttttttacagtcaggcagatctagccagttctctgtctaatgctgtgcaaatcgttggcatgagtgctacccttcctaatttggagcttgtggcttcctggttgaatgctgaactctaccataccgactttcgccctgtaccgcttttggagtcagtaaaagttggaaattccatatatgactcttcaatgaaacttgtgagggaatttgagcccatgctacaagtgaaggtaaatcaatatatgtacatcactactatttttatctgtgtgtttgatttcattttctagcaaattgcta

SEQ ID NO: 107802 - DNA, 1110 bp, Homo sapiens
aagtagacggttatatgggcagcacctctccatcaaggcatttctcttcattggatattgcagtctgcacaattgagagagccaatggtctgatcaatcgcctcatagaggaaaataagatggatctgttaggtaagaaagttagaaaataagtaaatactttctattgctatttttgatggaatgaagtggagctgttgtgatttctctaggtcccatttgttttcctattgtctattatctacttctggaggcaaggattggcatctgtaatgttaggaacgctgtgtttataagttttgtgtcctgctgctgttattgactccgttacgttgcatttttgtactttacaaaacgtagattatatccttgagccctcaataatttctccttgcttctttcctatctaaactctaccaggaatagaaggaggcctgctgggccagatctgccattttgtggttagtgtatatgggtttttgttattatattctgctgctatgatgtctattttgggcttggacccagagtctgtcatttagcatggaaatggtaggaagctaaagaaactgacactctatttgagcttgggattgtgggaagattttctatcttaatgcatttttttgccattatggaaaggccattatgtagaggtagcaacaggaatagaaggattgcagcagcagaagtagcaagaatatcagctaattattgagaagctggtgaacttaaaaataccatggtaaagttatggtagggtaggggtggagggtgggaatcagacataggctatgctccataaagcttggagagagaaattgcaattgatttgtatcagaattgtcttattacttgtgaccccattggactttaaatatttgagagttgcaatagactcgtagtaagtgctatttccaatgtacctagcacagtgcttggcacacggcaggcagaatacttttttttttttttttttggtgaatgaatgagtaagtgctaaaataactcatcagacagtacaattttggagacagcttattgataggaaaaagaacatcatgtgtcattaggaagtttcctattgtctccttaaattccttttcacca

SEQ ID NO: 107803 - DNA, 1798 bp, Homo sapiens
accacgcccagctatttttttttttgttatttttatagtaatagagatggggttttaccatgttgtccaggatggtttcaaactcctgacctcaagtgatcccccggccttggcctcctaaaatgctgggattacaggcatgagccaccatgcccagcccttttcttcaacttcgatcatagctcctatcataataaaattgttcatctacttcctcaaagcaggccttttacccatttggtacttaaaggaaaggatctttaggtataaactaggtactcagtagtattcatcatattgctgatataaagatttatttactctgtttttagttgagactattaagacaggtggtttaaagtaaagggcatttcagggtataaagattttaagtgctattgggcccttagtgattggttagccttaggctctgtagtactacacatggcttaaaacatttattaatgaattgtaccgaatattacttttttcttataatcttgtggaataatcatgttttagctcctacaagtgctgggaagactcttgtggcagaattacttattttgaagcgggttttggaaatgcggaagaaagctttgtttattcttccctttgtttctgtggctaaagagaagaaatactacctccaggtaatgttttttactaagtttgaaatagtgaaaggctcattattggcagtcttggtttcattcatttgaaatagaattataaaagcaagtggaaaacaaagtttcttcattgtgccctatgtagctttaagaggctactgccaaaagcattaaaaatttacagcaaggggctgggtgtggtagctcacgcctgtaatcccagcactttgggaggccaaggtgggcggatcatctgaggtcaggagatcgagaccagcctggccaacatggggaaaccccatctctactaaaaatacaaaaattagctgggtgttgtggcgcacacctgtaattccagctactcgggagactgaggcttgaacctgggaggtggaggttgcagtgagccgagatcacgctattgcactccagcctgggcaacagagtaagactctgtctcaaaaaaaaaaaaattaaaaaaatttacagaaggaaattaaaagaaaattattattgcattaaggagaaggggccatcaaatcaaaagaataattggtgaaaattgtgtaaaaatttgtaaaccttttcttaggaaataaacagaatatttaaactagcatataaacacgcacattaagaatcagcatttaactgaacagtaggactagactgaagcatagaaaggaaagagtgtttaaggaagtgtatcctgccctaattgaggactatttaggaatatttaggggatgaaggtcaagatccattggtgcttaggtaaagctccaggtatgtgatctgttcctctgttctgcaaaaatgactaatagtagtttacatcaatatgatgctcacagtttttagggcattttcacaaatacaatattttattaaatggaataaatttactgttgtgatttctgcagtgaaaaatatgtgcttttgaaatggaaagattgttatactgattgttaaagaaatgtgggttctagtcccagttttgccactaactatgtctttaggccgggcatataactggctgggcctcagtttttttatttgtaaaattaggatgttaacccttagccctgtgggttaacttagtaaacactcaggaaaattttattgaatgaatagctctaaatttctatggttctataaatcttttt

SEQ ID NO: 107804 - DNA, 3019 bp, Homo sapiens
tctatacatggtcaatttctcataagattcttgaagtcaggatgtgctttaaagagcttcatttcaacacataggaattccaacacacggtgaagggctaactgtaaaactcatatattagaagtaaattaaattttaattttttctttttcctaaaaggagaatgcaagcctacagttcctgactacgaaagagacaagctactattggcaaactggggacttcctaaagcagttctggaaaaataccacagttttggtgtaaaaaagatgtttgaatggcaggcagagtgccttttgcttggacaagtcctggaaggaaagaatttagtttattcaggtatccaaatttatgtaaactaattactatttttaagatatgaatgtaaagaatactctattgaggtagttgtggttcgtttaaaaggtgaatgaggcagtgctttataactagagaaaatcgtacaatatgtgtgaaaagtggagttttatttatatttaaattacaaaagttttattgtttgactggggtggagggaagcaagaaaaatgacaatttaaagagtgggcaattctgcctgccattattctcaacaaacatatatcccagtgagtgtgcaatgggagatgtaaatctgcccttcccctgtttgatcctggttgcttttcagggtatgagcattatcattacatgtttgttaatttaccttttttttttcttgagatagagtttgtctccaggctggagtgcagtggcgctatgtgggcttactgcaacttccacctcccaggttcaagtgattctcctgcctcagcctcccaagtagctggaattacaggtgtgcgccaccaggcccagctacttttttgtatttttagtagagatgggatttcactgtgttggccagactggtcttgagcttctgacaagtgatctgcctaccttagcctcccaaagtgctgggattataggtgtgagtcaccgtgcccagctatagattgacctgtttgtacagggttgtatatacaaacaacaagtaatatactttatataaaatttttatgggttttcttttttttttttgagatggagtcttgctctgtcgcccagactggagtgcaatggagttgtctcggctcacggcaccctctgcctcccgggttcaagtgattcacctgcctcagcctcctgagtacctaggattacagatgcccgctgccatgcctagctaatttttgtatttttagtagagacggggtttcacatcttggtcaggctggtctcgaactcctgacctcaggtgatccacgcacctcagcctcccaaagtcctgggattacaggcatgagccaccatgcccggccctatatgggttttcatgggcaactatggcatacacaatttttaacgcatgcttactacactgactttaaatctaatcatttggtaagatgcaattcctttgtgtcagttttctccgaaattatgagtcacacagatttttcattatggctgtaaggacgaattaaataattatcagcagatataagttcaggcagtggaattagactggttggatttgaaaactatcacttactggctatgcagcctcacagattacttaggaagagtgagagagtgtatatgtgtttgtgagtatgtgtgcctcggtagtacttagagttgattaaattatttcatatataaaagctcagaacagtttttggcacatagaaagtacttgtattgtgaaaaggcattacaaaaaataaaatacttgtaaatgctaagaagtcatagttagtggcagtggcataattgcttgaccatttcaattgcttgaaactgaaacttgggtatcattcagaactctggtcaccagcttatacaattaatcaccaagtcctggtgtctgttacctcatatatctcttgcttctgactcctttctgtttttaggtccattacctggtacagctcattatcatctttcttctagattatgcaatagctttgaaactagttcattcttttcctctgatcttgccctgctcctgcagccaaagtggtcttttttttttgatggagttttgctcttgttgcccaggctggagtacaatggcacaatctcagctcactgcaacctctgcctcccgggttcaagtgattctcctgcctcagcctccggagtagctggaattacatacaggcgcccgccaccacgcccggccccaaagtggtctttttaaaaaaaatttttgtttaaattttttgtagagatgggggtggcactgtgttgtccaggctggtcttgaactcctgggctcaagtgattctcccaaagttttgagattacaggcatgattcactgtgcccagtccaaagtgatctttataaagtacaaatatgatcttgtcactccttttcataaaactcatcagtcacactgcattgctttcaggacaaggtttaaactccttaaatggtgggattataaacctttcttgtggcactttcatatctcttcttttatacccctggggtactttatactccatgcttactaaattaccttctgtgtcatctgaacatgccaggctttcttctaggcctttgtaccatatgctgtttcttaggcatggcattcctttcctcttcctttcttttttctttttttggaacagagtctcactgtatcacccatgctagagtgcaatggcgtgactgcaactcactgcagcctcctcttcctgggttcatgtgattctcaggcctcagcctcccaagatgctgggattacagacatacaacaccttgcccatcgtggcctcctcttgctttcttccttaccttctcataaattctgtttcatttccataagattccttgcaacttttttccttccacttcttttttttttttttcctttttgagacggagtctctcactgtcgcccaggctggagtgcagtggggtgatctcggctcactgcaacctctgcctcccaggatcaagcaatt

SEQ ID NO: 107805 - DNA, 1051 bp, Homo sapiens
taaaataaaatacaattaagtttctggaaaaataaatggttaaaaataacatagacaatacaaacacagtttttatttttaaattcaacagatataaaatcacgatgttgtcaggcatgctagtctgtgcctatagacccaactactcaggaggctgaggcaggaggatcacttgagtccagtagttctgggctatagtgctctatgctgattgggtctccacgctgaattctgaatcaatatagtgacctcccacctcccaggagcaggggaccataggttgcctaagaaggggtgaacttgcccaggtcagaaatggagcaggtcaaaactccagtgctgatcagtagtgggattgtgtctgtgagtagccactgtactccagcctgggcaacagtgagaccccatttctaaaaaagaaaaagaaaaagaataaaatcactatgtcaaattgctataaaagtttctaaacacatattctcaatttttattcttatttccctgtgaaacagaaacagttcagcttgtggaccacacactgagtggcactgctctggaataatctttcagcacttcctggaaccagtctggcctttagattaaatctttactgagctataaccataggatgtctgcctcagtggccctgtcctcttctcgtgccctgacattttatagcaagtggaaataaagaatggtgtaatgccaagagtatagaaatagaattctggagctctagggactgattccagctctgctgtaaaaaggcttatgatgctgaggagagtaataatattttaccatcctatcttgatttccagcgctgactggagattatagtaccatccctgtttacctcacaggggtactgggaagagccatggctataacttaagaataatgactaacatttattaagctattatatgtcttgcaaaacacagagtactttttaaaaacaatcctatatcatagatgacgttggcatcctgatttcacagaaaagtgaatggatatattaatgtttagcaatttgtccgaggatacagag

SEQ ID NO: 107806 - DNA, 2094 bp, Homo sapiens
tgaggagaaggaatgtggaagtccagccactgagcagcgaatgagtctaaggctggaagggcgtggaagattagaacctggtggaatttgccaagttgttgactctgaggcaactttcctctcagaatacccctttctacagtggttgggtcagctttgcttaagtgcaagactagtaggagggaaagcaacatagccctatagggtgaaaactctctgactttcacatttttctttcagacccggagtggcgttggatggaagcgagtcctgcgttcactctgtcattcacggacccgagtgccacttctagcagccatctactttctaatgattcatgtcctgctcattctgtgttttacgggccatctatagacttagttgttactctttggaccactcccctcaaaacttggaattctctcacctctaacatcagaacatcaattccagtggaacagtcttcccatttacaggtcttctctccaactcttcacggaaagtgcctgcaaaaacagaggtggatacgaggacaggttggagctgcagggactggcgagtctgctttcttctactgccctgagcctgaacgcttctgcttaatctgagaatcacatttggtttgttgagcctaatatttgttgagattttgcaggaccctgatcttttgtggtcctgtaaaagatactgaggaatgtctttcagccaagccaagaggatggtttcaataaacctaataatctgaagttcagtatcattttgattgataactttctttgccttgtttgcctgtattttctcctgtttcagggggaaggtggctctgccataaacagagttcagggaaatgaacatgtcacctcataggacatctgatttaggtctcttgcagaatagggtggtgaaagctgaaggaactccctaggggttttagctgttagatcacatgggaggacagcatcttcttccctgccaatttcagatataattggagggagaatttcaggtcttagactataaggatagaatccctttgcttttgcccttgatcacatgtatactaaggtattaagtggcccaagtctttcctttcaccaaagggcagggagaagtgtctatggacagcagggttccaattcttgtcattccaggaatatctgaatattcctggaatgtggaccctgagacagtgctcaggggccactgggagccaatattaggcattgactctcagccaggagtctgactggtctaacaccacactgcaactcctgacctcttgaagtactaagctactttgctgttagtgacagttattacagtttctcagccccattgtctctgccctctgtggcaatggaaggagaatatagagaagacaaaattaaatatagatagacctgagaaggacagccaggatagaattccatttgtgcctattccctgcctcccctcccctcccccatcctaccagttggttattttctcattgcatacgtgatgtgttcactgcctagcctctccctaaagaagagagaagacaagtgggctgactgatctgctctaaatctactgtggtgattaaatcttggttacaacatcctgggaagtttcctgaacaactgtaaaataataaaattattttcagaatgaagagtttgtgtgtatgtgtgtgtacgtgtgagtgaatggatatgtgcacaggtgtttcggtacctgtgtttgcatgctggggggtggaaggtgggtaagggaagtagggaaaggaggtagccaggaatggttataggggtagaaagctctacatattcaggctttcttctcactggccaatatcagtgacagctgcatgcatttttccagccttagctgctagaccccaggtgatgaatgcagtgaggaaattctatcctaatactgaaccaaataagctgggccttagggcatgaaattgatgcaggtccatgcatggtcctgggagaactcttgtctggcacatagtgaaaacattaggcccctagggatccctctgggtgggaatgggagaagagaagcttaatagcatgtagcaggttagataggcattattatgtt

SEQ ID NO: 107807 - DNA, 1033 bp, Homo sapiens
ttgacactgaagtatcagagaggagacatttgcagtttttaaagtctgcaggcccaaatgaattagttaaactgtagactctttattggtagatttgtctgggagttttcaaagggactccagagcagctcccatggagttccccttccagcaaatcagctatttccggaagttccaccctttacagctctagcctgtctcttttttccgtcaactaactcccgtctcaggcctgttacatttgctctccaaacattagactctgaatcacattgggcatttgtctgtctaggacagtgttttaaactgaaattcaggaccattaataaatgatgaaatcattttggtgggcaacaactaaaaaaaatttttaatgttttattgaagtaaaacatacagaaaagtaaacaaatcataagtacagcatgatatattttcacaaagtgaagatacccatataatcagcacccagatctagaatcagaacataccagaactccagaagtcccttgtgtcttctgttcactcctacccacttagaactacatataaatggagtcataccttttcttttatattgcttcatttattttgtgagattcatccatgtcgttgcatatagtgtcatttttccactctcatgctgtgtagtattgcattttaggcatataccacaatctctattctgttgaaggacatttgggcttctccagtttggggctattacaaatagtgcagttggtgtttttacaaaaaaaagaaatgaggtaaaaacacgtatgtaatatataataaagaatatgtctgtctttggaaaactttagttttaattgtatatatttatatactgggttctaagtcataaagttgtgttttttaacacctttattgagatatgtaattccacttaaagtgtgagaaacactgcataggtcactgtcattctgagtgagaaacagtttttcctttagaactcaactgtaagaaaggcacctcaggccgggcgcggtggctcacgcctgtaatcccagca

SEQ ID NO: 107808 - DNA, 1091 bp, Homo sapiens
aggactctatcatgcccagttaaaagtaaaagaagaagaggtacacaggttaagtgctttgttttcctcctctcaaaagagaattgcagaactggaagaagaattggtttgtgttcaaaaggaagctgccaagaaggtaggtgaaattgaagataaactgaagaaagaattaaagcatcttcatcatgatgcagggataatgagaaatgaaactgaaacagcagaagagagagtggcagagctagcaagagatttggtggagatggaacagaaattactcatggtcaccaaagaaaataaaggtctcacagcacaaattcagtcttttggaaggtctatgagttccttgcaaaatagtagagatcatgccaatgaggaacttgatgaactgaaaaggaaatatgatgccagtctgaaggaattggcacagttgaaagaacagggactcttaaacagagagagagatgctcttctttctgaaaccgccttttcaatgaactccactgaggagaatagcttgtctcaccttgagaaacttaaccaacagctcctatccaaagatgagcaattgcttcacttgtcctcacaactagaagattcttataaccaagtgcagtccttttccaaggctatggccagtctgcagaatgagagagatcacctgtggaatgagctggagaaatttcgaaagtcagaggaagggaagcagaggtctgcagctcagccttccaccagcccagctgaagtacagagtttaaaaaaagctatgtcttcactccaaaatgacagagacagactagtgagtagctagttctttctttctgatctgtttaagagtttttgaacctttctttaaatttatttttatagaaaaggataaacacattcttatacatattatctgggaacgcagggaaagtattatgtatcccacaggttctgtttggtcttagagaagcacagaaacatgatttaaattgctaaacctgccaataccattagaaaaaaaatcagaaatttccttggcacaaaactctccattggttataaaaggactaagaggtggagaactgttttatatattttatata

SEQ ID NO: 107809 - DNA, 1179 bp, Homo sapiens
catatcaagattatcccttagagaagccaaacgttagcttgtctggagcaaagtagaataaaataggagaaaatgttacttttcagtgttgaaaaccatgtcactaaaataagtgacatattttggagtttatgacttaaatatatgaacccttaagtatgatatacctttaatacatagcactcagtagataaacatgtaggtgcagagaattaatacctcttcagtaaaatatttaacacctgttatgaatgttaattcatttgtaaatctattgagtacatgttatagtatttgttccttgggaaacacagtttttttcttgaaatctgtaactaatgaccttctctctgtttcaggcttgaacatgacaagcagatttgggagtccaaggcccagacagaggtccagcttcagcagaaggtctgtgatactctacagggggaaaacaaagaacttttgtcccagctagaagagacacgccacctataccacagttctcagaatgaattagctaagttggaatcagaacttaagagtctcaaagaccagttgactgatttaagtaactctttagaaaaatgtaaggaacaaaaaggaaacttggaagggatcataaggcagcaagaggctgatattcaaaattctaagttcagttatgaacaactggagactgatcttcaggcctccagagaactgaccagtaggctgcatgaagaaataaatatgaaagagcaaaagattataagcctgctttctggcaaggaagaggcaatccaagtagctattgctgaactgcgtcagcaacatgataaagaaattaaagagctggaaaacctgctgtcccaggaggaagaggagaatattgttttagaagaggagaacaaaaaggctgttgataaaaccaatcagcttatggaaacactgaaaaccatcaaaaaggaaaacattcagcaaaaggcacagttggattcctttgttaaatccatgtcttctctccaaaatgatcgagaccgcatagtgggtgactatcaacagctggaagagcgacatctctctataatcttggaaaaagaccaactcatccaagaggctgctgcagagaataataagcttaaagaagaaatacgaggcttgagaagtcatatggatgatctcaattctgagaatgccaagcta

SEQ ID NO: 107810 - DNA, 5512 bp, Homo sapiens
tttagcagtgttatggtacaaagaaggttttgaccaaaaagtctgaagttttagaagatgaaatacaagtttttagttgggctatttttttaatgttataaaacatttgattacagctttttttttcttttttaaaaatagatcagcattgttgatattgccaacaagaggagctcttctgctgaggaaagtggacaagatgttctagaaaacacattttctcagaaacataaagaattatcagttttattgttggaaatgaaagaagctcaagaggaaattgcatttcttaaattacagctccagggaaaaagggctgaggaagcagatcatgaggtccttgaccagaaagaaatgaaacagatggagggtgagggaatagctccaattaaaatgaaagtatttcttgaagatacagggcaagattttcccttaatgccaaatgaagagagcagtcttccagcagttgaaaaagaacaggcgagcactgaacatcaaagtagaacatctgaggaaatatctttaaatgatgctggagtagaattgaaatcaacaaagcaggatggtgataaatccctttctgctgtaccagatattggtcagtgtcatcaggatgagttggaaaggttaaaaagtcaaattttggagctcgagctaaactttcataaagcacaagaaatctatgagaaaaatttagatgagaaagctaaggaaattagcaacctaaaccagttgattgaggagtttaagaaaaatgctgacaacaacagcagtgcattcactgctttgtctgaagaaagagaccagcttctctctcaggtgaaggaacttagcatggtaacagaattgagggctcaggtaaagcaactggaaatgaaccttgcagaagcagaaaggcaaagaagacttgattatgaaagccaaactgcccatgacaacctgctcactgaacagatccatagtctcagcatagaagccaaatctaaagatgtgaaaattgaagttttacagaatgaactggatgatgtgcagcttcagttttctgagcagagtaccctgataagaagcctgcaaagccagctgcaaaataaggaaagtgaagtgcttgagggggcagaacgtgtaaggcatatctcaagtaaagtggaagaactgtcccaggctctttcacagaaggaacttgaaataacaaaaatggatcagctcttactagagaaaaagagagatgtggaaaccctccaacaaaccatcgaggagaaggatcaacaagtgacagaaatcagctttagtatgactgagaaaatggttcagcttaatgaagagaagttttctcttggggttgaaattaagactcttaaagaacagctaaatttattatccagagctgaggaagcaaaaaaagagcaggtggaagaagataatgaagtttcttctggccttaaacaaaattatgatgagatgagcccagcaggacaaataagtaaggaagaacttcagcatgaatttgaccttctgaagaaagaaaatgagcagagaaagagaaagctccaggcagctcttattaacagaaaggagcttctgcaaagagtcagtagattggaagaagaattagccaacttgaaagatgaatctaagaaagaaatcccactcagtgagactgagaggggagaagtggaagaagataaagaaaacaaagaatactcagaaaaatgtgtgacttctaagtgccaagaaatagaaatttatttaaaacagacaatatctgagaaagaagtggaactacagcatataaggaaggatttggaagaaaagctggcagctgaagagcaattccaggctctggtcaaacagatgaatcagaccttgcaagataaaacaaaccaaatagatttgctccaagcagaaatcagtgaaaaccaagcaattatccagaagttaatcacaagtaacacggatgcaagtgatggggactccgtagcacttgtaaaggaaacagtggtgataagtccaccttgtacaggtagtagtgaacactggaaaccagaactagaagaaaagatactggcccttgaaaaagaaaaggagcaacttcaaaagaagctacaggaagccttaacctcccgcaaggcaattcttaaaaaggcacaggagaaagaaagacatctcagggaggagctaaagcaacagaaagatgactataatcgcttgcaagaacagtttgatgagcaaagcaaggaaaatgagaatattggagaccagctaaggcaactccagattcaagtaagggaatccatagacggaaaactcccaagcacagaccagcaggaatcgtgttcttccactccaggtttagaagaacctttattcaaagccacagaacagcatcacactcaacctgttttagagtccaacttgtgcccagactggccttctcattctgaagatgcgagtgctctgcagggcggaacttctgttgcccagattaaggcccagctgaaggaaatagaggctgagaaagtagagttagaattgaaagttagttctacaacaagtgagcttactaaaaaatcagaagaggtatttcagttacaagagcagataaataaacagggtttagaaatcgagagtctaaagacagtatcccatgaagctgaagtccatgccgaaagcctgcagcagaaattggaaagcagccaactacaaattgctggcctagaacatctaagagaattgcaacctaaactggatgaactgcaaaaactcataagcaaaaaggaagaagacgttagctacctttctggacaacttagtgagaaagaagcagctctcactaaaatacagacagagataatagaacaagaagatttaattaaggctctgcatacacagctagaaatgcaagccaaagagcatgatgagaggataaagcagctacaggtggaactttgtgaaatgaagcaaaaaccagaagagattggagaagaaagtagagcaaagcaacaaatacaaaggaaactgcaagctgcccttatttcccgaaaagaagcactaaaagaaaacaaaagtctccaagaggaattgtctttggccagaggtaccattgaacgtctcaccaagtctctggcagatgtggaaagccaagtttctgctcaaaataaagaaaaagatacggtcttaggaaggttagctcttcttcaagaagaaagagacaaactcattacagaaatggacaggtctttattggaaaatcagagtctcagcagctcctgtgaaagtctaaaactagctctagagggtcttactgaagacaaggaaaagttagtgaaggaaattgaatctttgaaatcttctaagattgcagaaagtactgagtggcaagagaaacacaaggagctacaaaaagagtatgaaattcttctgcagtcctatgagaatgttagtaatgaagcagaaaggattcagcatgtggtggaagctgtgaggcaagagaaacaagaactgtatggcaagttaagaagcacagaggcaaacaagaaggagacagaaaagcagttgcaggaagctgagcaagaaatggaggaaatgaaagaaaagatgagaaagtttgctaaatctaaacagcagaaaatcctagagctggaagaagagaatgaccggcttagggcagaggtgcaccctgcaggagatacagctaaagagtgtatggaaacacttctttcttccaatgccagcatgaaggaagaacttgaaagggtcaaaatggagtatgaaaccctttctaagaagtttcagtctttaatgtctgagaaagactctctaagtgaagaggttcaagatttaaagcatcagatagaaggtaatgtatctaaacaagctaacctagaggccaccgagaaacatgataaccaaacgaatgtcactgaagagggaacacagtctataccaggtgagactgaagagcaagactctctgagtatgagcacaagacctacatgttcagaatcggttccatcagcgaagagtgccaaccctgctgtaagtaaggatttcagctcacatgatgaaattaataactacctacagcagattgatcagctcaaagaaagaattgctggattagaggaggagaagcagaaaaacaaggaatttagccagactttagaaaatgagaaaaataccttactgagtcagatatcaacaaaggatggtgaactaaaaatgcttcaggaggaagtaaccaaaatgaacctgttaaatcagcaaatccaagaagaactctccagagttaccaaactaaaggagacagcagaagaagagaaagatgatttggaagagaggcttatgaatcaattagcagaacttaatggaagcattgggaattactgtcaggatgttacagatgcccaaataaaaaatgagctattggaatctgaaatgaagaaccttaaaaagtgtgtgagtgaattggaagaagaaaagcagcagttagtcaaggaaaaaactaaggtggaatcagaaatacgaaaggaatatttggagaaaatacaaggtgctcagaaagaacccggaaataaaagccatgcaaaggaacttcaggaactgttaaaagaaaaacaacaagaagtaaagcagctacagaaggactgcatcaggtatcaagagaaaattagtgctctggagagaactgttaaagctctagaatttgttcaaactgaatctcaaaaagatttggaaataaccaaagaaaatctggctcaagcagttgaacaccgcaaaaaggcacaagcagaattagctagcttcaaagtcctgctagatgacactcaaagtgaagcagcaagggtcctagcagacaatctcaagttgaaaaaggaacttcagtcaaataaagaatcagttaaaagccagatgaaacaaaaggatgaagatcttgagcgaagactggaacaggcagaagagaagcacctgaaagagaagaagaatatgcaagagaaactggatgctttgcgcagagaaaaagtccacttggaagagacaattggagagattcaggttactttgaacaagaaagacaaggaagttcagcaacttcaggaaaacttggacagtactgtgacccagcttgcagcctttactaagagcatgtcttccctccaggatgatcgtgacagggtgatagatgaagctaagaaatgggagaggaagtttagtgatgcgattcaaagcaaagaagaagaaattagactcaaagaagataattgcagtgttctaaaggatcaacttagacagatgtccatccatatggaagaattaaagattaacatttccaggtaaatgagtagtgaatttttcctcctccagaggtaacttcaagcaaagaaagtctctaaactatttctgtttccttttagacaatgggactaattttggcataaatgtccatggaagatatattctctctcacttctgacttttttttggcaaacaacaatcctgctacaactgcatgaac

SEQ ID NO: 107811 - DNA, 2107 bp, Homo sapiens
tttgctttacccaaaactagtataccacctggcaaataatggctactgaataaagttttgttggattgaactgaacttagcattttatcctattggattgtgtgtgaacagttagtgagaatgaagacgtgtctccttccacttatcatatgcttcatgtagactttatggatttagtagcgtgtcgttaatgctttattgatctaattcatctttaactgactactacactttatcatctaggagtgagaatgaatagcaagtaaaggttgtaaaacttttattaaactctagagccagtatttctaacttaaccattttacagttttccacttagatctaaatggaagcttatgcacttgtattagacgattcccactatttctaataagtaaagaacaccacaaattcagctcattatttaacccattcagagcacttctttgagaccttatccatgatgcttattttgcagttttgcaaacagtctgtatcctatccatgtggcttcacatggtttggaggtattatatgggttccattcctttgctctttcctgcagggatcactgaccttaaggttttctgtattggtttttgtgtctggcctcatagattacttttaccttgtatgtcatgttgttttcaactcaccttttgcactgacatttctaccactgtactcctttttcaagtaatcttgtgaaatgtctgaacatatatactgtcttgaattcccttgtctcatctatggtggctttcctatgtgccaggcactattccagttgctgggtatatagctatgaacatattggaggggaagacagactacaaacctgtttatacacataagaaaatttcagagaatgataagtattaggcttaaaataaaacagagtatttcaagtatgccttggagaagaggaacgcagaattggagtagtgagagtaggcctttctgaggactttaaacctgaatgatgaaaaggggacagccatgcaaagaggctaagcagagagcattccaggcagagaaaaaagcagtacaaatgttctcaggtgtgaatgaacttgataagtttgcagaagagaaaacagaccagtgtttttagagcagagtgaacaaaaagggggcaatacaagaagaggaggttggagaattagtagggtcaaagcatgagggttcctgtaggtcacattaagacatttggatacagtgtaaaaaatatatatatttttttcctttggtgtatctgtgttatcttctcagaaagaatataagcttcttgaggatattgatattgatgctcaatatatacacattgtcacagaacttgggttaaaactctgaagacttggattctaatcccagctccctgaactagctgcgtaacctttcgggttgtgtcatttctttgtttccttatatgatcattgaggagataggatagctcccttttagtgctaaaatttgatatctttatgaacattgaagaacattgtaagtgctatattaatgcaaaatatatattacaaacatagtaggattatggataaattatatgtattgtcctagaagttccagattatgccacagaaatagctgctttatgtcctgcatcctggcatccttctcctttcaaaccttccactatttagtatacttcattcaggttcattatcatcacctagtactgttctatcttatatctcatgtaatcatatcctcttgccacttctttaataaggctttcacctctcccaagctattttgtttattttttaaaaaattatttcatacaattcaaatagcttcacatgcaatcctgttttttcacacactccacatatatcttctaaagatatttattttgtgactttcagaaaaactgtcttctcagattactctcctagaggctcagaatagaactggggaggcagacagagaagtcagtgaggtaagtgatgtgttcttaatataaccagaacatgagctagattaagagaaggtagcttcatatgaaaatacgtccataattttctagtgttgccagagaagtacattacctatagagtaagatctattaaagagattcataatggttatt

SEQ ID NO: 107812 - DNA, 1036 bp, Homo sapiens
gaatttttattatacttggaaaacaaaaaacaattttataaatcttcttcctttcttaagaggtacatattcctttgcctctattcctctttgtggaacctctcttcatgttcattctccttcaggagagagaccatgttacttggtgacattaatctaatcttgtaatactatttgtttgtgaacctgaaaatgttctttcttatgctatagacttgggatttctatctttgtaatccaggcttcaatcttaaatttaaaagccaatgaacttgatatttgtgtgaaatattttatttctttttctaaatctttagataaaacacttttcttcaaagattacctaggcagataagtagatgttatttttaaagtattttcatggctggagaacttctagaagacaaaaatgctggaggctatctgggcgttagtgtgagaattttctgctggagaatcattaatttgttgtctttctacaatttaggcagtcactgaggagaatattgcttctttgcagaagagagtggtagaactagagaatgaaaagggagccttgctccttagttctatagagctggaggagctgaaagctgagaatggtatgtataaaagaaaaccataattctctgtcttcttatcccacaagtgcctctacttttatcactaattatgtataacatgtagaattctctgattccgtgataataaagatttagataatagagctggtaactatcaaagataatacacattaaacaattagagcatagtatcagtgtttacataagtataacattttgcaatatggactatacatgctgcaggatttctttataactcataatcattttggaatggtcatcgtatcctataggaagtatggcttgaacaggaccttaataagatgatttttaaaataggtaaaatgaagaaagaaaggacattctggtaataaatttgtgggatgaggtaacagagatcagtataaaggtttaaaggtagaaactatgttgtgagtgagtggtttatgctc

SEQ ID NO: 107813 - DNA, 1050 bp, Homo sapiens
ccagcctggccaacatggtgaaactccatctctactaaagatacaaaaaaaaaaaaaaaaaaattagccaggcatggtgacgcatgcctgtaatcctggctacttggaaggctgaggcaagagaatccttgaacccatgagtcagaggttacagtgagccgagatcgcaccactgcactccagcttaggcaacagagggagactccgtatcaaaaaaaaaaaaaaaaagtgcctaggcctattttattttacttttgaaggaagtgatttactgaggtgtcctttggttcttgagaacatttaacatttagctaataataatgttgtcattggcatcataattttaactaaggaaactaaactagtaaacagcatacagtgtatctttagaagataataataactacatttcagacttgaagcaaatattacatttattttttttcttttccttagatcagctccagcaaaaatccaaagaaattagccaatttctaaatagactgcccttgcaacaacatgaaacagcatctcagacttctttcccagatgtttataatgagggcacacaggtaattaaatgtgaacttcttatgaatattaactgtttgtctttgctgtatctgtacttcggtgctctaatgaggatttattccagagagctatataaaccttctgttttttctgcctgaaaaaatacttttttgaggacaattctatttgaaaggaatcatgaaaggcattaatgcagtgtttcaacaataaagaatgagaaaataatagataacaaataccatggtctcagaagcctttctgattctaaggtcttaacaatttgtatcggagatgaatcattacttttgcttctgtagttaattttcccagttcggaagtcttttttttttttggtaaactaagatttgatcaggtttagtgaacacgagtcagtctaatcaaacttaaaagtctactatggaaatcatattgttcccattaattaattaacagtaaaaaagtatataatggccaagtagcttcttattggccagt

SEQ ID NO: 107814 - DNA, 1078 bp, Homo sapiens
cagcaaataaatacattggctgtttagggctgtccctttctcagacccatcagatttcactcttttgctgccttctttttcttacacaatgtaagactctaatacaatgtagttcttgtgggttttggtggtttgtccttattagcttatattttagggtttttaggacggtctgcctaatttaactgtaaatgttatctgtggtttttttggttttactatcttgtgctgtctctatgtgaggagtcagagaaattgaaaaattgccactactgcttctgtcttcttctgacaaataaaattttgataatgcatgcaatttccttttgggttcaatggaaactagaaggaaatatggtaggcatttaggttaagcaagaaagggaggtcaaagaattaataatgctcattcttttgcttaaataattttttttccttctatgtcttcggtttgataagagttctacagagatggaagaatttgtaatgatgaagcaacagctccaggagaaggaagaattcattagcactttacaagcccagctcagccagacacaggcagagcaagctgcacaggtagggacctcacaaaattaggataaagagctatgaagtccagtgggttattacgcacaagtcaattcagtgagtcactttaaaaaatcctagtagataaaagtatagtagcatgggtgttgcactagaaattagaaggatatgtagtagaagagattaggagatgtgtggtaggtaagtgtgtcattagggaacaccagaaaacctcacaatgtgttatttaccttgatgaattttctatagcctaattgatgactgtttcttagttctgcatgtccagaaacttaattttaatagcagacagagattcagtcttttgggaatggactcatgctgagttcaaaagagaccaataagtaaaccaaaagaaataaaaataattaggttcattctttcccaaaataatatctatcttaataggaaataaattatagttagattacttagtgagcctgtaatgagaaagtggtgtaggtcatgtgattttatgttaaatggcacc

SEQ ID NO: 107815 - DNA, 1090 bp, Homo sapiens
cagcctcctgagtagctgggattacaggcacgtgccaccacacccggctaatttttgtatttttagtagagacgggatttcaccatgttggtcagactggtctcaaactcctgacctcgtgatccacccgcctcagcctcccaaagtgctgggattacaggcatgagccaccacgcccggcccctgctgagggttttaaaagccaaataacattttatcacaaaatgtaaaattaggcataatcacgtaaactaatgctatgcatagtccagttctattttgatttttcctatcaaagcattaatatgcttctcattttcatggactttatggactagcagttgacactgatctgaatatgtagcctacacagtggttataaaagtaaattgattttggaataaccttagatttacatacaacttgggaagattagacagacagttattgtatacacaaagcatcctctaatgttagcattttacacaaccatggtagctttttcaaaacagagaacataggtgcaatgccataaactaaactataggtagacttcattcagatttcaccattttttccagtaatgtccttattgtgtttcagaacctaatccaggatactgccttgcgtttatttatttatttatttagaggcagggtctcactctggcacccaggctggagtgcagtggtgcgatctcagctcactgcaacctctgtctcccaggttcaagtgattctcccatctcagactacccaatagctgggactacaggtgcatgccaccacacccggctaatttttgtattttttagtagagacggagtttcaccatgttggccaggctggtctcgaactactgacctcaagtgatctgcctgcctcggcctcccaaagtgccaggattacaggcgtgagacactgtgcccggcctactttgcatttaatcagcatgtctccttgtcttctctaatctgtgactgtttcttagttttttgttgtttttcattactttgacagttttgaagagtattggtcaggtatttttagaatgtccctgaatctaggttttcccagtgttttctcatgat

SEQ ID NO: 107816 - DNA, 1033 bp, Homo sapiens
tcctggaagagagccccaactcttcagttctgagaattaataaaggtccagactgcctcagctctttcagccctcgtaggcccctggcaggtacctgttattggaatgggaagacccctccttgtatcaactactgttctgtaattggcttggcgcatttgccagtgaatgcccactggctcttttgaggtcctcttggtgttgtactcctctggcttccctcaatttcctcccagttgaacaccagtgacacccagatcttttgactattggcggtttgtctatatccacgtttattttggggtttgtaggaaactttgttaagtagttttttggtaaaggctgtccatggatcttttgttacctagttgctttgtctgtttttatgtgggaataaaggaagatacaaaatccatggggccccttgctactcccatcttctcagaatcccatcagttggttattttgttttctttgttccaaagtggtctgaaaaatctgaagataaagtgattctgtttgataagttaggttccattatgattttctttgattagcagaaatctatatgtttaagaaactctttagtgatggtattcatttccttcattaaaagttaaccaaagaaaatatgatctctaaagttgaaaagaaagtttagaatctgtatactgctgaattgtgattttttaatcctgactatagctgtggttctcatatcttgaataaatagttatatatggccctatgtactcatgtatgacactgtgttgcccttccagtatttagatatgaagttatatatgatcctgcgctgccttcctagggaacagttcactttttctatttctgtctcacgtatcttttccaagtgatgtgctacttagattacccaagacaatctattaaaaaaacaggtatctctcatcacttctttcttaagaaccatggctgccctaaacactattattatccccagtagaagaaaactgtagcagagcctagtttcatttaagtgtttattttgtacaat

SEQ ID NO: 107817 - DNA, 1489 bp, Homo sapiens
ccttggacagtatggcccagtgtgctgtaattcttattcatacatattcaaattatccttttagccaatgggaacctgtgtcctttgaaagcttcctatcttgtatgacaagatgtttcaggatcattttgtacatttccactttagaaatggaattagccatttctctaagaaaaccttcttttaaaaacttttttaaaaatgggaaagagtatttcaagaccccaatctaggcactagagatattcattgcttctcagtttgtcattacttttaagcctttttggtggacagagctaggaaaatatgtgaacaaatataaaatactgaattgtcatttcacactgagtgttcctattcagattcaaagattagtttgtatttcggggttcttaatttcttctgtattacatctgtatcttcttttcataactgaaaatacagaattagtgtatccataattatcatttgctttaattctacatttcacatatagtaatctaggagtgatgatacgaatatcaccaccacaaccactttagacgagatcgggtgtgttcaggatggtatggccgtagacaacaaccacttttaattattgaaaactgtttaaaaatattttttattttttgcatatgctattcacattcttcccgattttttttcatggttgtcctatatattgtcagagcatataatcattacatactatgctgtctctcctccagtctttacttagtcttaattctgttagtaaccgtatatttaatgctcaccactagttcttataatgatgtttctttagtcatttggattgcctcaagttttgcctctagtaaattctttaggaaaggcttaagggaatattcatatttcatgaattttcttgctcgttcataacattttgtctgtgttttttatatctaaagtttgtgtttgccagaaatagaatccttggctcactttttcttttcttgaatatcttaaatttgtaactcattttttttttctggcaaaaacattgctgttgaaaaatctagtgcttttttttctttatcttactggtcatatgatcttttagcctaaagcctaaaggatttttttaagtccagtaattttactagagtgttttgttggtcattctgagttgacattctgaggtacattgtgggctctttcaagatgtagtttcaaatctttttaaaaaaaattttcaaataaatattcttggattatggtttttcatatttgtgctgtttctttgctttgcttttcttcttcagggaatcctgttattcacattacttatcttcaatatttatctgtttctcgcaaatcctatgtaactcttaatttcttacattttttaaaaataaacaaattattaggaattatttcagatcactacagaaagtttactacagaaaatttgcaaagatagtgcagaagtctggtgtatcctttgcttagtattccctaagattaacat

SEQ ID NO: 107818 - DNA, 1856 bp, Homo sapiens
ccagaggggccgcgggagctgcccaagcagctacaccggagtcccctcctcgccccgcctctcccggattcagtcctggatccggcccttcacccgcctccttcacctaccaggcctagttctagtagcccacaagcctcggcctctccggtgggccttcggggtcaccctgcgcagacttggaccacttgctcacggtctgtcccctccccggtacgtttctcctctgggagcgacggggaaaagcgcctaggtcagtcctgtccgcacggccttgttcctggagcggcctgcctaagtcggcctccgtacgcagccgctgacgtcggaaagaacctgctgggcccctgtgctcaggccctaaacaaacttggtgtcccgaaggggaggcgcgaccaaaagaaatcaaaggtctttagggcggagatcacagaatcattggagatattaatgcaaacggaggcctgtccaataatcctgctaatgctaatgggttactggaaagatgagaagagaggaaagatcccaacgatcccgtcaacacgaaaatcccaggaatcagaggtgggcaggctgttagagaaaaaggaacctctaagagagttctcgaggaaaaataacttggtttgatggtgtggagtatgtttaatctgcacaaccggaatgtgaaagggagggtgagtcctttgaggaatgaggaatatatttgtctgacttatttaaagagctccagttggtctatggggagcggacagtttgagagtgggacagggatatttacaatcatgggtaagtactttcacttttggagatagttggaagctgtctgagcatttaaaggacctttttacagttctgtgcaagatgcaagcaagtggagggctctttacataagggccagaggcctttccaaaagcgtgaattgataagatttagatggtcagaatggttatgaaggggcaaactcaggaaatatcctattggaaaaatggcaggatttggttttggaatagatgcaggaaaaagttgaagagtactcaaaagttgcaggcattgtacattaactgcttcatagcttttacttctcatcccttgaccacagaatgaccatttaatgtttttcttttcactgcatcaatattttttactacctcagcagcttccaaaccttttaattgcactccctatcagtaaaacatttttgagcatgcatctccccaaatgttgtgtgtttaattatttatagtgtatgactaccactgtaaatatgttgtgtataatatgaaatatgcaaaagtataaacgtaaaagaatgaagtttttaaaaagccttgtccacaccttgggacctcccaacccaatttgacaatcacgtaaagatacttccttgtttttcaagaaggtcgttggcatttctggcatccagactctgggatgcagcctttcttaaacatgatctttagaagatttttttcaaccttctgcttgagttttataggccccctttctttttctccctttgattaatggattaattaaagggatgttgactttatccttgtttataaaataaatcattcattaatttctctaggttaattactattaggaataccactgatcattacataccagtctgtggttagaaaccattatgtaaaaggagactaagctctatattgctgtatttttaattaagctattttaaaatcagctatatgcttttgataaaaggaaatttaatacagaaggatacaatgtaaaaaaagtctttttcttttctatctactgatctacccatctccattccccacttcccagaagtaagcactgtaaataatttcttggttatattt

SEQ ID NO: 107819 - DNA, 1052 bp, Homo sapiens
aaatttgtcccatataatgcctattacaaaatttctttttaccagagtccattctgaaggacatgagaaggaattcagacagaaatatactgtctccttggtgtttacaatcatctaggctgtgtagaattaagaacccttttttctatagacatagaacctgtcctctagagatcaagtgccttgcccagaatcatagtttataagggactagaattgagactagaatctattgcttttttttcctcttcattgcttactgcacaaataatacgtgactatatccttgtaaaaagcactacagaagactgtatattttaaaagtcactgttctcctgcattttgtcacagtcccattcccctccttatacacactcagagttaatcattattgcaatgtgatcactaccatatgttgtagtgagaaaatagttctattagttaggggagaaaaatcacaaaccttcaattttttttcttccaggcgcttaaattcctagcgaagtgccgtaagaaaaagaaactatttgctccttggcgaggactccaagaactcactgatgcacgccgagttgaactgaagaaacgagtggatgactatgtcagaagacatttggtatgaagcttctgtaccatatcagtattacattattccaatgcatgatattgataactgtacacacacacacatatattgtgtgtgtgtgtgtgtgtgtgtgtgtgtgtacatttattgctggtataaggtaatgcattggctttaccatagaagtaatggtatatctttttctagttacatagccatagaggtatagtcagtagtgaaggagactctgctttaaatcagttttttcccatactatgtcaataagacttgttcattgcttcttttgcaatagtactgtaaaacttggactattttgaaccttccagaaagagtatatgtaactgtcaatcaatgattattcattcttacatttgttggactactaatgtacctccagaagccaataagatatagcatttgactatttgcctcttatgatcttacc

SEQ ID NO: 107820 - DNA, 1052 bp, Homo sapiens
cattagatcatcagtatattctcatgtcactaaatattcttcgaacattttatgttttcatagttcatagaatcccatcccatcaggtgaatgaaccagtatctgtttatccaactcgctgttgtgagacaaagtttgttttcaacttgttactgttgtaatactgtggagaacatttttgaacataaatttttacatatatatctgattatttccttaagaaaattatttgtaatagaattaattggtcatcacttttaaggctttttatttatatatttcaaatatttttccagacttttaatgcatatattcaaatatttctacagaaagattgcacaacagcagcagatgacaagctattttatcataccttattaacactagaaattatcttaaaattttttctgtttacatttatttgattactagtgaggttatgcattttttcatatgatttatgaaaattatgtataacacactgtttccatcacagatccaaacgatcaaagatgttgctggagataaataggcagaaggaagaagaggacctcaaattacaattgcaacttcaaagacagagagccatgagactttcccgagaattgcagctgagtatgctcgaaatagttcatccaggtgagtggcagtatcaactttatcaatataagaatatttaggttatcttttaacaaaccaacttttctagctacgtgatgatttttttttaaatttggacttttgtcctttttctctgtttttcagataaactttattagatcttctgagttcaaaaacggttactgttttttcaattcagacctattagttgacgatgaacaatctccccaccagttttttttcttatccttcagataatttagtgaaacataaaaatgtatgcataaagatagctgttagagacacaaagatacttcttgaactgaaacaaggagttggaatattattacattctgccatcagagtttaactcattccttagtacaaatgttgtgacatcttcttgccgcctttgacagactaagctgaaa

SEQ ID NO: 107821 - DNA, 1050 bp, Homo sapiens
aatctttttcaactaataatgactaataataatctgcataagtgcttccacagggcaagcatttactgaatatgtgtctgtagtaatttatctttaaaatgtctccatttaagtatttttgttcaaataaaaaaaatttatctctactttttgatttaccacagtgattccatcccactcctttttttttttttttattaaagagattgtctagacagatttttttttttttatcagataccacaattgagcacgtaagaattctcaggagggaggaatatcttaaagatttcaacctggaattctctgagaaaaggaaaaagaaaaatcatatgattaatcttgttttcatttgtttttaagccagactttttagcttcaaattaatactgattagataacaaaatcatattttattattataataatagttgtaccttttgctattccatttcaggactcagacgtctactaagtaaacaggaaactgggactgaattcagtcaagaacttagacagcttgttggccttttaagcccaatggtctatcaggaagtagaagagcaggtattaagttacaaaaaaaaaaaattgcatgatatttgctgactatattaaaccttagttttccttaaatgttcctcactttctttctcttaagatttcaagcaaaatacccccaaaacagaaatatctttaaattttttactcaggaggttgaggcaggaggattgcttgagtccaggaattggagactgccctatgatcacacccatgagtagccactgcaccccagcctggtcaaaatagcaaaaccccatctttaaaatataatgttacaaaattgtatctctccgccattcaatctgctggaaaacataatttcaatctcccatttacatctgtttataaatactgccacatcagtttcattcatcatttctcatgaaagccccatctctgatgtttatcttcttttatctataagctatttaaacttttaaaactgtttttccaaaaaaaatctctaattgtagcaaactgtattta

SEQ ID NO: 107822 - DNA, 1006 bp, Homo sapiens
tttttcaacaaaaattctttattgtcttggtaacaaaagaagcatactaaaaattctcaataaggcacagtgtctctagaagcttgagcattcaacataaacttctaattaacacgaacttgtgctcttatttcagccattgctgtgtgggcttggagccaggagaagatgcagaggaattttacaatgaattacttccatcagctgcagaaaattttctagttttggggagacaattacaaacatgttttatcaatgcagctaaggtatgtgtttatttagtcttttgtagctaaatcagtttaattcttaagaagctgttctgttattttttaaatgtgcaatatttggctgaaagtacaattaaagtagtgaatttaaacattttcaaagttacaaccttccaaaaatcatctctatgtttgaaaaatttttaatgctgactgaagcttgccatttgattttttgaaggatctgccttgctactttacttgttgggcagcacccatagacaattatttccataacatctttctaaacatactttttacttaaattaacagtagaggaaagtatgttctctagggctagggcttttctaagtagctccagtagtgaagaataaaggtgaacttcctatttgatctctcatatcttctccagtcaaaatattcaacccaaacataggggtcttttcaagtatttcttggttgcattatgctagatgctatacatgtgctctttttttgacccagggatttagaagtgtgttgcttaatttccaaatatttgaagatctactagatactttattgttatcaatttctaatttaattatgttttggtcagataacattctctatatcatttcaatcctttggaattttttcagacttgttttatggccctccgcatatgttttatctttgtgaatgttcattaaaagaaacttttgtgggctgggcgcagtggctcacacctgtaatcccagcagtttgggaggccg

SEQ ID NO: 107823 - DNA, 1040 bp, Homo sapiens
gctatgatttattacagtgaagggaaataaagcaaaatcagcaaagggaaaaagcatattgggggaaatcaggtacaaacttctgagttctctcccagtggagttacgtaggatatgcttaattcctccagcaaccagctatgacaacatgtttgaagtgttgtctaccaaggaagctcaactagacactcagtgatcagaatttttattggaggatggccacataggcaccctctgtataggtactctcgactggcatgtaccagaattctaagactcctggaaggaaggcgggtattcagcatgaaccacattgtttttcataaacagttttaggcacagggagccactcttaccagagaatggcagaaaccctcctgaaatctaagttctagatgccagtcaaaggccaaccttgtaagcacacctttgaaagtatagtagtcttaggcctgtcatgttagctcttttttgcagttcttcttgtgtgattaaaggaagttaattcctatcctagaattattgtgcagattagagagagaatgtgaagctcctatcacagttcctgactcttagtgagtgcacaataaacaatacctgctatagctgttacatgtgaggtataggaatcttgagctcttttacactggttagaaaaaccagttttctataaggaagaaatgaaaaaatctacattctgcctctcaaacaaggcaagaaaagctgtttttatttatattgaaattatatttcaaacattatttaggtagtgaacatttcctggctttttgacctttattctctgattctgttaaaatataggtaataagagaaatgaagccaacaggtacagacccaaggatcttatctatagctgctgaagttgcaaaaagccctgagcagaatgtccctgttatactgttgaagttaaaaggtaagaaaatctttttgtgattagatagcattttaagtgaaaaatggttccatcgttggtacaattttaacatttcttttaaatttgttcagagaggtcttaacac

SEQ ID NO: 107824 - DNA, 1033 bp, Homo sapiens
ccttcccgcgtcgcgacgcacgctgccccggaaggccgcggcgctgtagtgcggcgtgggagccccaggttctttagtggaagaacgcgaagcgaggatgaggtaacttatctgaggtggtggctggggagggagagggccccagggcgcctaccaggaggccaggaccccaggctcctggacgaagtcagccggcttgtaagagctcttaacgggagaatcggcctgccctcacgcccactctgtagagatctggtgtggaaactgaggcctggggaggtgcagtgtccaggcacagggcctagtgtcttatccaaggcctggtagcgcgaaagccgggtctagaatctggagtaaaggagcccagaggccccagaatctcggtccttagacttgaagcgacgctgttacctcagtaatcgttttctgacctttttgtaccagaggaagtttcttgtggtcctaggactggagaaggggatgtgtagtggggaggagaaagaggattcggagatagcaactgcagacatttaggatcagccgcaacaggatcgcactgaatttccttttcatttattttcctcacagtgatccgtggaggcagtaacaggcgcggcgagggagaagtgattcccgaagaatcaaggctgggccggacccggtggcctggcaacagggtagtagccttaaaatagataaataattgtctttttgtgtcaaatttcatgaatttaatgtaaagatgggagaagtgttgaattataggagaaacactcgagaaagtttacagatggtttccataacaggtggtttttcagggtaattacgcaatccaactgcactccctcaccttctgccttaggcacatttgtcaattgattttggggtaggtggttatgtctccttcaacctgtctgtgtaaatcctaccctttgaaggtgtgccgaagctgtttcatatcgtagttaaatgctttaaggcagatggtggctctagtttgaacccctgctttatacttaacagtgtgactttg

SEQ ID NO: 107825 - DNA, 1033 bp, Homo sapiens
gcatgaccacagccaacacaggctgcctctcattccaccacagagggtgcctcctccctgttttgcccaaattacactgtgggctaggtggactacctcttgtcagagctaaagaaatcaagcgagtgcagagggcaggggagagttcgctgcctgtgaagggccttctcaccgtcgcttcggctgtcatcgcagtcctgtggggtaggccaagcgaggtcacaggagaaaatgaggctcagcatgattaagcaccttgcaagccatgagctaggacttgaatgcaggctgttgtggctagagcctcaccttccttcacagctgctttgctttctttacttagcaacccatttccataccccaaattagaacactgggcctgacagaagacacttgttaagtcagcattgcaaggccctggtatatatgaggttgggaccctctgagacatcccctggaaaggaccattaaactgatttttaaaaccctgatattccatatatgggccaaaacattaagattctgtgaataggcaagatgccaatgggtgccagacatagttaaaaggggaacacagaaggaagtaggcctttagggcccctagaaacagatcttttgtatttttttaaagaagtgactttaaaaattatttggggctgggtgtggtggttcatgcctgtaatcccagcactttgggaggccgaggcgggtggatcacctgaggtcaggagttcaagaccagcctggccaacatggtgaaactgtgtctctactaaaaatacaaaaaattagctgggtgtggtggcgggtgcctgtaatccaagttactcaggaggctgaggcaagagaatcacttgaatctgggaagaggaggttgcagtgagctgagatcgtgccattgcactccagcctgggtgacaagagcaaaactctgtctcaaaaaaaaaatttataattaatacatccaaatgacagcagtcctttaatgttgccactttgcaaagatatgttgccattgctcaaaaacattaat

SEQ ID NO: 107826 - DNA, 1029 bp, Homo sapiens
aattagcaaattacctgaacagtttctgaaggatggaaatccccatagtagctagtccctgctcttattatttttttttttctaaaaacgtgaaggtaaataccttccactactcccactcccagccacctttggctcaaaccctgcttcattcttactaccacaggaatgcattagtattctcctctgtttttatttctgtctccaggcttgttgtgacttcctgaagcccttgttttctgacacttttttgcctatgcctgcatcatttgagatgaccctgtcaaatcagtccttagatcctttaaaatattaacatatctgaaaactcttcttactctgacacccctaaaatactctttatgtcaccaataaaaattagagcagatttacaatacacatcatgccctgagggggagttttttaaaagcactttcatcatttttccaagtctggggtaagcttatttctgggaaaggtagtgggtttggaaaatagcgggtaggaaaaaaattgtagatattgacgtagaaagagaaggaaacagaagtcaaagttaggtccactggtgcgtgaccttgcatttttgtttcatttcctcaataaacatttcttgacaaacagataataaagaattgcagatattaccaccaacctagcaggagcaagtctgtaatgctaaggttccgtggcatttactgtgggtgggggagctggaactgcctgccgctgcacttcacacggaggctgccctgatgcctttgactggattttaaaccctttcaggacagaagagggtcttgtttctctttacatctcctcggtgcctgacataatgctggacccacaaaagggctttagtgaatatttattgactttgctaaacttgaacataaatattaaccattcattttaaattccttgtagatgctggatattagacatttgtcagatggatagattgcaaaagttttctcgcattctgtaggttgtctgtccaccctgatgatcttataagtggaagctgga

SEQ ID NO: 107827 - DNA, 1009 bp, Homo sapiens
gatctcaactcatcgcaacctctgcctcctgggttcaagtgactctcctgccttagcctcccgagtagctgggactacaggcatgtgaccttatgttttaagggcaggtggatgaattccatgggagcagagagaggctggggtgactctgaaaatgagacaaaggaagttggaataggagatggggagtagagccggcatgaaaatgatggtcaggagtctggctgctcaaaatgtggtgtctggtatcacacagattctcattagaaatgagaatctcagaccccactctagacctgcagaatcaggatcttcgtgattaacaagagtcccaagggatgaatagtcttgggaaaaattgagacacttcactgtgtctcacgcccggagcaggaagggaaccttttttttgtgggaaccccctattgctgtgtgactctagtgtgccctctctcctcagcataccaggcagctttatccctgggccaggacccatccaatgactgcaacgacaaccagcgggaagttcgcatagtggcccagcggcgggggcagaatgagcccgtgctgggggtagattaccggcagcgcaagatcaccatccagaaccgtgagtgcgggggaggtgtcaggggaactgggggtggggggaggtgcagacaccaggcctggcaggctgagtcagcatgggatttcccatttctttctgctgcctgttggtctacttggtcactgtcattgtttgaggaaagtgccagcttcatagaatgtgctgcaccagctgaagtgacttccctggaagttggtctctggaccagaggttgttctgttgctatctatagctttggctaaaggtctaggggtgaatggttccctttgctttcctgagattcagggctaagttgtggatcaggtttctttgattccttccacaaattgctctcagggcctactgaaaccccaggtccctgagtttccttccggctattcctgttgttcacatggaagg

SEQ ID NO: 107828 - DNA, 1013 bp, Homo sapiens
gacgagaagggcagtaggctgacctaacgggtttcgtaggcctggttagggagcttgaactttatccttaggaaacgggaaaccattttaagaagagacatgatgtgaggaaaaaaatatattagcagtgtcacttctgtacaaatgtggctttattttgatacaatccttatattgttgttggatatgtcatcactgttaatgcactgtaaattcctgggagttttcctcactcctttcttcctatgtccctctgaggctgctgagtgcgttctcaccccaccccacccatagcctgcccaggtgagtaagaacccagactctgtctgtgagctcctagccaggtcaggcaggatggcaggcaatatcttttgcccatttgcattgtttttcttacccatgagcagagtaggtcaccttcagcattttctcctgctcttggctttagggtgcctgtccttgcttgtgacggtccagcacacagaacgctatgtcaccctgtttgcctctatcatcctcaaatgtgactacaccacctctgcccagctccaggacgtggtggtgacatggcgcttcaagtccttctgcaaggaccctatctttgactactactcagcgtgtgagtatccttacccccttggccctctgtgggtcccagacacctctgtgacatactgcggttagggttgagggattatttaggattacaaatcttggtagtgaggagaagacacaaagatcacctaatgtagttcctctgttttatagataaacaaacggagcccaggtagatgaaataatgtattcaaggtcacatactagtttattttaaaattttttcctgctttgttctcaaaaaaatttaaagaaacttaaacattagggaaaagtcctgcctccctgtccattcctggttccatgccaatgtgctgagctgatgatgcaggcccgcctcccctcacccccaccaccttagaatgcaggcaagaagactctacactcagcacaaatga

SEQ ID NO: 107829 - DNA, 1019 bp, Homo sapiens
tctgagattagtgtgtggagacatgagtcactaacctgggtgaatgactttgggaaaccccaagcatctgcccctcaaccaggtcttggcctctcccccggtaaccaaaaggatgttaagttcaaaccacctgagtggctatttatttcacttagtagtttatcaaaaaaaaatttaaagattgatattttcctcttttgaataggttgtggtgaaacatgggactgtcactggctatttatgggaatatacatttctttcctgaagtatctattcgaatagaaaaggtttattccctttaactcactttgagatatatattctactggaataaaagaacgcatgtgaagacgtacttatataatcatattcatttcagtaattaatgccagcattgcttataatacttaaaagtcagaaacaacctaaatgtccataatttggaaaatgtgtaaataaaagtggctcattgatggagtgaaatgttcatgcagttactaaaaaaaaatagatctgcatatactgatatacaatatatcattagtttgaagaaaaagtcacaaatcaatgtacataatatgattaatttaaaaaaaacaacataggaaaagatgtgaagggatgtagaccaaattgtcaacagcagtacctctggaaagtggaattcatggtgagcaaggaggaactttttacttgataccccctccactgtttgaagtttctcacttatttattttgtattaacaaacaaaaaggaagaagagcttctgtacaaaatgattaaaataaatttgtgaatgtcccttaagtgcgtgaatattcctcaaagggttaaatctcaaccatttagaaaacttatccagaagacatggtagtgtagtggaggtctaagcttaaatccagctttgctactttctagctgtgtggccttaagcagattacttaatctctcagaattttcctcatcaatgaaattgagagaaagtaaagcttatctcatcagtttcttgcaaaggtta

SEQ ID NO: 107830 - DNA, 1052 bp, Homo sapiens
tgcttaatagagtgcctgaacaaagtgagggaaagcttaatcaatattagctagggtgataatagtagtcaggaattagagccaggtaggattgtttaaagctaactttaaggaaacaagtttctctattcctccttcccctatggctaagaaatgtgagctatagtaacaggtgattatcaggttggaattctgaatctccttcttactagttgtgactttggatggattacttaaactgcctttgcctggaaaacaggtgaaattcctgacaagccaactccctgtgccctctcaataaggccaactattgttgggtggattaaggtcaagcacagtgtcaatgacacgctgcaactgtgatatgcactttggaaaaccctgtactagagtgtgttcattttggtccatcaccttgttctctcctgtctctgaagaagagtcaacccaattctctgattagcctccaagttcccacaattgcaaagtgtgaggcagtagtaaaattgtgtcatatttaggtatttgctggtcactgtggcttggggcccctaatgaagcttctgaggccagggagtcttgtgatattatcacagtccttgtgctctgagctgtgtagagatcacttgtcagaagtaggtgtgtgtggtcttcactcaggaaatactgggcataagtccttctctactcccccaccttttccttaatttttaagccaaacttcccaaagtgtctgtcaagatcaaactgaagatcaagcttcctctcttgctctcaatatctatcaaagcagtggtttctgattttttttcacagctcccagaaagatccaagtacattgtgacatgtatgcacacatatacagtttataaaatggaagcaaaatgatcacaaaaattttattactaagttgaataaaataataacaatggatattacatattatcttactgatattaaaattcatttaaaaaatcatccccacattaacaatatcacaagtgatatgtgaatatctgctccttaaaacattaaaataaggctaaagtaag

SEQ ID NO: 107831 - DNA, 1211 bp, Homo sapiens
ctaaatctgttgacttaggacaaaaatggtaatagccttttggagcctactaaattgaatttagttccaggcctgatttacgcaggataactcaatgacttttgtttctgtttcaatattttaggtgtttaatgaacgctgccgaattcacttcaagcctccaaagaatgaataaagagagattcttttttttttttttttttttttttttttaaggactgggtcatctcataagagctaagcatgacagatatcaacagggcgggctttctaggatgatttctgagccaacagtccaagaccttttgttgatttcagccccacttagccaagacctcaagtataaataattctgataattatggagaaatcaactgctattttatactgattctgtaaaaaaaaaaaaaaaaaatttttgtaactattaaaataattttctgactcagtgtacatatttatttgattgttttctatgttgagacagttctctttttatttatttattgaatttttagtttctatttttttaatatcctgtcaggttgcaagacagttctcataagataatttgcatgcactttcaatatctgatttgtagtgtattttttaatttttataaatttattggcatggatgtggacctttttggttattgataagtttattccttgatttatctttgtgggttgattataaaagggcagtattataagctggacaatgcccaaagaagttttcttttagtaccttaactgatcttattttcagatataaaaactaatttttggtggaattctttcctggacagtatttccatggtcatggaaaaggaaagcagaaattcaggaaagggaagagcagggaagagcttgcatgacagcaaatgagttagtaacaaacctgctgtaattacaggatttggtccttgcaaaaaaaaccactttctagtgtatggagtggttatgttactagttttctgttgctgcttaacaaattaccacaaacagtatcttacagttctgtaggccagatgggcagatttgactggaattttttttgtttagggtctcaaagctgaaatcaagctgagtcccaggctgggctttggtctggagtctaggggaagagtctgctgctaagctcattgagttgccagattgttgcatcgtggtcctgaggtccccatttccttgctgactgtcaggtac

SEQ ID NO: 107832 - DNA, 1054 bp, Homo sapiens
ttacaggcatgagccaccgtgtccagccggcatatagataatttatataaaactggtgaaagtctagtaattttggagtttgtatttcaacgcccttgaaggtgttgacaaaggaaactgcagggcaaaggctgttaaattggaaactgaaaagtcactgtttgcagatcaagtcaaacaacagagtgactcattagtggagagcaaagttcaaaactctactgagtgtttgggaatgattgtgacacacaatttgctcagccttgagatctgcccttgtgtctttagggcccagatagaatcaccaggatgaccactgcaaggagggtttagaaaccaatcagtgagttgcatgaggtttgctttctagcttgataacatatagggttgggggtaaccatggggtagtacataagcaaataaggaaatgtgaattttttttttcaattttcaagtttgctatgaagattatggaatcagagagagctcttggagatggtacagctctacctcttcattttctatctgaggaaaaagactcagagatacttgagatactaactgacacccccaaagccacaagctagtaagtggtagaactgggactttaacccatctcttctgaccctgcattcagtcagtttctttaagttgtgactaatagtcagatactttagtgagtatatttcatttatagacagatgccagtcaaaaaatccccactagtttacctgaatatttaactcaaaaaaagcaccttcgttgctggacctctataactgctgtcacatgttagtggccttaagtttacctgttgaagacctacagtctcaaagacaactgtctcaaaggtgacagtttgttggtagcactgataaaattgtattagaaattggctgtaatatctgcaatgttgtagaattttaaaaaataatccaaaggcagacagctctgaggaaataaatcccacctaccttggtggctttgtaaccttgtgtattaattgttctgaaaagtctgattttgaatctgtaaaatggagttgatacctaat

SEQ ID NO: 107833 - DNA, 1105 bp, Homo sapiens
ttataatttctttcacttgttgacaatgtgagacaggaaaaaatatgaaaggacaaagagaggaagaatagccgtttaagtggccaggtgtgtgcgggtggttgtagaatagaggaacacatgaatggaatcatggggaaagtcagtggtgtagggcagaggaaactgaagtgagaaaagcccagcttggggaatgcagaaggaaagctgaagtcaataccaggagcatattgaggaagaggacagccccagacctcataccttccaccctcagagatgctgccagttatgtttttagatgaggtagctgattcaacacaatcttctctttcatggtttcagtcgtcagaaattgttttagaaagtattgaatttctatagtctcaaggatttttttgaaaaacactaaaatgtgataaatttatgcagtttttttttctcctttcattcctttgttcttttagttgatggcagctcatgccagtagagacagagtcataaaaaactgtatagcccagacttcagcagtagtaaaaaacctccgagaagagagagaaaagaatttggacgatttaacgttattaaaacaacttagaaaagagcagacaaaggtaagttgaacagaattaacatttctcaggcaaagtttttccaattgtagccttcaaagtaagatttttaatatgaaaattttggcatataatatggcagttacttaaaaaaatgatcaagagattagtgcttcatttttagtgagctttattttattatgtttagttattaattggtaaattaatgtgcacttcttgaacaaatgcagcatagcagctttgtctaaaataagcacagtcataatttattttcatttctttgtttctttcccactattaaagacaagggatcactacaggtgaagtaccacatcagaaattctggggaaatcacatctgtacagtatctgccttttgagacataacctgagaaaaacatctctaatatattttggaaatagctccagtttcattgtgtagaaatctgctgaaatgtaatatagactatttaacttcaggatattaccctcgttagccataaaaatatagtatga

SEQ ID NO: 107834 - DNA, 1067 bp, Homo sapiens
tatactgccagaaacttctcccagagtttaactgaagacgagatgtagctgatgtccagcctttctctagtgacaagtgaaaagaagtacactgatcatatgtgggtaggaggggttgtgctgtgtaggtacttactaccagtctttttaagttccctgcccttttgatattatttttctgttggttttttttttttttttttttttttgagagttggaggctttctgaggtaagatggatccttggaacatatgagctatggttactaagaaaaaataaaaactagtagtacactttattggctgtatgctggaggtggaaggagcatacactgtttgctaaacaccgtgccagcaaatgggatttcaacatgagtaaaacagtcttaacccttaagacaatcacatttgagccaaggaggcagagttggtgcccactgttaggattaccattacttaacctacctattgtccttgaacattttcttatggttgcatgtatttggcttggtttcctcactcctgacttaaaggattgtaaaatatccaagagctttattttttacttaaatgcttattttttgtcactaactttccatttgggttatattcttttattttaaatacatataggaattactcaaggtgatgaggacaattgatgacagaatagtacatgaattaaacactacggttccaacagcttcctttgcagggaaaattgatgccagccaaacctgtaaacaactttatgagtctgtaagtgtattttttgagtcttttgcttctttcatgcctttctttgcaggctgaataagaaatcagttatcttgtaactcgactgtgactaaaggaatgacatcttttctttgcctatacctgatggtgtatataagttttgatctggttactacacattaaagaaaatgtgtgaccttacgcttgtgaaatcttaccaaacctgggaagaaatggttctaaagaatgggagcagttgttttgtagcctttaacttaaggagaccttatgtacaaaggaatgaaaggaggagagtgaaacagtgaagt

SEQ ID NO: 107835 - DNA, 1031 bp, Homo sapiens
aaaaagttgcatccatactgaacatgtacagacatttttcttgttatcataccctacacaatacagtgtaactaacacctatttacatagcatttatattgtattagatataagtaatctagagattatttaaagtatatggaaggatgtgcataggttatatacaaatattgtgccattttatatcagggacttgagcatccttggattttgttaaccataggaggacctggaaccaaacccccatggatactaagggatgacagtaattatatgaagaatgagttaataaataatgagctctgtgatactgtctcttactgctgcattatttaaagacaaatattgctgagggctttcataaccaaggaaacctctatccaaaaggcacaacttaacccttggcctcagaagatcagttcagtttagatagcgaaaaggaaggttttgaaagagaatttaaagaggctttttttttaaaaaaaaaaaaaaaaataggccagtcataggaggtaaagtggcaaggtaggtccctgtcttctacttacctatttttttttttggacttcccaaatagtactgccatcatttgtttggaatttaccacttaagcacaatacatatatccttcactatgtgtggtggttgcccaatgaatgcattgagattattccttaagaattccagtttacagagaatactattaaaaaaatagaaagatacaggacgagaagataatgaacttggttttagacctgatatttgctagtgttttattagtctgaattatgagccttctgcaagccgtttcacttctagattgaggtatagaaaaggccattaaattcactaattaaaaattagtggaatgatagaacagaatctagactacagacttagattgaatgggctaaatggtttataattggaaacaacctaaatgtttgttaatgagaaagtggccaaatgagttgtgcttgaacaggatagaatacttaaacgcaactatttaaaatatcttcagggctggg

SEQ ID NO: 107836 - DNA, 1114 bp, Homo sapiens
tcattcaccttcgtttgctcacaatgtgtgagggcagcccgaacttttgcctagaacctcttggagttgccttaacagctttggcacttttttccctgtgaagaaatgtgagcctggtgagacggtttacagttcttttccttctcccttttcaattttgaaagaaatcacttcctgtctcattacaccacaaaaacactgaggggctactatgttggacagaacattcactgttctcaacaggttcctataaataaaattcgaatctccttcttttcatagctgaaatgattgactaaatggcatgcctctactacttcatcacccacactttatttcgctacaatgtttccttccccaatcattttacctccctttttttctttctctttagcttttctggtatctcttctgtgacatttaagaatggcatacagttttcagcaattcctgaacaagtacattatcagtttaggggttgtcattatattttctagaatatagcactgtccagtaggactttctgtgatggtgggaatgttttgcatttatgctatctccatatgatagccactagcaacaggtggctcttgaatacttgaaatgtgactagtgcaattaaggaactaaattttaaattgcatttaattttaatttaaataatctcacatggctaatgtctgccatgttaaaggcaagctctagatcatatattgataattctctagtacacacagaaaaattgatacagagtcatgctccacataatgatgtttcagtcagtgactgactacatatacaacggtggtcccatgagattataacaccatatttttactgcaccttttccatatgtagatatatttagatacacaagtatcactgtgttacagttgcccacagcattcagtacagtaacctgctgtataggtttgtagcctaaaagcaatcatctatactatatagcctaagtgtgtaagtaggccataccatctaggtttgtgtaagtacactctatgatgttcacacaacagaatcacccaatgacacatttctcagaatgtttccttgtcattaagcactacatgactatttgataatccataggttccac

SEQ ID NO: 107837 - DNA, 1054 bp, Homo sapiens
tttggaaaaagcgggcaattcaaagctcttttctcgagccattggaggtcatggggggcgcgggtttggccttagggagcgaggctgctctgtaggaggagggaggaggggggtcatagttctctccgcggctctccggccttgtctgggaagctctgggtaatctgctgtggtaaagctcgggatgcgtggataaggattgtaacaatcttgtagcagttccctgaactcagtttccagcttctgccattcctctcctacttttgtaagtagagtttttgtgggagagaagaaggtgcagaagagctatttagttgataaaacatacttggtgcaatttactatttttgtgggacaggacgtatggaagcttggagggaggattaattatagtacctgctctagtgtcattgcccattagagaagatgtaatatttagaggttttgcctttttatgttcaaatatcagagacctagggctaattattaacacctgaatgcaagaatagggatctggttttgaccaagttgccattaaagttatctgttccaattcagtcataaatgtgcttctgtttagttacaaagttgaattccaaaatcatgatcttaaatatgtattgcattattaactaacccaagatactgaaaaattgacctatctgtagtaagctttgtactttgaacggtttgaaggtagtggtattcttgaatactgcctcagcctccctgtagctaggactacaggcacgtgtcaccacgcccgggtaattttttaaaagaaattttgtagcgagagtgtctcaccaaataatcctcttgcctcgtcctcccaaagtgttgggattacaggcgtgagtcaccacgcccggcctaaagtgtttaaaatttttgcaactcttattttttcattataaaaattagatttagtacttctgtaaaatatcctatttccaaattgaaataaaatccagaaaagagtgtttaaaatcgagtgcctagaatcccattttagcatgcattcaagaatttattagatactgtattagtccgc

SEQ ID NO: 107838 - DNA, 2082 bp, Homo sapiens
attgaaaacatacatgttaatttctcagattagcctgagggatgctccaacaagagatagggccactgagcagagtccaattatgtgttttctgataaaagcatatgttcattgaaaacactggaagagcggcatactggaatactggtttatctggtgtatttcgggagtttacagatcacgaaagttgcacatttcctttctatttcacacaggtactcccatgggtacatatccgctagggcaagggcccacggcgccacactccacaggaccatctccgaggctggctcaggatgcggcgccaggggcactaggctggcgccgcgggtctccagcgcgtggcgcacgtcctacacgccccgcactggcgcaggcctgtacaccgcgtcgcgcacgccccgccccccggcgccgcctgcgtccttcccactccaacgctgggtgacattgagctcaccagcgccaccgtccccggcgaagttctgcgctggtcggcggagtagcaagtggccatggggagcctcagcggtctgcgcctggcagcaggtgagacgccggtcgggatatgggaggtaggggagctggcccggccgctgcgggtgggggaatcctgaagccttcctgggccccggagtggctccattccatgacgcactttctcggttcctcagaatcctacctacttagtagccatgtgggagggaactaggtgagcagctgctgataggcattggagactgcccgtgaattaccctcatctccatccacccagctcccaccaacttaactgcccacgcgcctacccttctccccacccccgtcctcagcctcccctgagctcagtctgtaaagcacctactatccctagacctcccctttacccatgcattcagctttccaccctaacctcccctatctattgctctccttgagtcttccctcttccccctgctccttcctctctggagtttatcccagaaaacctccagtctgaagtttccccactcattaaatgtctgattaggccaaggatttaggtcttagagattaataataattgttttcttaaaatggaggatacattacttttaaacacttatacaattaattgattcgaatttcttggaggaagtgtgtaattgaaggatctgcagtttgttttggtggtagacatttgtgtgatgactattttggacttaggtaatgaaagcttaattctttttttttgggagaaccagcagagccttggcatagtaggggttgagaaatcagagggcttgcattttgactcttttctgggtaccagagatcttttgttcaatggcacacactacattattaaaaagttgttaattaaatttttaaaggaaaaatagccccaaacttggctattcaaataatataaatatatattgtaatgtaaatgaagtaatgcaaaaaaaaagagtgaatgttgcatagtttcacaagtttgatacataaccttccccacctcaagattatcctttacacagcttatctagtgttccggtagagaatggactggaaaacatgtctcaaactagagagtattattatatttacttcctttaaaagcaaacacttcttccactaaaatcctcaatactatgatttcattgattttgtcagttttgttgaactaattcacctaaaatatcttctgtacatcctattaacattatgaagcttttcaacaaggcaagtgaaaggatcattgctctgtaaaaaagttaaaatggactgcatgaaaagaactttgacatcttggaactactttgacatctttgaactaatactgagtatattgtaagtagttcatcttcttgctttgagaatatatttatgcatcttgcataaatatatttttgcatctctgcaaacttctgatgtgtaaaaacttcactattgaccacttaaccaaagcagaattccttgagtgatttaagaacaatttattttacttcagatataaaatttttaatagcacactaaggatgttatatgagcagctctctccatatgatcttccacgaatgtctgatgctttgtgagcaactc

SEQ ID NO: 107839 - DNA, 1155 bp, Homo sapiens
ataggaactgggaaagaagacattaaagaagattggtcatagaggttggagatgaagtgagagaatttggtggtacaatgtaaggaggcattgaatccttgtagaaagatgagatcagtcgaatcaaatggccacaaaaatgggaagagtagagtcagaagggctaatgatgagaatctaaaaaaatgtattcatgaccgggcacggtggctcaagcttgtaatcccagcattttgggaggccgaggtgggcggatcacgaggtcaggagatcgagaccatccttgctaacacggtgaaaccctgtctctactaaaaacacaaaaaattagccgggcgtggtggtgggcgcctgtagtcccagctactcaggaggctgaggcaggagaatggcgtgaagccgggaggcagagcttgcagtgagctgagatcacagcactgcactccagcctgggcaacagagcaagactccgtctcaaaaaaaaaaaaaatgtattcatatgactagaaagaggtcactaatgttggtagagtaattttagtaaaatgattggagaaggaaacattgtagcaaaataaagtgtgggtggtgaagtgaagtagtagatacatgccatttattcaatcatttgagctatgaaaaagaggaaataagaattttattaatagtacctgttgagaacaagtgaatgctttgtccaacatagtggaccttcagtgttattgtagagtaataagacagaattctcagtaactactagtagaagttactggagaagtagtcagcctttctggaaagtagtatagatggatagatagatagatagatagatagatagatagatagatagatagatagatagatgagatagatagatggaaacttaaaggggttcatacccttttacccttcacttccaggattttattctaaggaaataatcagaaataccatcaaagatgtatgtagagaactgttcattgaaacattacttataacactgaaaaattggaaagaaatcaagttgtagggaattactacattcagattatagctgtgtgtcgggttttatacagctattaaaagtattaatatcttggaaagtatttgtgacatagcaagatacagtattatctgattatgaaaaatgtatat

SEQ ID NO: 107840 - DNA, 1017 bp, Homo sapiens
ctaagaggtaaatagttttcccaaactcacacagctaacaagtggcaagataaaaatctagacccaagtttgcaggttaccaaacctcatactatactatcttgctattaagccatagttatttttatattcagcagctttggtcaaattcttcttttaataccatgtataattctatatatcacagcttccatgtggaaagtgatgtcttacaactactttaagatactaaaaaggtccttctatacacgcactcttaactgactttcttatcctcagtaattccagagtaaaaggaaatgtacttttggctgtcttcattcttgcagttaaatggaaatactgaccattttaggctgacctcatgggagtacgaaggggcaaatgtgctgagctgggtgaagttctcttgaaaactctgttcccaccccacttcattttttcttgtctccctctttgacctctcatgcatagttctcagattaaaaccagcagaaacatgtggacaggactgtgagcttctaggattctgagaaatttgcattgcttttgtatactcgattgtactagctgagtttaaatactccagaagcaaattattcacctggaatctcttctagcatcatccaggggtatatgctgtgtattttagagagttcttctcctgttctttaccataaaattgtaacattttagttttatggaatttctgtttccataaatactactggaatggagaacttttgaactcaatgtgatttggaagagaaaaattagccattgtatattttgctctcaccatcaacttccctttctccccccgctcccccaccccccgccacatacccaattcttttacatatgaaattacacagatagaaggaaatatcagcttagggtgctagtttcactatttggtataaaagtgttgaaactggcctgtatgtaagcttcatagaaatctgaccgtttacatggagggaaacaagggaagaggacggttgcctcccccactca

SEQ ID NO: 107841 - DNA, 1691 bp, Homo sapiens
ttctaagtccttagaaattcctggctggaccttgtcagaatgtttaaaaaactattctcctaaaagcctccatctgccagcatgttcaaagattatagaatgtggtctggctgcttctcagcgctcgctctattagggggcagcctccccaccagtacaccaggacatttgagaaggctggccctccaagctgcacctgggccatatactcaactggccttccttatctcctcaaaatgagttcgcctgtggagaggttactttgataatgggaagagaagtaagatatggtacctgcttctctgaagagttggtattcaagttgaaataaattgtttcatttttctccaaaaggctgagaggctacacttgacttggatcaaaacaataaaacacagtcattatttaagaaaatttatttctacttctacagcagaaatacggaaatggtacaggtttgggcaaatcatactttatgaaatggatcctcataccacatcctttttaatacaggcacgttataacataattcctggattttcaaaatccagccaacacggatacctctgctactctgttttggccttcatagctgcttcctctttcagacgagctttcttttctaagttcaagcttgttaaagtctcgtgtctttgggcagcctaaagcaaaacagatttgaacaggtgatttgtatgctggtcaggggagggtgtctttaccttgcactgatgacagcaggttaacagaggcatggaggcatggagtcctctgctgcttgcacactgagcacggcagtttcctctatgtgcttcaacttcctcgtacgcttccaagaacagcagctcatccactcaagcataagtaagaagtgccacacctctcctttttcttcccttctggcccctttctttcagtctttatcctctccttttctcttatactttcttctcattccaccccacttctcttttatactaaataccttctcattgccatttctatcccgtttttcttctttcacttttctctgttgctgccatttctccttccccaacttatctgcatactcagatccttctagttcctcacttctcttttaccaaaaacattcagctttgggaatcccagactttacccaaatactaccattgatgatttccacgagtatctgtactacaattccaacctttgagtgggggaggcaaccgtcctcttcccttgtttccctccatgtaaacggtcagatttctatgaagcttacatacaggccagtttcaacacttttataccaaatagtgaaactagcaccctaagctgatatttccttctatctgtgtaatttcatatgtaaaagaattgggtatgtggcggggggtgggggagcggggggagaaagggaagttgatggtgagagcaaaatatacaatggctaatttttctcttccaaatcacattgagttcaaaagttctccattccagtagtatttatggaaacagaaattccataaaactaaaatgttacaattttatggtaaagaacaggagaagaactctctaaaatacacagcatatacccctggatgatgctagaagagattccaggtgaataatttgcttctggagtatttaaactcagctagtacaatcgagtatacaaaagcaatgcaaatttctcagaatcctagaag

SEQ ID NO: 107842 - DNA, 1042 bp, Homo sapiens
cctcccgggttcaagcagttctcatgtctcaacatcccaggtagctaggattacaggcgtgccaccatgcctggctaatgtttctatttttagtagagacagggtttcaccatgttcgaggctggtcttgaactcctggcctcaagtgatccacctgcctcggcctcccaaagtgctgggattacaggcatgagccactgtacccagccattttttgactttttaataatagccattctaactggtttaagagagtatctcattgtggttatattttgtattcctctgatgattagtgatgttgagcatttttttgtgtgtgtttgttggccacttgtatgtcttctttgaaaactgacttctaatcttgaggcctattaataatttcatttgtctgtcactggacaatttctcattcctctcagtgactatcctagaggatcagtgtatttgagaaatatttagaagtaaagttgacaggacaggatgattgattaaaagaggggagcaagggaatttgaaataattccagggtttctggtttgggagatcagatgaacaagtgcataagcctgggatgctggtggaggactggagagacatggcagatgctacctgcacacttttggtaatattctgtgtgatgggatatgaaatggtccatagaaaaaaaccggaaaaatacgccaaggttaggttcattctaagagtctaaaaatttcaaaaaccaaaacaacattataaatggtgtttctcaaggacctttcactacctttttagattgtgcttgtgattttcaggcaagctaaatgtctgatgaagactgctcttcttttgttctgtgtctgacctactaattcctgcccatgcttcaaactcagttcagaaatcactgaaggaaccatccactgccggcctgcctgcaaccacagctgacagctgagttagttaggttttcctgtccctattatttaccagtttgtactgaaatgctttcatgggctgtgcttccagattatgagttctgtggaatcaggaagta

SEQ ID NO: 107843 - DNA, 1392 bp, Homo sapiens
ggtcaggagatcgagaccatcctggctaatatggtgaaacctcgtctctactaaaagtacaaaaaactagccgggtgtggtggcgggcgcctgtagtcccagctacttgggaggctgaggcaggagaatggtgtgaacccaggaggcagagcttgcagtgggtggagattgcgccactgcactccagcctgggtgacagtgcaagactccatctcaaaaaaaaaaaaaaaaaaaaaagctgatgggtatattttacagtaaagaaaaaaatttattaatatccaaccgacgtggaagctgctggttgccttaggctattacacagggatttttcctttttacatattgtatgtattgcataagtgacagatgagtagaaacaaagatgatttatttcttcactccatgactgcttctcttctattttgttgaagagattccactgaccaagtattttattctgaaaacaaagaacatttgaggcaaaacatagccttagttcctgcagactacattgttttataaatcgtacaaaattactgggtttatgtccagacgtggtggctcatgcctgtaatcccagcactttgggaagccaaggcaggcaaatcacttgaggtcaggagttcgaggccagcctggcaaacatggcgacaccctgtctactaaaaaaaaaaaaaaaaaaaaaaaaattagccagccatcgtaccacaagcttgcaatcccagctactcaagaagtcgaggcaggagaatcgcttgaatccgggaggtggaggttgcagtgagccaagattgcaccactgcactccaacctggctgacagagcaagactccatctcaaaaaaaaaaaaaaaaaaaaaaaaaaaaatcactgggtttacaagtttattaaagatagcttgaatgattgttgccccatttcacttgcattttgaaggagtcattgttttctctaattttaaattaatatacagtcatttctgtgtttttttgcagaaagtaaaattactcattcttattcatatccacttaacctgcagaaggccaatgtagtccgctgggagtcctcaataaggatcactgctttacccatcacttgggctgggcattattaagatacagtgatgggtaaggagaaaacagaaacgcaaaagaccgtaatgggtggtgagagaacagtaccaggtttgggagagacctgcgcaggctgaggtgtaaactaccagagtgtgaaatggttgcaagattaagttacgattatgaggagtgtcctcttgggaagtcaaaagtagtgtctgctgggcacagccccagtttacatttggagatcagctaacacctgtgaattattttactgccccctttcacttttaaaaatgtcccagtttag

SEQ ID NO: 107844 - DNA, 1057 bp, Homo sapiens
aaattaaggtaacatgtctttatttgatcatctattgtacaccagatacctggctaagggctttccttttttctcatgtagtcttccaaatgttctttgataattgtcactatattatagatgacaaagtgaagacttacgagaaattactttgccccaaggttacaacacttagatggctgtccaagggcggggaagagccctgcaaattctgtgtcttgaagaaagcagtggccacgcagtagttccgtgcccaggatctcccagaactagacttggcaaccacagctgggccagccttttttgttagaccattcttcctgactcctgcttaccatcagcacccttaaaatgacgaaatcaggcttaagttgcttttaggttacacagactggagtgtaggccctctcaggccaaacatctttcctcttctgtggtgctaaaattctgtatgaccagacaagtatggtaataggttttttttttttttttttttgtgcaaatgattttgtgtttagtaaaataatggctaaacacatggatccattcaaacgcacaaatgtggaaagtattgacacggaaggaaaggctttgaagaattactgcctcaggaagcagtgccatggatgcgaatttaacacagtctacttcttcctaaaggaatatcatcccaaggaatgtcaaaaattaaaatcaccttttaatgtactggttgttgagtgtttctgctttacctcaagtcattctgaccactctacatcctgcttcaaagtgttctgacacttagatttggaatggctctaatgattctttgtacttgaatgtggtctgtcaggccatgggtgagtgccttgcacatagtagacattcaataaatactaaatgaaggaatatgcatgcatctttgtgatgttagtaaagggtgcttgataaaagaaaattcaaaggaattcccttatgctgttacttgaaaccaggatcaacatcttaagcaaatgtctcaacgtgttttatatgcagttacttttcagaagacatgatttgacctgaagtttac

SEQ ID NO: 107845 - DNA, 1051 bp, Homo sapiens
gcctctcagattctgttaacttagtttaaattcactgaataccctaccactaaggcgttgctcattacaaaagcatgttaatttcaatacaggaaaactcttttgtagttttatatatggattggggaaagtgactttgttttacttttcctttttattcccctccatcctccaaacttccaatctatattatttgtaatgagaactttggtgggggaaaaaaagcattaagagaattttggatgtaaaggcatctggtatctgatggaccagcaggtagatgtggttggattgagaaattttgggtaaggtagatgatagaagaaagagattttaggagacacagttctctgtggaacactttctttcatgttcctgtaactaattgatcaagacccttttaaacgcttatctttgtcagttccgcttttgaaaaaactattgccctaggattgtttcttccatatgacagatgaaggttattggctctgagtcatttttggcattatcgtcacagataaaaagattggcaattaatctcataaaaaatctgaattattccagattgctgccgatttttgcctaagaaacaatatgtaagtatattttataaaccaaactttgtcaaccaattctattgtacgtctacccacaggcaactttgaatttacttctctagtgctaaataaacatttcagcgatttaatcccccaacttgggggatgcattatgaaaaggttttcctggagtcaaggggtttttctttctcgctagttttgtgaaaatttttatatcaataggcaaatcattataactttttaggggttgatggtttttaagtatattggaaattgtggtgtctaaggatgatgttcagtgaagaaaagggatccacttttagaaaccagcattgtttgctttcaactttcatactgtatgctaactcctacgttccaaaatgtgctcatttgcagacacaggtatgcctatatacatggaagtctcaaatctgaatttttatccatctcaatatgaccatttctctctgttg

SEQ ID NO: 107846 - DNA, 1483 bp, Homo sapiens
tgttgctggtatgaggatttcgaatacttagtaatcgaaaaccatatcctgtaatttaataaaaaaaactaaggacgaaaaaaccctccaattttcccaaatgcaatcagtgtaactaggggctgtgtttctgcattaaaataaatgtttcaggctttgtggtcctgatcaaggtcctcattaaaaaattggagttcaccctaggtgcttttcccctctgtgactggcagataacacatacttttgaaagtaactttgggatttttttcttaggtgcagctcgattctaatcttttcatgctgcacacgattcctttaatgtagcatccttatctgaaagaaataaccatcttctcaacatgacctgcttaacccaaataagaacagtgatcttataacctcattgtttcctaatcattttatttcatctcctgctagtactgtgccgcttccccctccccccacacaaaataaaaacagtatctgccttctggctcatttaatgatgactgcaatctgtacctgcaaatggcgcttccagtactgtgttcagtgatccacatttgtgcttggactggaatgaaaaaatacgcttaattgccaagacaactgcaaatgagttcaatacgacttctcggtgctagttggccatcttgactcaatgttgggatacactaccagagaagatttttttgttgatgtgctgttcaaagtgaattctgaaggaaaaggttgctcacctctgtttcagagcatacccttttaaacctttttagacttgtcctcttctagaattcattataaccccaaagtgtaaaaactatttggaagttgcccctgacaagctattatacatctctggtaaatcctgctgaatgtaagggatattcagagcttttcatacctcatcatgatgttatttaagcagccaacttatgtgacctgatttaaacttttaaaaaatccacttcattcaaactagaaagagtcaaagacaaaggacatttatcagccaagagtgtgacgcattcttcgcatctagtctgtagtagtgtctgtgctctgggatggataccgtctgatgtctgtttgttattgatggcgcagccactgcaaaactagtcaactcccatctataactgttactttttctagtgctgctttgtgctgagagaacattttagtttactgcacttgacctgtaaaagactgattctttgtaattttagggataaattaggtggttaatttaaagaagaaatttcaatgttgcctttacatcacattaaaatataacttctttcagaaggataatagaagcactgattcatagtaaaaatcttgtttttagctttgacttttttgtggctgttttttaaaattgtaaattactagtaacatgtcatttctataggatgttttaaattatgtaccttccattggatagttaaaataatttcattttataagccaatttgagtgg

SEQ ID NO: 107847 - DNA, 1734 bp, Homo sapiens
ggtattaataagtaagtattcctgtttttggaatgcataaattgtgaagagaaaagaatggagaaaggtgccagagaactggtttgggataatttatttagagggttttttgtttttgttttgtgaaaaggtatagcttgtatggttgaaagagtgcttgttttttgtttttttttttaagtctctgcagtgaagttgaggatgacttgctcactaatttcataagtttaacaaaattaaaagttttgtttgactacattattctttgtatttaggtacctagtagaactgggttgtatcaagccgctctgtgatctcctcacggtcatggactctaagattgtacaggttgccctaaatggcttggaaaatatcctgaggcttggagaacaggaagccaaaaggaatggcactggcattaacccttactgtgctttgattgaagaagcttatggtaagatgctttggttgaagaagtttatggccaagaatgaattgggtcatagatagagttcagtaaaaacaatactactactgctaggcactggatgaaaagaggactgttaggaaattgctgcttctgcagactggatattacttgcatatgtatttaagatgtcagtttataatactagctttcagatgtaatcccagcagtcatttctgtgctattataaaatacttatgagatacaaataatctttctttacatcaagaacagagatatatgacaaaatatagtttaggaatatatagttatggaatttccaatatttattgaagttttcaataaagattttcctttattcttcattttaggtctggataaaattgagttcttacagagtcatgaaaaccaggagatctaccaaaaggcctttgatcttattgagcattacttcgggaccgaagatgaagacagcagcattgcaccccaggttgaccttaaccagcagcagtacatcttccaacagtgtgaggctcctatggaaggtttccagctttgaagcaatactctgctttcacgtacctgtgtcagaccaggctacccagtcgagtcctcttgtggagcccacagtcctcatggagctaacttctcaaatgttttccataatactgtttgcgctcatttgcttgccttgcgcacctgctctcttacacacatctggaaaacctccggctctctgtggtggaatacccttctaataaaagggtaaccagaacggcccactctcttttacggaaaaatccctaggctttggagatccgcacttacattagagttatgggaatatacacatattaatgtggctccctttttcttgtgggggaataaaagaggactcctcctcattccctttaacatgggggaaaaaactgacattaaaagatgagactaaatctttatcttgaattttacacaactacttacgacaagggagatgtttagacctgttgtgtatacttcagagtacttttcatgagttcttccacagtgaacccttggattacctggtggctttttctagccagatttgcattaatccttactgagattggatggttttctttcctctattggcgccattcttcagatattaaagttaaaccatccactccctcaccttcagccttcagtgaatgtgctttctagttgtcaggaatgctgaagaattaacactttgactcctaaatgtgatactggtttgtagattcccttagagcagaaaggag

SEQ ID NO: 107848 - DNA, 1005 bp, Homo sapiens
tccttagcccactttttgatgggatttttttttcttgctgatttgaatttcttgcagattctggatattaaaataaatgggtatttttgtagttgtttttaatttggaatcatttttcactgaacaaaaccttagcatttttggtctttaacaaagtatctaaaatacagaatttcctagttttcacatttgtgaaagttcctttacctgtttagtccacaaagaatgtgttttgatagggagtcttactccaagaattgatgtatataaaactttgctctctgaaattattttccttgggctttgactacagattagtgcaagatcactgacaacattgccaaagatggaaatgccacttaggtacttgctgcttcatctttagaagtgtaaatcaccctagaagtcaccaagtacatgcctggttgccttcttgagtatctcacctcacttctggcttttagtctattgaatttcataatcatcattttccttttacaggtttctccatgtctgaatgtgctttcctggttgctgtttgtcagtgacactgatgtactggctgatgcctgctgggccctctcatatctatcagatggacccaatgataaaattcaagcggtcatcgatgcgggagtatgtaggagacttgtggaactgctgatgtaagatatcttttagaaagtgtgtccactttctctcccttggtactagttttctagctgctaatacttaaatattaatggattgtacatgataattgatttattgtgctttgggctactgtttttgttacttgtttattttgatgtcagatctgtttgtcttgttttattgaggcttatagagaacctcttagtcctctgctgttagcaggcctttagcagaaacattgggaaaactctgatatgtgtagttccaggctcatactggatggcctgagatcaaccaccggacatcagaaggcatactgccactaaaatagtcattccttatctgtctgtc

SEQ ID NO: 107849 - DNA, 1026 bp, Homo sapiens
ctgggctcttggcaacattgctggagatagtaccatgtgcagggactatgtcttagactgcaatatccttccccctcttttgcagtaagtttcttcttccttcttcctttttttttctttttgagaataaaaatgtaagagattcctcagaaagcattacatgtttggaaatcattttggattttctagtgttatttttaattccagatattttcttgtttagatcatttcctcaagcaccctatctttttccatgccaaaattctgaattctgaattacttgcatcagaattaatgaagttttaatgttctggagaaaagctatctgaagacatctctttatcaaaagtattattatttagtatttatgtcatcagataatcactgtctgttacatagtttaccattgtaccatcgtgcttttaggttattttcaaagcaaaaccgcctgaccatgacccggaatgcagtatgggctttgtctaatctctgtagagggaaaagtccacctccagaatttgcaaaggtaaggactatgcttttgggacattggcagaaaaaatacaattaaaagagtattgcaaccaatggtaaggtgaacaggaagataatttttgttaaaatttaaaatgttagaattttatctgtttttggagaaacagggttgttgttgtttttgttggttctctttattatttaaaaagcaaatttagagcatagcttgaaggtgcacatttacgatgggactgcaaataaagcatagcatgaaggaagaatttgtaaagcttattgaaattaggcttcatacaattagtatactgtttaggagactatcctttcagttctcttaaaacagtggttctcaaagtgtggtctgtgagttctctgggagtccatgagattctttttttttttccaataggtttttggggaacaggtggtgtttaggtacatgagttacttgtttagtggtgatttctgagattttggtgcacccaacacccaagcagtgtacgctgtacccag

SEQ ID NO: 107850 - DNA, 1050 bp, Homo sapiens
ataaagctttccagtgaaaagtatctttttcatccttattccctagttaccatcacctttctatgcaggcaacaagtatttagtttcctctaactcattctgaagataatctgtgcaataagtaaattaatgcatatattcctttttaacgcttttagaaaatatggtataatgccatattaatgtacactgtttgcattttgttttcatttatatcttgggagatcataccatatcagcatatgtaacactctctcattctttttatggtgtcatgtttactctttcttgaactgaaattttagacaccctgaatattcttctaggttgaggtatttcttctggatattcttcttttaaaattaatatagtactcaactgataggttatgtgcaaataatgatctcagaatctttttttcatgtacagaaaatgttactgttataagtaaacaaacttttacattctaaaaagataatgaaaattatttttatctttatagtttgaatcagcttgggtactgacaaatattgcttcaggaaattctcttcagacccgaattgtgattcaggcaggagctgtgcccatcttcatagagttgctcagctcagagtttgaagatgtccaggaacaggtaaaaatgaaacaaaaagaagcaggtgaaagaaagtttttggctgggcatgtcgctcactcctgtaatcccaacattttgggaggccaaggtgggtggatcacgaggagttcgagaccagcctagccaacatggtgaaatcccgtctctactaaaaatacaaaaattagccgggcatggtggtacgtgtctgtaatcccagctacttgggaggctgaggcaggagaattgcttgaacccgagaggtggaggttacagtgagccgagatcgcgtcattgcactccagcctgggtgacgagagcaagactttgtctcaaaaaaaacaaaacaaacaaaaaaagaaaaacaaaaaaaaccacaaaatttcccaacataataaggggctgagtttcaccagttggctttggtaatctat

SEQ ID NO: 107851 - DNA, 1034 bp, Homo sapiens
tcctgaattgcattgagaggttatcatcattgtgtactacttagtgataagcataactggcatgttattcttttgctaagatgtaataatttcttttttttaccatctgtattcaggctgttattcacttacttttcattttcttagtcattgtcacttgaattgttttgcttctctattttattaacttgtgtagcttctggaattctccctcatttcccctgagatctttggtgctaaactcaaaatagcagtttgaacgctggcaccaattagaattctaagtaattttttctcaccaataactctgtactatatccctgtatacccaggttattattataatttcttttgcatccaaatctcactgtaatctttttcttgtatacagatggtatgtattctgatcttattttttttccagattgcttttccttagagttttcatttatttgactttatgtttgcagtatctgatgactgtttattgaactttgagcctgccttgtggtgggacagtttgcttttatacttacatcatatgactctggtttacaaattaattttcctagtaagcaaaagaaactacatcttaggtgaacttgttttttcttttttagtataaataatctggcatactgttatttaaaatttcttgaactagatatccaaactacaagcaaatgaaatatttctgggtcagcattatgtttcaggaaactatgactgggcttcgtaatgtattagattaggaggctgtaacttagtccttgtctttgactgtgtaacattactcgagtcattagtcaaattgttggattttttttcagatagtttcctcatttgtacacaagaaaagccagatactttacatctctgggttgttgtagggatcatctgcgagtatgtgaatagtactttgaaaatataaagtggccgggtgcggtggctcatgcttgtaatcccagcactttgggaggcctagatgggaggatgacttgagatcaggagttcaaggccagcctgacaaacat

SEQ ID NO: 107852 - DNA, 1035 bp, Homo sapiens
gcagagaacagagcctgatcccctaagcaacctgccgagaaccagagggaccaaatgaggaaccttactgcagtttatcatttgaaatgctttgtaggaagagggaggtagggaaaattattttgttcatgctgaaaaaagtgtttctttcctgtctctgggaatgagagtagatgagagatactgaatttactccttgatctggcggtttttattaggtggtagttcttttatgcattaaatatagatggtatataacctttcagatctaaaatgaaaaaagtcggagaaatggatctttccccatctctgcattcccttgtactccttaaaaagtacaagtacattctccgacagtgccctcttctggctaagacattctacatctttttttaattcattactctgtaatcttggaacttgtattttaacacatctgaagatgaaagccttcagaaatctctaatttgcttctatgtaaactcccagattccacccttgtgcaaactaataattaggctgaaatattgcaaaatgattcctccggaagtgataacctcatgattttatgaggatagtcttagctgtcctaactctgagaaataaccaactgtttgttatctaagggccatctctagcttttttatgtgcacatttaaggacaccatggtgttctccctccactgtgactagtggggacctttgaccacctcagaagcaagggggcaaatatatcgagagagaccttaaagccaggagacttgatgatctaccatgctttcaaataattagacatgctctgggaagcttggaggttactccttcctctgccttcttggagagcagacagatgtaagctatccctgatactcttacctgcttactagaacttgaataatgcacctttggaatagggcttttgtcatttctcttccagaaggagagtcatgctatgtggtgccaagaggaaatttgatggctcagctcactaataaatcttgtggacaaacttaatttcttcattccatagataaa

SEQ ID NO: 107853 - DNA, 1046 bp, Homo sapiens
aagagcagttagacttaaaactcatgtacaggaaacaggctagaaggaagtataccagaacacttaacaatggtcttttgaggggttttttgccccctgctttttaggttttctaaaaagtggaggcagtaatttaatttttaagaatttttcccatcctttattctcatattgagacttgtcttcattgtgaaacatttcagactaccctgtcctcaaagtgataaacccaatttgacatttcatttgttttaggtagatttccagcatgagagatggtaaatggagggagggatgttaagaagttttgagctgttaagttcttgcattgaaatcaaaggattttttttttcttttattttatggggaaacagaacctaaccctcctattgatgaagttatcagcacaccaggagtagtggccaggtttgtggagttcctcaaacgaaaagagaattgtacactgcaggtgcgaataatttttatttattgcctcataacttaattccttttgaaaatttttattttgtacacaaatttgttactaatttttatctgtatgaagaattaagtttgtttataatgatattcctgacaactacattgcaagctgctttcatagctttgttaacatgtaggccttcgttatactctttattattattataatttttaatcatttaaaatgtttatgattgtggataatacttctctaatagggaaatgtttacagcagaggagccattacagccaggaacttatgtgtgggctacataaaatttggtgttgagggagttttagatgatacttggtggctttctcaggatggtgtaacatgggctagatcagagtcttattaattcccaaatctgttcctaattaattcttcctccaccccacaaaaagccgataaggagataactttgtcaggaatctgtgtacttattgctgtgtcaatttaggctttcagtactgtactatataagggattccaagaggaaattttgtaatctctggattcagaattttcttttttttttttttct

SEQ ID NO: 107854 - DNA, 1034 bp, Homo sapiens
tacacgccaccacccccagctaatttttgtattttttttttttttttgagatggagtctcactctgtcgcccaggctggagtacagtggcgctatctcggctcactgcaagcgccgcctcccgggttcacgccattctcctgcctcagcctcccaagtagttgggactacaggcgctcgccaccgtgcccagctaattttttgtatttttagtagagacggtgtttcactgtgttagccaggatctcgatctcctgaccttgtgatcctcctgcctcggcctcccaaagtgctgggattacaggcgtgagccactgcgcccggccttttttgtatttttagtagagataggatttcaccatgttggccaggatgatctcgatatcctatcatgatccgtctgcctctgcctcccaaaatactgggattacaggcatgagccaccgcacccggctggtaagtactttttttgatataattagtgtagaatggaatctgatacttgttatcaacctgggcaagtaaaaagaattctgaacccgattataacgttggtagtaaatacttaaaccccccagtattaagttatggttgtttagagtcattagtgatttaaaaaaatttaatatatcccttgaggttaagtggaataaaaaactactactatgacaaaaaaatattgtcttttgcagaccgcttattaaaaatatttgaaggaaatgtacacttcctcaccccttttaaaaaagtcttatctctttcaacatgctaagcttaatggttttcttctgtaatgtgcttttttttttttttaagggctttcaccattctgctaccttcctgcatgtattctggtttgccagcatacctcttaaaaatgtgataactagaatccaatatttcagatgtgttgttattaatgtagggtatggtgagaggttaccttctttgccctaagagtgtctattttgataatgtagtccaaggtagctagttattttgatagtcatggcatagtaatattttattgaattt

SEQ ID NO: 107855 - DNA, 1061 bp, Homo sapiens
agagtaagacagacagggtcttgggcttacaaggaagttacagtatactggaggaacacagaaaaatatctgggagtgtaataagggctggggcatacgattgaaatatggtgctgtgatagagataaagtggctactttaggcttggaggtcttgaaaagccatcttttaaaacttaacatttaattttgataagaaagaatagccagctatgtgatgagcaaggaggggaagagcaataagctccttgtcttatttactagtaagatcactttctactgtgagctttttaatgatagacaaagaatttggcttcattatattattaataatcttacacgtttctatatgtaaagattgtcctacctttatgtaacttctggggaagtatgattaacttaataacttggccatgatatctgttatctttctttcctttgaattaagggtgataatttattatatgttctttttgtttgtgatcgcagggtggtgtcatcacttctgacatgattgaaatgatattttccaaaagcccagagcaacagctttcagcaacacagaaattcaggaagctgctttcaaaaggtgagctatgaatatgttcagtatattttttcatctctctacaaaattactttcccatagtctgtttttcataccacaggtaatttgtgttggagtatttttatcaataaaagaataaaaatacagacatatatgtaattgtgaaccatgcctaaattttaagtttcctatttatttgtgggatctcaccaggatcagaaaacagaattattttcatttttgggttattttataaaagactttatagtgaatagtagtcagtatcatgttaattcaaattgagagactgacttttttttatagagtgactttaaaaatactccttgaaagagttatgattgttgattttaatgttagcaatttaccactgaaagttaggaatgcatttactggtgggcagggtgattacctttttttttttttttaaagacggctctgttgccagtctggagtgcaggctgggcgcgatcttg

SEQ ID NO: 107856 - DNA, 1095 bp, Homo sapiens
aaaactgttgaatagcacattttaataaaactgttaaagtaacctggccaggtgaagtggctcacgcctgaaatcccagccctttgggaggccaaggttgggggatcacttgaagctaggagttcaagaccagcctgggcaacatgatcagaccctgtctctacaaaaaataaaaaaattctctgggcatggtggcatgcacctgtggtcccagctactcaggaaactgaagtgggaggattgcttgaacccaggaatttgaggctacagtgagctatgattgcaccactgtactccagtccgggtggacagagcaagaccttgtctcaaaaaagacaggagtgggggaggggaagtagccatttctgatgtccctttgggatatgtctgggcatgtatatgtttaaaagactgagctcttagaataacagagctcttcacagtaaactcatttgttctctccccacttgtattgtagaaatcatgaccaccccaggaaaagagaactttcgcctgaaaagttacaagaacaaatctctgaatcccgatgagatgcgcaggaggagggaggaagaaggactgcagttacgaaagcagaaaagagaagagcaggtaaatcctttacctttattcatttcttttaaagaatttaatgttccattttaagcctgaaactatcttcattttagcaaagttggggtgtgtgtgtgtgtgtgtgtgtgtgtgtgttttccccttctcccctgtaaaatcaacacttttttggagtggggatgaggaggtactgaaaagtggtatacaagaatggggaaatctctcaggttctcattttctcagcataactacactattcaatattttcacctatttgtgtttagtgtattttagttttctaagggtgcaactttcttctttaagatttttttgatgtatgtttgttaattaattcacaagtgaccactaaagtgttgctgttcattgtaaacttaaaattggaaatgtaaaaatatacacaaaaagaaagaataaacctcatacataaaccagtcctttggattcagtaattgtcaacagtttgctacacttgcttcgtgt

SEQ ID NO: 107857 - DNA, 1066 bp, Homo sapiens
gcaaggtgctgtcatggtccgtttgggttgctgtaatgaaataccagagactaggtggctaacagacaatagaaatttgtttctcacagttctggatgctgggaagtccaagatcaaggcactggcagattcagtgtctggtgagagcctgcttccttgtttacagatgccttatcttttctctgtgtcctcacatggctgaaggagcaagcaaactctttggggggtctctttttaagggctttaatcctattcatatggactctaccactaagggctaatcatctctcaaaggcttcaccttcaaacactatcacattgggagttaggatttaacatatgaattttgggtgagacacacattcagtctatagcaggtgccaagaccattctgtggagaaagaggagtcttttcaacaagtattgttgggacagctggatagacacatgcaaaaaaatgaggttggactctcataccatgctacaaagaaaaattaactcaaaatggatcacagacttaaatgtatcagttaaaactcttggaaagaaacacaaggttaaggattcttggatatgacaccaaaagcatgaacaacaacaacagcaaaaaacagattaatttggacttcatcaaaattaaaacttctgtgttttaaaggacaccaagaaagtgaaaagacagtctatagattatatttgaaaagcatatctgataagggacctttatctagaatgtaaaaagaactcttacaactcaataataaaaggacaacctaatttaaaaatgggctaaggcacttgaatagacttcattttaatgggagatacacagttaccaaatacgtatgtgaaaagttgctctatctcattagtcatcaggggattgcaaaccaaaaccacaatgagttgccactcacacccactaggatggtttcaatgaaagttttaatagcaaagtgctggcaaggatgtggagatactgcaagcctcatatgctgctgaggggaatataaaatggcacagccactttggaaaaacagttgagcagtttcttaagcaattaaac

SEQ ID NO: 107858 - DNA, 1111 bp, Homo sapiens
ttgcattattttctttattctctgttgctctcaatggtccttttaccttttcccttttccctttacatttgagaataggattatatcttattctttgcatcttcagtgttttagcacagtgtttgttgaattaatgataaaatagagttttaatgatttatgatgtctgtgcttttaagtctaccagattgtttttagatgtatgagtactgtgtataaaatcagttaagacctttgattggtcttgcaagtaaagatgactgacctagtgataaagataactccttgttttgttttaaggtatctttgtactttgcatggtgttatgaatttagccataatagggaagaaaacactggaaatggtaaacagttaaattagctgatttgggctgatttctgtcttttgctgcagtaagcaggagatggcctgaggccaactgagggccagatagggcctgcattagaaaattttgaggttgtacattggaagagtagggatgaagactgtgggaatgtatgtttctttctttcttttttttaaagatgttacaaacctacaaaacaacatgaaaaaatggttctgtccaagtgttgtagactaattgggacagttcttgaaagcaggcagtaatccagaatgtggataatggagataatctccttcatattaacaagaataatgctgcccttcatatacaaagataagtctgcttactcatcatgattgtttttccagcgtgaggagggatatgtgctgagtccatgagtgcctatatactctgtgagcaacaaggcaggttggggtcagaataggcagcttggggtcagaataggcagcttggggtcagctagggaacagaaagacccgctgaaagtactctgacatctattgatgggtcaggttctgcatcaggtgctttcacttacttgttcttgcaaaaccattttgaggaggtgattacgtgtgcaaggtgattgggtaactcgccttacttcacaaagtagtggagttgggattcaaatagggctgtttgtactgtgttcacattgatcgttaaagattggttttagccgttcagtctctttggcagaacaaactagatgtagtt

SEQ ID NO: 107859 - DNA, 1100 bp, Homo sapiens
cagatccgggcagtcccggagggactcaggagaggccctggggcgagggcgggtgccggcagggcctagagccggggttcctgggccggacgctcgcgccgcgtccgtgcgtcacgggcccggctgtcctaacggccacaaggccggcggaggagagggtgggggtggggagccctggtgtgatcgccatcgggaacgccggtcgaggctaggcggggcggggcggcgtggcgcggcggcggggctgtaagcggcgccggggactgcggggcgccgaggcagcgggcggagaggaggcgagcgcggagcctgcgccgcggccgggcggcgggcgggaggcgggggtgggccgcgcagagcgctgtgacagaggcaggaaggagcaggggtggcgtgtaaaaattctaaccctggcaaaaagggaccgtcttgggaattcacaagttacagaccgggtcggagccggcggcccggagggaggtgggggaagcggggggtggagacggccggctgcagtttaccgatgtcataacaacatgggcctggagcggctgatcgggggtgtggtaattatagcaatgacagaacttggtctgcacgccgcgtgtgcgatgcgagggaagcagcgaggtatcggattaagctcaaaacgggaggaggaaacaaggatgactggagtcaaggaagtcgtcatgaagtaatgttttaggattgggtcgtgttccacttttaaatgaaagcgttcaaaatatttgatttttaaggtttcaactcagaacaaacgattgccgagtttttgtttgtattttaaagagatggggtctcgctatattgcccaggctgtactccaactcctgagctcaaactgtcctcttgcctcagcttcccaagtagctgggactagtcttgggcaaccacacccagctctgcagagtatttttttttctgaaacgtactgtcaagtaatattaacttgaatttcacccttttttcttaaataaacggttgcttaaaaatctctattagtagatgaagtgatttcccccctcctgttttgtttttttttttcttaagagatggagtcttgctttgtttcccgg

SEQ ID NO: 107860 - DNA, 1009 bp, Homo sapiens
gggcatggtggtgcatgcctgtagtcccagctattcaggagactgagatgggaggattgcttcagcccaggagttcaaggctgcagtgaactgtgattgcaccactgcactccagcctgggtgacagagtgaaaccttgtctcgaaaaacaataaaattaaatttaaaaaaagaaatgcatcggcccctagggaaatgacatagggccaatgtttgctggcacatttagtattttaagtgtttcgggcatgcagatttaaaaaaacacatgcttcctgccctcccaaacacagtgctttgagcaggatttccattgcattgtgtttactagggtgtattggttatcagtaagctgtagtcattccacttccattttttaagaaagccattctcatttttcacaggtggccggagcagcagcttacaatgaaaaatcaggtaggattacctcgctctcactcttgtttcagaaagtctttgctcagatctttcctcagtggagaaaggggaatacagaagaatgtctcccctacaagtgctcaggtgcgtgactgcagacccttgtggggacccccgcacatgcttcagagttggtgtggcaccgaccagcaggcatattctctcaaggcctacaccattcctctcctttgcccgtaaatgtgagactcttttaacgacagcctatggctgaattgaccagatggggtggccaactgattgtctccttgctcaacgagtactatacaagctaaatagttctggcctaattccaggggtcccccattaaagattttcaaccaaagctcaggccaatagggcctgactacccaattccggcttcgtttgggtaattgaggccacaagaggtctttctaggagactcagattagaaatgggagttgaagcaaaataaaagtaatgatcacattttatctattttaggatgcacatttttttttcacattttaacaatactgaaataaggtagtgtacctgttatcaattgatg

SEQ ID NO: 107861 - DNA, 1067 bp, Homo sapiens
atgcaaagaaagtaagtttctcctgtgtttcttattctttgtaactcttactgctgttaccactattatttgatcctaaaaagtaattcacattctgaatccatgttaaacttacccatttttgaaaatttgaatgtgttcatctggtaattgtgacctgttaccccttccctccctccaactctaccctttagacgggcttctgcgggcttttctcctccattgcttgatttaaccaacagcactgaattgtttcttgctgcccaaagagcagagcaaggccctgatgtcaagggctggtgaggggaggcggacctgtgaaccaaggagcaaaacttctccaaggcctccaaggggaagtttcaagcagaatcttaataaattgagtgtggcggcgagatggggaggacaggattggggggaaaagcacctgaggcttagggaccactgtggtctgaagcacagagtgggcctggggcctgggaggagaggagatgggtgaggggatgaaggagggagagcctacctagatgggcactgtccagcagaaatacaatgggagccagtaggttcattctaaaatttttgcagccatattttttaaaggataaagaaacagatgaaattaattttaatgatttttaggaaatttttaaaggataaagaaacagatgaaattaactgtaatgatgttatttagcttgacatatccaaaacttaatcatttcagcatgtaatgagatttttacattctttttatcataccacgtctttgcaacccagtgtttttcttatacttacatcacatctcgattcagactggccacatgtagcctcagtagctatgtgaggctgatagtccaccctggacaggacatatttagatggtgaaaagccttgaagagcagtgaagatgacctgaagggctttaagcagggaaagcaagaaaatgacttgccagatttgcattttagaaatatggtgctgacaaccgtgtggaggacacatttacaagcagggatgagtggcggcagagaggcctgagataaggtttttgcacatggctg

SEQ ID NO: 107862 - DNA, 1335 bp, Homo sapiens
atttttgtttttgtatttttagtagagacagggtttcactgtgttagccaggatggtctcgatctcctgacctcgtgatccgcccgcctcagccttccaaagtgttgggattataggcgtgagccaccgcgcccagccctggagtgatactttttatggaagacaaaagccccccaaatctgtgtaaaatctgctgcaaaggtgtcatccctcttgtgtcatcactggggttagaggtgggtccgaaataatcttctgtgtccttcagttggactctcggctgccaattgatctctttttcattgccatctctggggtggttctttggttttttgtgtgttttccccttcatctctacctgtgaaagtgaaattctattgtaaatgggaggaaaaagggttggttgtgaaaaattaaagacccacattctgctttcttactcatggtaagaaaagtggccatgagtagagattgggcaagcattggtaataaatggaataagactattattattattatttgagatggagtctcactctgtcacccaggctggaatgcagtggtgtgatcttggctcactgcaacctccacttcccgggttcaagcgattctcctgcctcagcctcctgagtagctgggattacaggtgtgtgcctccacacccggctaattttttgtatttttagtagagacggggttttgccatgttggccaggctggtttcaaactcctgagctcaaatgatcctcctgccttggcctcccaaagtgctggaattacaggcatgagccaccacacccacacaagactatcatttttaatgaccaagagcctagtatatagttggtgcctgtcttagtctgtttgtgttgctataaaagaacacctgagactgggtaattgataaagaaaaaggtttgtttggctcacaattttgctggctagaaggttgggcatccggtgaaagcctcaggctgcttccattcatagcaaagggcagccagtgtgtgcagaaatcaaatgacagagaggaagtgagagagagaggtgtcggggaggtgccaggctctttttaacaagcagttcttcaggaactaagagtgagtcactcccatgagaacagcaccaagccattcatgggggaatctgcccccatgacccagacccctcccgttaggcttcacctccaacactgaggatcaaatttcaacatgagatttggaggaggtcaaacaaactaaactgtagcagtgtttcataaaattgtttgcctgactcaggttgctagtaagccagcagagggatatttgcctcctaaatctttggcagaggcag

SEQ ID NO: 107863 - DNA, 1065 bp, Homo sapiens
ttgttgattttaatgcagttcctcattaatgctataccttatatttactctgtcttaaagccacgtttagatggatagccatctcattcttgtagccaagcatgtttattgtaatttttcttccatctctgaaataatttgcttgtcagactctatagggattattcctctgtatgtggtactttaaaaaaaaaactttaaacatgtcaaataatggaaaagattggagaaaatatcataaggtgattcatacttaaggccatgacttatagatagaatacatacttaaatttgattggtgaaatattctgcagctcttctagatggcaggtgatagtaaatacacaaaaattgtggttctaccaatagcatattcattccttctataacaaagcttatattaatgagagaacagaagatgaaattaaaacagactttattatctcttaaaaagccatgagacttaacagaagttaaaagcgtgtttttttaattcaggaagaggatcacctagcccgggtagaagaggcaatcacccgtatgcttgtgtgtgccctgaaaactgcagagaatccacaaaataccagagcctggttaaaccccactgaggtaggcggcttctggtcttcatcatggcagttagtttcctgtggtaaaccagccctgactagaacatatgttttccagtgtaactaaatgtatgtaaccattttaaaaggtttttctcttcccttaggttgaggaaacgtcccatgcagtcaactgttgctacttaaatgcagctgtttctgcattttttgatcgctgcagaacatctgaggtagtagaaatccaagcactgagaacagatggagagcacatgaaaaaggaagaattaaatgtgtgcaaccacatggaggtgggccaaacaggtagccagaacttgaccacaggaacagacaaaccggaggcagcaagtccctttggccctgatctggtccctgtagcacagaggtccgaagaaccgccttcagaaagaggaggcatatttggaagtgatgggaaagactttgtggacaaggatgg

SEQ ID NO: 107864 - DNA, 1015 bp, Homo sapiens
gagaatcaggcagggaggttgcagtgagccgagatggcagcagtacagtccagcttcggctcggcatcagagggagaccgtggaaagagagggagagggagaccgtggggagaggggagaggggagaggagagagagaggagagaggagagaggagagagctgagatctaattttatcttttccaaaatggtaataggattgtcaggaccatcatttattttacagtttgttttcccttcatgatttgaaatgtctgtttaatcatatactagatacctgaacatatctgggtctattttgtccattggtctttctgcctatttatttagtgaggtcttatgttttaacatcagtaggactgaccattgctttgttttgcagggtttttctggctattcttgcctctgtttttttaatgtgttctttaaaatcagcttgtctagctttaggaaaaaaaaaaaaaaccttttgattttttttttgatccatattaaattttatctgagctttatgatgttgaattgttctgtccacaaattaggtgcctttccatgtatccaagttcagttttgtttgtttttgtttttacagctgtgttttaaagttttcctcacataagctttgcacatttcttttaaatgtttattcctaaatacagtagtatctccttatcctcgggggatatattccaagatccccagtggattactgaaaccccgagtattaccaaacccgattgtaatcagtcaacacttttctgttcatgccttccacctacaaatgtaatgtcttagctaagatgcaaacttaatccattttaactaagcacttatgcactgtggctgcagcttttgcagtttgaggtgtgatagcaaaactaccataattttttctcttgacagttttgtagatagaagatttcttcttaccatagaccttagtaacctcagcatgctggttttccttctccttattaagtcgagaactttcaccttttcacttaaaggaagcact

SEQ ID NO: 107865 - DNA, 1044 bp, Homo sapiens
aaaagtagaaattgctatgaggaggagggagagctattatgtcaagaatagttctcttaatatatagtgcctaaaactgaatatcagtaggccttatttggtagagtataagatttctaccccacatgatctcgatcctaaatatctccagtgctgcttgtaatattgggttagttttttaagtaatctcatctcactttagtttcatattcaactttaaaatatctgtgattttttttcacatgatctgctgtcaggcaggttgaatcctatcctgtacctataaagctgattttaattctaaatccagtatttcacagtcatccctgttaattttcatcatattggtttggttgagcattccagcttgacaagataattttaaatttgggtcttatctgtcattttagtgaaacttcaagctggcctgtgcccttttgatatgtccccgttaattagactttgagtgtatcctggctttctggcacaggaagatatcccaggataccctttctcctttagtgccccacacttggaagtcaatcatttctccaggtagccacagttctttttgtaggaaatggcatttagaaactgagatctcagctctaaatctgttcattgctcctgggtgtcagtgtttctaggctctttcagtgatgtagctagaatgtgagatagatagatagattagatagatagatagatagatagatagatagatagatattgatgtatttatatttctaattcatgtgtttaaaaaatatatctagacaggtaatatgctgacgtcataacaaggcttaagggaggcatgtctcacacatgagcatgacacccaatcatcagacttatgaactataaaagtatctaattcaagtttaacatgatagaattttttatttgtttctgtatttttatctcttctcttaacactgaaaatctgggtccttaaaaacagtaacataaggccgggcacggtggcttacgcctgtaatcccagcactttgggaggccgaggtgggtggatcatgaggtcaa

SEQ ID NO: 107866 - DNA, 1063 bp, Homo sapiens
tttttttttaagtaagtgcaaatcatgcttttaaaagatatataaggtctggctgtacaactgggtaattaattttttttaaccaatgcttcagtatttttttgttgcagtgcactataacgtatgcattctgtcttctgttaatggatgtttaggttggaaattggaattttagtggtgtgccactctctttcttttaaggacacagaatgcgcctgatgctggcatgcagggtcctttcccttgaccagtgttgttaggaaaattgtattgggcctggccagatttgccgatatgtgtcccttgttgccgctcctctttcacaccatctgggctggaaatacctgcttcttggttcagggtcattactaattgcagaattctgtcttggcttctacatattctcaaagcggagtctttctttcagtgctaggtttttatcatttcatttctgccagaagcctttccctctgatgtgttaagcttaatcctggttgcctgctctatttgacaattagaatagctgcttgttatgctcaagtctgtctcttcaactggggccttaattgcagctgcctctctttaaccagaggccctgactgcatctctgctctccttgacctgaagcctggattgcatctttctgctctgtttgacagccgtatcctctccctagtctagtttttcctatcctttgctaataggaatggctttggaatcagtggaacagaaggaatattgttacagaaagctatgttgtgtgggcttagtgaagagttgtagcccttgaggcttaagtgagaggtatggcaggagatcagtagcgtcacagaaatttcgcctatagcatgctgaactggagttgcagcagatgtcaaggtagaatccatggagaacttccactcccaatgccaaagtcatatctacaatagccctgacaggtgcttcacctcccaaggaagttcgcttgttgttaaagagtagagctgtcatctttttaaaatatttgaaaatacctccaagtttttccataatcttttcttcttccatgctcaaaacctct

SEQ ID NO: 107867 - DNA, 6104 bp, Homo sapiens
tatgtacacaaatatctgcactgcttagaggaaatacggctttctgacttcttcggttgtgtctcagagatatttgaaataatgccatttccgctgcattcactgttctaactgcccaaaacacgctttccctaaatatcagcataatcctgtctgtttattgtctgtttccaactctgaaatgtaagcttcatccgagtaggcattttgtctcttttgttcattgattcattacaagcttccagaacagtgcctggcatgttgtaagtagtcagtaaatatttgttgaatgattactattagtgtggttattcaaatatgttattggctaaaaagatttcttgaactgccctggaaacctaacctcttccatctgtagcattttccataatagaatattccaactgctaaataacagatgtgcaagtgaaaatgggcagcattaccatacagagaagttggttagttcttgatggattgcaactttatttcaaaacaggatgtgaaatggtctgacttcgggtttcctggaagaaatggacaggaaagtacattgtggattggctccttgggagcccacacaccctgtcatctggactcctatggttgtaacttggtattccaggtacaaggaaggtaatgtgtgtgtgtgtgtgtgtgtgtgtgtgtgtgtggaacgcacatgtgcatgcatgcaataggggtggcagagagaatagggcaataccccaaggtgtagtcccagccccatcctgtcagcctgcctcatgattagggcagacctcttaacctctggttttggtttctcctctgtgaaatgaggacagttaaaatggtggtttacaggtgcgtgccttgtcatgatcaggattgtcttcagagagtttattctagaactctgagattccactcccaggtcagctagacagctctctgcttggtcttttttttttttttttttttggtaaattagagacatttgagacagtcttgctctgttgcccaggctggagtgcaatggcatgatcatagctcctggacctcaagccatcctcctgccgcagcctctcaagtatctaggactacaggtgtgtgccagtatgcccagctaatttaaaaaactttttatttagagatggagtctttctgtgttgcccaagtatggcctcaaaccatactcctgccttggcctctcaaagttctggtgtgagccactatgcccagcctatgcttagcttttcttttttacataagagtttgtagttttcaaacttttatttaaaaatgggaacaccctttcttcaaatctaaataaataagagcagagcagtttgttgaaaggaagaggcttcactgttgccctcaagctcctctccaagggatgccagcgatcctggtttgaaaaatactggacgctttcaactctaaattttagtttgtgcctacttgacacaatacagtgtattgttaccttaggtcagtttttgtctccatctatctgtggactctagaagatacgagggataggcagtgcttttgatatacctggtttctggagttctatgagagtctaagtgtttgtgccacttggaggatgtactcagatgtatgtgcagccttattttcccctaattaatgatgccccagtcttttctcctggtcatgtgggacatttacagggcagcacagagagtaaaacagaaaaggtcatgtgcaagttctcagacctattagatgtgaaaaggattatgagcagattcaggagaaatagtcagtatgtctgtggatacatttcacatgtgaagaactctgagaattacagaatggtagaagttagtccactctctgatgcattccgtctttattaaagggcatagaatgtgtcaggtacatagctacacgctgtggatgcaagagtcaatcagatgagtgtggtctctatccttgtggagttaacaggctgaaaccttaaacttggtaagagagacaacattttaagtagctgctgtccatgtgttctgaattggaaacaagccaaagaaattcaagttggaaaaacatcaaaaaatacctgaattctctctatgatataaagttaatatcactttattttaactttgtaataagacattttctggccttatataactctggaataataaaatagctttagtaaatatccattgagtatccttctgtacagggaccatgtgttacagtaggtacagaggtgagggagtaagacaccctctctatgatgggagtttacagccagagtgcaaggcaagccgacagacatccatgatacaaggcagaatacccatgctctagaggaaggtttcacagagctgtgggactaaaaagtagaagagatcatgttcctgttgtaaagatcagggaagatttcacagaggagctgccatttgtggtgggccttgaaggatggataagtgctcaaaagacccagatgggaagggcagagggaccctgagaaagcatggggtgtagagaggaccccttgagttgtccagtatatgttgtgcattggagacagagggagtagaccagaaaggcaggtaggttgagtccccagggtcttgacttccaggcagacactgttattctctgttctttcagcatccagaaccatgagaagtttttaaagcaggagatcacatgatgattgaataccttttctaatagaaggattcatgcattttacattttttaacccaaacaaagcagattggatgggatggttatcattatggctgttcctttgggaaatattgctgtggtgcaggggaaggaactgggatctggagaagccaggagatctgtgacctagctctgaatccaccactaccccagtgagtgacactgggcaagctctgagtctttctgccactactttggaaatgaaattagactgatgatctcttcagagcccttccaactctaacattcgaagcatatcaatactgaaaactgctttcaaactaatcatacagtggaatggagcagctcttaaagcttaaattaagttaaagctttaagattaggcaaacagcttttgaacctcaatggtttttaagctgatggccgtgtaaattgataggctgccttatagctccgaaatgaatttttttttttttttttttagatacaaggttttgctttgtcacccaggctggagtgcagtggcacaatcatagctcactgcttcctcgaactcctgggctcaaacaatcctcccacctcagcctcctgagtagctgggactacaggcacacaccatcacacctggctaattttttaagaaaattttttatggggatgaggtattgctatgtttcccaggctccgaggttgttctctatcctggcctcaagcattccttctgcctcggcctcccaaagtgctgaggttacaggcagtgagccaccatacatggcttgaatgtaaatgtttactgaagagtaaagaatttcactatttctataaaaccttcaaatttccaaagcaaaataagacttcagcatatacttcttagttcgaaaacagcagccgctgtttcttggttctgaaaggacttgatagccccattctaacaactgcaaggggtcactagagggctttgggcttcttttctcagaactaggtttttccctcttttctctttgcctccccatctagacatctagatgtctgggtctcatttttttctcatacttctctcgcttttgcctcagatgtcttccctctattggcataaagcataggagtgtctagtgttttgtgagttagaatttattacctccattttcaaaactgttttaaatgacaaacattttaacagttttctttgaaaattcctatattatactgctttatttatgtggcattatttgtgcatgtccactccctaatggatcaacttaacaaatgtttaacttaaggaatttataacccaaacagggagaagtctggaaactatttggtggatagaactatgagtgtttgctctgaataagataagaatacagatatttgaaagggtgggggttattgtgaatagctctagagtcagggatgaaaactatttatgagaaggcagactttgatttgagataagaaagaatgatcttatgaactagattctatcccagcaatgtaagaggctgcctcatggatgtcctgagacatccatgaggcagccccttagttgctacacaaccttccacccggtatctgcagagggattctagcgctgagtcagagatggacaggtgaccactgatggtgcctatattcccttagggattgaatttaaacaagtaaaaatgaacacttagcttttgtcttcttccatgttttgtcttaaggtcagagtactaacttgtatcttttttttttttttttaattaggaaacgatggcatctctttcctcctgaagatactcctttcctttatccaactagaatcccttatgaagaatctagtgtgttcagtaaaatcaatgttgtcaatcctgatttaaagcgttttcctcagttccggaaagctcaaagacatgcggttacactgagcccaggacaggtaatagggctttaaaacattaatgacctgccaggggacaccacagctgtaactctctcaagtccttatgctgtgtgcttcccctccctgcgcagtgcaaatgagaatggcttccttccctctgctctgctgttggaaggtagcttccccagttgtaggcttcagacacatacacctctgcttcacaggtcctggaaaggaaatggcaagagggaacacagctcctcctattggtaaagaggagaatggactttggaggaagacagtctacaagagtcattttcatttaggtcaggagaaaatgttcaaggcatgggtactcgagcatctctggaacatttaatcacagttagtatctgttcaattatgatagcactgaacccagacacataaacacaggtcggaatgcctccaggtgtgggccaacgggcagaaggaaccgagaatgtttgcttttaagcaaaaatggatgttgttttcataaattactaactctgaaacatttccaaaggtactgtacatagtgctgcttcccagtgaggaaaatttccttttcaacattggcacttgctgtctgatatttcattaataatttgaaaggttttcttagtcacttaagaagattttattctctcgattatccctctcccttgcctgtcttccatccattgtaccggtctcactggctcttttcctgcttccttcactcaagtactatcaactcaaacaatttcacttgactgagttgcctcgacctgttagtcactctgcattcccctctccccacagcccctgacaacaactaatctttttctatctctagatttgcccattctggacatttcacacagtgcaatattataatacagggccttctgtgtctgacttctttcacatagcataatgtattcaagggtcatccacgtcatagaatgttactagcacttcatttcttttttatggctgaataatattccattgtatggatatacaacattttgtttatctgttcatcagttgatggacatttgggttgtttctgctttgttggctattataagtaatgctactttgaacattcatgtacaagttttgtgtgtacatatgttttcaatactcttgggtatacctaggagtagaattgctgggttatatggtaaccctgtgtttaactttttgaggagttgtcaaactattttccatagcagctgtactattttgcattcccaccagcattgtatgagggttccaatttctttttatctttcccaacacttgttttgcttttttatcattatttttacagccattccagagagtgtgaagtggttgccaattcattttctcttctgtgtttaatagccaaatttgagtgattggttttgcctattgtatcagttttccttacatcctatccattctttaatccactcaaacccagctctttctgtcaccactttactgaaactttactctgataggacatgcataacctactaatgac

SEQ ID NO: 107868 - DNA, 1032 bp, Homo sapiens
tgttacatcatattgaaaggctctgtttatgggattatcactcattattagacttgaagggttggcctgtgttatattaatttttgtatccccagcacccagcatcataccacgtatatggtaggtactcaaaaatgtcattggcctgaactattttaaccatcataagtcaacagattcttctttccctcccaagcagccagtgtgttccaagctgtaaccctgagccaggtactaaattaggcattgagaaaacaggggtaagctcccagtatggagcttataggctacatgcagagagaacaggatttttgccacccactggaactgccacatgtgagccatgtgcatttacagtggtgctgaccttgcaaaaattcccccttctatgacagacattaattatgtgcacgtattcagccattttcatcactcaaagcaaaaatgaaaaaaaaaaatgctctttctagtcttcctcaaaaccatccattaaatttctctttaaaatcctttctctttgaatacagctgttaatgttttccctctaaaaatagaaaatttagactgtagttactgataaaaggagtgtcagcattgagaacgatgttctgcacatagaagtggggtgtttttttttttgcttttattttttaaaactgaaaggaaaacctcatgattaaaataaaaataaggcagagccatcatgcctggttcactagtatgttttttttcttttctagcttataaatctgtttaatcacatggatttgggtttatgtgtgaccctatttttctgtgctgcaaatgcgccatcggcttctaaaagtataggcttttcccagtagttgacttgggcaggatttgctcacagaaccaggcatatggagagtcttaagtccagagcactatgctgtctctgttctaaagatcattgcacttaagaagttcatgactttggggagtatattgaaagccatccatggatgtatatttcaaaagatgtattttgacaccctcatctgaagactgatc

SEQ ID NO: 107869 - DNA, 2741 bp, Homo sapiens
gctcccaaactgaaccccagatacagtctacacagaacctgtatccatggaattgtaacattccatgacccgcacatcataccattaatgcactgtcagacggcacttttctttttaagcaactaaattataccaaggctaatattgggcctccctgtctcttacttgcagactgttgcttagcatatctcttcagccttgacttatagtcaaggactagcctaatatttcctaattttccttgtgatttactatttgacttatggattatttggaagtgtaatgtttaatttcaaatttttggggatttttcagctatctttttgtcatgaatttttaatttaattctgttgtggtgagagaacataatttgtatgagttaaatccttttaaattattgaaacttgttttatggcccagaatataatcaatcttgataaagattccatatgcacttggaaatagtgttttctgttgttgggtggagtgttttataaatgtcaattaaatcaagttgattgttcaagtctcctgtatccttactgattttctgtatatttgttttacccattatagagacagaggtattgaaatccccctactataattgtgtatttgtgtttttctcattttaggttggtcagttttgttcatgtattttgaaactgttattgggttcatacacatctgggattattatatcagcttggtgaagtgaccttttattgtgatgaaataccctctctaccttgggtttacttgttctgatgttaactatgtctgtctcctcctttgattagtgttagcatgaaaaaggagtacttactatatgattccatttttatgaaattctagaactgccaaactaacctgcagtgacagaaagtagatcagtggtgtctgagaatgagggtgtagggagagacaggttaggaagggacactgggaaccttctggacatgatcaaaatgtctgtcatcttgaatgtggtgatggtttcttgggtgtaggtatatgtaaaacttaatcaaactgttcacgttaaatatatgctgtttattacatatcagttataccccaataaagctgtgtgtgtttttttttaatacaatactattagtacactttggtcccactgtctcgacactagcagttttgttcaccattgcatttgtattatcagtgcaaatgtcaacactgtgaaataagcaagtatcatcttagaagtattatgaaaataattttgatctcaaagatcctctgaaagggtgtcagggacccccaggggtctatgggccactctggtttacaacatcacaactgtaattactctatttttttctgttctgactcctcctctaagtaattctaaaacagtttcttatgaaaatacattttaaatcatactccagattaaaattaaaatactttaatcatgttcacaaacattttataagttaaaattatataaggatagcatttaagaccctcccaagtatggctgatgccgcctgtctgctccacgcaaggccctgtccaatctccccactgacctatgttctctcttccctcctggcctctgctcatgcccccttcaatttctgcctgttaaagttctatgttttagggcctggctcaggttcagccttggctatgaagccttctcaaccgcttgtccccatatccatctgtcccttgccttccttcctatatgttttatttggattactatttaaatggtaagcaacacagaacgtttgtgttctgttcctttaacaatattgtaagctctttgggcaatgttttataattttttattcctgcaaactgctaacatagtgctgaatacataataggtatttgaatgattatataagtggattttttcctactctatttcttgttttgatatttctctggtctttaggacccctcagagaatgttttgacttaaacccctagcttcacctttgtcaaattttctgtggcttctagttaatcagtgtagcatttgtcagccttggtaagaaattcttaatctctctggccctctactagttttttaagtttttacttatagcctctacttgaagtttcctcttattaactcttttcttccacaaattaaattcatccatgaaaaatatgtacattgataaacatactaatatgattggaaaatatcctgtagccttgagatggcctaaaagtatgattttgacacttaactgacttttgtgtatagcaaataaaattaatcttattattttttagttatacatcatatcattgactaaataaagcatttgttttgaacattttgttctctactttcctagaaaggtagggaatttgtgacagtacaaaacaaaatttcttgctctcagactcattaggtaagaatgacaagttttaccttttgcaattatcgtaagtatcatcataattgaagttattaagaatcaacatgtaacaaaagggattttgccccaaggatgcttctcaggtagattccatttgatattgtgatttgaattggctactgaaggtcaggagcctcgttaagtcaccaggacacagaatcccaaaatacagtagatggaagattagttgtaacatgtcttggactttaaaacatagctatgagagcatgttgaaattgaggcaggtgatttggtaatgaataatggcgtctgatggccagtgatgctttctgatgagacaagttggaatgtaagaat

SEQ ID NO: 107870 - DNA, 5332 bp, Homo sapiens
gtagagacagggtttcaccgtattgcccaggatgatctcaaactcctgggctcaagtagtcctcccacctcggcctcccaaagtgctgggattataggcatgttccactacgcctggccaatgttggtatgttaagagtttatgtatattgattgtttactatgtgccaggcactaagtgctttacaaaaattgttaaaatttaaatagttcttgaatatgtacattttaatcttttagataaatgtgccctagttaagttcttctgcttctcaaagtgaggtgacaagttaaagtggatgaattaggatgattcgttgacatacaccctgcctctattacctctctgccattctgtggcttaggaaaaagaaggtaaaggaaaaagattattggataattctaagcagttacaggcagaaacgtaagaaaagataaaagctgttgaaagaagaatgtgaatattcttctcttcctgctactgattcagctaacttttaaagggttccaagtaaatatatgaatggataagaagtactaataatagtgcctaacattgactgggcacggtggcccacacctgtaatcccagcactttgaggcccaggtgggcagatcacttgagggcaggagttcaagatcagcctggccaacatggccaaaccccatctctactaaaaaatacaaaaattagccagacgtggtggcacatgcctctagtcctagctacttgagaggctgagacgcgaggattgcttgaactcgggaggcagaagttgcagtgagccgagattgcaccactgcactccagcctgtatgatgagcaagaccctgtctcaaaacaaaaacaaaaaataaaaaaatagtggcgaacatttattgaaatctgctgtgtcaagcactgtgctaactgatctacatcacatcctgaaaggatttcatgttttgtaaaggaagtcataatcagatttcttaaatattaacttcctctgttcatttaagttgcaaaaataaaattaatttcatcattcttttagaatagtttttgtgtcaatccactgactccaatcttgactcattggagtcatacccataataacaagccactgtggacagataatacatcttttattgaagctttcctgatcaaccctcatctctagtggtctttgccttttccaggtgtcagcagcataaaattttgcatttaactgtatggtgcctcaagtttttatttactaaatcctcaagtttggattattaaatctactcatagggtagtctttaatcttaaggttaaaactgctttatacttttatgtttaatcctgagtattgtgaattttgtaaatggcactcattatataacaagtacaaattaatttttaaattttttaattaatttttttttggagatggggttttgctctgttgcacagactggtctcaaattcctgggctcaagccatcttcctgcctcaacctccagagaaactaggattacaggcatgcaccaccacacctggctcaacacgaatttttaattagtcttcaaagttaattttttggttgaaattatctttattttaaaaaaaaaacaataattaggaaatgtgttcattatacatttaaggttgcattctcttacattgcagttcctcagtttgaaactacatgtaattacgtagaagctacactcgaagagtttctgacctggaactgtgaccagtctagtatttctggaccatttagagattatgaccattccaagttctgggcttatgctgactataaatattttgtcagtctatttgaagacaagacagatcttttccaggtaagtcagaaccttccttctaatcttggtaggaatttgtttttgagaaaagaacacaaattagaatctccctggcaccttctctgcctttttctctcataagtaatcgccatgaatcttggatatttcacccactcaaaccaaaagatttgctgaagagaagtgtaccatttggctcacacagatgagcaggcttccttgttttcctactcccaaacttcctacacaccctcctttgcttttaaacagtgcttgagtcggtttggagtatgttagaagcatagattgtgtataaaacttcattgcctcctgacctccatataagttcttgtcctgtcagtgaggcagatgaaagcataaagctgattctgtgaaggagcattccttgggctgtgaccaggctgctgctgcaatttctacctgctctaggggttttggacagctgttttctctggcagttcatggcctgaggcagagaacacttggctcccagtatttggtagtggaagccctgtagaagtgtgggagtgacttgcagaagtaaaattatggaagttctttgccgtatgttgacataactgacaacagagtttccagactaccatatcctcttttaagtgttttctaccttaaactggcagtttattttgtgagataattttgcaaactccctgctcttgttgccatgtgtcttaggtgtggggcaggaatgggagccatcctggaggctgtttggaggactctgccttgccctgactcaggccaaggctccagagtccttcttcctgccccttctttgtggagagaagtatttcaccatccctgcaggctgttcaccccttctcctctctgccaccacccactctctggacttggctttcatataggctgatagttctttggctcctcagtaattttccattcagtgtatatttttcttttttatgttgagtcaagatgtaaatgctgatgttaacatagttattataatagatcctcccatctcagtctcccgagttgctgggagtataggaatgtgccactgcgcctggcttaattttgcttttttattttataaaaaaggaaaaatgtgtcaccttgccccatagttgttttttttgttgttgttgtcattgttgttttgagatggagtctcactctgtcacccaggctggaatgcagtggcgcaattacgactccctgcaacctctgcctcctcccaggttcaagcaattctcctgccacagccatcacccaccccctgaccccagtagctgggattacaggtgactgccgccatgcccagctaatttttgtattgttttgtagagacagggttttaccatgttggccagggtggtctcaaattcccgactttaagtgatccaccagcctcggccgcccaaagtgctgggattacaggcgtgagccactgtgcccgtcctgtcatagttgttagttgagaatgtattttcattctcatacccatgaaagaaatgcataggttttaaaaacattcagtaaatgactctgaattcaaagtcaataccaaatctactatttactcatttttaaatgataattttaaggtagatgttttttcttacaaccttaattgtgatcactttatggttctttaattatggaacttacaggtttcatagttaactttaaaagtgttttgttatgtttctcatacccacgccccaccattccgtaaattagactagtactttactccatatttcaggtaaaatattgcttaatagtaacattgatcatgtacttactttttgggggaatttttctaatgttttacacttataatcctcaaagtaactctatgatttaataattgtccccattttaagaaaaatgagacccaaagaggttaagtaaaccttttctaagattatacaacaaggaaggggtaacccaaatagtctgccttcagagctttaactactacagagctttaattactgctgtgcctacagagcgtgtgcatacattcggtcctgttgggactctctgtcctgagtgtaggctcactctgccttggatgagtgtttgatctgaccccattagtagttctgtcccaccccaggcaaggcagtactgtgcagtatgtgacctgtccattaagtgcggatataaagggcagccttttggcaatgtgctggaattctgactgagcccttataaaatctgatattttgagttgaatgagttttctgtcagctcatattatggcaattaattctgctatgaataaccaagtccattaagattatatcatcttttgtctcaaaattttctgggcaccaagtcttcttacatcacaggtacctgtgttggtttaattcattcagccaccaagtcttattacttgctgtttcaagctttcttatatctgtcataaaatggtgggtagttaaacattaaaatgggtacattttaaaaatgtttattgatttatttaaaatgacacaacccactatacgttaacataataatatttttgagaaaataactatattcaaaaaatgtttaatgtcattagagggatagattgttgtacattttggcatgtcttcttgatgtctggctgtaagaagacagctggattctctgcttctccattcaagctgttgcaatttgttggtttgtttaaagtatatgaagaaaattttgcctcacacacatatgaaactgaaaaagggaggagtatttattaataacagccttttcagataattgtggatttttttataccacacacaccaaacttgatgaggggtagtttcttaaaggttcattagttgcagtataaaaatctgaacctataatgaatgaactctctactcttataaaatccattggtctgtcttgcacagaatggatcttatgtaatgttattcatggaccatttggaaaatattgacttactgaattagtagatcttccaaatgttgacacattttcagtatacttgatacatttcattattcaaaaagtcacatttgttaataccactgttcttatcagaaaaatagtgttaggaagctttcaggctcatgtatttctttttttttttctttttctcttttttttttttttgagacagagtctgactctgtcacccaggctggagtgcagtcacatgatctcagctcactgcaacctctgcctcctaggttcaagcaattctcctgcctcagcctcctgagtagctgggattacaggcgtgcaccaccacacctggctaaattttggatttttagtagaaacggggtttcaccatgttggccaggctggcctcgaactcctgaactcaagtgatccgcctgcctcagcctcccaaagtgctgggattgcaggcatgagccatcatgcccagccaaaaatgcaacttttaaaataatataattaactataattactatccaaaacttacgaaggataaatatttcaatccaaatttcaaacagcccctt

SEQ ID NO: 107871 - DNA, 1006 bp, Homo sapiens
agcatcatttctgtccctgagctcaggccagacaagcatttttcagtttctgtatttccagggctttgtttcttcctacttcagggcctttgcatgtgtatgtagttccctgtgtctagcctctcttttctcacttccctttccccctactttacctaaataattcatctccttctgtcagatcttagcttaaatgtcatttttcctgaccaaatctatccttccccataccccaaatcaggtgtgactattcaattacctcagaacactttgtatttcttagtaacacttagcacagttgtaatcacatggttgtataattacctgtttaaagtctcttcccctcaagaaggtcacttctgtgagggcaagggccacgtctcatcatgggctgagcacctaatggacattgaatttgtgaagtgaaagaatgaaagactttgaaacatacagctaagggctttgcacgaaggcggtttctatttacattcttttcagaacatgtgagggttcctgttttgctactctttggccaaaactgaaatttatcttaaagatctttcaggctggccatggtagctcatgcctgtaatcccagttctttgggaggctggagcaggaggattgcttgagcccaggagttcaagaccagcctgggcaacatagcaaaaccctgtctctacaaaaagtataaaaaaattatcttggcatgatggtgtgcacctgttgtcccagctacccaggaggttgagatgggagatcacctgagcctgggaggtcgaggctgcagtcagctgtgatcatgctactgcactcaagcctgggagacagaatgaggccctgttacgtgaaaaatgttatctcattattttaattaacatttatttggccgggcacagtggctcatgcctgtaatcctagcactttggggggccaaggtgggcggattacctgagctcaggagttcgagaccagcctgggcacgtggcaaaaccccgtctctgct

SEQ ID NO: 107872 - DNA, 1571 bp, Homo sapiens
tgtatacccttggaaaataaaaatgtctagcttgacggttaaaaaaaagaaggaactgaaatgcaacagtggttgtttttggtttgtagtctataggcaaccaatcaatttgttcttttcagtattttccaaattgtatttaatgtgtgtgtattaacttataattggaactatatatactttttattgttaataagttaaatcataatttctaagtaagtattttggaaaacactatacacattaaaaaaaaaaaacaacaaaaaaaactacctgttgagtactgtgctcactatttgggtgataggttcaatagaaacccaaatcttggcattctacaatatacccatgtaacaaacctgcacatatacccctggatctaaaaaaagaaaagaatcaggtcttttgaggccacatgtgtatataaacagcagtaaatgacgtatacattattgtaattgtagagaatgatttgccatgataaaaacaatattagctattttttctccatattgtatgaaaaaacttgatagttttctatctattgctgtattcatttctctttctaggtgaacatgtcaaaccttttaagccagagaaagcaaaagaaattatcatgtctttacaacaacctgcaatcttctgtaacatggtgtttgattggccagcacgacactggaatgctaaatacctttcgcaggtccttcatggcaagcagatacgattcagaatggggatgaaaagcatgagcacaggtatgactataggtaatcaccatcataatgtctcttcaggagcatccctacattctcagcagtggcctcctgatctcttgagaatcctttctttctaatcctttttttgaccattcactgcacatacaggaacattttattggaaggtttggaaaacagtttggcttaagtgttttttgtttttgtctgtataaactatagactgttttgtctatagtttataaccccatacaaaatgtatttgttcatgtatcttatatgtatattgctagacattattgtggttcattaaatgttagacacttaataaataaatatttgttaatgtgctcttattcatgttcctattagaccaatactaatctaatagtcccgtccactttttactcaagtagaatgtgtccttttatttgtggcttcgggcactatttatagttgtatataattacttggttgtaattttatccctctgctttattgactgactgacctgttttgcattgcacaaacatgaaacatatgtaaagctcgctcttttattctcttaagcaaatagattctgcctcttcttttctgaaatcaaaatcataacattttgatttgtttgccctattttcagataaagcaattaccattaactctaaaatttaggtaatttaccattaactctaaaattacagtttctaatctaagagagtctataatcatttttctgatgtttaacttgtatttcaatatgggtaagtttggtagtctagaatttcagttttttaagcattgaggtaaagtggcttattaatatctattaatagctta

SEQ ID NO: 107873 - DNA, 1582 bp, Homo sapiens
tgagagacaagttaatttcaatttcaagatttttgttatattctgttaatattcggagtgtcctggacacatggtaaatgttccttattcttgtcttaaagtctaaatctcagatacaaatccaggccaggtgttaattgacagacaccagatagttggcgttctcagagaaattaggtttcaaattatcttgtactttacattaattttaaaaaattactgagaaggacgcaatttatttttgatgatgtttcactatctccaaagaattagttgcaactcaggctgtaataaattgactggagaacatcctacatttggagagagaaaaaactattgggtaacacccagatcactaatctgttttttttcagtagtttctaaatcatctagttaaaaattactacctgctgcaagtttagacctaaatacccttatcctttgaagactgttgaggttgcttcagaatttttatagctctttgcaaaatattattagcatggaataactgggtgcatccataggctgtttaactaatacagggtagcattgcattcttctttaaaggaaattgtaacatttaaattcattaatttaatggcccagtttattgttgattaaattatcagaagctaaattagttttatctcacaaccagctgattgttttatttcacgatgggcctgaaattctgtaaatatgctaatttcctgttatggtgaacatcctgctactctgctttgcacacacttcatagtgctctcattcatttagcaaatgttttggcatttaatatataccagtcactaggccaggcactctctcagcaaattttagtgttggaggtctcctattaaataatctctgggatgtgtgggatttttagatcagataattacattttttaaatttaactttatgctagagaagaaatatttacttctttatagcttttttgtcaaaatactactcatgtgttactgtcgcctgtgtccatatttatagaaggctacccagttatatctacccaagtatgaaccattttgggaataatcaaagccatgtgatctattggctctaatgtaaggtaagtagaataaataaatcgctaccccaaagtaactcatgcttctgtttttctctgccctttaaagttccagaagcaaaatgttcaaaggttgaatattttacaagcttggaactgaaagaatgctacagtgtgtcagaccagccatgattcatccagcccaagccacagaacagtgtagagggagaatatggttatccttgaaaatgatggcctcagaaagcaaggtgttataccagctatgaattaataacagtctagactagaaggaattttgtttttttttttaatctaaaaggattcaggaggtagtagttggttcagtagcacaaagatgaacatatttgcattcttttggttaaggtttgcgatttcctggacctttcatttgtctctcaagagggctaatcatcatgtctgcttttcaggcagtatatagaaaaggatgagggcaaaaaggctgactcgcaacttccatatgtgcgcgcgtgcaca

SEQ ID NO: 107874 - DNA, 1018 bp, Homo sapiens
gccgaggtggaaaggaaggatctgactagaaaaggagaaacagaaacgaagctaagactacaataaagaacgctaaggtccgggttaggtaaaaagcgccacaactcagaccacgtgtttgtatttccacacccggggtatcaaaacaaagctgcgtggtcccgcccagcatccgtcacgtgacctccacgtgagagccggcgtttccgtaggagccgggcgggagtcgccggggctccttcctgtggtgcagcttcgggtctcggagtttggcccctactctgaccccaccccagctccgctccgccttgggttccggcagaacccgccttgcggtagccatggcagcaggctccgaggcgaccactcctgtgatcgttgcggctggggctggaggggaggaaggtaggtgccaggctgaggtccgaccctgagtacaaacccaatgccagttgactctcgtggcacccctcgtggggccgtttgccttagccccaacccaggtctctctggccttgcattagactatgaagaaaaatctatattttctagtgagcgtggcatttctcgaattgtggcatccagatttttgatcgtcgtagggtagcctacgagtgctgtttcacgcatggggtgttatttttgttttgttttgttttatatttgcccatcattagctaaatagaggtgttttgaacgtttagaggggattaaaattaaatttgtgaaattgaaggcaacctttgagattaatggaagttatctgagacttttgtgaacagggattatgcgcttttattctatttcagtgaaccctggtttagcaagtggggatgaggtttggaggcccatgagcctgagatccctgttattatttattgaatgattgcaccgtgcagggctgtgttctgaatactgtcgcaggatccagagacttttgaatatttataacaataccttttccaaaggagcctagaaaggaaaaagaatgacttactatgtggtcacctgaactatt

SEQ ID NO: 107875 - DNA, 1055 bp, Homo sapiens
gccgccgccgcctcccggcttctccaggaggcccccagcccaggcccgagcccgggccccagcagcggctgcctctcctcttcgctgctccagcgagagcccatggcgacgcgtcgcccgcgaagccactgccgggcgcagtccgggtcaccgccgactagcccagcgcagaatagtcctgagcagcaggaggcggaggctgctgtggtcgccctcggcctccggaccgcgcctggtgcgcctgcgcggcccgagccgggccggcggggaggcggggaggcggggcaggcggcaaggaggctggggtccgccctcccctccgcgggtggcgaggaaacaccggcgagaggaaaggagccaggtcccagacggagggcaggtagcgctgaaaaggcagggaccagcgcggctgagtcggggagagggaaactcccagagaggctgtattcgaggaggttgggcaaggaaccctggggtgtttggaggaagtgtccaagttaaatcttgtgcctaataaacaactcagtgacctgttaagtgacgtcagttaacctgatgcttgcttctattttgggcttattctcatttttgttgagttagtaacttcagaaattataggcgaaggataaagtttaagcgtagttggtcccaggggattatctcataaaaatcatttcttacgtgcaataagtactacctatttttgttacttttttgtcttacatatccaaagaggagattccaaactagccaatttcattcatatatatgtaaactttacccatttcgcctgccaataggcgagcaataaaggtatgtccagtaaagttggaagatttttgccccaaagatccatctccagtgattatgatttgaccacagggtaaacgagaagaaaggtggttgttgatctcttcacacagctgtttgtttattttggtatacaaattcagaagcctgacagctgtggattagtgtccttgaaaacctaaagtcaagcaatttggcttgtctggatcgggaaatgagtcacagggaacgcaatcacaggattc

SEQ ID NO: 107876 - DNA, 1049 bp, Homo sapiens
ttccctctccccgactcagccgcgctggtccctgccttttcagcgctacctgccctccgtctgggacctggctcctttcctctcgccggtgtttcctcgccacccgcggaggggagggcggaccccagcctccttgccgcctgccccgcctccccgcctccccgccggcccggctcgggccgcgcaggcgcaccaggcgcggtccggaggccgagggcgaccacagcagcctccgcctcctgctgctcaggactattctgcgctgggctagtcggcggtgacccggactgcgcccggcagtggcttcgcgggcgacgcgtcgccatgggctctcgctggagcagcgaagaggagaggcagccgctgctggggcccgggctcgggcctgggctgggggcctcctggagaagccgggaggcggcggcggcggcgctgcccgcggcggtcccgggtcccgggcgggtatacgggcgccgctggctggtgctgctgctcttctcgctgctggcgttcgttcagggcctggtctggaacacctggggtcccatccagaactcggcgcgccaggcctacggcttctccagctgggacatcgcgctgctcgtgctgtgggggcccatcggcttcctgccctgcttcgcgttcatgtggctcctggacaagagaggtgaggggtcgcggagcgccagcccgcgctgtctctcctccgggagcaggcgcctgcccgcgctccaggcctgccagccgcctcccttggccccggcataggggttgtgtgaggtgatagagtgttgctagcattccatttctgacttaggaaccctccgtccccaaagcgacaaatatggaaaggcaaccttgcaaatatttatgttttttatcaaggccctttatgcaacaccagggatttaagcgatctctaaacgttcaagtttttacacattgtgaacatcagagcatccccgtgcacgtgcggtgtatgtgttttacacctgacaaaaatgactgatgctttgacttcaaagggatatggggatgttgaggatgaa

SEQ ID NO: 107877 - DNA, 1046 bp, Homo sapiens
attttggagcagatggcgtggagatgagggatttgaaatgcctattagatacccaagtagacagattaaactgtcaattggatatacaagtatggagttaaggggagaggcctgtgcagtatatttgggagttgtcagcctacaatggtatttaaagtaatggggctggttcaagctcattcttattggttaaaaaaaagaaaaaagaaaaatataaaaagtgtcttgtggctgggtgagatcacctgtggagaagggtggagcttccctggagtagaggactgagccttggggcattccaacattcagaggttggggagataagaaagaaccagctagtaaggactgagaatagagcactggatttagcaacatcgagatcttttggtgtcctttgaaagaatcatctcccttgaatgatgtggtgagtttgaaataaaatgtaacaagaggaatcaaagacagtgagtgtagaaatttctttcaagaatttatgccataaagggcagcagagaaataggcagtagccagagggaatgtgggtactaaggaggtttaggttttgttttgttttttcttttttttggtaagagatattaaagtatatctattaatgcagcatcctaacagttctataaaaaggggaaaattgatgatgccggagggaaagggaggaactgctgtagccatgtaggcaagatgggatgtggtcctccagggcacaggtagacaagttggccttagatagaagcattgacagttgattctttagtagtaacgggaaagaagatagagtatacacataaggtgcagatggtggatgataagagcttgtagaagttatctttgcttttttcccctcagaaaaataagaaacaaaatgatcccctgatgagggagaataggggaacagttactggagagaggattaattatgaaactattttatagaaaaatggagaacacatggtttacgaaattgtagtaggattcttgggtagcactgagggcctgctttcagtgactgattattaatttgaagtcag

SEQ ID NO: 107878 - DNA, 1050 bp, Homo sapiens
tttttggaaacagagtctcactctgtcgcccaggctggagtgaagtggtgtgatctcagctcactgtagcctctgcctcccaggttcaagcaattctcatgcctcagcctcccgagtagccgggattacaggtgtaatccaccacacacggctaatttttttatttttagtagagacagttttaccatgttgcccaggctggcctcaaactcctgagctcaggtgatctgcccacctcggcctctcaaagtgcaaggattacaggtgtgagccaccatgcccagcccatcatttcattttcagcatgtagggttcgttgtttttttttttttccatttttaaagttatacagaaaagccataatattagcatataatgtcagtatgattgactaaaaataatctttatttttaacattggacttaggagaaaatcaagataatttcaatgtctttgtttcattttaggtctccggataactgtgctcctgacatccttccttatggttttgggaactggtctaagatgcatacctatatcagacttaatccttaaaagaaggtaaatcctgtaaataacatttctcccccatttttcattttattatgtgtataaatttttaagaagatcagtaaagggtcatatttatagaagcgtttatttttttactctatatgatgattaatttaattgatatttatcagttgtcatggaagacactagttgttgtggaaataaaaagagcaagttaatcttcatattgtccaggaacaataataatcatgtgaaaataatagtataacataccatttgtaagtataataatataacatattatatatatatatagtgtagttaatgctacagaagaaatacaaaattgcctcgagactaggagaagttttggctgtgggtatcaaaaagaggagttcataaaggtggtggtaattaaactaggcattgaatgatgagtagaatgttggtaactatagtcaggggaagggtattccaggatgggggaatagcaagagtgaagccatggaggcaggt

SEQ ID NO: 107879 - DNA, 1095 bp, Homo sapiens
taaggaaaagtgtagcacccatttaaatgatactgattttgactgggtatggtggctcacgcctgttatcccagcactttgggagggtgaggcaggtggatcacttgagctcaggaattcgagactagcctgggcaacatggcaaaatcctgtctccaccaaaaatacaaaaaattagctgggcgcggtagcacacgcctgtaatcccagctacttgggagtctgagatgagaggatcacttgagcccaggaggcggaggctgcagtgagccaagattgcaccactatactccggcctgggtgacagagtaaggccccatgtcactcacacaaaaaatgatattgatttggcagatctgtgcttcatgttgtaaaccctaagaagtccttccaagtatctttcttggtacaaactctgagagagatagagaccctgaatcatatcagttattaaataaagtagaatttaaaattacatgaaagcaattttttaaatttttaaattaagtattgggtagaattgtattaactagggcaaatgtcatgaacaaagcaagtagaaaagtactaaatgttctgaaagtaccagcatcagtacagccagatatgcagtggtccttaacctagagcatgaccccactcacctagaggatagaaggaagtgtttgtgggagcctagtgggcgttggattatagataccagatgtgctgcaatgagaggagtggtcctacagaacagagaattctcttgcctcaaatgccaatagtgtgaaaaactatagagcgataatttaagcttcaggatgttatccttctcctgagagccttcatgtttgcttctggcagcaaacaccaatagagcaaaagactcatataaagttactgtatcgcttagaataggctatgctcctgggagaagtagacctccaaaattctgagacttaagaaaaatttatttgtcattcacattgcaatctgggacagcgtgtgtaatctaggacagttgtccagtttggacagctcttttcctcacactgatttaagagaccgaggctgcttccacttgtattctcttctgtcccctaggaccttgtc

SEQ ID NO: 107880 - DNA, 1026 bp, Homo sapiens
agggctggaaatgttttctcaagaggggaacaagctatacttttgaaacccagctcaacttctttttctctgtctactctcttgctcagccccacatttctccctgccttccacctcctgatacatttttagttgttgccccatgttttagcatctcattattacctagcagtttcctatgttggttatatttaaactttttcaggctgtgactatcttccatccttttcttattttaagagttcctagtccaatattaggcatgtagtacatacttgaaaatatttgtttgatgacgttgattattttgttttcaatattccaataaacagttaatcaaggacatattttagatgtttgtatacattagttacacatgaattcttttatttcatccatttagctactaacatattgattatagaggactttttttcattccttttatattgcagtatgattgtcttgtattaaatgtgtctgcttctttcttaacaggtagatgctggctggattggattttggtccatagttggaggctgtgttgttggaatagctatggcaaggtgagaatattttgttaaacttgtgagtggacagagcagggggaaaaagcctaaagataaataggctcccctaaataaacattacaattcagggaaaagtaaaacaagcaaaggtcagaaaggggtacttgttcagagtacaagaaaattcatatgcgttatatagaattgctgctaacaggccgggaatggtggctcacgcctataatcctggcactttgggaggctgaggcaggcggattacctgaggtcaggagttcaagaccagcctggccaacacggcaaaaccctgtctctactaaaaacacaaaattacctgggtgtggtgatgagcgcctgtagtcccagctaccagggaggctgaggcaggagaattgcttgaaccccgggaggcagaggttgcagtgagccatgattacgccactgctctccagcctgggcaatagagtgagactccatc

SEQ ID NO: 107881 - DNA, 1038 bp, Homo sapiens
aaaatattttaattggtatttttcacatggaaaagaagtataatctttagccttaacacatagagcatggaaatgcttatatttgtttaaaatttctatcagagcataatacaaagatttttatcttggttatagtcattatatcactgttaaataataataataattaacaaggcaaaaaactatggtatacttcagtaaagttatttgaaccagcccctataggtttattttacatttagtgttattccatcattaatacaaagcaaaacttactggaaatacctgttgaaagtatattacagccagcttacttagcttatctaatggacctgaaacatttttagttgctgttgtttttcttgtcattattaatatcatcaattcagagtctattttctattgctgctgtaaaagttatgcaaatttagcaacttaaaacaacagaaatttattatcttacatttctgtagagtagaagttcaatacaggtctcactgggctaaaatcaaaatgtgaacagactctagggaagaatctttttccttgccttttccaacttctagaggtcacccacattccttgtttatggctctgtcctctgccttcagagccagcaaccttgggtcaagtccttttcacgttgcattatctgtgcctttcttccatcgttacatctgcttctgaacccttcccttctgccttcttctttcttcctcttccacttttaaggatgcttatgattacattggacccaccaagataatttggaaaagtctgtcaattttaaggccagctgattagcaaccttagtcccatttcaaccttaatcccctttgtcttgtgaaataacatattcacaaattccagagattgtcatgaatatctttaggggagggagggcattactctgcctaccatgggatctttttaaaattactatgacagattattattggcttataaaccagagactctgttattactccttcctttcttccagcaaaatattaagatgcatattttatattatttgca

SEQ ID NO: 107882 - DNA, 1040 bp, Homo sapiens
aaaaattagccgggcatggtggtgggcgcctgtagtcccagctacttgggaggctgaggcaggagaatggcgtgaacccaggaggcagagctttcagtgagccgagatcacgccactgcactccagcctgggcaacagagcgagactccgtctccaaaaaaaaaaaaaaagtattcacacatagttttgtttccctaaagtttagtaatttggttttttacgggcacaagggtggggaggagtattttcagggttatgatccaagtcatgtgcttgaaatacattcatttttaactgtagtttgtgctacacaggactttgttttttaccatttaaagtgtgggcccatgaaattttattagctttttattagaaaaaaaactgcatcagcacttcagttgtgtttgttctgctgaattaccttgaatttttaattgaaaggcagttgattgtaattttagtatcagtattatacaaagttatggaaatacttaatgatcatgtagtttgaaccctctatgacaagcaggaaattatcttgtctgcctgacttttaatagatgacattcacccactgaatgtatgagaactgaaaactcaaatggaagtcaaattcagacttggaataatcagcctctgctttatgcatgccccagaacactggaatatattaaatcagtcctgacacagctaccttcccccattctgatgatgaagatctcaatctaaccccttcctgggtaaattattgtgattctttactttctgcatttccacatgtccaagtgatttccacatgtctatccattgtaatagaaacctcttggtcatcacttttatggtaatacaagaagcaaacaccaagactgagacaattgaatgaaaatctctaatttttgattactggcctctgaagttatatcatccgtttatcctacatatagtagcccatttgtcctccatataataggcattctaacaaatgggaaaatcttcatgtcaaggatcctgcgccaaggctgtgttatgtggctcctggg

SEQ ID NO: 107883 - DNA, 1062 bp, Homo sapiens
atccttttaattatatgatagtggtaaattgttttgtgctctggaataatccaccagaaaggtaaaggagataaactggtacccatccagcaataaaatggttttgtatctactccagaaaactgcagcaaagagctggcagatgtgtgatgctttgtcaaactttatcaactacctttgaaaagaagaaatttttgagtcaatacttaggaaagagaacaccccgaagatctatctgatatgactcactgccgctagtgtgaaactaaaatgtttgtgtttttattttagtgacattgtatgcctcctgtattctcctgggagtgttcttgaatagcagcgtgcctatattttttgagctttttgtggaaactgtctacccagttccagaaggaattacttgtggagttgtcacttttttaagtaatatgtttatgggagtacttttattttttctcacattttatcatacaggtaagaaatttgattttttatttactatctaaatgtgttacaagaaaagtttgggtcactagtgtatagaagtttttatatggagaagtctcaccaaggcaaattactttatgtgaacttccattgccagtaaaagaaaaattcctcagttgtttttcttaaaatgcattctagctcaagtgcaccctcactcttctctgccccgcccctgtactcccccacccccgaatttctgaattaattaacctgggctggagcccagtatttgtatttttaaaatcctccccacccccacgccttaccctaccaggtgattcaaatatgtagattctcattgagaacctctggtctattgctttttaaaaactacttcgaatctctcttaacacagggtgtaaattaatgttaggggtgtatatggagtttaaagcctgagggatgaatgacaggatgtcacccaatgtaaggaatgctctaaaatgtgacactccaagaggccgaattgtttataggagtgtttctgacagggttataactgaaataataaccgtgctaacctccttgactggaaagcaaattttgaaactt

SEQ ID NO: 107884 - DNA, 1983 bp, Homo sapiens
tcagatgattttcgtatttgtctttttaatccatcagatatttataaacagggacaagagtgatgatgatagagggtacttaaaaaataattatcaaactaacatttaaaggtgattgattttttttctttgaagtaatttattttgtaaccaaagtcaaggtggattaaattgatgaaaagttatgaacaatattgattaaaaatattccacatggaagccccgtcatatattacacacatcacttagtctccagattgtcactatttattgaaagccagtttctaggccttccagggtacatttattataagtactttttaatgcagagcagattccttccggcatacaggtggtggtctgctggtgatacatgaatgtttaaaactgcatgtttttttgtcttacagagttgtcttggttcaactggtgccttcccgggtcgtgtttgctcagtctcctcctcattctgtgcttcagggaatcctatgacagactctatcttgatgtggttgtctccgtttaatagcacagacttgaaggagtttaaaaggaggctggaaatcaatactgcacactgcacatttgctcagaattgcacatctaacaggaaaagagggagaagaaagaaacttcattcagaggttttgttaggttacagattatcacattaatttaattactactaggtaataataatgggagacttgagtgataataggggattttaaaactctacagatggcatacctgtgcctgcttctggggttggaagtgtgacttcttacacataaagcactacctaagtaattctctctctgttttgtgccagtgctaaactactgattacttgtaattatgaaaagaaataaagggtgtctatcatatgaagataacgccttccctaagtcacatatcagaataggaagatatgccactaacttctaaagaagttcaaaccctgtatccaattttaatgataaaatagccaagaggtatatcgatgatggaaattagccacatgtacactacattttttctaataaagccatttcttatatgactccttattttaatcaggtcagaagcccttggccatctttactatggtgatcaggtgctttccagtgacttctgagcataggcactgtgtctccatctcaacttatccttgtttctgtgaaatacaatttcatctactaggcccttaaataattatgtgagggtgtctaaatgtttaatatgattacattaaatattgtatgaaaaaatgtaattccattaggatctagcactttgttacaagtgaaatgacaagtcacatggacatactgtgtcttctgcctgtatatggtggcatgagatgtaatgtccagagccaacaattatttaccagggttagattttattcagtgacccttgtttaaaaataataatttatcacattgaaactttcagctctgtcgaatgatttctgaattacatcctgtgtttcagcttaggttgtaaaatactccgttctctgtggagtcagcatatttgagagggcagcgttttgccagtacctatcttctttctacagaagatagctttttaagaaataagagttccacattgagtggctgtcagacacagatttcactgtgacgtaaaatacactgcagtgagaatatggtatcaccactattcatatttacatcattcccctcacacagaaaaaccaacccttttcccaaaaagtcaagaatactgctatacctttattattctcagcttcctccagcccttcttgtttttcctcacttgaaattgaaccttcattgtcagctaagtatatatacttttgtgttttcctggacagagtgcaagtggctcttatcagccaaggtggtgaaggttcaggaaagctgggcagcactgggccctgctcctctctgcacctgtgtgcgccatgacacacccacatgcagattcccaagtctg

SEQ ID NO: 107885 - DNA, 1056 bp, Homo sapiens
gggttgagggacggcgcggggctgcaagcttccggggccttcaaggccaccttggtctggctccccctctcctccagagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccaggggtaagccgggacggggcggctcccgaggcctccactgcggaggaggcgcttaagaggcggggctttggacccgggagacctggggtcggtccctgcagtctccactagtgtgccttaggacaagtcactccacctcgctgaaccttggttctctcctcgtaaaacatcttgcagggtttttgtgagggttaattgagataatctccataaagcacttatcagtacctggaggaagtgtgtgcttagcaaattttggtgggtggctgttgttatccctgttgtcaaacacatagctagggccagtcaaccatctctagcccacttgatttattctcagtcctttctgtacagagagttctttatctttgaagccacagcacttattgcccagatgtggggacagatggagatgatgctttgagtcagccccacgtttttgctcctcttgcttccttccttagaagaggtagagagggctgctgcaggtagggcagaggtgaggcgccacgtggaggagttgccctggcttcccactgcttctgaacttggttcttcatgccgtagcttcaagcggactcacagatttgacaactgtggcatcagtgtttaagggggaaaccaaagcctattccaaagccaaatggaaatgtagcccagactcctaccacccgaggctctcccaggctgcatggcctcattttcatgatactcagaagctggcaccaccacagccatgcgagcttctgtggcctttgcaaccgagagtcctgg

SEQ ID NO: 107886 - DNA, 1372 bp, Homo sapiens
cagccatgtgatgtctgtgtgctcctatgttcctcccccaggccacagagtgggcctccagtgaggacacgcgccgctcctgccaaagcaaagggaagactgaggtacgtggtctcggcggtccaggggccccacctggagctggaaggaggcctgtggttgtggggatggagcagcactgtgtggactgaggtcccctgctagagaggcctggccaggatgagctggggctccttgggcaggtgaggataacagccctgtggcgagctggtcctgagcatctgagtgagcagtgatgcggagaaatgaccttggtgggaggggacgtccacagacgtgacccggacgtcgggacaggtggatctggggtcaaggggagtgtttagaatacttgttggcatccatgacgcagtggtgtgagcgtgagatatccagcatcgcacctggagagctgtgctgtctgctcctttccttcctgcctcaggaggagtgtcagaactacgtgcgagtcctgatcgtcgccggccggaaggtgttcatgtgtggaaccaatgccttttcccccatgtgcaccagcagacaggtgggcacctcagggtggaggagactgaagggggcaccatgccgggggttctcctgcctaggcacacagccttgaaggggggttaccaaattttgcaaacagacacccaaaacagaaacaaaaggacacccagttagatttggagttcagataaacaataagtgatattttagcataaatgtgtcccatgaagtgtctgggacaaacttatactaaaaatttactccctgttcgtctgaaattcaaattgagctgggccttctgtattttgttggtcagccttaccttggagggtcctgactggggctggaggcagatggagctactgggaggacctctccctcactgagggctgctccctcagagggaccatgagctgagcagtgagatgacgctggaggaggggagaggcccagagagactggggcacaggaggaaacaaaactcagatggaaagaacaggcagccccagggcctcagggaaaagtgtccccttctccccattgtccccaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatggtaaggaggccccagtgccaggggtggggactcccctggttttgagcccaccagcccaccct

SEQ ID NO: 107887 - DNA, 1063 bp, Homo sapiens
ttgatgtgatccttcaacctaattctgatttcactagttttacatgtgtacttcaacaaacccaaatggtagcatccgaagactctactctgaaccttgtgaaagcatttcaaaagctgccatttattccgcaccggccatgtgccaggcactattttatatgtcatatatgtagtaagtcagttactgcatgtagtaaaggtagtaaatcacacatgtatttaatctaatacatgtagtaaatcatgcctgcagtaaatcattgaatcttcacaagtgggtgaacccaggaagtgggttctatgtacccccattttatggaccaggaaactgaagctcagagaggttatgttaccctgtgactgtggtcacactgttcttcctcatccgctctgcggcttccccagaaggtggttatgttttctgtctggaggcttcccacacaaagatggagggacactttttcctgcatccttgagcctggctatgccctcagatggacagggaaactcaattctagacctggtcccttaggcttcttagagccaatgtagtgggtctttggccactttcttttcctgtctccagctcattttccttcctccttttcttctgcctgacattgtcttcccttcttcttgacccctggatctctggaattcaggctagggaaattttttattcatttataaccctcccttgttccgaaagggatttagggtgggtcaggctacagagatttctctctgttctcatattccagctcccaggagagttgactgcgatgttgtgatgaatgatttttgatgggataaaaatgaataaagtgatgcaatgtttcccctaatttgttaaagctgtgagcagatgcctgtgttacctaagcaggcagctggggcacagccataagctggagcttatctgttcccaggccaggagggtgggatagggagagctctgctaaggacttggggagggggttggagaaggacagcagaggcctggagccaaggtcacctgggaggcccgcccagccccaggacagcaaagaagatgagtgggg

SEQ ID NO: 107888 - DNA, 1036 bp, Homo sapiens
cagggtggacactgaccgcccaatctctgcacctcccacctctgcagaatcttgtctgaaaatccaattcccctcatacaagaaggaattgaggattattcatatattcgttcaaacactgctaggtgctggactgagcctggagatctaggaagcaaagtctttcttggcccccagggcaaactaccaggctagacacacagtgtggcagtaaagtagaagactatgggagccctttagcctggcttgaagcagtcagagaaggcttcttggaggaggtagggatgggggtgaacaggaattgttccatcaagggagaacagaagcacaaaggtttgcaggctcttgtgggatggatttggggaagtgtgaagtgttttagtgtggctggggtggagagtttagggaatgtaaaaggtgaagcatcattctttcaggggatcagtaaataatcactgtgccaggcactggacttgggaggacagtggaccagaacccaagggccttcgcaggagttggacttttcctgggggtagttgggagctatggatgggttctgggctggagagtgacatgaccacatttgcatttgagaacaagcgttcaggttgctttgtgggaaaaggactcgaggggcaggcctggaagccaggctggttaggaggctgttggcactgctccagacaagagctggtggtggcttggatgtaggtgggatacagtgggaaaaaagtggatggatttcagaggcagtgtagaggtagaacaggcaggatttaccagtgtgtacttatgtggctagtgaaggtctgggggaagtcaagggcgagtataagtatcccttcatgcctctgtggggagggtagtgccctcctctgagctaaggagtgtggcagaagaatgactacaacacccactcccaagtccctaggggcacacagaggtgggcaggtggcaccaggtctcccgggtgccaccgccccacttccccctgactttcacccttctgttctgtggtctgctgcgatgcagctgg

SEQ ID NO: 107889 - DNA, 1087 bp, Homo sapiens
ctccttactccactgctcctcacccctggacccagggcccaccctccatctctccttgtctggtgctgcccacgtctgcctgcagaccacacctgtgagcacttgactaagtcttctggtaagaaaatgacacggtttcccactcccttccatttctctgctgtccttgtgggcctgagcagaggacacttccaggctccctccccagaattcttgcatttcagatgctcctccaacaggcctctatgaagataactctattccagttccattgtggaaaaggagagctgggggtgggggctgggcctgcagggtgagtcatagataaagtcctgcaaatagtaagcctgttagctgttattcttattataactgagctctatgaatatggaacttaaggggcttggcaccaatggccaggtttaaagagagacattcattaagcactggaagggttttgtcagcccttgaccatctttctgtctccaagaagggcttcgtttataccagatcagaaagagctcactgtgcttctcttaaagacccccctccccttctcttcccaccccctggcccagggctggaactctctattctgcccacaaccaagccccatggcctgctcagctcctggacaccatccacctgagaagtcctcaggcacgtgtccctgcctcactctccccaacccatatacccaaacccagaaggaccagtcagctgccttgtaggtgctcagggctggggcagcagtgaggctgcatcattgcacctgcaaagaagctttgaaggaatgatctggatctcaggcatgtgcgcaggcgagtgtgcacccacgtacacattcctatgtctggggcagtagtggtggtggagtcccaggcctggccttcactcagacctgtctttcacctgtgtgtgtgcaggagcgagggggctcacctggcaatgggagtagggctgggagcagttcccagaaatgcttctggccagggctggacagtgggtttgtgctggtccttgttctttctcccagcctccactctacatcagccaaccacctgccggcttctccctccccgcctgc

SEQ ID NO: 107890 - DNA, 1018 bp, Homo sapiens
gggagtgttcttttatgtctaaacattaccaccctctcattcctcatgcttttctgggtgggaagttctgctttatattttattccaattattccattatagtttagaccggggatgcaaagagaggctggaatatctggaaatgcagctgggattgtagtgggagggcttgtttgtggtgcaaagcagctgcccttttcatctaagcagctgtgtttctgttctgagaatgggggtggtggtggtaggggatgtgtatggagcagaactgaacatagatggggggagggtggtaaggatgattggatgattctgtgggttcccaggcctggccgttgctcaacacagaagaccaaggcttcccttggcttaaaaaagcccaattgccatcctggctctctcagcctcctgagtgcctgttcctccaggaaaccaaagtagcccagagtaagggaaagggtttgccccaccccaagcttccaaatctcccaattcctaatttcagcactcagggcagcaccagcaagccccttagaaggttgttgtttaaaatagggatttccattcagtttaaaggttgaatgtgttcagtgtttatttaaattggtatgggaaagctttactaacatccttttctaattggagctgaggtgactttaaaaagtaactaatcagtggtgtgggccactatttggggagcatttgttagttcctggagactgagggtgacaggaaaggaaggacatttcttcttttctctctctttcttcattttcacgctcctgacttgtcagttactcccatcctgctctgtcgtcccctcatttggttcatgtaccacccagcagccacctctcaggggtcatttaccaacaccagacattggagacgcaaagatggatgaaatgcttttcccagctgcagacactcctagtccagtggacagtgacccttcatgagtggacagtgcttttaggttgacagagcacagtcacatttgttgtgttttgagtctcgt

SEQ ID NO: 107891 - DNA, 1020 bp, Homo sapiens
gagatgcgctttgcctgacaggactttgctaccaaacacacgctgtctactggtgatctcagctgcccttctcaaatgcccactagccttcgtttagagtctctgcaggaggcacattgagttcatctctgtggtttgcaaaacccacctcagacccctttctggtagtgaggactgtgtggcccactggaggcctcccagccgccctagtgcttgccaggatcctgtcaggattcccatgagatcaggaatctacagctgttctgagcctcatttgcatgttccctgttccctagatgtgtgtcccggccaagtggcttgaacacattcagagcagctggagcttctgtaggcctctcaccagcctccggcttggccctcctgtgcccaaagctcctctcaccgtttccttcctgtggaatggggaagacagaagccaagctggagacagctgtaggatgagccagagaagcctcccagatcgatgagcagcagccttgttccccgtcagcatcctttaccctccagctcccctcttccctgaagcctttccctctctcctttctattctggctctttgactccgtggggaaagcacataagtgaagatggggtgtgtgcttccagaggctggatgggaatgcgtgaatctggctagattgggagcagggaagagagctagatgtgagggcctcagacactctgctgaggagtggggcttggaagccagcttggagtgggaggaaaagccgggagccacacagactgggtctcaacacctgctttgccatttactgttagagtggcctttgggcaaattatttctcctctccaaggctcagtttcctcatatgtaaaatggccatcatacctacttcagaaggttgtcatgggaattgaatgacacaagttcctttctgtatagcaggtcacctggaaaagtacctgggacctcaaggtaccaagtgaaccggtccttttgcagagtggactagcgagctggagcccaggactcagcag

SEQ ID NO: 107892 - DNA, 1054 bp, Homo sapiens
tcaagcaaacaagctaaagagcggtgaatatagggggtgacggagtttttaggattcactcttgacctagaaattccaaacttatcttgaactaaggttgaaagagtttaagaaatagatccaaattctcatgctcaagagcaggaaagggtggaaaagctaggagcacaacactgtcttcttcctcccacctgagggcattttctgggagataaagctaaaaaatgagtgcaggctctcccaagaggccatctctctctctctctctctctctctctctctctctctctctctctctctctctctcccctctatgtgtgtgtgtgtgtgtacacatgcttgtgcatagcccaggcacaaacacaaaccttgtcttgcagcaaaaggcaaacagccagtcatatactaataggagacagagaattgaaaataaaaagacagcacgtataatgtccaaattgttttctgctcccagaattgcctgctcattgtgcctggggatggcaaagaaaaaagaaaattcccaccccagaagtcattgtcaatttgtgaaccaaaaccttgctcaggtcagaggaactgaagtgtcactgaatgactgctttgccattgtcctgaactaatgtgaaagaagagatcttccttccttccttccttccttcccatttaagtgtcactcactaagctaggcagagaggtcataggaagagcttcacaggcaggcaggggaggcagacgtaatcatagcaaatgcaaggactgccacaggatgggagctctgcgggcacatggagagccagttaccatcctaccaaacaggacaaagaagtcttcattggaaatggccattctagctgagaatggaagataaggcaggaatttgccagacagagaagcaggaggaggcagagtattccaggcagaggaagtagcatgtataaaagcacaaggcgatataattagatttctgtttgaagaattacttgcccctggttaacagattcagagagagctgaagcagtaaatgtgagcaggtgtttcatgtggtggaaag

SEQ ID NO: 107893 - DNA, 1546 bp, Homo sapiens
ttccataacttatgcgctcccttattttaggaccatcctggtccttttcccctgaagttccagggaacttcctgttcctggcaccctccccccaacccagattttcccgttcttttccatttgggtgtggcaaggacactgggcaaatgggaggagaaaagtgtgggttgagttgcttgaaacacttccatctcccaataccctggccttttggatcaccagtgaggagtggcctggtactctctggttggaagtgggtggggaaagaagccccctgttctcttcggtctgtgttctccctcttggggagaaccaggctggagtggggcagtgtcacttaattgcgtctgggtttgttgaatgctggtttgccatcagttccctggagccagttggtctgggcgggtctctgggccaggaggagggagctatctcctgaaacgccccccatcggtctttgcacttgggctgagtaggaggtcctgctttcctccctttcccctcccttttgtgaaaacaaacggcttgagaatctgaaatttcattcggcagacatttatttgtcaatcacattgtttggattgatattttgccctccactgggttagattttgggcggagagcaaaacacacattgtacctgccgtctggtgttgccctggattgggcaaaggagtcagtcctgtgagcaaataatgacagaactgcaagtgctgtgaccttaagtactagtatccttcactgaaccggagccatacgttgatttaaagggaggtcagccatggctttcctgaggtggtagggttgaacagagtctgaaagatgtgtggtagttagctaggcagtggagggctgcaggtccccttcaccaggaggtgcggaagagcaggtaggtttgctgaaagcactagaacctgggagtcctgagcaagcaatttctatcttctcctttccctaagccctagagttggcttagcgggtaggaggtggagggagcatgccaacaggagcagtggtgagtgattgctggacagcgcgttgggtctttgtaaatttaaatgctgtatctatctgataagtgctccccaggttcctggaagccggttgggtttctttgttcactcaatatttactgagggctgatatgtgcacaggactgggctgtgacctgaagggtataaaggcatctgcagggattcgtgtacagggatatacacccaccacattttttacaatagcaaaatgtggaaatgggttaaatgctcaataatagtggcatggttaaataatatctggccttgtccatatcatggaaagtgatatttatctttttcagtttggcctgctataagaaatatcccatagactggtggtgtagaacaattgaaatgtatttttcacagttctgcagaccaaaagtccgaaatcagggtgccagcatggttgaattctagtgaggaccctcctccagaagactcttgacttctcactgtattctcatatgatagaaagaagactagacagttctcttgggtccctttttcaa

SEQ ID NO: 107894 - DNA, 2412 bp, Homo sapiens
acactgctaccctaattactactgtaatttgttatctacattcataaatgtagaaagcatttatacatttataaatacattcataatacaggaaaggctaaatttcagttagaggttagtgaagataaagatgtcatttttctccatccaaattcgtagactacagtggaaaaaaattatataacacttggaaataaaagatgattttgtgacattttagtatcatactggagtattgtataagaaaccacctaaggaccagctgtgttctaggggatgtaactctgtttattattttttatgggccatactttgtaaagttaagtaggatgcaaattatttctgtttggtaaagaagagaagcacaaagattattgccctgaaggacattaacctgttggtatctaatgtagcaatcttatatcaggattatatcctcttttttagggtctcttattagcgagttaagtaaaactttgaaatatgctcaatacctatttgtatgagaattaggcttttaacattttagaactgtacttgactccagttcaactgctgagtgagcaggacgtaaagatgtgttgcttagaagagaggtctgatctggagatgttaatttaggggtgctgttcaggagagtgggtgaagttggctgggggaccatatagggtaggaagagagggtagactgagtgagctgtggaacttcaacattgaaagaatggggagaggagggtttacaaagaagaaaggaatgattgctagagaggtaggagggaaaccaagtgtcgcatccagttcaagaggccaaacaagatgagaactggaagtgcctgtagggtttatctataggaggtcattgttgagccttcaccaagagccttttttgtggtggttgtggggagggcagatttcagagggatgagcaatggaaggagggaggagaatgggaggagcaggggagatggaaaattctggctgtgagtggagaggggagtgatatggggtccagagagagagtttttaaaagatgggtcagtgatggagtttcttcaccttaaggagatatgtgtaaaatggattcctgggctcccagcccctggagatgtttttcttcaagaataaagcccaggaatctgtattcccagaataccgagctctgcggtaaagctacaaaactagacacatttccaagttaatcttatatggctggtggtattttgccagccgaggtgggtgctctcaattgagtgtgtagcacaagttctgctcacattggagctgtgtcaccattgtctgcttggtgtcacttggcctgagcatgtgcttttctctgaagggatttgggggtttgtggacatgctggtagcagagggaagatggatcaggttgtcattgtagctcttttcagcaggtcacgctcaatagctggattggaagggacagcagacttgccagcctctcgggtattattctgggtggagcaacggggagtggatgatgctccagggatgtctgtgggaactattcacattgacagcccaagagaaaagcatcagatctgtcctggcggggacctggctctactgttttaggcttaatccgaggcaaatcccttctctgagcctcagttttcacatctctaaagtggggatagtaccacctctgcctataaacactcattgtttatgacaatttttcaactcctgcaagaacagttatacattttacagtgtaacccagtacacactgggctcactgaatgcatagtgttgctacctgtgctactcactgatgttttctagtcaatgtaattttttaaaaatgctactgtaactcactgattttatgactagactcctgggttgagacctgaagggtggaaacagtggcttagactctcagcttcagaggatgaaatgagatcatgtgtgtaaaagcatggatgtacaccgtgggtcatgaacactgagttgttattttcttatcagttaacggagcttggaggcagagttgatttccggagtgggaattcacctgctcttcctccctccctgctgcctaattcaatgttccctctaccagttcttcctcgttaacaggcctggcacaccaagctggcggtgatccagacccctcttggctcaagaagaggttttccaaaacattaaaagctttagggacttaagtcctggctaaatgcactgcagttgcaatttcaggataagaaaacctgttttcataagctctcagataagttgccctgcccctgaattgtccattgttgacagcaacatttgtgccatggggaataaaaaggggagacactgtgctgcgtagccccaaatgtaaggtgtggctttttaaaggaagcaaaatataagaaatgcagctggacttgtatttacagcag

SEQ ID NO: 107895 - DNA, 1010 bp, Homo sapiens
gtaaccacagtacaacgatcaaaactaggaaggtagtatttgattcaggacccaaaccagaatcacacactgcatttaattgtccttctttagtctcctttaatctggaatagttcctcagtctctgtcttttgtgaccttgacatttttaaagaattttcctcaatttggtttttgatgatgttttcatttagtgcattatatcagggggcacctgacgtcaatttgacccattactggtggtgttactgttggtcccttagttaagggggtttctgccatgttttcccactgtaaagatacattttctggtggggagatactttgaggcagttaattattttcataatggtagccaagtggtggtaatttttttctttaaacatttagattggacatgcttattatggcaagttgaaaaatagagaaaagggaagaataaatattaccgagggcaaatcctcagtgtttttctgagcatacttttgtttacttatagttgtggttataccacgtatattttgaattctttttttttttttttttttttttgagatggagtctcactctgtcgctgaggctggagtgcaatggtgcgatctcggctcactgcaagctccgcctcctgggttcacgccattctcctgcctcagcttcctgagtagctgggactacaggcgcccgccaccacgcccggctaattttttgtatttttagtagagacggggtttcactgtgttggccaggatggtctcgatctcctgacctcgtgatccgcccacctcggcctcccaaagtgaattctatttttaaagacattaaagcaaatatttttgcattgcgaagtctttaaaaacaccatttaaataaaataccatctaaatggcttattcttctattgagtggtttactctgtgtaaccattctgttgttgttggacatttaggttgtttataggttttaactcttatggttagaatggttgtgagtcatacgtgtgtcagacctct

SEQ ID NO: 107896 - DNA, 1160 bp, Homo sapiens
gtgaggaattaggatatttcacctagagaatcctaaaagagacgtgtttgctgtctttggagtgtgataggctgacagatgggtgtgtgtgtgggggggatttaacatttctaatgaggagccctccaagatgatatgggtatggtgtaggacatgggacttctacatattagcatattgagttcccacagccttctgggtccagctgagttgagtggtctcaggagattttgagtccttggctctggagggctacctggaggctggagacggtatgtgaggaattttgaggggatttctatatttttgggaaactcatcagcccaactcaactctgaattgaaagagatgtcctagcttttctgtctccagcagtggtcctcttaccagaaaagggctgaggtaaggaaattggagagttcccgggctaattcttctttcatttgtgaatagctggcaccaggtgaccaaagtacctgataagaacaggcacactgaaaatttgggctactgggaagaacactgggtaaatcaatcccttgacagtctctctgtctccttccttataaataacatatctaaagttaatgcatgatttggtgcttgaggcactttgaaatatcccagttggaacagatgtttgtatttctttctagttaaagcttttgttcagtgggcactcaagatctatttgtgtgtgccagaacacccagaatgagagctccttaaaaagatcatttatttcacccatgcagaagcctgcacagggatattccagggccagagtatccctctgtggtgtcagggacccaggtaacgtctatcttattagctcctctttagcaggcccttcctccccattgtctcaaggtggctacttgagttccagccatcttgtccaaattccagctggcaggaatgaggcagggactaagaagactcttatcagatgtctgttagggacagtttctaaaagttgccacatcacacttaagcttacattccaagggctggaacatggcccccttgctgcaagggagactgagagataaggcttttattgcgggtggccacatgcccagggaaactcaatggtttcttcacaaggtgtgattacctcacagtacttctctggtggtggtcgtgagaatgggtttacc

SEQ ID NO: 107897 - DNA, 1048 bp, Homo sapiens
aatcatctctagattttttatgataccaaatacaatataaatgctaagtaagtagttgttatactgtattggttttattgctattattttttactgttatcccgttattttttatgtttttcaaatgttttccatccatggttggtcaaatctgtggatgcggaacctgcgagatagagggctgactgtatatatctgcagtccatacagccttataaaagtgcctggaggggaagggagactgggagtgggctggggagtgtccctagaggtgaagaagtaggtgtggtgcatgagatgtgttggtttgccctcatcctctggaagtaaagcagctctaggcagcacatccatgggcaccgattcttctggggcccagccagaagctggaactcacagtcgttggctccttgatccccaggtggtcctgccatcatggctgtcctctgcaaaggtctcctcgctcattgagagaatctctgaccccaaggacttgaaaaaactgctcagaacccggaataatgtactggtgctttactccaaatctggtgagtgtcccttcctggccttgaggtcaaccatcggggtaggatgggattcaggggaaggagtgggaggcaggagacgttaggatgaaaaccacttagggagggtccaagggacatggggtttgtcacctttcctcagaagacagaggcagaggcacacagaggcattggctctgccactttctgatccgagggggtggttccatttcttttttatgactgtttgttgggaaagtcctctggagcccctcactcctcaagagggagagggcgtgtgtgaagtaggacagaggatcacagtggcggacactgggcatggatgtcctggcttcctgcacaggcatggggccgagccctgccagggcatgcttcaccagagctgttgattaactggccaggccggcctgttgccagctgaatgggtcccaggcttggaagtactcaccccagctggcagccctggccctgcccagtccatctgtcctgctctggggtcagat

SEQ ID NO: 107898 - DNA, 1039 bp, Homo sapiens
ccgccccattgcatggccctttttgtttttgagatgaggtctcactctgttgcccaggctgcagtgcagtgtcacaatctcggttcattgcagacttgacctcccgggctgaagccatcctcccagctcagcctccccagtaggcgcgtaccaccacgctcagctaagttttgtattttttttatagagaccaggttttgccatgttgccccggctggtcttggactcctgggctcaagcaattcacctgccttggcctcccaaagtcctgggattacaggcatgcgccaccgtgcctggcctggccttcttttggcctcttttcccctttctcctttctatatggatatatattttcctttttttaaaaaaattttttgcttttctgactcttcctccctattcctttatgtgcacctataggaacacacaaacacttctctgctggttttctccccggtccaggccctgtaacttgttgctctggggtgtctgtagggcatctgacttctgtctagggttttgtcagctttccttccccctcactccactcttggctcagacctcaacagccacgctcagtctggctggtgatggttgtccggctgttaagcgggttgtgtgtgcgggagttggtattcccctcgtgccctgccagctgggcgctggggctcgggcttggcgtggagtgctgctgtctgggaagctgagctggagccagcatggagctgtgcctggtttgctaattcccgaggctgcgtctcacagggggcaaggctgtcctatcaggtgcttgctactttcttttcctcggggcttaaggtcattgcttaaccacatctgctttctttcctgctctcctccccatctgcttgatttctctggagcagtcacagcttcccagatgcaagactgggggcctgccagagcaggcataacatattttaaagacttatgttttttcctaaaaactatttgaatttagcatttgctcctaagcatgttcaacattacttaccagggggtaaaacagactccc

SEQ ID NO: 107899 - DNA, 1016 bp, Homo sapiens
gctgaaacttggaggccacgctgaagaacaggcaggggtgcctctgtgcccccagctctaccagccaacttagttgttttggagtcttggtcctaagccttgcctgggccctcagggaacctaagactgctgtcgtgggacttttccatggaggggtttcccacagagtggaccaggattggcgtggaaatgaaccaagcccctgtttcctccctctgctttgtgatagtcacaggcagaggctgccagccaggcttgatggaagagagaggagcatggggtggggattctcctgtccagttgctgccttgcagcgtctgagcccccaggcaggaactgcagtgtgaacggagaggcaatgagcaagcccttcgcagctgctggtgtcaggatggggctgatggggctgagggaggccatgcacatcccatcccagccttggcccctgccccagctgctgtttgttgttgcagttgggtggacggtaggtggtcacagaaacagtggagcatagcagaacaaaggccagcgaggaaggtgccatgtgagtggttgtaaacatcctgagttgagccctgtgtcccagggaattaactcaaacagggaaagggcacctcgttcgcagttgttctcaaacagacccaccacctgtccatgcagcttcaccacagagtccctgcgggacggggcacacctgaactgtaatagcagttgtcagaagaggcatgcgtggacctcagagggcttaaggataagaaagttttcagcgggtgccctgggctgccttctccatttggagagcccactcccagcttgccccttctctctggactctatcttaaaatgtccttgccaccttggggtaggaactattgcagtgtcattagcctttcctctctggattcctcatgcatttcatgagtccccactgtttgccaggcccatggctggaagctgcagtggctgcagcgatggctagacagctgggactagtagggaggaaacccctgggcctg

SEQ ID NO: 107900 - DNA, 1868 bp, Homo sapiens
cagactgtgaactttgcattaagtcctttccccaggggccaggctctttccccaccccccacctccacctctctttactgaggcatcatcaggcatcttcctcatgcacccttcatcctctccctgcccaccagccctgtccagtgggctatgctagctggtggccaaaggctgctgacttgtctcctgaccacagcattccctcatagctcgtcctttctgcttcgagagatacaactggtttgagggttgctttcttacttagaaaccctcgggagctctccgtcacttcctgaatacagtcccgatttcttaggtatttcaagcctttcccaaagtgatcctggccaactcactcagccttttctttcatgtcttctcctttctgtgtatcctgccttccagttagatggaaatgtgctccatttcttgggccacatctttctttgccttgcctccagttccccatcccgggacgtctgttgaaatcttactctcctctgagtgcaagctcacatgcagcccacgctaagaagctgccgtgatggttcctggcagcagggctgaacacacagaagagcatgtcacgccagctgagtggccccaagcatgcagatggcagtggggagcagggaggctgtgttcttatcttctccacaggccgagaccaggtgtgtcacctcatttgacttcacaaattctaactccagaaagtgtttgtatgtagtttttcaaaaatttttgcctcattaactaatagatgcccccaaaatggcacaaaagtgctacagaaacttggagaattaagagctcaccccaagcgaaggtggtttgcaaaggctgcccagagacgtgaggtttgatttgccttaagggatgggtgagtctggagggtcgccaggaggcgggggatgggcagcctcagtaaggggactggaaggcaccaagtgggggccaggagagaacagcgagtgttccagaagtgtgggcagaaatagagcacctcctagtcctagtaacaaaaatagctaatacattttgtgttattgattatcttgtattatttcattgaatcttctcaacaaccacatgaggtggctgcagatgaggaaagtgagacgcagagacaactgtgactcattcaaggaaatgcgcgaccccatggggagttgggactcaaacccaggcatcctgagtccatgcttccagccactgcatgttgctgctgcactcagcaagatgtctgagaaggcagacagtccaacttccttcctgtgcagaaatctcagactgtcttattcctgggagaataaaaaatctagaccctaacaggtgtacaatgaagagttttgtaagaaagaaagattcaaaaatgaaataggtaacatatgggcattgaatgtggagctggattttagcctatattcaatggaattggaaggttttgtgcagggaagtgatgtaatgagcgaggaggacgtgtaagattaatctgtggtgaatgtgcactgacactggggagatcaattaggcagaaaaaaaaaggacttttaaagaagacaaatattactggaacaggccgctggagcagtctgggaaatgagcagaatgacttttatagagcgttccagggcttcaagtaaattcgaattcaaatttattcttcctgtattatttgctgcatcctaaaatgggctaggaaaaaaaaaacagtgaatttagtgagcatttattgtgtccttgctgtatgtgaggccttgtgctagggacttaaaacaattggaaagatatccaggtgcccctaggaatggagaggccagaggcacagtggctcccatcaccaggaagacttggtaggaagatgacag

SEQ ID NO: 107901 - DNA, 1022 bp, Homo sapiens
tggcaaaattttaaggtgcttaaaaagaatacattcaaaagtctcgctttcacttctttcctccttatcctccctcctataccctagaatttacaacttagaccagtttcttttatgttcttagagtgtttctgtatgtagatattagcaaatgtgaataagtatattttatctccccccttttaatgcaaaagttagcaaattctagactgttccatccatctccagcagtttgtccacatcagtgcatagagaacatcattctttgcagtgctcagccctccctcgtgtagatggacagcagtttacctaacccgtccttccaattttcgctatgacaacctgcagtgaatgccttcagatgcacataattttgtatgtgtgcaggtgtattgtaaagataaattgctctgaagtgtaattggtggtgttttgaggggtcagtagtttgagcccaagtataggaacctagattgcatgatgtttgtctaggaccattgtctggctggtgactcattctgaagcttgattttgtcaccagtcccatctgacattggatatgcatggactgagattgatttgccctctccctgcctccttccatttcttgggacctgggaggccatggtggccagtggggcccagtcagaagggccagagagggcttctgaaggcgacatcatacccggctgcggagggaagtgggtggcagagttccattgtgtcagccacttcactccctctggattttccagccctggctgctggaactttaaaatatttcctcctgtaggctctcaaaagtgcgacacaatggttgtcttttcacatttgtcatccttgagggttttttcaaagctgcaattaaggtgctctggcaaaggtagttgtgacagtaaagcagcagggagactgtgtcaccaccagccaccttgtcctgaactttggggcaagggagggcccctgcgagcctccctcctcctagcagatgatgacctaggactggcacacagtcacgctgc

SEQ ID NO: 107902 - DNA, 1116 bp, Homo sapiens
tggcctctctctctcctcctcaccccctcctctctgtaccctcttcctcccctccactgcccagtgggcagttttaaacacaacagtgagcttttccaaaggtcaccattcactgttgctatttattctttccagtttgctgaaagtttgaaataggttgagaaagctaacaagcccctagattcccaggaggaagtgagatttcttaggctatctagagagctgtagccagaagccactgtttgtaacaggatatcagctaagtacctgtctggggctttgcggggaaggtggaggtgggcagggccacaccactcaccccacggcacctccatgagggcagtttctggtttgttaaaggctgagcccctggagtgggccgtcccgagcccatggggagctttgggtccaggggcctggaattagaagggctgccaaggccccagggcctgctctgagctctgcctgtttttggtcttccagtccgcagccgccacagccccaggtccctgagactccctgggcagatgagggcggctccgtttatcacctgaccgatgaagactttgaccagtttgtgaaggaacactcctctgtcctcgtcatgttccacgccccatgtgagtggaactttgctcctccccctccacaccctcccctctctcagagtaggatgagtgtggcgctttgcaatgtgaacccaggaagcacttattttttggatgccaggacccatgctaagccaggggatgcagtggtgacaggcgaggtccccaccctcgtagtgcacatggcctaccccccattgccatggaaacaacacagaagtcctgatcaggctttacttgtcccttagctagagctcagtgagtctccaccacccctagctctgagcatcttcctcccagtcagcatgaattggagaaattaagctggaagcaccctgagatgttacctagaacagactgggcctggaaataaaattagggctgatacctcatatgggggctcatacctataatcccagcactttgggaggtcaaggcaggaggattgtttaaggccaggagttcaagaccagcctgggccacatagcaagaccccatctctacaaac

SEQ ID NO: 107903 - DNA, 1722 bp, Homo sapiens
cctcagactgccttctgtccagagaagatgatgatggtgatcacagcatggtgccacaacctacacgctgcctgcagctagggcctctcaccagatggttgggttttcaacccagctctgtgaccatggctgtgtatatggccttgggcagtcacctgccctcttggtgcctcaattgtctaatccatagaatggagataatgtcagttcctactttgtggggtagttatgaggctgtaaggcactggtcagtacctggcacaccagttgcccgtattatttatgcagttgttttatttttgtgtctggggtaccttcccactaccccaacccacttctggtggattatgcaaaatatttcttttctttgagctggtgctgctgctgcttttctcaggtgtctgggaatgggactgagctgccttacagaggcggcgcaggggagcatcccgagggcctctgtgccataagaatggtttctcttgatctctccccacagggtgtggccactgtaagaaaatgaagccggagtttgagaaggcagcagaagccctccatggagaagcggatgtaagcttcctttccttccccctcaccgttctctttgaaagaatcactgacaggtggaatcattatgactttcccctgcaagccctgctgcagctcccgtggtccgtggaggccagcagtacctctgtgtgcccaagtagaacatcttagacagatgggatcctagagggggcagaaagactactggcccatgttcccgtgcccatccaggtgacctctgcctgctccctcttttctctgggaccctggctaacaggaacaggtgccaatctactcaacgtggctggtggggcagattcaaaagcctcatctcagctcataaatgagaaatgatggccgtgccaatgttcagttgttccctgggatatgggagcccactgggctagccaccccagttaaattccagcaggtccaggatgggttgtgggggcagcgtctgggctcctgtgttccaccagcaccgcatctgaggctgtaatgcatggttggcctttcccccatcccagagctctggtgtccttgcagctgtcgatgccactgtcaacaaggccctggcagaaagattccacatctcagagtttcctacgttgaagtattttaagaatggagagaaatacgcagtgcctgtgctcaggacaaagaagaagtttctcgagtggatgcaaaagtaagtgttacgatctcagtagcacatcctaactgccagctggcggcccctggagaccaccttgaggaggtgaagtaaactttatggtcaatgtcctgggctcatgcccgtaggagtcaagacggatctgacttcctcaaccctaaaaccaccgttcatatgctgatcacgtgtcttgatcaggtcactgctggcagtccttctggacgcagcttcatcgacgcactaaaccgtgtgttgctttttctctgtctcagcctccttaggcccagatcttattgtctgcattttattccactccctttgaataaatgaaggagacacagctcttcatagccagagctagactcatttcgtccaggtttgctagtggttggctgggcctccagtaatgtccacagggcaggctatggtggtttgcaactgaggataaagattttgaagagccccctcagcctatgtattagtttgctagtgttgccata

SEQ ID NO: 107904 - DNA, 1009 bp, Homo sapiens
tgggggacaacttccgggagaccctgaagaagaagaaacacaccttggtcatgttctacgccccttgtaagtagcttgggtgctcactgagtggcacagtaagaggggtttggccccaccaaaccaaaaagacccgcacacccaccccagggaccaaggcagccgctgatggatcccagggtcatctccattatgaaccaggctctccaattttattccaggctaagaggtccttcaaatccagggcctccttttgtcagactcgtcgggctctccttcctttggggcagcctttctcgtgtctgtcctaaagccctctgcctctgtgctcgtcccctcttgtccctgggctcctccatgcccctgtcccctacctgcacacttcccacccctcagctgtccccgccccctcttccttctccagacactgacttatcttcagcaccttggaaccccctctccctgcccttccagatggctctggagccgtggcataggcacagccacattcgctcctgagctcctgtgctgtgctcgttttaatcagagctcaagctgaggaagtgacacgtctgccgacattggcatcggtgacctcaggtttctgtgtattcccattttgaagttgttaattgatacttacaatgaaaggttcttagaatttcccactctctgctgcccttctctctctcccccaggttacagctcagcttaatggagtgaggataataaaagctgcagtctacagagaagccaggcagctccatctagccataaacctgctcagttgtagctggccctcctgttggctcccccgtccccacctttcaagtgtcagtaatccgtggagtctgtgtgttctcagggtctgagaggggccgccacagcctcagcccctccttgaggcagcctccctgcccatctctttctgcctttccttctcagagtgggacttgtcctctcccagtcccttacagagcttccggctgtcctcttcggtctgtagagt

SEQ ID NO: 107905 - DNA, 1074 bp, Homo sapiens
gccttccttcctgccctccttccttcctgcccgccttcctgcctgccttccttcctgcctgccttccttcctgccttccttccttcctgccttccttcctgcctgccttccttcctgcctgccttccttcctgccttccttcctgccttcctgccttccttccttccttccttcctgccttccttcctgcctgccttccttcctgcctgccttccttcctgcctgcctttcttcctgccttccttcctgccttcctgccttccttccttccttccttccttcctgccttccttcctgcctgccttcctttctgccttccagcctgcctgccttcccgcctgccttcccacctgtcttccacctacccatcaaatatcagctctgtgctgtgcagtgtctagggcccagggtacaagggagggagacatgtccctgccaggccttgaggggctcactgtctaccctgacaaaattctaaacacaatccatccagggcagggtcactgagtgactcaacctctggcagagggcttggtccttagagtttcttcatttctgttactgcgtttttctgtccctaaaccttgccccagggacatacatctttatcagtgggttacagggggaagactttccaaggacaaaaaagatacatcttttgactttttaataatgaaaataataatacctatttttatatataaatatggcatatactatatactttttatatatgaaggatctaaacactacagaaatgtcaaatagtaaagtcaaatgcctgatagaggtctaaaggaaaagcagcatacccacacgttcctgctccccttctagctgcctcaccccaacatcttacctcccctcacatctctccacctcccacatcccttctcccaccatgtctgcccctgcatcctgtctccccagcttctgcacagctcttcctcctgctgtttcattgttccttttacgctgaatggtctggtcatggtgactgcccttctcaggccagcttggcggagtctctagaactgcaattgtccagcctgtcctcagtctttgttcctcttt

SEQ ID NO: 107906 - DNA, 1915 bp, Homo sapiens
gtagctgggattacaggtgtgcaccaccacgcctggctaatttttgtatttttagtagagaaggggtttcatcatgttggccaggctggtctcaaactcctgatcttgtgatccaccctcctcagccacccaaagtgctgggattacaggtgtgagccaccacacctggccattttaattactattcttatattactagtaagttgaacatttttacatatgcttatcaagtttggctttaatttttatgtaacccaaattgttcattttgttttaggtcttctctgttggttgaaatgtctatgattttatctgcctcagtcattcgtgtcagagatggactgccactttctgcttctactgattatgaacaaagcacaggaatgcaggagtgcagaaagtattttaaaatgctttcgaggaaacttgctcaacttcctgatagatgtacactgaaaactggacattataacattaagtaagacttcagtttgcttcatttgactcatttgcccagtagttgtcattttaatgaagtttaagtggttgcaatagaaaggagtgattaggaaaacctgttcaagtcgagcatcatattgttctgaacttatactaaatagtcatcatgtcagcagcagcctttttgtagtttctttgtatctggctctgggaaattttatagttgtgcagatcatagatatccctcttttaagttgatcactaaatatttatttgcattcttacatacctagggttgtagtaagcaaactataattggaaataaaaattttttacctgatatctgccctcaaagaactgaagcaacttacgtctagtgggagggggtagcacttatcactgagtcacatacaaatcaagtaaaactgggcaatgggatagagagtgactatttattgtggtcaagacactctctgagagggtgacatttgagcagagacctaaaagatgagagaggaggtaattatatgaaggatgctgtggatgaagagcaaggcagaggtagcagccagtggagaagcccttttttacatgccaagagacagaaagaaaaccagtgatcctgaagaattatggacaattaatagagttgcagaaagtgaggccagaaaggtaggaatggggcaagttatgtagtgagtttggagtctattagtctgtttagtctaatgcagtaggaagccattgggtagttttaagctatagagttacatgatttcatttggcttagagtagatcattctgcctgcactgtgaagaataaaggaggaagtggaagcagagaggtcagatggaagactcagagaagttcaggtggaggtgctgattgtaacgagctagggtagtaatgaatagaagtagttagattggggctatattttgggattaataccagcaaatcttcctactggattgaaataggatgtgaaggtaaaagaagaataatcacctgtagttttttggcctgaggaactggatgaataatgtagctgaaatgagcaagaaaggagaggataagtgcgtctccttggtaaaaagtaagagttctgtttggacatgttaaatctgagatgcccattagacatccaaggggcactgctaggtaagcagctggatatatgagtctgaagcttagtgaagaggacaagtatagacatttagatttggaagtcagcttacagtttgtgattaaaaccatgggaatggatgagaccaccttggaaagcttagacgtgaaacaattagagaacaattaatgtctgatatcaagctggatattgattatgcatacagaaggaaataaggtaaaaacacagtccatataggatataataagcagagggcttcgttgttgagatgagacatgagccatgtcctgaagaattaataagagttg

SEQ ID NO: 107907 - DNA, 2862 bp, Homo sapiens
cattcttccagcaactataattatgagagtttaggagtgggataaatcagcagaagtctaatctggtctagttcaagaatacaattcagataaatgcatttcagagccatgcatagaaaaatgtctatgcatgtttttttgtaccaaaccttcaataaggattggaaaacagaagttctagttctagttcctgacaaggacctggatttcatatgttttctatcattgataagagatcttgtggtttagtttctgtttaatgaggttgttaccttatatgacattgagcttagactgaaatgcgtaaaattgagaatttgtgtgtgttacctgacttaaaattctcacaccacaactgtttttctaacaactatgagtttgctagataaaactcacaggtctgctgtagcaacatcatagcacagcctgaaattgccaccatgctgtccctcttttctcctagccatattaaatgcttctttccttcaaaccctacttcttttgaatcaccttctttctcattactattttatgtctctaatgatctcactcctttcacagatcacctgtagaactcggttgactgcctttttcatcacttattaaaatttcttatttttaatttaattttatttctccatcctctctttataacagggttgtaactcattgagggaattgatctgccatggcttatactatttttgattcctcaactcttggcattgtggttttcaaatttgtgtagaaattgagatactctttctttacagaatctcaaaatcactaagtatataattatgtgccaaatcagttgatacctcacattaaattctagttgaataggcaagggaagaccagagtttgaaggaaaaaaaaatcaggggagtaacatttaaaattgagataattaggctgggtctggtggctcacgcctgtaatcccagcactttgggaggccaaggctggcagatcacctgaggtcaggagtttgagaccatcctggacaacatggtgaaaccctgtctctactaaaaataaaaaaaataaaaaataaaaagccgggtgtggtgatggacatctctaatccaagctactcaggaggctgaggcaagagaatcacttgaacccaggaagcggaggctgcagtgagctgagatcgtgccactgcactccagcctgggcaacagagtgagactctgcctcaaaataaataaataaataaaatttaaaaataaaataaaattgagaaaattcctttagttttcttctcctctgtattgggaaaatgatgaatttcaaatgaatgtagtagctggatacttctgtttcgccaatgaaggacattctgtggagcatggcttgtgctagcacagttccttgtgcatgtcgtagtagctactaaatgagggatggttgttttaggaatatgacagcattcagagtgccagagaaaccttgttgattgggcaggatggtgtgtagtgtggggtgttcagttttgtgatttcttctcacattctatagtgatattccaattctctctatataaaattttaaggaattcatctgttttataagtcgaagggtactttccttagactgtaatgaatttttaatgaataaacttatgttaccacttaagaaaaaaacatggctaaagtaagtatgaaccatatggaaattaggttgggtcatctgagatctttaaaactttgcagttggctttagagatttaaaaatcatagttgtacattttgaaatctctttatttaaacagtaagatgctgaaaagacaaataccttttgggaagccaatcatatcctattgtgaattttagtgcaagaagtaaaattttttagttctttcactgtgaattcatttgaagccgtataatcgctgtgagcctcctaatgttttttccttgcctgagggttcactttctccctacactgctacctccagccaggaatactgttttaggcttacctgcattttggctttagtgtctagcagtgtttccctttcactctttcgggaaattttctgattactagagtaacaacttaaactataacccaattattgagtacttgctattgccaggtactttactgacattatcattaagctttctaacagctctgtgaagggctattaaatagagctcttttccattgccaggggcagacacacaactcacattagcttaaggaaaaatgggtattttgaagggtagtggtggagctggcttcacagatgttatcaggaatctttctcatttctacagtctctcaccttttgcagatagatactctctacgacttgaaagcactacacagacagctccaggcttacttcagtccaactgagcaactcctctccatgtctcaagaacaagacattgtctttgcttgtataattgaccatttctagactgattaatcattgtagtcagaggggatgaggtactcttatttggctaagactgcatcacatgtccttacccctttgagctttaccaaagccatacagaatggcgctgaaggtaattccccaaagggaaagagggaagggatgctgggcaggtagatgctgggtagtgctatcactaccctattttacagataaggtaaatgagacttaggaatgtaaaggagctccttcaacgtcacaaaaatagtaaatgatatatatgaaccacaatcttttggattcaggcatcgcattattatctggtaaaaaatggctgctgctctttacccttaacccctttcttggcagcatgtgttcctaattctcccaattcttttcactttttatggagagagaaatgaaccagggaagagaatgaagggaaa

SEQ ID NO: 107908 - DNA, 1097 bp, Homo sapiens
attttaaaaccaatgttttttacactgtagttttattagctctctgggagtgagctacatgatgttgtgcactgaaaattacccaaatgttctcgccttctctttcctggatgagcttcagaaggagttcattactacttataacatgatgaagacaaatactgctgtcagaccatactgtttcattgaatttggtaagggcctgatttttttttcctttttattctgtctgcatccaatcataagcaattttaaatctaatattgggtggaggggggacttctgctatcttgcttttgatataataatttggtaaatgatctataaattatggtaactttttacttagatgcttattagaaaaaaattgtgtttgagctgtgaaggggattgtgagtattggtccgaagaattaatgccagaggataacttctcaatgagaaatttataagccagagattcagacttttgcgtttctgtaataatcttttatagtctgcttcatgtagaataggggatggcaaacatttgctggaaaggaccagatagtacatattttagactttaaggatcatatagtccctgtcacaactattcagccctgccgttgtagctcgaaagcagccataggcagtacgtaaatgagtgcagttatattctaataaaactttacagaatagtcagcaggctagatttggcctgtgggcagtagtttgctcaacttctgatgtagaagaaaaaaaaaaaacaccatgttgtaaatagtaaaaataaaattccacttggaaaatatttaggaaatgtcttatgttagttttattcaatttattctttaaaacctacattctaatggtgtaagcaataaaaaacagatttataaaaacatgcaacttctagtgtgtgttcttatgtaattgcagctggtaaatctgacagatttaatatttcatgagataggaatctctataaaaatcaagactttgggccaggtgtggtgtggctcatgccttttatcccagcactttgggaggccgaggcagtaggatcacttaaggccaggagttcgagaccaccctgggcaacatagaccctgtctg

SEQ ID NO: 107909 - DNA, 1104 bp, Homo sapiens
agtttgaggttacagtgagctatgattgtaccactgcaccccagtctaggtgacagagcaagaccctgtctcaaaaaaaaaaattcaagactttggtttaaagttaaagctgttttttgtttttgtaatttcttgaagtggatgtaatacacttaggtagtgttaaatccttagtttatttaaaattactgatttctagagggtaaaactgatgattccatgatacattaatcattaaacacaagtaatattggactatttcatgacgaattgaacaattttgaataataaactacctgtaatatttactatccataaacatcatattctgaaatgattaattgacaagtgactgcaaggaaatttattttttattttacatagataacttcattcagaggaccaagcagcgatataataatcccaggtctctttcaacaaagataaatctttctgacatgcagacggaaatcaagctgaggcctccttatcaaatttccatgtgcgaactggggtcagccaatggagtcacatcagcattttctgttgactgtaaaggtgctggtaagatttcttctggtgagttctggatctcagttattttattttaaaaaaatccttgggaaaaactgagaaactcttgaaaatgaattactttattctaatattttaaatcaagtacatgagagaatatagaagttcaaagcaatcctttcagtgatttataaagtaagctaccagatgtgtgactaatcgggaaaatactttcaaatagcaacctcagaggatctctttgctagaaaaacatttttttaaatttaaaattaaaaaaagttaattttcatgggtacatattcggtgtgtaatatatttatggggtacatgagatattttgatacaggtatgcaatgtgtaataatcacattagggtaaatggggtattcatcacctcaagcatttattatttctttgtgttataaacatgtcagttgtgctctgttaatttttaaatgtacaataaattattgttgactgtagtcaccctattgtggtatcaagtactaaatcttattcattttagctaactatattatgtacccatta

SEQ ID NO: 107910 - DNA, 1078 bp, Homo sapiens
catttctctgatgatcggtgatgttgagcaccttttcatatacctgtttaccatttgtatgtctcttttgagaaatgtctattcagatcttttgcccattttttaattggcttgttagattttttcatatagagttgtttgagctcattgtgtattctagttattaatcccttgtcagatgaatatagggattcacattcccttctcagtttgcaaatattttctatcattctgtgggttgtctcttcactttgttgtttcctttgctgagcagaagcttttaaactcaatataatgcaatttgtccacttttgcattggttgcctgtacttgtggggtattactcaagagatctttgcccaggccaatgtcctggagagtttccccaatgttatcttttagtaacttcatggtttgaggtcttagatttaagtctaatccattttgatttgatctttgtatatggctaggaaaacatttaaggtttctttgtaaacatttttctagaaatgaaaaataggttctttgtactgcatatttataggcatgtaaagtgctttgcattttgttaaaatggctacattcaaggccagtgttcttgactgtcacggaaggtgtaaatactttagtgatcgtctgctcaaacctcccatcccaaagaaggaatactatcgtcaacagttgtgaaatgatataaacttttgcttaaaatgaacacctcattattttataaggtagcatatgccattgtcagactatttgtttaagaaaattattccaacctaaggctttaggaaaaaaaaaaaacttccttatataattgagctaaagtcagcttccctatgtctactagtttgttttgtgatctgttcctcccttccttcagcagaaccagaataacagttaagtcagcaactgtgtgtcctttccatcctcttagactagtctacttcatataaatatctccaattcaccaatgagaacacatggacacagggaggggaacatcacacacgggggcctgtcaaggggttgggggcaaggggagggatagcattaggagaaatacctaatatag

SEQ ID NO: 107911 - DNA, 1819 bp, Homo sapiens
tactgatatctttatcaggtaaaagtaaaatgcttctgattttctctatttattaggatagagaaaaatgtgttaccaaattagtacctacaacaggtcagagaatgaattgctttgttccataagaagactgcatttgaaaaagcacatgcagttgaaacctacaatctgtcatcctccaagacacatccattttggagacttatactggacagttaaatgggaatataataggaattgctacctatacatcttttaagacttggatggtggcactgatctctgtaattaccttgatgatatttggattgggggagctcaaaaacttccattggaccttccttctctaatagttctaattccatgggtctggcagtcaatattgcaaaatatatccgttcgttaatagacactcaggattcaggtatataacctaaattaggggtgggggtccaacttgacttaccaggaggtagactctgttagaaactccacgtatcacctgacttccataagtccccaccctgacctgtagctggcagtggcatcctggatcaccaaacgttagacacttggaaaatggggagagtctggtatttgttattgttttaaggaagaggggcaagatgcagtggttcacgcctgtaatcccagcacttgaggaggccagggtgggaggatggtttgagcctaggtgtttgagaccagcctggacaacaaagtgagaccctgtctctacaaaaaaaattaaaagattagctagacatggtggcacgtgactgtagtcccagctactagaaaggctgaggcaggaggattgcttgagcctgggaggttgaggctgcagtgagccttgatcatgccactgtactccagcctgggtgacagagtgagaccctgtctcaaaaaaaaagttttaaaagtaactcacaactagaatttattttattttatttttatttttgagatggagtcttgctctgtcacccagcaggcttgagtgcagtggcgcaatctcagcccactgcaacctccacctcctgggttaaagcaattcttctgcctcagcctcccgagtagttgggatacaggtgcatgccaccatgcatggctaatttttgtatttttagtagagacagggtttcaccatgttggccaggctggcctcgaactcctgacctcgtgatctgcccactttggcctcccaaagtgctgggattacagacgtgcgccaccacgcccagcctagaacttattttaatataactttaaatttacttttaattcagaccaagcctacataatattttctatggtccccaagttaaaatatatttttatgttttggaacttctaaataaaactattcagtttattttagaatctgtttaatagttacttgataaacatcatttttcagggttttcctccctctgttacagtatcttactctcagtatcttttttgtatttcttgacttttttctctttctaatcttttgatcctctccccacagtctggcatgaatgtttttatcttgccatacttattttctgaagtctacagatgttgttcatggggttaaaatattaaatgaagggtactgtgttctgcttttacttcttttaaaactgtttattatggaaattttcaaagtaaacagaatagtataaataaacagaatggtataattaactctcatgtactcaactataacaacgatatcaacattttgccattcttttttcatctgtacttctacctactccccactcatccactcactaatttatttctatatttttttcttgtttaaggg

SEQ ID NO: 107912 - DNA, 1031 bp, Homo sapiens
aggccaaggtcagaggatcacttgaggccgggagttcaagaccagcttgggcaacatagtgagactctgtctctataaacaattcaagaaaaaattagccaggcatggtggcacgtgcctgtaatcgtagatagtcgggaatctgaggcacgagggtcgcttgagcccttgagtttgaggcttgtagcgagctgtgattgtgaccctgtctcaaaaaaaaaggaaaaagagaaaaataagttaatttttcagggaaatgaagcttttatgttgtcaagcatttttcattttataacagtatttaattgtgaatatatggtgttaaataattctatgaagtatctgcttgacccatttaagttgagcagtgaatttctgttttacctaagttcatctttgtgaggtattggtgttcatttctaactatttcttttattttccagctcaccagcgactggaaccagcaactctgtcagggattgtaggatttatccttagtcttttatgtggagctctgaatttaattcgaggctttcatgctatagaaagtctcctgcaggtactgtgctatttttgcaatttcaggtgactgtgcctcttcattctactggttacataattgatttgaattggattgggtattagtataatttacagtgcatactcaaaatctatgtttttttatatctgctttagcctccttctaaaaacactggttggcttctttgattccattggcacatgtttatcatctgctctttaggaggcactatttataggcaccctggggaccccaagatgtgtgtgacataggccttgcagtctcataactgaaagttgaactggggaggcaagaaagtaattgccaaatacacagagttgggaagggggagaggtcagtataatcaggattggagaaggaaggttttgtggaggagagttgaactggtcctggaaagatctgatcagacagagagcagtggaagaatgaagagggcacacgtgggctgtgtttattccacttctgtgta

SEQ ID NO: 107913 - DNA, 1032 bp, Homo sapiens
aagatgctcttattacctgggaaattccaagtgatttaggagttctgtgtcagatactgttttttatcatatatatatatatgtatatatgtatttgagatggagtctcatcctgtcgcccaggctggagtgcaatggcatggtttcggctcactgcagcctctgcctcccaggttcaagcgattctcctgcctcagcctcctgagtagctgggattacagatgtgcatcaccatgcccagctaattttgtatttttagtagagatggggtttcaccatgttggtcaggctggtctcgaactcctgacctctagtgatccgcccaccttggcctcccaaagtgctgggattacaggtgtgagccacctcgcccagcctcagatgctcttatcactcaagaaattacaaaggtttcagtagctctgtgtcaacaccagggtccatgaccaaatatagggaacaaaacaaaaaagaccaaatatggaaacaagagtctcctagcatgtttatttacaagggttttattttaggagctctgtgtcaggaatcaggggcagaggagagaagaaaaatatgtggaactctctgcttaattttctgtagacctaaaactgctcttaaaaagtctattttaaaaatccatcattaaaacacagactttctccataataagaagttggaggggctgggcacggtggctcgcacctgtaatcccagtactttgggaggccgaggcagatggatcacgaggtcaagagctcgagaccatcctggccaacatggtgaaaccccgtctctactaaaaatacaaaaattagctgggtgtggtggcgcacgcctatagtcccagctattcgggaggctgaggcaggagaattgcttgaacctggaaggtggaggttgcagtgagccaagatcgtgccactgcactctcagcctggcgacaaagtgagactccgtctcaaaaaaaaaataaaaaaataagaagttggaggaaaactggaaagggaggaatgttctcactctgggctt

SEQ ID NO: 107914 - DNA, 1047 bp, Homo sapiens
ccaataaccagtgcaaaaggaatttttcctttatactattttatgaagaaatgataatgagatactcttctgtgtcttgtggaaattatcattgtataaagaggttttttttttctctctaatataagaaaagggccaaattaatgttcctgcctggaagaaaaaaaaatgtaatgctcctgcccgaactttatcttttactgtataaaaacattgaaagaagtcgataatgtagatatttaagaagaaccaaaaaggcataggaaagcatgggttgttacatgtctccattagttttcttttcagagacattctatgcatgaggtatctctgtttttcctctgggtggctgtttttctagcatagcatgcaagactgattagtcttaatttttcacgttgggatttagcacactctagtggacagtagcttttcagttttcacagtttttaaaaaaatcatatcaaattactttattggacaattcagtgatatacttactagcagtaaagtttgtcagtatttgaatcaagtaatgaccctagtgagctggagtaactttgtcagccactggggtgttgtacatttttacatgatttttttagcagtaggaggagaggcttttatcgttatgtcagaacttttccccagtggttttcctcttttgagtggaatgaaattgatgggggtggccaaaatgaagaggaacacttgtacctctacctcacactctttaggtcttagaatgtgctttatgttttcattttaggactcttgagaatttctatataccagtgtgtgacaattttgactgtttgtaaatattgttacatcctatcttgatggattgtttctggaaatgggctcccaccggaaacaaaaataatcttttattttgcttttgcagagtgatggtgatgattttaattacatcattgcatttttccttggaacagcagcctgcctttaccaggtaggttttcttccattttaaagaaacacttaccattattgtttacttcgggtatcagttctaacaattgtgca

SEQ ID NO: 107915 - DNA, 1034 bp, Homo sapiens
ctcattgcttcagtcaggaaatgtgataagtttgatcatttggttaagatggtgtctaccagatccccattgcaaagatatctttttcttctttgtaattaataagtaatatgtggggtagagacctattattttaaaagccttggaaaaccttgaattaaatatatgtgtgtgtgtgtgtgtgtgtgtgtgtgtgtgtgtgtatatattactggaaatgctagctcatttttacagtagcattccaagcaataaatatagataaaaaatggaaatataaaatcaccattaagcgaacaccacagtaatcattgttgcaggcaagaatcattaatggatactaaaattaatgagcaaaagtatgatgagataagatattcacataatctcaactccctgcccccaagacaataattgcaaagggaatagataccaccttattaagtgatctaatttaatatgtaataacatgtattgcgtatcacctctgatattcttgccaaaattgtataacctcatttcaatcttgacaaaacatcagacacacccaagttgagggacattcctacaacataactgattaatactcttcaagactgtcaaggacatgaatttttttttttttttttttttttttgagatggagtcttgctctgttgcccaggctggagtgcagtggtgtgatctcggctcactgcaacctccgcctcccaggttcatgccattctcctgcctcagcttcccgagtagctgggactacaggcgcccgccaccacacccgactaattttttgtatttttagtagagacagggtttcactgtgttagccaggatggtctcaatctcctgacctcgtgatccgcctgcctgggcctcccaaagtgctgggattacaggtgtgagccaccatgcctggccaaaaatttttttaaaaaaagatggaggagctgttacagattggaatatacatgacaattaatgcaatacagaatcccagattagattctggaccagaaaaaggaccctagtgggac

SEQ ID NO: 107916 - DNA, 1023 bp, Homo sapiens
actatcattcttactccctatccctttttcctgctttctctttttcaagacataactgtttgatattatatatttaaaatacatttataattcttccccattaaaatttaatatttatatgaacaagggctttgttttacttacaactgaagaacaatgcctgacttgtagcaggccctgagtaaatatttgttgaatgaattctccctcaaatgttcagtcagatgctgtacctagcatagttccttgtactcagtgggcgactagtaaaatgttgtggattttgttaatactcagactcaggttatattaagagtccattttgtagaatagcttgtatgtgcttttttgtattttcctgggtgagaatggaacacccgcagaccctgggaatgcttcttagttgcctgtcaccatggggaatttgctcagcctgtttgcaaggaagtcattccattgtacttccatttaaaatatgatacaaaatgcttttcttctgaaaaatgaaaaacttaagaggaaaatctatttccctttcaaactgtgaaactttcatagctgaatgtcttagatatatgctacattatcttatccctagataaaaaataaccttatccattcttatattttactctctgacctgttacaattttatattagaaacatctgtttcttttcctgtaaccctaatcatctttcatttttatattttgaacagtgttatttacttgtctactacaccggctggcggaatgtcaaatcttttttgacttttggcttaatctgtctatgcaacatgtatctctatgaactgcgcaacctctggcagcttttctttcatgtgactgtgggagcatttgttacactacagatctggctaaggcaagcccagggcaaggctcccgattatgatgtctgacaccatccttcagatctattgccttggcttcagggggataaggagggaacatatcataactgcactgtgatgaagaagctgttccccacagaggagaagctctg

SEQ ID NO: 107917 - DNA, 1092 bp, Homo sapiens
ttagtggggccaccaagaggctgtagccccccgaaccttcctgccctgccagggcgcagccccagaagtagttggctgcattgtcaggcgcccacctgtgctggggtggagtttgcagaggtggctgtagcagctggcctggccctggggattggctctgcccccagctgtagcctgctctagcggccctgcccctagcttccacctccactctgtctgacactttgggctgatgctgtctgccacctgcagggtgcatcaaaggagctgtagtgcttctggcatccgtgggcccccaggcatgtgtctcagcagaggtaggagcaggactgtctagtctggtgcattttcagaggcaaataactgactgcagggctcctccatgggacagcctgtgagaagaagcacagggatgccccctaccccccacccccagccttctcccgtgggcatagctgttccagagccagacacaggtagccttattcatggcgagggacatgggtaaagggtactgcctcccaggagcttaggtcacctgggcaggaaggcttggcaagaagacagcacagaccagctggctccccgtgcctctgtgggtggtggtggaaggcggggccctttagcgtccagaagccctcgggatgatcccagtcctcacagccacattcccagggactccaggaggccaccaggccatgggcagcacagtcaggagcccacttaccttaggggcagggctggccattgagcctaggggtcctggatcttctgccctgggagctcttcctccgtgctggacccaggtcctgaagccttggaaaggagcaccagctctttccccatggacatccaccaccacagggacagccagggccctgagagtcagtcctggtcctgttggagattctacttgcagctgagcagaaaagtgtcttcatttagttaggaaaagcccaagtgggccagccagatttttctcatgaacactcttgtcagatggttccttgccacacctcggtgtgtgacacctcttcccttcagccccttgtagggcactactggcctcttgacccgagggatctgccctgt

SEQ ID NO: 107918 - DNA, 1010 bp, Homo sapiens
gagggagagacggaatagcattcagcaaggactccacaaatggtcccgggagtgcagtggacccacctgtgtctctccccagcatgacccctgggccttcctggtggcccttccagcctgcaaggctccagccttgaaccgctgcaccattgcttccaggtcaacggcagggcagattctgcagctgaccaggagcgggactacgtggggaacccaggtgagagaggcaggaagacaggaaagatggtatcttgacccaacagagaaatcaataaaaagcacattgacccgctgtgtgccatcagggaggggcggtgggtggcagctgaggagtcgtggagggctcagaatgttcccaggagggttgagaaggcttctgggagggagtgggcagcggtgagtttaaggatttggagaggactaggcctctgggctcgggaggagggactgaccagcgaggagcaggaaggaggtgggtgtggccctgagcactgagtgagctctatccttagcaccaagctccaaggacctgccatttccctcattctctcctacgctgtattcttccaccagacaaaccatgtctactcaaagaccccctgcagctttggtaattaaatgattgggctcctaagtcccatttctgccaccaaatctgatgcagctggccttgtaaatcatgtccccctcatctcccatgcaacctaggctgaaaaagaatctgatggacagagaagccaagcagaggatccaggatgccctacccctacctgcccccaacacttcctgctgaggcctatctgctacagacaagctaggtgtctataaaaccccccaagggcagacagggtggttgaaaaagcactgagccaggagttgggaagcctgggcttggcttggcttttcctgtgtgttcctgagcaagccgcatcccatctctgaagtctcctatttgtacggctcttgggacctttgggcacccccagcttttgtggtgagtgaagcaggca

SEQ ID NO: 107919 - DNA, 1028 bp, Homo sapiens
cctcgcctctgcaggatggtcaccctgggtgggcttgagtgggaacccaggtcggggccccaagccacccacagctgtcactcaccctgccttgccgccagcctccatgtggttggctagcgtgacatcgttagaccagacgtcgaactgccacttcctgagaccaaggacaccgcagtgtactcgcccgctgtgaattcccacacgcatgttcacgttcacccctgtcacctcccggaccaacctggggatggagcaggagtaaagctgggagaaggctggaggccaggcacacagaatgggggtgaggctgcaggtgcagggaaggtgaaggtgcgggggtcaaagagtcttctctctcccatccagccctagagtccaagaacgttcagcctgaagggcactggggcgggcggcaggtgcagtcggctgtgaaaggggctgttcccggcctggccacaaggtggcgcggtgccacactaaaacctagagccctgctgcttcccctccaggagggcacctctggccagcactgccctgtcaattaaattgtgattggaaaaatgcaaatgcacgttagggccgacttgaattaaacagggaagttaccaccactccaaaccctatttgtataatgctcttgtgggtaagacagaaatggcttttggattatctttttattggatttatccacactgctgcttccaagatgttagcagggtgatggcaaaagctggttacccaggtttcaagggtatggcctgctcaggagggaaggggagcctgggcaggtgcaggggcttagggtgctccatgccctagaggaaagcttggtcccggccacatgcaccacatatccatatctgggagctcccagtagacagggcaggccctccgtatgcacttataactcctcatgctgggcgagcagtggaggcagactgggaaggaagccatacatctccaggtgcatgtctgaggcccatgggaacctgcccagcatctgcaggagagggtgcaggtgccag

SEQ ID NO: 107920 - DNA, 1050 bp, Homo sapiens
tgcctttgtacacagcccttaacccctggccttctgtttccttacctgttgacttggggatattaattcccgacttgcatgttccacagggtcgttacatgaactgactcatgcaaaaagcacacccatactgtaagcagtacaaatgaaatgtgctgttatgattatggttattcctgaagcgttcctgggatgaaagattcagcattagggcactaaaggtctaagtcaattaactaactggtaataccagtttgttccagaaataattggaggtatctatcgaagaagcagacatcaaggttaaagaaaactaaactgagaaaagtgatgctgtacaataatatgcatatagttaacaataatgtactctccacttcaaaatgtgttaagagggtagattttacgttatgtgttttttaccacagtaaaaaaaaaataagcctaagaaaacaaagcagtatggagagggaaaagaaagtaagaactagggacaattcagatgggacgctcattacacccttcggtgggtagagaccattttaacataaaatagatgaccatggtccaatagaaacataatgtgagctatatgtgtaatttaatatttttccatagctgtattttttaaaaagggaaaagaaacaggtaaactgagttttaggcatacactttatttaacccagcatatccaaatattatcattttaacaggtaaccaatatgaaaaatacgtgtgggtgactttacatcttttgttcacatcaagtctttggaatctggtatctatggaacattccagcattgcagagagctccactgggcagcactgctctagactttggccctccagcttgccttggaacccttagagaagccagtgcggggctgaagcttggggagggtatggagagagctcccccagtcctgcccctgggagattctaaggggatagctggatggccggccctatgggagctcccagtccaacaggggattctcgaggcctaatgaaggagaaagctctcccattgatgagcttgcagtgaaa

SEQ ID NO: 107921 - DNA, 1054 bp, Homo sapiens
aacttcccacctcccacggcgcagaatcacatccccttagtggcttccctccgcttccccttctccgcaggggtggggcggggatgggttttatagccaggggtcaggattccacaagcctgatagccagtggagcttgtgcccagcttgggctcgtgcccagcgtgggcatgagtaaggaggaggcggatgtgagtgtgggatgggccggcaattggggcgggctgggctggtgcctcttggtgggctcaagagtgaggccagacctcctgtatcctcttgggctgctgccttgtctgacccactcctgagcccggggccagggtggctccagtaactggtctgtcctctcactgcaaggtgcagggaagtctctcctgtctgtgaagtcagccctgatgctccttcccaggagggaaacagggaagtttctgtaccacgtgtccagattctgctatacaaaattcctcgctcctatcgggtggtatctctgtgtctgtatctcccctacttgagaaaggaccatctcattaattggcatgcttgccccctcccctgaaatggccacaggccttggattcttctggagccttatggcctctaaaagcttgatgagaagagagaccaagcctgctgctgatgggcccagcctggaagctgttatcctatgatctgggaggaggcgagtccttacagctgggcattctggctggggttgaggagggggattcgcagcgccccctgccaccagacatgagctgagctcactgcctctgccctgcagttgtgactcagtggctgtgtggtttaatggtaggtgccggggcattccagtcaggcggctctgcatttgaaacccagctccaccacctacctgtatataagagccttggagaagtgatggcaactgtctgaccctcagtgtctccatctagcacttggagctattgctatccactccacagggctgttgtgagaatttgtttactaatctgtataaaacaccctaacctaccaccctgcccatgggacttccgtgggcagcccgagagga

SEQ ID NO: 107922 - DNA, 1062 bp, Homo sapiens
aggctgctggggacccatcaggatcacctcttggtacagccctggaagtctgacccggggtctctctgttgagtagtattcagtagatacgaagcttggtgcttactagagcgtttctagggtgtctctaaagcccagttccccagcaccatcaacaccctaagaaataccccagcatcctttagctgtgtttcagattcacttttgttcctgtcgctcttctcaagaaaactaaaggaaaatgaaactcgtttgctaagtagatctttgagattatatttttacattttcttttggggatgggacggctgtttgttcacttagtgtgccctagtccccagtcttcctctggccaagtccctttcccgtaagcatttcaccacgctgagtggaaggaatccatctgcccccttgactggctccctgtaggtgatgccagctgggaagtgtcttggctctggtacctcagctgagcaggctgcagagggacaggggcctgagctgagtcctgggtgagcagtgtgggcttgcacccctctggggccctgcctgcctttgtggcatctgacaccgccaatctaaattggaaacatccccttctttttctctgtagcacttatgctggtttgtaatttttctcgttaggtttgtttatgtgtctttccactggactgttggctgtctgaggtcagggagcttgtctctttcaatccccaaatatttactgagtgttattgatttttagatccctacttgcccaacactgtgggaggaaggcagatagtgcccattctcaggttccacaggagttctgactttggcaggaaggggtccctctgggtgcttcttccctgggctggcatctcctctaccagagccccacctctcttccttgtgcctgggccctgccttagaaaacactggttttcagctgggtacagtggctcacacctataatcccagcactttgggaggcagaggcaggaagattgcttgaggccaggagttagagaccagcctgggctacatagcaagtccctgtttctacataaaatgaaaaaa

SEQ ID NO: 107923 - DNA, 1089 bp, Homo sapiens
ctacctgctcagcagcccagcccaatgagccccgctgaagagctgccaccttgctctggaacttggcccagaggcctgtctggtggatcactctggctgccccatgtgagacgctgggtagagtggaggaagacacactttcacccacaggcccgggtattgtctgccaccaattgctttccctatcacctgcatttctggataggagaaattcagtggcagtgaacttcagcagcaggctcaaccccagcgcagcagcaggctggggttgggggttggctttgggtttcgagtggaggagggtctgcttctcttgcctcaaggctgactgtatttgccgattatatttacttattgcttattagatcgcctctttctcccaaaagctaggagtgggtatttggaggagagcagaagtggctggggtgggggtcgtcttctagatccctagagtgccttgatccctgggggaggacttcaggaatggcagagactcagcggaggggcacaatgcccagctgctgtatttgtgggaatgtacactgttaataattcaatctaaatgttcgtctgcaacaggagcatgagttctgtgtgctgtgggacccagaacagtgcgttcatgtttgtctgtaaagaggacatggatgatgcgttaaaccccatcaacctcacagagagtttcaaaatcagtttataatgcttggacaggaactctcctattcattcaagctctggccatgagtccctctgtccgagggtgtggctggagcacacgcagggtggtggcccatgttcgggccaggcctcctctcccgcatgaggcatgaatggaactgccaccttggtcctcaccaaactgggacctgaggagggagcctcccgtgatggcgcagcctcttgctgagtgccttgctgtccgtggctgcctgcttgctacttcagttaactttatcttggtggtgggtgcaacctgccgtcatgtgtttcccaggagtgtagcctgtgttgagaaagaaaagtttgctctgggggcttcaacatgatggtgcccgtaaatcctttgggtacagttacataagtgaggcc

SEQ ID NO: 107924 - DNA, 1113 bp, Homo sapiens
agatgaaaaaagtctccagagcagacttctgacaggaaaggtttagatgctggagagttgaagaggtgtaagaagagatcgtgccctcatttttcacttatttttttggttattcatttataataaaaggttggcattgatatggtacaacctgcaaattacttgcagttctgagtttcagataaaacattataaaacattaaattcaatacatactgctcctttgaaatttgggtaaaaaattgtacaaccgtatatatagtcatttttgtattttttctatgttgtgaaaaccaaaattgtaattttataagtctttgattcactaaaattatataatttaaatgtattttttgtatatttagaaataaggagtccagagactacgcttaactttctatgcatgcatttgaaagctgtttttacctgataatgtagtaataagttgtattcataaaatactgatctgtgttgcatttcaaaataaactggtgtgtgctctgcctggatttgaaatacctaccagtgagtgcagtgatttttcatagtcagtaggcctgaatgtggtgttgcaggaatatgggagaatttcagttcaattatggactccagctctttgacaattttaaaatctaattctgctattcataatggttctgcacttacaggaaagacagattatattaagaggtttccaaaaagtccttccctgccagtcagtcttcaggctaagccagtctgcaagctggctgcagagggacaaggggttcctcatgcaagtgaccagggaatctaagatattaatcagcatggggttgaggaaccttgtcttataacaagctggggttttgttagtgtaacttttctttttttgttttgagacagagtttcgctgttgttgcccaggctggagtgcaatggcacgatctcagctcactgcaaccttcacctcccggattcaagcgatgtttctgcctcagcctcccaagtagctgggattacaggcacccgccaccacacctggctaattttttgtatttttagtagagatggggtttcaccatgttggccaggctggtctcgaactcctaacctcaggtgatccacccgcct

SEQ ID NO: 107925 - DNA, 1773 bp, Homo sapiens
ggaggattgactgagcccaggaggtccagaccatgagccaagatcacaccactgcataccagcctgggtgacaaagtaagactctgtctaaaaaaataataacaataaaatagagattggagctgttggagagatgaggagaggaaggatattgtacaacaaagagcattttacctggagttgtttacacacagtaaccttgtgaaggccaggtggctcaaagtggtatttcctagcagggacactataggcattttgggtgggatacttcttagtagtgggtactgtcatgcattatggcatgttttagcatccctggtctcatatgccaaatgccagtaacctttccctttctcccttatttccaaatagtcaaactatcgaaatagttccaaatagttccgagggaggcagtactatcccattcatttgagaaccagtgctttctaaagtattctacaaaatgaccaagaacagaagaatccccagtgcctaagacactggcttgcttttcataaggccttttttttttttttttaacatccaaacctggcttagttgtgttcaaagcaaatgttgtggcattcctcctcctcctcaagtctttacccgaaactacttcccaagagaggttgctcttcccaaagaatcacctgccctgggaccatatggggctaggctgagggtcaggagccaagagcctggtcccaactctgtctgtggcttactgtgagaccctaggcaagttgcttaccctctctggggctcaaattcttcctctttgaaataggaataataacttcatcactagaattcttcacctggttgttgtgaagttaatcagaataaatgtggagataatacatgaatgagcgtacagaatattatttggctgttctgtggcatcgatataggtcatgatagtgacaatagtgtctgtcattgtattccacaccacttcttccctcagctaaagcaggaaaagaaaggaggtaagtctctctgtgttttttcttcctttccccaagcccactttgttaccttccttggttgctggatgagaaattagtcagagggtcagagaggacctcaacttcatatgctttaaatagagcatatgcaattttaaaccatcctcttaaccaatttttcttttcttttcagtttttccccagttatacttccacatgatacaccagagaagaaagatcctttctcatactgaagaacacaagaaatttgaatagttcctgctttctgcacctcccaccaaaacaaacttttcaatgatcaaaaaatgctgcagattttttgagttcccaatacgtttcatagaaaataagtaagaactatttttaaaatattcaaacaaaactaaaacaaaaatccagtgtcacatgggcctgagattttattttagaaaaaggttgttacataaaacaccctggccagttcatttcagcatgctctttcaaccagaagttcttaatatttatgatggcactagaaagggatttggcattttatgtccttctgtgtccttcatgtatctgatcaatgaagacctgtaacactaagtacttgagagttacagtctgaataatgaagtcgtaccagctgaatagcccagcttgcagtatagttatgtttcagtctgcagtgtgtttagcattcccttgtcaaagtgcttgactgcatgctggaaactttgtatttttgaagcggcaaactctgttctctggaatgctctgaagttatggctgggacctatcc

SEQ ID NO: 107926 - DNA, 1096 bp, Homo sapiens
gggcaagatacattgatgaggggtgaggacctggagaagctggcgctttccaggttgtcagtgactgtaaccacacctctgatttttagagaaaccaaggagacttggcccaggcagagagcatatctggtgctgtcgtcctccacagttctctccccagaggggaagagagccccaagagggctggccatcttcttaaagaaaggagggcccagcagcacccacacccccctcgtccccaacacacagggactgtcacacacacgtgcccagcagtgtccccattctgtgttccctgaattgggacagcagaaggtggaattctcaatagcctgttgtcgggttgaggggttttttcagtgctattcctcagtgtagctcatgttgttaaaagtggcagccgtgcatctgaaaagctttcagtctcatggtcgggttcagtctgaacatgtaggtgattcagatggagacagaatcatagttctggtcagccagaagccactgcctgaactgtggagaataggccagacaccctaggcccttggcctcccatccacattcctttctctgggtactgaggaatctctgggagatgtaaaggagtgaaagtgccatcatctgacccttctgataggtggcaggccctgcccatggaaatgaaggtctgcgtggccatcttcttccttgaactgccaccaagggcttaatgcatgacttccaggtcattctccttccccgggccctctgaaccagctgtgagactgcagccacccactatggggttgtgtgaacacaaatgcaaccagtgggaaggtcttgtgcatgcccagctcacagattcccttcattacagtaaatctatagaaatgggactggccccacatttttaaatgattaccattaacattcctaatggtttaattatatctttacttccagtttttagattatagagcttgtcagattttctggctttcgtgccaaaatagttctctgcctgtcgaattatatgcttaagtggggtcttttctgtgaacgacgtcctgcctggcagtagcaatggcgtggatggcagccctgttccacgtgctgcctc

SEQ ID NO: 107927 - DNA, 1774 bp, Homo sapiens
catttgaaaaatagtagcagtatacagatgcttatgctattttttttgttgttcagtctttgtgtgtggtgtggaattcctagaccacatgttccaacacctccgccactaccaccccaaccccatcccaagacccacagggcaggacccgtcagtataaaccatgactcagttcccctactttaccaacatttggcatcactttagttattttagagcataattttgaagagttgtttattttgtcagaccaaattttgaggctgcctgaacggcctttattttgtcgttagaacatttggaaacatatacctgctgtaggctggtttcagaaactggcttgtaaaacctgaatttgagtagcaggtaaacaggaaaatgtataaacaatcattttctaaaagaccagtactgattagaagggtgggaagtgcagcttccttctaaagctgactttgagcctcagtaatgaatattttgttttgttttaggtacacacttttcattgtgctgtacccaatgggagtgtcaggagaactgctcacaatatatgcagctctgccctttgtcagacaagctggcctatattccatcagtttacccaacaaatacaatttctcttttgactactatgcattcctgattctaataatgatctcctacattccaagtaagtaaacagttatgcgtatatttaattatgttttaaaatttggctctacaataactaaatatctttgactgtctttgcactatatccaagtaaatgtaaatctcatttattgggaattcttggtttttattgaatgctgactatcaaaaggaatttttttccagtagtaattgaataaagatgaacccttctcaatacagttgccaaaatgcagcccttctcagcatgtgggtttgaaactgaataccaggctaggttaagtatgtattggggaaagtactgaatggaaaacaaaaaagccattaaaggccttaccttgattgtagttttctgtgtcttaagaactgcttgttacagtatttgaaaaacatgataaaaagatttttgcattggttactatatcaaaatagacatttaacttcattttgaagggattggtagttaactagaaacataacaaaataataatagatttatttttttctaaatttttcattttcttgttgagcactgattgggacacagtgttctcttcaagatggtttccaattattttaatagtactgctgaagatttaagtatatggataatcaaatgtgcctatcagtgtattcagtgacagagaaaaagacatgtttgatgtctctgtgaagtgagccctactttctgaggatgaggagtttagtcctttgctggaattctgatgttcaattataaatcctatgattgatttctatataccaaaagatcttcttataaccaacgacatacagtgttagtggttcttctcattttgctatttctataaccactgtaactctgaatcttattttaatctagaaaagatactgtattcttccctaaaccccaggttaaatcagacagggttggacttctcctcattgcatggcatcatcggaatgaatcaccctaacaaagcgacatgcttgtgtccctctgtggaaaattgcatttcatgcattgtgagaaaaaaactacatccagatttcatgtgagtgtttatcttgcagaaattcttggatacagttctgcttcatgattcattttccactctttattcatgttgagtcctctctagtg

SEQ ID NO: 107928 - DNA, 1190 bp, Homo sapiens
ccaccctgctgctctcactcctggtgactgaggccctttgcacttggccctcatctctgggatgtacacagctgtcatcctaggccccagctctacacgcaagctctttctgccatacaggggtcctgaagatagagaccagcggctgtgccgactcactccctggctctgccgggtgctgcacactgtcttcattaacgttgtctgtgtgttttttttcttttgttttcctcttccttcaggtacagagtgaagacagtgtcctcctgtttgttattgcatggacgatcacggaaatcatccgttactccttttatacattcagtctattaaaccatctgccttacctcatcaaatgggccaggtaaaaaagcacatttcaaaaggctcacttttgaaatgatctgtcattgaatttgccctttattgcctaaatattgcctcaaagtttctaaaaataaaattgagacgggttgggtagaaattttgtctgtagatttcatcagaataggagtctgtacttaactttgactaacggaaatactgttttaaggtttttatattttacttaaattattttaattgggatcagttcttttcaattaaattatgcagtattttcttttttaaaaaatttcatcaccaagtagcaatcaatagagatttgccgtaacatcccttttttgtccatatcatcacattttactgatgagcttctgccattgtgatgggtttttttggaccaagtcctattctcctagtctcaattttgccaagaagttgtgactcttaaattaatttttaggtaatgacaaacattacatgtcagttttagcttatcacttttgttttgctttgattgtttttacaagtaatgatgactttggtaaaaggctagtagttcatctgcttaccttaatgagtccatgagacagttgtaggcagttttctgagctgggaaggactttgagggagagtgacaaagcagaaggatccaagtccctggagccgaaatgccttatttggtggaaggaaagcagtggttcctagagtgtttatgagttcagtaattaaattagggacataatccgattgtttccaacattttgagtatgggaactcctttgttattttattatttttctcatttgcaatgaacatttttattaggaaaggggaagaatgggaaa

SEQ ID NO: 107929 - DNA, 1203 bp, Homo sapiens
tccttggtaggaccttcctgggcagtcctggtttggatatgtccagggcctacaagcacacaactttgtgcggtggccaatgtgattagtcgcctggtttgttactcagtttttcttaggttgaacccagcattttactccctgccagttttactagtctcatgtccatatgcctcttgctcatggtatccttttacatattttaaagtacttaccctctctttccttttccaaagtcagctctgctagttgaagagttcttctagcagactctgttccctaaatggggtctcatctatttacagtgtagtaattgggataagactgttaatgtggctgaatcctggagtgttgtttgtttgaacagccacctcacaccctgttggctcctgtgaggcttatggttcaccaaaaactccagatctcttgatttcataaggtgggtcttctccattctgatctggagtcattttgttgttgctaagtcatgtaattacatttagacttattaaatttatgttactgtgggtttgggggttttttcatttattttttgtggtaaaagacatacaacatttaccattttaccacttctaagtgtatagttcagttgcataaatactgtcccattgttgtgcaaccatcatcaccatccatctccagaacttttttaatcctcccaaactggaactccataccaattaaacaataattctctatttctcatcttcccagctgctggcaaccttctgtctctactctttgtctctgcctcaccctaggtaccacatatgagtagaatcacacagtattcacctttttgtgactggcttattttacttagcatgatgtcttcaaggttcatctatgttgtagcatgtgtaagaatttcctcccttttaaggctgcataatactccactgtatgtatataataatatcccgctgtatgtatagaccacatcttgcttatccatccatcagtacacacctgggtttctttgccttttgactgttgtgaataatgctgctataaacatgagtgtacaaatatctcttcgagtctcattgatcatgctggttttaagttatgcatttgtccattttgagttattggttgtataattatctataaatcacataaggtcaatctctttatccaaatcccttcttgataacaatgttgcatttcctattgattgga

SEQ ID NO: 107930 - DNA, 1005 bp, Homo sapiens
gcacatgccaccatgcccagctaatagtttttgcattttttaaagggtttaaaaaacaatgatgaatatattacaacagccacatgtggtgcaaaccctaaattatttactaactagccttgtacagaagaagtttgccaacacctagtctatagcattgctatggactgaattatgtctcctcccacaaaaaattcataccttgaagccctaacccccagcgcgatggtatttggcaatgggacctttgggaaataagtttagatgaggtcatgcggaggtggagccctcacgatgggattagcacccttatgaaaaaagataccatgtgaaggagggcacatctagaaggtggccatctgcaagtcaggaaaagacccctcaccagaaaccaatcatgctgccatcctgatctcagacttccagcctccataactgtgagaaaatacttttctcttgtttaagccccccagtctatggtgttctgttatggcagcctgagcagactaagacaaacgtacagtttttccaaaagcaaagcctagtcctaccctcttagattttaccaaatctcttcacaaatgaaaggggttttaagaagaggaaagaatgcttgctgtaaagcttggtcagggaatttctttgaaataaccagcgcagtaagcagcgggttccaaaatgctaagaagaatagggtttctacaatagtggttttcttatgtggcaccatctgtttttctttgactgtaataaaaatgacagcttttcatgtactgatactccctgtgccttttaaagtcaaacatatgatgctatttgtgtgtaaaggtttttctcttgcacccatttgtttctccagcttgaatttctatgtaaactcccttggctaaattacacaagccgcctacacccagccgcctcctccctcgctttagagcagggggtggaaaccttccgtctgcagcatggagtatccaatacacagctcactgtgccaggcaaaga

SEQ ID NO: 107931 - DNA, 1036 bp, Homo sapiens
gaggctgaggcaggagaatcacttgaacccgggaggtggaggtttcagtgagccgagattggaccactgcactcctgcctgggcaacagagtgagactccacctcaaaaaaataaagacatatactgtattattccacttatatgaggtacctagaattaacaaattcttagagatagaaaatagaatagtggttacctgggggcggtgaggggaagatgtggagtgattgtttaatgggtacagagtttctgtttggaatgatgaaatccttctggaaatggatagtggtaatggttgcacaatatggtgaatgtacttaattccaacgaattatgcacttaaaactgttaaatgataaattttattttatattatccacacgtacaaagaaattactgagatattaaaatgatggtaagatgaaaaacctacctatacatgttcttacaaggttgttttttcccccatagtgtccattggtgatagacattgactcccttctccccgcctccccacacaatctgtcagagaaatgttgcagaataacatttgtatgctaaagaagtcacaggggccaggtgcggttgctcacctgtaatcccagtactttaggaggccgaggcgggcggatcacgaggtcaggagatcgagaccatcctggctaacacggtgaaaccccatctctactaaaaatacaaaaaaattagccaggcatggtggcaggcacctgtagtcccagctactcaggaggctgaggcaggagaatggcgtgaacccgggaagcggagcttgcagtgagctgagatcacgccactgcactccagcctgggcaacagagcgagactccatctcaaaaaaaaaaaaaagaagtcacaggaaggggaaggttggaggggttcaatgaatctataacagaggttggcctataggccaaatctagcctgcaatttataatagtttttactttttttcttgtttggtggggtttgttttgttttttagaaacagggtcttgctctgttgcccaggctgga

SEQ ID NO: 107932 - DNA, 1026 bp, Homo sapiens
tatgagaacaaggtggcagttatcgagagagaactcaaggtctccagcatgcaggttttcactgagcagcttctgaaacccttacaaagcagccagcggcttttgtgcagaggagtgccacttccttcagagagagaacacggttttcctttcttcctctttccctcttccgttcaactcttgtagaagccaaaacaccagatacataatgtcctaatgcccctgcttccggacctgttttcgttgttggggtttttcctccctgctgggtcctccagctgggtcacagtgtgctcgtgttcttcctgcctctgaggccacttccctggttggcgtgtctcctgtggccgcacgccttctgtgttatccctgatagctgtgttgtggacttcccagcatgcgccatccgtgaacgtggtatcatggtgaggcagaaaggcagcttcttacccccatcattcagatgaggagatgagatgctgtgtcaggggcacatcatttcttccttgggccctgtgcttggaccaaagctgtgccgtcctgtcatctagccccagtgccctttccacagtgacactgcagctcagttagcagaggccattgagttatattcagtatcctttgtccccactaaaagctgaatgtctaaaatcctccaccctactccatttggttactttctattttaaatattcttgtaggtggatttacatcaccttcattttaaaataacacctctcttaaaggtaaaaaaaaaaaaaagtctccttatttgattgttaatcagacactgtcaaacttgaggcagcttctagacaaatgcagcagcacttagtggcattttcacttaaagattgtgttagttatctcatagctagctggatccttttgccgttacctatatttagcatagatggttttggcaaaatcagaatgtctatttttctctcagtgtttttctgcctgtccctttccaacattttccttgtactgtgtatgaagattttatttcaaaatattgaaaaa

SEQ ID NO: 107933 - DNA, 1165 bp, Homo sapiens
ggattctaaatccagggtctttctgctgcatcagagctgccaccttctcaccctttaaaaacatgatggtggccgggcacagtggctcacacctgtgatatcagcactttgggaggctgaggcaggagttcaacaccagctggggcaacatagtgagacctcatctctacaaaacaaaaaacaagaaaacctgacgtaaacataatgtttttaacttttgttgtgctgacttctctcactcccctatggagtggaaatgcctgtgtgagatccataggtgcttttcctcctcaacagttccaccatgccatattcacattaggatatgattctcctgctaaatcatctgtacatcagatgtacacatcaattgtgggccctaggtgcttatctgcaacacattgcttctctgtttttttactgctcaagtgctctgagatgaatccttctaattagcctctctccttaaaagttctaagactctttctcaaactaggatgtatgcactatttggaccagaatcacccagagggcttattaaaaacgcatattccaggacccaccttacacttgatacagaatgtctgggagtgggaccagggaatctgaatttttattaggcttctcaaataattttaagaattccaaggtttgagaaatgatctaagatacctatgtgttgtgctgtaatttttgtgaccttcccttgatttaatttacttttctacttagtttacttgaagcctaacccaatctcagcatctcttttctaactccaagagccattgtttcattcttgaagaatgaaaaccttagagttcccttaaactgctaagtaaagatactgtggaatttctggtgctctgtccaaaatccagcgtctttgctgatgactaggtaagaggaagcttaaggagcctgccttaaagcagaggaagatctgaaatcattgcactgaagaagcaagactgactttggtttgtttttaagagagaggcccaaggaatccagctgcctcacactggggtggagttgctgggaagggtctgtagcaggcatgtgcttcatgctgtgggccagagccattagggagatctcttcacagagctgtcagggagatcagttcagaggccattcccacctgaggtaacacagtgccgacacc

SEQ ID NO: 107934 - DNA, 1667 bp, Homo sapiens
ctatgagcacatctgccaaagcaggtagacaggtacgtcaaaaatgctttacaactcaaatcaggcaattctattagtcaagttgctgttagcaacatttgccaggatttcctgtgtagatcattgaaactggttggcttgcaaagctattaaatgtctctgtggattataggtacatggacttggtgtcatcctccataaccatgctgcctgccagatgcaaaggacttaacatataacagacggtttcacatacattatcacatttgagctttacagtaatttgttatatactcattacatttccatattcaaaattgtttctctacaaccagagtgactcaatttctgctaacattaacatatcattttctttacctgccaaaaaaaaaaaggaaaagaaaaagaaaaggcatatcattttctgaagtatgtagtacattcttcagtatattttattgtcttcccatcgcctcttggatcctcttgtttttacatatgcactgttgatgaattgacttactcttttcacttgtaattggacttcagcgtttctgctgtcctaggatcatggttcttttctcctcattctctttttctctgcacagaactcctcattcatcgttttgtttagagcagtaggtgccctccatccctgccctacgtcttcgacagctaacttgaaaagcctgttgctgtggcccctcagaggccagtacttgctatatgtcaccttgaaaagcctgttgctgtggcccctcagaggccagtgcttactatctgtcaccttgaaaaggctgttgctgtggcccctcagaggccagtgcttgctatatgtcaccttgaaaaggctgttgctgtggcccctcagaggccagtgcttgctctctgtcaactgttccctggacccttctcttggccaaatgctatttttcctgccttggagtttcatattagctatagttcaatttgttctgtataacatcacatatgacttctgttcttcgatttcctgaagcatcttaaaaatgtctttattttccttaatattcaactctgcttactttaatggtgggaactgtataattaatgcataaggaaattgaccttagaaataactgcttaatcacatatatctcactttcttgtagtaatgttcaaattcttttcacactactatcatttctcagtttctttttatatcatattcccctctaaagtggacaagaattcttcattttaatcacattacatgtgaatttggactcctgctccaccccctctgccctgcgtgtttcctttgctcatctcccttgtttttctgtacctgtacatgatgtgctagggtgtagcctatataaccttttcagactagactctacttttttcacgtgaggtatatttccttttaagaagccctatgggacatgcatcattgcttgtcattttaattctctaccctttggaatgctagtcacataaatgtcatcacgtacattgtgaaactaaaaagtgatcagatggttttctcttatgtgtaaggatctacccatcagctagtgtgacaccttgatcagcaggatattaatgaaaaaatttgaatcaatacacagaggcaagaaaagaaaaaaagaattgtgatccgtatgctcacatgcttttccttg

SEQ ID NO: 107935 - DNA, 1062 bp, Homo sapiens
gtctgaatgacatgatttggggaaaattaaggtgtctaagtaggcgagttcactggatagagaacggtagaagcacctgcaggcaaggccagaaacatcttgacatctacttcaattagaaagtattgatcagctttttgttcactacttattaagatttaaatttactgccaaaggtgtgctaagacaggcacttttgtatattgctggtgggagtataaattggtaataaacttcttagaaagcagtttggcaatacatttcaagagccttaaaaacattcatgccatttgacctagtacttctacttctgggaaaatgtcccaaggaaataatcctttttttaaaaaaaggtctaagcctcgaattttgagtgttatttgtaatgcttcattacttcatttatagtatcaagaaattcgaggcaatttaaatgtcccacagaaggagaataaacaaacatattaactcaaaggaatatcatgatttaagctaaaatcttttgaagaagagaaggaaaattcttaaaatgttaaatgagaaaagcaaaaacaatataaacagtagaagttaaactggtttaaaatatgcttagaggaaaagactggtgagaaatacactaaataaatcgttgtgtgtgtgtgtggatactaaagcatttttaagaaaaacactgttgaccaggtgtggtggctcactcacacctgtaatctcagcactttgggagaccgaggcagcgggtggatgacctgaggtcagtttcagatgacctgaaactccgcctctaacaaaaatacaaaaattagccaggcatggtggtgcatacctgtaatcccagatactcaggaggctgaggcacaagaatcacttgaacctgggaggcggaggttgcagtgagccaagattgtgccactgcattccagcctgggcgatagaacaagactgtctcaaaaaaagaaaagaaaagaaaaacactgttaatttatgtatggcatttttgaaagggagacaaatacaaatttatattccctagagaagggtgatttatagtggagagggaat

SEQ ID NO: 107936 - DNA, 1897 bp, Homo sapiens
tttttagcaaagatggggtttcatcatgttggccaggctggtctcgaactcctaacctcaggtgatccacccaccttggcctcccaaagtgctgggattatagacatgagccatcgtgcccggctgggtttagctttttgaaaaagctttgcataaaaaagttttcaaaagtatattgaaacagtatttgataaatttttaaaatagaaatactaataatttttttatccagcattcaaggtacttatgggttattagtataagttagcaaaaagtgatgatatatataatagttcaactgttttttaaaagttcaattttgttcggccctgacagttttactaattaaaaaaaaactgtctgtgatgtgctcttgctggtgaaatacatatgaaccattcatatttcaaggctctaattaacaatctggtttaaaacactggtattccataaacaataaaaataatagggtgggaatttcctattggaatgctaactataatacagagatttgagtaagtttccatgacttacaattgactcactgtgtcctctcagagaatgacatctattatcttcacattttcatctttttcaaaacgtgacacccttttaagttatcttcagaaaggaaatatgtgtcatttatttcatgtctatattttgctctcattcagaggttagactttcagagtggagacctcaaaagtaaacaagcaagtgaggaggctctgaatgttcgagaaagctttcaaaaaagtcattcccttaagaggtctctgggccctctcttgaaaccaatttattattttttacctgtaagaacttcaataagtggatgagtaagatgctagtggcagatatttggacagctggccgtctgaaatggaggaagtagaaaagaaaatgaataaagtacatccagtgaactagaaaccagtacagcaaagtcattaatatataggaacacggctcaaaaaaccaagcaccaggatttttttctttcttttcttttctttttttttttttttagacagggtctcactccgtcccctaggctggagtgcagtggcgtgatcatggctcattgtagcctcagactcaggctcagtgatcctcccgtctcagcctcctgagtagctgggattacaggtagacaccattatgcctgtctttttttttttttttttttttttttttttagtagagacgaggccttgccatgtttcccaggctggtctcaaactcctgaactcaagtgatcctcctgaagagttgggattacaggcatgagccaccgcgcccagcccaggttttatttctttcatggaccctatgaattgtacaactggattattttctctcattgtattggttgtaaaggagctcagagccaagtttgtgatccacctcaaacaggtgcacaggccttctctgcatttgtttaggtattaatttctctcatgattttaaattattgtttttacccttattttccctgagcctgacttctaccatacgtttttttaattttgtttttctttgagaccgagtctcactctgttgcccaggctggagtgtagtggtgagatctcggctcactgcagccttgccctcctgggttcaagtgattcttgtgcctcagcctcccgagtagctgggactataggcacacaccaccatgcccagctaatttttgtatttttagtagaaatggggtttcaccacgttggccaggctggtctcaaactcctgacctcaagtgatctgcccacctcggcctcccaaagtgctgggattacaggcgtgaatcaccaagccggccccatatgtgttttttattatgtattatagtgctctttcagcttttcttcccaagttttctaaacaccaatgg

SEQ ID NO: 107937 - DNA, 1511 bp, Homo sapiens
tgtgagctgtgttcagtgttctccacattcactcacactttcagtccataaatatttatgaaacgtccctggaattcaaagcaaagtaattcccacagtactttatctactgtgaagaatcaaggggaatacatatgtcctagctctttagagtttattcatataacattttcatcttagatctggggctgatttgcttagttggttagagtataatgcttatgggtggaaattttttccttaaaataatctgtgtggaggaaggcgtaatcacaattccaacacttttaaaggaaaattatttattaaagggcaatcaactatttataatagttaagtacgttcgttaaatacttcatttatatctggtagatcttgacctgacattgagttgccacattcttggctctagaaagatgtttttaaaagatgttcatgaatactacatgtcaaaattgtaagagaaagcagatttttaaaatttttggacataatatactagcaaatttttttagatatgaactctgttttatagatgattcagaagattgtttaccagaaaaaaattattacaccaaatttccaccatattttttcttattgatgtcattgctttccatgactgaaaagtgtaattgaaatggcttcttttaaaagtgttgccttgtcctgcactctgatggtttgacttcttaagtccacccagattctcttcagatattgagttcattttctcaactataaaaggataagtaggattgcatttggttatgcataccagaattctgactactgtggctttaatcaagtagggatttatttttcctatataacaggaagtctgtctttctgctctactatccttagtgtgagacttctgtctttgtacttgtagtcttatggttataagacgtctgtgatgagttaatatggtgtcatgtttacattccaggcagaaagtgcaaggctttccagaaacttggtttatgtttccttggtcagaactgtgctaggtggcttcctcaagttgcatgggatcccaagaaagctagtgttttagcagggtacattgctaacccagatgagatcagtgttctgttagtgagacagaaagggacattgtatagtgggtaagcaaatggtattgtctgccacaagggtttggatggttgctcaagtcctgagccgatagagcaatccatgagtccatccacttggcaatagcacatagtgatagtacagtactcagtgtaagtaatgaatcggctctatatctttagtgttggaatccagaagcaaaaacacagagtagtttacccctaggtaatatacgtggtcataaatctcaataatgatcttgtacgtgatcttgttttcctcccattaaagtcctcattaataataaggggtacttgaataaataaactcttccaaaagctgtttccatttagattttttttgatatatttgagccaggcacggtggttcattcttgtaatcccagcactttg

SEQ ID NO: 107938 - DNA, 1023 bp, Homo sapiens
gtctccctgtatggtgccactgtaccttcccacagcttcagtggctcccacataccacttctgggccacatccttctcctgcatctctgtcccagctgcccacctggacatctccacatggttcctctgcagacaccacagactcaacatgtgcagaagccacctcatcattgttccccgacctgctctcctctgtactctggatctgctagtggcactaccagtttccacctcgttcctaatcaggaacctggggtgtcagcctttgtcttcttcaccatttgccctctgcttctctgtctacctcttttcctttcagggaacatcatttctctgccacttgtgtttctgttctttaaaacaaaaaacaaagcctcttttgccttcatcccctactctaaatctcccccttttctcttccctcttgccctttctttctctgtatttttctagccgcttcattgctgctcattttctccatttctctttttcctcttgcttctctagtggttccttctcattccctattcacattctcttcagtcctcactgcgcagataccaatcttgatcctgcgcctgttctttttcctttaggggatttgagtttcgatgggacagcttgaggctggccattgctaaagcctggggcatgggagaatggggtaagcaaagtatcaaatacttctttttgttgttgttgttgaaacagggtctcactatgttgcccaggctggtctagaacccctggcctcaattaattctcctgcctcagcctctcaaagtgttgggattatagatgtgagctaccacactcagccttaaatacttctagactaaaatccaacttactgtttctctttcccttctacaccaagaggtaggccagtatttgtcctctgagcatacctggattcccaaatgacaactctggggtgccttgaagactgcagttataattttggggcagaaaacacccccagaaatcctcaaacctaataaaagatatctgaatgatcaggaa

SEQ ID NO: 107939 - DNA, 1504 bp, Homo sapiens
ttattattcaattttctttattacatttttatttgaatctgttctcctttgggtgctttgaaatttagtcttcatttcagatataattttatctttttcttttttttactgaatttaatcaattttttgttcagttctgcccacttttagtccatttctattttcagtttttgaattgattaaacatgtatttttttcatagcccaaatgcctatttaaggatatttaattcagtttgggttattgtgttaaagtttcctttgtgattttttggagggcattttcattagctgaaatgttttgatcttctttttctattttctcctgaaaatggttttgtatagttgtaaactacttgcatctgctccttttgtagacaagattggaagtttgggttggtttataagatccctagtttgcaaacactgtaatgcttaaatgcagtgaagtatagtctctttagtggatggctttttgcttgaagaggtcggtgggggaggaattatatgaccctgattgttttacctcacctttgtgttacaggaatctaaatttcctcctgcctctttctctttccctatccagtcactagagggcacctcctctcccttcttttttactcatttcttccttagaagcaatgccgttttcagattgccatagcatcccacagactctgtctcttccctgtggttagtgctccaaataagatgtttttcagtgtttttataattagggtagactgtctctttcaggagtgattttggctcagatttaggccttctgttctgctcttctctcttccatgccatttttccaaattctcctcactttccacaaagatttgcagtgggacctcaggagatagctgtgcttggaatttgctgtttattatttttacttacaggtgtattgagtctgtagtctgtgtcaattaattgtgctgaagatgtgaggtttgtatgcttgtatttgttactgttgatctgtatagatttttggaggatttctaatattcagctatatagatatattgtgatttttaaccagttgtctatttgttaaatatgttggtggttttaaagtgtgcaaattataactacttgtagcttaatgtttatacagctgtgattaatctctatagataaatttccagaaataggtcaaaagttatatattccaaggcttttactaatatagacttcccagtgtccctccagaaaacccacaagtatttattattaatttttctttttttttttctttttttgagacagtctcactctgtcaccaggctggagtgcaatggcacaatctcagcttactgcaacttctgcctcccgggtttaagggattccctgcctcagcctcccgagtagctgggattacaggcactcgccaccatgcctggctaatttttatatatttttttttagtagagatggggattcaccatgttggccaggctggtttcgaactcctgacttcaaatgatccacccacc

SEQ ID NO: 107940 - DNA, 2102 bp, Homo sapiens
tgttcttaccgggacccctgtcacaaatatggataacaaacatttcttattcagatttaaatattgctttctgcctgggagcatgtttagtggtggtgatggcagggggatgggggagaaagggatgtaacctagccaggcagctagcctgtctcccctgcttagaggtttctaaggctgacccctggagagccgcctggggagattggaggcctgggtaggaggttgccaaatccaaccttcccctcctttgcaattaattctgcctttgtcatttattcaaatacagtagttttccagcatcctgacaatggagctctaacggtcaagaccataagtggtcatattcaaactttaatctttcccaaatcagttaagcgcttcagaccagaccagcttagtagcctccctctgccttagctctggttcattctgttgtctcctgatcaaatgttccctgctcccctccagacaaggagagaagaaaatgcacctgcatcttgtgctcctgatacacaaagcttcagcccctgttctctgaataaaccttgctttttcacacctccataattttgtacatatggtttccttggcgtggaacaccaagctctgttagttgttccctgctctgtgtgaatgtaactgagatgaaggaaaggaagagagaaatagagcatgctcatttgtagcctaaagagcctgagcagggagggtggaagacttacccaggtatacaccacctggtacctcgcactttgcaagcactcagtgagcagcacccaagtatgaggcaaaaacagtccccgaggatttctgtgcctagttggagttcagaagggaaagctatgaagagagcccagatcagggaattttatcctctgctgtccctgcaggaacaactaagtctttctttggaatggaaacctattattgagaccttaaggtgccttctctatgagatagtattagctggctgtccagtccgtcagaaatcaacccagggcacaccctgttggaaacattactagtcgtttgacaagtcagacaccttccctctgggcctagtttccacatgtgaaaaacgagggcattggactgaatacgtgatgatctctatcattccttacagccactcgttctgaaattctgtgaacctgtaaatgtgatgttgcttcagaaatgaatgtcaatgatctgagtagtgatgtaaaaggagggtacgctagatgtttaaacgtgccaaagtatgagtgtttggaaattcatttcaagtacagtagttctactacctttttccctctagataaattttgaaagtcccatcagaatacagaattgagagaggacacacacaacacgttttctgtaacagacgtttactatggtcaccactagatggcacccttgtattagtaaggagatttttctcagaaattatagggcttcgggatgacttctaataaaaatagatagtaattaatcaatagctgaaactgaggaatgagcaagttaagcagagaaaatagaaatggatgtttttctatcactgtctgatgacttgatccttaagattcgaggtaaggaaaagctggagctgtctacattgccctgatggagattattttataaatatttcttaattgtaaagcataagatacctttaaatccaacatgagtttgatttgcttgatgaaaatgggtgccatatttcagcagttctttggtgcgatggtttgtgatagtctgaagtcaaccttacacctattcttagcttcaaaagcaaggttagtcctgcaaagttgggaacaccaagtagttaccaagttgagtaaatcctgttgaaccaaaaagtgaaaacttgagtcatcttttagccaaagaataatttgatttatgcttctgtggcaggagttgaacaatgtgttaaaagggagcaagaaagcttcggaaaatttgtatgaccgtgatatgtcatttttatagttcagtttccttttcttgggagaggattttttttctcttcattcactgtaaacatctttccattaatttttaaaaatatgctatttttttagagcagttttaggttcacagcaaaattg

SEQ ID NO: 107941 - DNA, 1153 bp, Homo sapiens
gtaacaaaataccataaattgggtagcttataaataacaaaaatttatttttcacagttctgggggctgggaattccaagatcaaggtggtgctgacagattccctgtctggtgagggcctgttgctcatagacagtagcttcttactgtgtccttgtatggtggaaggggcaagtgagctcccttgggccttttataagggcactaaccccattcatgagatcccttgtgacctaatcgcctcctgaataccccaccacttattacttttgcagtgggcattaggtttcaacataggaattttggagggacgtagacattcagggtacagcaccaagcatgtgtactatgatttttagttaatgttagttttattttaataccccaaatccctttatctgtcttaaaatatacccttatatgtctttataaaatttctctacacctggaaataaagtttctgacaagtatattttttcattcacaccaagaaaattatcgaacgcctagcacgtgtgcataccaggtgctgttgggcagtgggagtagagaggtgaatgggctcagacctaggtccaggaaacccacagtcagatgggcatcccctgagttcctctggtatagtccatcctgaggactggtgtgcacatcacatgctgctcagagggttggcaggtttgcttccccctcagactctgagctcctcgagggcagattctgtttcattaagctctgcatccccagagcccagcggcaggatccttcttatatcctcaaggaccttgttctgtctgtacatctcttgctcctgcctcatcaccctgtgctatctgccttttccttctcagtgcacaaaatgctcagagcactctgtcttaaaaatcttttaacctggccattgaccctgtatttcccttatactactatataactgttctccgtcccttttcccagatttatggtaggctctttctacttcctcatgcccatcgatacctgaaccctgcagttgggtgtctgttccccttgttctacaaaaaatcaccctctggtctaaagtcagcaacaatgtctactggattctaaggacactgttggaagttcctggacttagctacatggggcaccgctgatgactccctcctggagatcc

SEQ ID NO: 107942 - DNA, 1801 bp, Homo sapiens
tggtcattaaatcaatcttataaatggcttcaaattacttttttgccaccaccacccccagagttaaatcactgctatattaaggatgagttggaaggggatttagaaggacttaatttgccagttggatggccattgagatggagtggagatggcagtctcactcaacgcactggaaataaaaatggggaagacagaccccagaatcgccagcaggacttagaaatggttgtacttgaggatgaggggaaggaaggactgttgaaccccaaagactgggaggctggttatcaagagggataacgggcggaatggaaggaaagcgtgtgcttcccactgaggctgtgtttgagccgctgctgtggctcccagatggagctgtccagaggcagcttgggatgtaggcccagatccccaggagacagggttggattggaccagagagcacctctgcagtgagatcattgaatgaggcaagatggggactgagggtggaacttagtagaatgaatgtctgcattgaagggcctgccaggcaagaagagccaacaaaggcccttctcaccccgtgttccggagtccgtggtggttctgttctatagcatatgggacatggagatgctgtacacttattgctcttacaagtttgtgcattatgaaagagcccttgatatctgataagctactgagtgggaagagtaaatcctcctcagaaaatccttcaaagatacacaaactaaaaatgaacaaacaaacaaaactgaacaagaatttacattttgttaaacagcttgtagccaagtttaaaaatggaatgttcatttttcatatttaatactgctggcagacgctgctctattcttactgaaacattagtttatatgaaataaaactttaatatcttgattcttactaattctcctcttttttccccttttttcctctagattttacattgtgctataggtaagtatggatattcccccctactatgtacagtgaattctgcttatttaaaaagtcatagatgataggctttattgatttctgttaaatattgaaaaaatgaaatgatttagtcatcatgtatgaaattgctgaaattagagtggctttcagtttctgaaatcataggtactatttagatgtcatgactgaacactttattaaagttcacagctattttgttctgttaatttaaaagaggtgtctcccaccttctcagtgtaagggtaatagaaacattagcatttttgtaaaaatgtggctggagttctggtgctgggctgtgttgaaaagccctctctgtgatcacttaaatggtatcattctctctccttatctttcaaatgggagtattgcctacctcccaggtgaatattacatgtttgtgagagggattaaagaagtactacgtataaagggttatacaaatgtaggggatttctactaaaagcagatacaatatgttttattttcctttttgtggggaggggcgagtcatcaaatattgctgtggaatagaggcataacgtctagtttggggtggctagaaccttctaattgaataaaatccagtcttggaaagttgatagaccctatagagcaagaccgtagtgattgctgtgcactccaggtatgtctcccaaagggaggatttgaagttgatacttagaagcactgaaagtcaaaaaatttgagaactgcaaatctataccgttatggccccatcaatttaatccataactaaagtgggtagttgctatattcagggaaacttacagttcagatgggcgcacag

SEQ ID NO: 107943 - DNA, 1054 bp, Homo sapiens
tttgaaatagtaatgtactccttcaatttctctactttgactgttacttactttagcatgttattccaactttgtataaggttacttctttatttctattattaatactcttttttccaagtattaggctgtacctctacatctgcccttttattttcctgtgcttgtccacagtggtttctgttactctaatttttaaatccaaacttattttcataatttactatgtacatctgactacatcattatgtccccatttacaagttgaaatacgtattttgaaaaataaattactttatttcttctttgtgtatcaattgggacattgtatttatttgcttttgaaaattttgtgtaggtaggtcattttatctatgaatttcttttcagaatggtagaggaggcattataaaatatgtgtgattaaaaaggggagagtgcatctgaggactgagacctactgctctgtcatgcaaagaagacatgctagccattcattgctgtgtgtcctctcctgcagtgtcctgttgctaatcagcagcctggatgtctttttttttttttttttttttttttttttttttttttttttgagatggagtgttgctctctcgcccacgctggagtgcagtggcgcaatctcggctcactgcaacctctgtctgctgggttcaagcgattctcctgcctcagccttctgagtagccgagactacaggcatgcgccactatgcccagctaattttttgtatttttagtagagatggggtttcaccatgttggccaagctggtctcaaactcctgacctcaggtcatccgcctgcctcggcctcccaaagtgctgggattatacgcgtgagccaccatgcctggccagtctgggtgtcttgctgcatacatggatagaataggttttctgggccgggtgcagtggctcatgcctgtaatcccagcactttaggaggccaaggctggcggatcacttgagcccaggagttcaagactagcctgggcaacatggcaaaagcctgtccatacaaaaaatacaaaaatt

SEQ ID NO: 107944 - DNA, 2778 bp, Homo sapiens
aaggccaaggtgggaggatcgcttcaggccaggagttcaagaccagcttgggcaatatagcaagacctcgcctctgcaaaaaattttaaaaatttaaaaaattagccggatacagtggcgcatattagtcctagctactcgggaggctaaggcaggagaatcgcttgagcccaggagtttcaggctgaagtaagttatggtcactccactgcactccaagtctaggagacagagcaagaccctgttttccaaaaaaaaaaaaaatgaaaattctttactctttatttaagtttaaataggcacatatggctagtggctgcacagtataagcctttagaccacggtacagaatgcagtgtgatcatgtggaatcccataagatatttcagattttaccaggatagaatgaagtgggaaggaggataaacataacgatgtaaattttgtatcactccagagttcataaatttttaaattgataatagaatagttatatgctgatgttttcagattaggaaaatcaatagggaataaaagcacaattgcagatactgaaaaaggtatggaagagtatatatcaaactgttaattagagcttacctctggaggggcgtggtattttggggcaaggggggagtaaaagattaccacttttaatatactttagtatatatttatatatcacatgaaacatgtaattttttaaaataaaattctatattatatgtaattgaaaacaagatgaatgaggaaaataagattttaaagttttttgaaaaaggaagacaataggcagcttattttatttttcgatttaaagagaaatagagttttacatctacaaatcctgttaatttttttaatggcaggagaataataaacctatagcataatagagtatagtaaaaatacatcattttttatgtttatacaaatggactgattaaatttatcaagatgaaaagatgaaatgatggttactggttaaaaactaaagtctaacaatctgttgtttatgagactgactttaagtttactaagggacaaaccagcttgccatgaccaagtgtcaagaaaagcaggactacccagttacagcataagataaagttgatttcggagcagaagctgaagagaaccttagttcacagtttgtcagtagcaagaacatgggagacacatgttggtgaaatcatatgatgaatgaatgattatctgaacagagaaacaaaatatgtaaaaagctggcagaaatgctatagaagttaaaaaatagaattgttcttaagaggtgtcacagtttgggtatgaagacttggttttgccattaattagccctgtgaccttgatcttaacctctctcgccctcgattcattatgtgcagtgaatacactggattaggtgaccttacatttttccccacttttaagttctgtgagacttcaacatttcactatcaaaatatgaaaattaagcaaataatgaattagtaaattataggggtggaaatagcaagaaaggtgaaattaagtgataaaggaaaaataatgataattgaggaatctttttacctatttcgtccttaaaaattggatgtaaaaggattttgaaaacatgtttggagtctgagggagcccagtgaataaccaacacccttttgcttgtttatgttctgaacattgagcagtaactcaaaggagttacataaggatcctaaaaatcacctttattagtgataaaggctgaggacatgctttagtgtgcgagtcaaatgggtttgctaactgaactccacagttagactcaccactcaccctgtcctgagcagcagcagatgggctgtcttagaagaaaccatgaaaacttgaggttctctatgaaacctctctagtggagctgaattgaacacaccccatttattcttcccaaatttacgctcaaatgagtcatcctttccagaggtaaagtaattaaaggagactagtactatgtggtggaaatccatccttatagaaaccagaagagagtggaaaggtgttttcccccagtaataagtactatatattcattgtagaaaaaattcagatgcagaagaaaatgcatagcagtcataatctaaagataaccactgttaacattttggtgtctatccttgaagactatatattattattattaagttttaagcaagaatgaaatcatatatgtgtagaatatgataattcctaaaacaaatcaaatattggtagatgtaactcaaattggttatggacctctgcaccgtaaaacaagtgtcgtggacatgtctgtggagctgcccagctcagcgtatcctctctggaatttgtctggttctcaaggctggacccttagcagctacatctctattccctgactctgcatcttaggccatagctggctgatccaggggtgcgtaactgagccagagtgggctagtcaggttttttttttcctcccaagaatttggaattttgaattgaaagacagagatggggaatcactgtagatgaatcacattaagtccatgggctgcagctgaggtcttgaaagctgcttgggtttctgttccctttgagacttcttaaactttttggggctttgttgttattgttttaccttggattaaaaatgaaattgaacagaattgttggtaacctacaaaaataattcccctagttcaaattttagaaactttgaaaagatgtttccaagtaatttattgtgcaaatggcaattttacattgaggttaaatttt

SEQ ID NO: 107945 - DNA, 1275 bp, Homo sapiens
gaataggaaattgattttgggtatttctataaaatacagcaaagtcttagaaacttgcagtgtccttaagaagaaagatcccttcttatctccctgccagtttttctttctttatggctcaaacactaactgatttttgccatggaggtattgtgcttcagactgcttttgtgaactggtttgaggacataaccgttgtctgttatatttttccttcttgtggaaacattctgatttcccagtaatagtctcaaaaaggaacttctgaaatgcaagctacatgcatgtgttaggctccttttattctggacccattttgaggaaacacatctctaaaagaggcttttgaaaagctagcaagagcaagttatagtgtagatatctaacacaaataggaatgacaacaaatcccagaaaaaccagcttctcaaacagtgtgaaaaccagaggaaaactctaacttgattaaaattaataagtgtcacaacattagaagggaagagagagctggaaggaaacaggaacccacccacacaggcctcactgcttggtgactcaagcaaatagaagcaaattgatgtggtattcaaagaggtacaatagctaacatctgtagaagggaatgtactgaaattaaaaaaaaaaaagaactaaaaatatcaatggtggcaatatagggcacgaaggagccacagtgcaagaaataggtgatactgaagattcaaaaaaggcgggagtttccactcacgttctcatataaaatgaattgcagaacagaagtcatagggaaattttcaaagttcaccatgtaaaagaaacattacaaaacattataacagaaaaacaatatatatagaaccaatgtatctagaaaacctgatgaggttgtataagctttcaaaaagtaagactaccagaggaagtagaaaaggttggaatatacagcttataaataatcagggagaaaagttatagaaaactttgctgaactgaaaggccacctcactatggttagtgagagtttatggtgttccacaacaaaaaaatttcttcccttcctgagtacttaaacaatttccagcataaaagagcagattttaaaatgtaatagttaaaaacaacttgggaccttaaacttgaaagaagaaaaaatccccgtgtagtaggaaatattaggttcctggataacagaccatgcagtttcctaaagctggaaacattttgaaaacacttagaaaagctaatggaactttgaaagcaccttaccaaagatta

SEQ ID NO: 107946 - DNA, 3014 bp, Homo sapiens
cacgttctagatcagaaagttatccattttgcttttgtttttttctcttagaaggcagaggaatttctttttttctttctttcttttttcttttttttttttgacacagggccttactctgttgcccaggcaggagtgcagtggtgggatctcggctcactgcaacacagaggaatttcaatagtgtccaaacttaggcattttaagtaggtggtatgatgaaatgagcttccagctggaagcctgagtacctttttattttaagtataatagttttcccaactgactctatagatttgggcaagtcttttctctcgtatccacctccttttcatttgtaaataattaggttaaagtagatttctaaagtcccttactaccctaaatttgagtgtgaggaaattttaacaaatcctaatgtgaaccattttttaaacttagaggcttgaactttttttggaagcggacactagtaaataagtagtactttctctttcagaaccttggccagtacagttcccacaagctacagagaagcaaatttggagtcaagaccatcagacttccagtacttgatatagtagggggttgtccccatttggaatacttcaataatttaaaggggtttctatctctttaagacatcataatattagagctgagcacagtggctcatgcttatagtcccagcaatcccagagctttgggaggccaaggcaggaggatcacttgagggcaagagttcgagaccagcttgagcaacatagcaagacctcatctctacaaaaaaaaaatttttttttttttagctgggctgggtggtgggtacctgtagtcccagctacttgggaggctgaaatgggaggcttgagcttgaacccaggagtttgaggctgcagcgaactatgattgcatcactgcaatccagcctggatgacagagtgagaccttgtctcaaaaaaaaaaaaacttggtaatgttagaagtataatttttaaaatttaagtatatcttatggaaggtagggacattaaacagtgtcatactttaaaatccactcaggaaccaagtcttagactttgaaggattagcctgtttatccttatagaatttttaatagggatttaggaaaatatcttggatttttggttttatctctgttatccccactaagaaccaattaagtgacaaatcctggatttgattttgggaaaatgtctgtgcataaggaagtgaagactcccaggaacatgcaggcaattaacgttgcaaaggtcagtgatggaagtaatcccttggactgggcgatagagcaggcttgctaaaaccacaatttctgtggttgaggagtttttcattgcctaccccatctacactgtgtaataattagatgtgtgtggtattgtttaattacacataagttatcctgatgggaattattagtgttgacatatatcctgtttacaggaggagaaaatgaatccagggaaggcagctactcatttatatctctttatgctaaatgttattctttattaggttctgtgggagtttacttaaaaaggaaatcgaaattacttgttctccaatttcacatcttcttaagaaaataataacactttgctttttaaaagacataaaaacatttaccaagcaagtacaaaggagcatgtagtagcaaggtacaaaaggaagcctggctgagtaccatggctcacacctgtaatcccagcactttaggaggctgacatggggggattgcttgaggccagaaattcaagaccatcctgggaaacatagcgagaccccatctctacaaaaaattaaaaaattggccaggcatggtagcacatgcctgtagtcccagctaatcaggagactgaggtgggaggatcacttgtgcccaggagttcaaggctacagtgagccatgatcgtgccactgcactccagcctgggtgacagagcaagaccccatttccaaaaaaaaaagtatctataaataaaatgctactcatggataaaatgtggtctatggatataaacattcataaaattaataaaggcaaatgaattactgatatatgcctggataaatcttgaaaaaatgcatgtgaaaggaggcagatacaaaaagtcacaaatagtatgatttcatttataagaaatatccagaataggcaaatccatagtgacagaaagtagaggaattgttaggggctgtggggagagagagtggggtgtgactgctaatggtacaggatttccttttaaggtgatgatattgttcttgaaatagtggtggtgggtgcacaactctgtgaacatattaaaaaccactagattgtacagtttaaaattgtgaattttgtggcatgtgaattatatgtcagtttttaaaaaacgagttcctctgtaatgagttgtgggtgttttctactttattcatttttggagtccatgatattcattgatgaggcagatgttatctttgcatatttgtcaagtatagttagattaaaaattagtggactaatgcagttatggcagtttaaaattatgtttgagagaatttgggtttctaaatatctttggttaacataagactgtaattatagcaaagacactttcttttttttttttttttttgagacagagtctcactccatcgcccaggctggagtgcagtggcgcgatctcggctcactgcaagctccgcctcccgggttcacgccattctcctgcctcagcttcccgagtagctgggactacaggcgcccgccaccacacccggctaattttttgtatttttagtagagacggggtttcaccatgttagccaggatggtctcgatctcctgacctcatgatccgccagcctcggcctcccaaattgctgggattacaagtgtgagccactgcgcccggccaaagacactttcaaatactcatgattggatatgcctctgtgattgacagtgagatttcaaatgggttaaagattgctctgcaaag

SEQ ID NO: 107947 - DNA, 1086 bp, Homo sapiens
gaagttggtgggtgtaggatattggaagtgatagatagaagacataatagagagcctgtctagaggcgtccaaattttaaaaatttaacaaaaatgtattgatttccctgcattaagggcaatgtatatccagccctctctcttggggtaagtatagattaggattttggaattgcaagggacaaaaacccaattcaaactattttaagcaaaaaaggaattttctggcctctgtagttgatacagatacaggattaatttacaaagaaactagctcaggaatgagaaccaaggagctgacactgccagattctcttgctttctctcatttctgcttgtctgtttctctttgaatgttggtcttgggctctccacatggtgggaaacagggagggtgtttatttttcgcagcatctgtgtcacacagttcccagagaggattctggttggccctacttagactatgccagtgatgtgaggtgcttgattagccaatcttaggacacatgcccattcttctgtccaagggactatagactttgcttatggaaaagagggatggggatagctttgggcacacaaaatcaatagccgccatagttcgtatatttcattatggtgaaaaaccttcagattgcagggaagatctggttcattttgcttagcctccaggcaagaccatcataacatttatactttactggcaacttttaaaacctgaactatggaatgatacttaagaaaaaatcatttatctcgctgggcacggtggctcacgcctgtaatcccagcactctgggaggccgaggcgggtggatcacgaggtcaggagattgagaccgtcctggctaacacagtgaaaccccgtctctactaaaaatacaaaaattagccgggtgtggtggcacgggcgtgtggtcccagctactgggaggcaaggttgcagtgagctgagatcacgccactgtactccagcctgggcaacagaacgagactctgtctcaaaaaaaaaaaaaaaaaaaattctttatctcatgaaatgaagtgtgatacctctacctttcattctcaatttttttttttttc

SEQ ID NO: 107948 - DNA, 1062 bp, Homo sapiens
acagtgaaaatctttcctcccacctttcccttctacccagctcccctccctcgaggcagttaattttgtgtatccttaagatgctgatgcaagcaaatatgtttatacatccccctatccctttttaaaataagacaaatgccaatatattaatatttttacagttcagcaccttgcttttttttcacgaagaagaaaatatatcgtgggaggatcatatatgtattgctagtattagaaatggtaggtgttggaacctaggctcagagaagttgtgacttgcatgagatcatagaacttgttagtagaagttccagatctagaaatcatttctcttgactcacaggtcaatgaagaactagtacagatacaagctttatatcacatcagtggtcacatagattgatttttaaaaaaacatccaggaatctcactgtgtgtattaatatttatatataaaattcttgttgtcttagcaagagccggtgagggcattggactggagagggattttgaggtacattggtaagaagaaagaagtctattcctgagcaatgaacatagagaatggggtggagggtaaggagtggtatcttaaaccaggaagataaattgggattgtgagagcaaagtaagctttttttttaaggctgttaatggttgtaccagttacaccattaaataatttcttcttttacaaactcttacttgatgtccttatgtgatagtttttggaaatagcatagaccacacacaccccattgcctagttgatactatacatttatctaaatccttccaggagacataccttaataaaaaggtccatttgttttattatggaacttaacaaaacattgtgtttatttttgagaaggacagtggaacaaaaatataacattcacagctgtatgcttaagtgctttcctgtttcgtggtttgtattgatctggctttcatttctgcattgattttaggaaatttggctaaaaaactttttttttttagcaagagccctttattcgtaattttaaaaggatagattttaaggtatgggtaattg

SEQ ID NO: 107949 - DNA, 1047 bp, Homo sapiens
gatagggcaattgaagaagggagaacgaaagcataattgttttgattcaacatggaagcagtgattataggagggcgaatagcgagggacgacgcaacatccagctggcagaagcagcgggcctggagagggtggctacattgaactaatccaagatggcgccgaggttgtaaccgggagcgcccaagaggcgggaattaccctgatccaagatggcagtggcaactgaggcaagccgaaagacgggagcgccaggagcgtctttgccctcagccaagatggcggctgccgtggaccctgtcccggctccgccccgcggccctggccccgcctgcccctcgtcccttcctccgccccctctcctcgcgtagtccggcccgagccgctcgcgctaggagagcgggcttcgggcacttgacatggcggcagtggcggcgactgcagcagcgaaggggaatgggggcggcggtggcagggccggggccggggacgccagcggcacgcggaagaagaagggcccggggcccctggccacggcgtacctggtcatctacaatgtggtgatgacagccgggtgaggctggggctcggggaggcggggagccagcgcggccggggagggagccctgcggccagcggcggggcggataggatcggcgcggcccgccgcaggcagtgcattcccggcggggggtgcccgggacccggtacctgggcgctgagggcggccgagcgctgaatcggccccggtggctgcccgcgagctccctcctgcgctgggggtcgagccaagttcccaggcactggggcgcggggacggctgccgggcgctggctcgcgagggccgcgggaggaaaggtggggctggccacaggtgcggggccgggggcagcggccggactacctgcggcgcggagcccgtcctgggcggccagattcggatgttgaacggcgccagcatggggagtggaggagctgtggctgcagagtgaccattcatttgggcggctgttttcaaaatctgggctgcgctttaatctgaaaggt

SEQ ID NO: 107950 - DNA, 1061 bp, Homo sapiens
tggttcagtcactgcacttgtctggaccttaggtttcctttctgtaattggaccagtgcttctctgacttagccatccctgaggacagtagagaaagagcatgtattctagggttaggggcttggggtgtagcctgtagcagcttgcagaaagcctggcatttctttgaactcctatttatttgtaaaatctacttacagttggtatcctatacaatgatctgaattttttggttgtaatataaaaatgcttcacccaaatctttgagtaaagttgatgttctagggtgaggtagcctcaaatatcccaaagggcatacagccacacccctctgggctggaggtgggattgaaagtagtttcaaaggtcccttccagctgtgaaattccaggcacctagagtaagtgagtctcatcctcaaaggacctaaggttggtaccaaagaattctaaaggaacctgagaagcgggatccctgtgccctgcccctggtgagaatggacagggctgtgtggaagtggaactagcagaaacagggagagagacagccctctgcagtgaagggtgaaggaggctggaggaagagccgggctgtgtctgggcctgactgtcggccttgagctgatgaccctggcaggtttggcttggcagctctccatctccccaggtaatttccaggaagcactaagccattgtttctcatccacagctggaggctgtctggggaggagccctcatatctcaggagggcagtgagggcagggggtgaactgcatgtggaaacatagagcttgtcacactgccaaggcctcctggccattctgatgcagcacctaaggctggggtctgggcttgtgcccagccagtgggaggagagttgagggagtctggagaagggcagcaaggttttggagagaacacagagatttctggcctttgaatgggaacaatctctaactacattctgggaacctctctgtgcatggggaaagactatctgctgatggtggtgtcagccttgcacaaatttgccagtatgcatggtctcttcctcaggcatga

SEQ ID NO: 107951 - DNA, 1012 bp, Homo sapiens
taattcatcaagtctatactcccatctaagataggagacctttcatagcatccttcacagatagttgtccaggaccttttgaacacttgtggttttaagaatctaccacctgaaatatgaagctgctgcctttgtccagaggtccggtagtaagaagctcctcttttattcaatagaaatctgcctatatgtaacaagctctttctggaacagcatatcatgaatataatttcattatatgtttgaagtctccaccatgtatctgtttcttcgtactccatcttctaacattacctgagacctgtctcataagaggacttctggatccccaagaaacttttgcctttttaaaacaaggaattccagttttttgcattcagactaaagcagttgcccagaaccatgaatgaaaacggaattttgtctgatttttaaatatctaaataaaatgattatgtagtttttttctttgtcactaagttgatactgtaaattacactgattttcagttgttgaaccagccttacattttcaggataaaccacacagaataataatatatttttttcaaaatatattgctgaatttgatttgccattattttgttgaggatttttgtgtttatatttatgaagaatattgttccatggttttttttataatgtctttatcttattttcatatcaagtaatgttgctctcataaaatttctttaattgaggttctctatttcttcttgtgggaattttggtagtttgtgtctttcagtgaatttttgtattttatctaagttgtcaagtttttatattatgacatagatttgtttatatatatatagagagagagacttgttctatatatatggattcatatatatatatatatatatataatgtctgtaggatttgtagtgatgttctctattttattcctgagatttatttttgtaccatctttctttttttcctgatcagcctgcctacaggcttaccaattttattgatctttccaa

SEQ ID NO: 107952 - DNA, 1034 bp, Homo sapiens
aatggccttgcggcattagatgccaacatagctagactccagaagtctttaaggactggtcttctggagaaatgaattcagaagaaaactcatcaggtgcttctttttaaaactagaacttggctatattgaatgtgtatttttctttagtgaaatgatgttttatgttattatgtgtgaagtaatatattgtacaagtaataaatgtattgttgagatatattgacactgaggagcttataaaaacaagtcatcttaagttcacaattgctacaagaagaaagttgtggataactaggaaattattgtaagtaatgttttatttcagtacttagcaattagagttcttttattaagatgtatctgctggattaagggtacaggttgaaatagttctgtggctgtcctaagaaataatgggaaaagaatctctggatgtaagtttttctgttgaaactagagggttttttttttctgtttacatatacttttttttaatagcaatgtgtttttattaaacatgctgtgtgccacaggccagtgttgttggtgaaatatataaacatttatttaaagagaaaagttaccagtatctacacctcttaaaaaacattgattggtctaaaaaatatatagataacatcctaagttaacatatggcttcttaaaacttgggcacttttatttgtttttatcccaaattcatgttttaaggcctttaaagaatagtcagactgataaagaagtgctaacagataagctatagttggggaaatttgtgggttttttttaaataagaaatgtttatttttgtccttatatttaaacatgatggaatttgtaaatcttggcattgattgtaattctgcctttttggaagaattttttctcccagcatgttagctgagaatattctctattttataaataatatgaagtaggttggtctctctgcttctctataccaggacttcttagctcagtatcatctcccttcatgtaagcagcacgttttaactcttaggaagctgaat

SEQ ID NO: 107953 - DNA, 1017 bp, Homo sapiens
ccagcctggccaacatggtgaaaccctgtctctactaaaaatagaaaaattagccaggcgtggtgatgcgcacctgtaatcccagctactcgggaggctgaggcaagaggatcacttgaacctgggaggcagaagtttcagtgagctgagatcattccactgtactcgagcctgggtgacagaatgagactctatctcaattaaaaaaaaaaaaaaaagagtaaaacatctccataccttaaaaaaaaattctgagcctctatttttagacatagtgatagattcgatacagaccaatgtattttatcattgttattttaattattatatgctcttgccaaagcacgttctgtgattttgtgcttctagttgcttgttttcatattaagaaccagacacttctctcaaatcctttttttaaagatggaggtatagataagtgaattaaagaaacaggtaaaaaataataattagtgttctggattcttcttaacagaactttacagactagcatggcaaagcttctctccgatcttagtgtggacagtgctcgctgcaagcctgggaataaccttaccaaatcactcttgaacattcatgataaacaacttcaacatgacccagctcctgctcacacttccataatgagctatctaaataagttagaaacaaattacagttttacacattcagagccactttctacaattaaaaatgaggaaaccatagagccagacaaaacctatgaaaatgttctgtcctccagaggccctcaaaatagtaacactaggggcatggaggaagcatctgcacctggaattatttctgccctttcaaaacaggattctgatgaagggagtgaaactatggctttaatagaagatgagcataatttggataatacaatttacattccttttgctagaagcactcctgaaaagaaatcaccactttctaagagactatcccctcagccacaaataagagcagctacaacacagctagtcagcaacagcg

SEQ ID NO: 107954 - DNA, 2096 bp, Homo sapiens
atgagcactttataaaagtgttcagtttcaccagagtgattcagaaattatcactgtgtctccactgttaaccaaaggtgaggaaagggagagggtaggagagaggaggcctagaggacaagtggggagatcagtagttgccactttaaatagcttctcttatttatattatctgatcatttatcttattgtttctttgagatcattactgtgtataattacttgtttgttatcagctctgtgagaacaggggccacgtctgtgttgttcatctctgtatattcagattctaatacaatacctcacacataggaagcattcgctgagcatgtatttgctcaacaaatggtgccatatacttttatcgccatgaaaaagaacgtgatagatctatgtgtttgtatacaacagtcttatgggaaaaaaaggcaaagttagaaattgtgtatagtatgtgtgtgtatgtagtgtaattaataccatatgtaaaagtgttttcacgaaagataccaaaattaatactgattgtctctggggacagagaggaggagtggaagggagattcttcattgagaatcattgacattctgtggtgtttgaattttttaactttgtacatgtattattcttttaaaaggattatgtattctttcttttaaaagggtttaaaaaattaatgcttaaaatgtcaactggaaaagaaaggtatgacttctgccaatcatttttaaaaatatatgtagtatttatgtagaactgctcatgcaattaatcgttaaacaaaatcaataaatttcaggccttttttttttttttttaagaaacaggtattttccaagtttgtactttttaggtttgggaaacaactatttgatccattttgtcttaacagtgttttctcttcagtcattgaatatgtcactgcaaaatcaattggaggagtcactaaagagccaggaattactgcagagtaaaaatgaagagctgttaaaagtgattgaaaatcagaaagatgaaaacaaaaaatttagtagtatatttaaagacaaagatcaaactatacttgaaaataaacagcaatatgatattgagataacaagaataaaaattggtacgtatttagacagtagttatggtcacatcttttaaaaggaataaggaaactgaaacttttgttgttttagaattggaggaagccctagtcaatgtgaaaagctcccagtttaagttagaaactgctgaaaaggaaaaccagatattggggataacattacgtcagcgtgatgctgaggtgactcgactaagagaattaaccaggtaaaattgacttcctttgaataactcatgccttttttatttttagatgtttttataaacttcaaaataatgttagacctgttttctcccccatatctttttctcttattttgccaatgtttttgctaatttctaatgatgttttcttctgttccaattaaattagtttaggaatttcaaacctggcgaaatgtttttttaaaaccatgtgattctgggcagggggtcctgatgagaagctgaagacttgtatagcaacaccattgagccctctggttctgaagctagagagatctgactggaatcccagctctgccacatattagctgagtaactttgagcaagccatttaacttctctaaacctcagctgtaaagtagggacatgaatagagttgtcatgggaaactaagaaatcattcatgaaaagcacttagcatggtaagccctcatgccatatgatcttgggtaagtcagcctctttcagcattatttcatcagttaaatgagtgagttggcagtaccccttgagatcacttcattccctaacagtatttttctaaaataaaattacctcactcaatttttctatgatattcacttacaaaattcagttttcttttgagatatttgctaagaattggattctcaactgctttttaaagttctaggcgagaagtcagttatctgaggcctaaagatctgcagatctgactttgtcttcgaatgatcctagaagttccaaatataaaataatcttgaatataaaataatcttcct

SEQ ID NO: 107955 - DNA, 1464 bp, Homo sapiens
ctacgcccagctaatttttgtatttttagtagagatggggtttcgccatgttggccaggctagtctcaaactcctgacctcaggtgatccgcccacctcgacctcccaaagtgctgggattacaggcgtgagccaccgcgcctggcccatgaggggaggttttatgttgtttcaggcaaccttaaaaattatctcaggcctcataataatagtagtatggttttgtttttgttttgtttatttagtttttgtcttttggggatgagatggacttctgctgtcttagtgggtttatgttttatcttttttgataggctatcacatgtatactattaaattggcttggtatgcttgcattcatagttcttcattatttctttaggcagttgagaattttgaaccagcaactcagagaacaacagaaaactcaaaaaccatctggtgctgtggattgcaaccttgaatgtaggtaaaagaactttaaggattgataaattatttgtggctccggaaatgttgataaagaattgagcttttgtaattactttgaggggataaatttaaaatattgtagaaacataagaaaataaaagatgctgtcacttcccaataatatacacctttttttgtttgtttgttttgaaatacaggagtgtgtttccttttacatatcttctcttcatatataattgatttatttaacacttactgaatacctactgtgtgccaggcacaaatagaactatatatgtacttttttaaaaatgagatcacactgtacatacttttccacagcttctgtttattcacttaacatataatggacacttttgtctatcaaaatacataattatgcatctttctctttaagaattacttgggtattctgcttatccaggtctaccataatatggtcctttgctaatagtactttccccttttttcccagtgcaaacaacattgcagtgaaaatctttgtatatgtctttgtgcatatatgtcagctttgtttgtttgtttgtttgtttgtttgtttgttttgagacggcgtcactctgtggcccaggctggagtgcagtggtgcgatcgtgtctcactgcaacctctgcctccaaggttcaagtgattctcttccctcagcctctcaagtgtctgggattataggcgcctgccaccacgcctgtctaatttttgtatttttattagagacagggtttcatcatgttggccaggctggtcttgaactcctgacctcaagtgatccactcacctcggcctcccaaggtgtgggattacagacaatgagccaccacgcctggccagcatttttgtaggatagatttatagcagtagaattgttgagccaaagggtatatacagttgcaattgtgacagatattgccaaattgtccttaatgatcacagagcttaataaagaaactataatagtaccagaagaaaata

SEQ ID NO: 107956 - DNA, 1952 bp, Homo sapiens
taagaaaataagtttaaacatacaaaaagtttttgcacaaacatatttacagaaatgtttcagcagtgaaaaactggctgttacttaaatgtctaactgtatgggagtagttacacagactatagtatatcctcaaaatatagtggtaactacttattaaatattcacaaaatgaatatattaataaacatgttttaataaatatatttcatatatttgagtttgttgtaattaatacctacaaatgagtgctcatacttctgaagacttgtttttatctttctttaggaagttcaaactgatggcaacagtcagtttgcatcacaaggtaaaacagtttctgcaacctgtactgatgttctacggaattcatttaataccagtcctggagttccatgtagcctgcccaaaactgacatatcagctattccaacattgcagcaactgggccttgttaatggaattctgccacaacaaggaattcataaggaaacagacctactaaaatgtattcaaacatatttgtctctttttcgatctcatggaaaagaaacgcatctggacagtcagacacaccgaagccctactcagtcacaaccagctttcttggccactaatgaagaaaaatgtgccagagagcaaattagagaggccacaagtgaaagaaaggatttaaacatacatgtgcgagatacaaaaacagtgaaggatgtacagaaggcaaaaaatgtgaacaagacagctgaaaaagttagaattataaaatatttgttgggagagctcaaggccctggtagcagaacaaggtagatgggacttataactttctgtagtatggtgttatactaaatagcaatgtcatgttatttagctatcatttaaatggagtttgtggtattttccatagaactgtgttttgagctaataagaaaatgagttctacttattgtattattttttaagttttgatcccttctttcctgtggatttaaaatgcgtttgagaatgtcaaacattcagtcttttgcttgcaagtgtgtatttattctgcttgataatagaccttgaaaagagtcaaccaaagagaatttggacagataaaaattttaattagagaatgcctataaatgattaactccctgagtagactgattattcttcctgttttaaaaagatgcagagaattctttcctgtcacttctttaatagccaactgttagattgtttaacaaatctcactttgagaagtaacgcataccttcttatgcccttttcagtgtatttttaggactttttttcttaaatcaaggtgtttctgagccagattctattcatttgtttccattctgtatatgtattctatagtaatggcttttgcttgaaatgagttacagttttgtcatcttggaaacacagtaattgattttggaagcattgattgaatacctaacgtttgcagaccaaaaaaaaaaaaaatcttaaaatgctatataaatgtagcaccattagaccaaagatttagtatattaaaattgctctgttttcagaccttcaacttattaccattttcacagtcagatacataatcatggtaataataataataccattagctgtcatttattgaacacttaccatgtgtccagcacagtgctaagtgttttatatgcattatctcatttaatcctcccagcagccctatgtggtactgttaccactcccattttactgatgaggaaactgagactccgtctcaaaataaataaataaataaagattggtagaagactgcttgatcattgaacacagttgtttactgtgtacatatacttttcatgaggatgttaaaatatctgtgaaactgaatacatttttgtaacttagaatacactttcaacttctaggttatcagatgattaataaataattttaagtactttcagcccgtagtaa

SEQ ID NO: 107957 - DNA, 1487 bp, Homo sapiens
tttttgaagaatcatatttcaagaacttttttcttcttccacattagcatcttcagataataagaaacagatacctaatgaagcttctgctagaagtgaaagagacacatcagacctagagcaaaactggtcattgcaagatcattatagaatgtattcacccataatataccaagccctctgtgagcacgtgcagactcagatgtcactgatgaatgacttgacttcaaagaacatccctaatggaattcctgctgtaccatgccatgctccctctcattctggtgagtacgaatgctgtttaaaaatcgtgagtgtaagttctaattaaattgcttggttactgtataaaaagtaggatatgtgattaattttttctccctcttacttacagaatctcaggcaactcctcattctagttatggcttatgtacctccaccccagtctggtcacttcagcggccaccctgccctccaaaggttcattctgtgcgtacagttcttatactacataagtaactatttgcttatagcagtcattcaggagggactgttgaatttattgcttataacttaatgcactaggatttaaagaccagttgtttatttttttttgctataaaagttttacatgtttatggccgagcgccgtggctaaacgcctgtaatcccggcactttgggaggccgaggtgggtggatcacgaggtctggagttcaagaccagcctggccaacatggtgaaaccccacctctacgaaaaatacagaaattagctgggcatggtggcacatgcctgtaatcccagctactcgggaggctgaggcaggagaattacttgaaccgggacccaggaggcagaggtagcagtgagtgagatcgcgccactgcactccagcctgggctacagagtgagactctatctcaaaaaaaaaaaaaaagaaaagaaagaaaagttttacctatttattaatgacaataatgaaggagaaagaggggaagagatcagtaggaggaaaaaaatcaaccatactgaccacccaagtacaactgctgttgacacactgatagagttctttccaatcgtttaatcctctgtataggttttagtttctggtttgtatttgttaacatttgctttccttttaaaataaagttataagtcaacaatacagtcttatatactgctgctttcacttaatactttattaaaaacatgtttattaatatataccctttgaatttttaataacttgttaatactgtattttttggatataccatagtctgtgtaactactatatggttaggagtagtaaccatatatttgagtttcttataattaatattattattaataagcaagtttttaatatcagaaacttactaatatttttagcttaaaagtaagttggatttttttcctcagtgcaataaagattcttgttttttaaagcttaatttaccctgtaatatgggagcattaca

SEQ ID NO: 107958 - DNA, 1048 bp, Homo sapiens
tacagacaatttttagcaccctgcgaggctccctccctgtcagtaccctcaccatcacctagaccctcatccctgtgtaaccattttcctgacatctgtttccatttgtgacttttacctgtttgatgacttcctataaatgtgattgaacactgtgcgcccttgtgtttgaccactttcagtcagccttaagtgtattaaacatccaggtagttgtatatatcagtactttgttggttttttaatgctgtatagtattccagcctgcgagtataccacagtttatccatttctgctattcatggctatttggtgttttcagctttgggctactgcaaatcaagctgctgtgaacattcttgcacatgtctttcagtagacataagcactcatttctattggtgtatacctgggagtggaattgttatttcatagaatatatgtacgtttagctttggtaggtgtgacaaatatccatatatttttctaaatttattttgtatactgataacctatgatttaccagaatattttcatttctgttaatagtgttttaaaaaacctttgggaaggggacctaattagggaaatagtattcagattgttataccaatctataggtagtgctatgtagaaaactttgttgttttttacttattactttgttaataccgatttctaccttgttcatagactaatactaggttctgtaagagaaaacaatgaagtacagccctgcttagagaaacttgtggtttagtcagaaaggcaggaggatgaaagataagcaatataaggcagtgtgtcagtggcatatgatttctatagacaatatgtgctctagggtggtgaagagtagtcactagactggaatgattggattggaaaaggcttcatggaagaagaaaactcagatgagccttggtgagtgggtagaattggattggtaggaatggttcatgaacaatgttattggaaggtgagaaaagcttgttgggtaactaaattggcctgcctgaaatgaaaaattggagttgggagtgatggg

SEQ ID NO: 107959 - DNA, 1605 bp, Homo sapiens
gtctaatcaggcattctaaagaatgtacataaaaggaaccagagttaagaactctgtcctatatcatgaattaacttgcatgtttcaaagaatttgggactatagaacatattttgggattaatatagtctgaacttagtgtagtagttacttctggtttaaaatagtatctcaatttccttttcaccttaaatagacttaaggaacaaatatatgtgtagtttgcttgacgttttacataaaagaaatttaatatatgaattaaattataattgtgtatttttaggatatatcacattaattaaaacagtgaataatgtggtacatacatataatggaatatatttgacctcaaaaaggaagaaaaattttgacacatgctacaatatagatgaagcttgaagacattatgctaagtgaaataagccagtcacaaaagaacaaatattgtattatttcagttatataaagtttctagactagtcaaattcatagaaactaggatgatagttgctagggtcagggagaagaggggatggaaaggtattgtttaatggatgcagagtttcagtttgagaagatgaataaaagaaaaaaatgacattaaattttgtcaagatagcatattgaaaatataatagaaaaatatttgtttatctgctataatatattatgtcataggtgttatcttcaggaaggcacactggacctgctaaattaacaaatggaaagaaagcgtaagtacttgaagacgtttacaacttcagatttcaaggaatttttcaggtctttgggctggatgacatgtcgtctaccccagaaaattaggtaggcctctaccatcacaagctctgaggaacaatttttcatgtctacccatgttaatcattttagtatttaacagtctttctgatcttcagaatgtgtttataaattcatcttgtacatggttggacaagctttcttgtctttgctggaaagaaaatgactacttactaatatattttgggaaaaatatttgtaagaatattaataagcttgttttccaggacctatttaagaaaaataccacgttttaatgcagattctggctattccatccattctgattcagaaagtcaggtaagattgaatagatacaatacacactattttaattagttttcaaatagtagctaaaaagtaggaataaaatgcaaagtattaattgctctaaggaagtatgaagtctgttgctttaaaacatcttttctaccaataatagtttgtaaataaacaaattttaaaactacataatttatattttttcctacactaacagtcatatacaaatgtattctaaatgactttatttcttacaggctgaaactgtacacgggcttgatggttgtgcttctttgctgagggacattttgagaaatgaagattcaggttttttttttttaattctttgctgatcaccttatctcaagtcattattttgatgtaacaaatttttgttttattaataggttcagaaacagcatatttagaaaacagatctaattctagacctttagaaagcaaaagatacggatcaaaaaagaaaagacatgaaaaacatac

SEQ ID NO: 107960 - DNA, 1388 bp, Homo sapiens
cgcctttttccggacaggtaagccgggcagggcgcggggggccagggctgaaggctactgcctcggacgcggcgtctcggacaagtttggggaaggagggctgttgctgccgcgtgcgtgttggggggcagtgccccctcggcgtcggggctggagttgccgagattctggttgttatggcagtgctggctgcgtctggggagggcgtgggggctgggaactccgcgcccctccgccttcaccccagttgcgggagtctgtgttggggaggtgggaggcggtcccctcggaccgccttctcccagagcgcggggatgggcggtgttggctcactttgcagcgcgccgctccggctaccggcgtcccggcccctcccttggctccccctcccctgtgcctgtcagcggggctcccggcggccgccctgggtcggcacccctcctcgccgtcgggggcccggggccctgatgtgcacagaggggcggcggggacccggagccgcgccggctgcagactgacaggagtggggcggaagacatcggtctcgcctggtgcgtgtggggagctggtccctctgacttgagaggcagacccagctgggagggcggtgggcgcctcggacctcccccttgtcctcctcttcagttctgggaacggaggagctattcataagaattactcattcctggaagtgtgagttagcgtccctctcatacacacccactaagtctctgcttgctgtgaggtgtagagccctgagatgtctttctagctctttgcgcccctgccatcgtccaagtcccgggtccattgctcctcctgctccctggctacacagtccctccctagaaccggcactgaccacccttatcttccaccacctgtggccctgtttctctgatggccagggattccccgtctccctgtacctgtggcttccaccagcttctgtgtgtagctccccatctccccacatgtctgaaacagttttgtctggaatctttgtcccaaggagtccagtaagttaccggggccccatgcatctgctctcccttctggaaagttggattagaggacatgaactggtgggggtcaggggtcaggttagctctggagggtctctgcacatccatctgtttcctaaccctgttaccttgccctggaggtcatctctagggaagggggtggggtgctttgcgggggagacttgtggctttggaagtcaagacttgattggctcatatgttcattctctagttgatgtgcagaggaaaaaactggaggacaggagctggtgccagggtctggggaaatcagagggagccctgtcattctattctgcttcccaggtctaagccttctttccttttctttcttcctccttcctt

SEQ ID NO: 107961 - DNA, 1038 bp, Homo sapiens
atttatttgtcttcatgtttacctctggaaaaaactcacaagtttagtgattcatctatataataagctttcaaatatttgcaggaacgtgtttgtttccccataatctttttgtcttcaggttaaacagtcatagttccatatttattattctgatgtcatgcttctcagaatccccatagcatttctttcctctagttgcattctatgttgccagtgttcctgctgccagaattggatccaacccattgttccagacaagatcaggttagtgaactctagtacttgcaggctgtctgaacacgaaacttctaacaccttctgtatagtatgagttagctttctgtagcctttccacaatgctgactcctcttaggtttgtggtaactgaaagcccaagaatttgtatcctttcccacactgtaaaacttttttttaaaaagctaaaagcaaggctgtactttagaaagaaagcttaatgacacaagtttaacacaaatacattctaaatttcagaggttactcgtaaagccaaagcctttttgaactccataccaactcagtttctctttggaggtagatcctggtattagttattaggggtccttccagatctttctgtgcatttacatagatagatagatagatatcatcagaaatgtgtaaattgtgtatgtgtgtttgaggttaacatatcattttgcaagttttctgcatgcagcatgtcctggaaatcttctgcatagtgtatttcacagtgtggatattccatagttttcttagcaattcttcgattatttctggtgtttaaaatcatcataaacagcgtctccttgtacacatgtacaagtgcttctctagggtagatacaaaagactgggtgagtgatacatatatgtttattttaaaatgtagatctcagacatgaaatttgcccttgttaattttgacctagtgttcgaatctgcccagataattttatgtcttgattttgatcatctattataatattaagcccactataccagttttgcccat

SEQ ID NO: 107962 - DNA, 1094 bp, Homo sapiens
gttcagacattattttgatgatttattctccttaataatagatgctgtttttgtggtgtttgttactgggcgtttgccaattctgctgattgtattctgtgcttatagacgttgactaaggagatggttgctatggtggggactgtctatcaaaagaaaagagctcatagagataagaagcatgagttgtatataaaagaagtcacattgctttttgttgttgagttttggtgtattcatggggacctgacaagtaaggtaggggtttacgttcctttgtttacatgtaattttttttggtaatgggaagaatgaaagactgctgctctttattcacagagcatcaggcagtgtttcccagcatgtgggaatgtccaccactggtagtacatgagatgattttaggtgatttacagatgtttcttgagcttctcttgctggtcactgcttggcacagtccagaagacaatctgttttccccgatgcctgcttctgttgggctgtccactcctgccccacccattcactgtgggccctccttaatcccacccattcctcagctctctcttcgttcctacctctggtctccctcttctccttctggcatccctgcctgggcctcacactttgccctgccttagtttcttggccccagtatgtctccagcctccctggccctcatgcctattgtctgtcccttgtgttctttcaaggcacagctttatgctacctgctacaagtatccccattccctggcatttctctattatcctctaactaattgcccagcttccatcccttcttatgtctgtgctgggccaccttcgccccacagatcctgtgtctccaatcctggacttgcgcctacctgtcttccttgcctctaatcctgagtgcctttccctttcagccatgatcttcttttttctttttctcctacctttttatgtcaccttgcagtccactaatttcttttataaagaagcataagtaaaaaagagtcaacttaatatcaaggaaacaacagtgtaggaggtatgtggatatggttaaaatagtgacagaagtacaaaaattactgatgtttgtcatta

SEQ ID NO: 107963 - DNA, 1037 bp, Homo sapiens
tctggatccgacactggtgtcctcacagagggcaccccaggcatcctccagcaacagcgggcagccagagcagcagaggaaggacatggcaggtacggctgacaatgctttgtgagcaggaatgagcatggggagatatgagtggggctcctggacatagtgagatgaaacttttcaggggctgaggtgcaacatgaggaagaagatcaggccaaagccagtggaatttggattgcctctgttaatgggatgtcttgtctggtgaaggctaggaaactcaagtcacagaagaaacttcccgtcagtgaggtagtattccccaatttaacaaatatgtattgaatgcctaccctgtgcaggcactattatgagtgtgaacaagagaggcagaatctttgtcttcatgagaatgacagtgaagggaagacattacccagttagaaagtgccatgggagcagagaaaatgaggaggagaatttcagctgtggatttgatcttgaaagggccttaaaggatgggtaaaagttgggcttgtggagatagaggaggcctagagaagaagggagaatttgggaaatagtctttatgtggtggatgtgtgtttatacacattgtgaatgtgtatgaaggagattaggaatattgagagagaaagctggaaaggttggttgggtgggctttcggtcccatgctaggattttattcagtagtctatgggcagccattgggatattttgagcaagaaaagtaacttgatcaatcatttcctgcctttggctgaggtcacttagcagcactggtgttaggcagggctgcaggccatgattgtttcgatatgttctcttcctggccttctcacgggagcagtcgtaattttatttttacccacttctctgttttgggcgtccgtcagattagcagctagctctatgcctccagttggaagagagcttctgttcaaagtgctgtatgggtggagtctttctgccactgtccgagccctgctgcccttcctgggtgttgaccttggctgtag

SEQ ID NO: 107964 - DNA, 1018 bp, Homo sapiens
atctcaaaaaaaaaaaaaaaaaaaaagaaatcagaaatggctacttaaaaagacatgttaataattattttgtaaaatgaagagtaatgtgagttccaggagatgctatctgtgaaagatgcaggagtataaacagtacttctattagtagactagagaatgtagccaccagatagaggttttgattgtttatattttctatctccagaatctagcacaatgtctggtatacagtaggtgctcaataaagaaatattgaatgaataaatttttctaggctggagtaatcagagaaaagctacctcatggaagaagtcaagcttgagttagatatttaaaacatgacagaaattgggtggcagtggagagggcattttaagtttttcagaggatatcattgccatgtctacagtactgtgttatttatttctctctcatatttgtaaaatattgcacaagtcacccatgagcactcagctatttcttatctcctttatcagaccattagggaagggttgactctggggcccatggcacctggttgtatgataaaatgcaagaagtggtgatttatttctacttgaagaaacaattttacagtttggggatgcttttgcagccctgttcaaagaggctgtggattggaattctccataaggccattaattattgaatttgctttactgtaaaacaaaggagctgcttataggtgtcagctgttgaaggtgcagagtgacttagtagcagtataagtgctcctcctaatcacaggcagacctgttagcagacactcagaaaaaaggacaggatactgtcagcacattgcttcagggaagatgggcaattagtggcttcagatgtcacatagcattcttctccttttggtctcccaggtgctctctgttgggcaatcagagattttagttatgactctagaaacaagtcccagtgagagaattttgggctttgcacttgccaaatggtgagatgagtggtgccagagagtttggctgcggtg

SEQ ID NO: 107965 - DNA, 1053 bp, Homo sapiens
tgggaggcagaggttgcagtgagctgagattgcacctctgcactccagcctgggcaatagagcgactctgtctcaaaaaaaaaaaaaaaaaaaagaaaagaaaaaaaaagaggtgggggttagtaaatcctggaaacctagaacttatccatgagtgaggctctaaaacaacaaatatttattgagttatttgtggatgctggaactataccatgtgctttatataaattattttattgtctccttttacaaaactatgtgagataatagcgctcatcaccatctttgttttgcgaggcttgaaaagagcaagtaaggtccccaggttatcacagctagtgagtggtgggcctacattttaaagccaggtgtgttggactccaaagcctaatggtttataactccccaccccatgcagcccctccaggtgagagggagcacaggcaataggctctgcccatccagacattccagaatacgaatgaggagaaggccctgcagattcagatcatggagcatcttctataagcaagtgcttatggaagatactctgcctcctagggagagacagagtgtggacttttatctgacagttcttgctgtctgtttgcctccgtgttatttcaagaagtatttgagtaggtggacctatcctagtttgggccttttattaggttttgaattgtcctgtcagtagcttgtgttagtggcatctccatccattagaaaaaaattattttgaaataattataccttcataggaagttgcaaagaaacatacatggaagtcctgtgtgcccttcatccagcatcccccactgttaacatcttgcacaactgtagtacaatatcagactaggaaataatccacagactcatccatccagtttttctcccatattctgagaatcacattttaaaagaagcatcactaggccaaagtgtatctggaagagggagagggtggttggtctagaagccaggtcatatccagaaattctaagggactgttgtgagctttttgcatatagatgctgtatgttatttacatgt

SEQ ID NO: 107966 - DNA, 1054 bp, Homo sapiens
aaaccatctgcaggagggtccttttccttgtggactgctgtcctgtgtggtatttctgataaagcttgagtttccagtgcagcagaggagaagaggagagtgtgtcttttcttcccttttgtcttaactgcattcagaaaattccacctctgcccctttcccctgcgaatgcccctggtcccagctccttcctgagtcctgttgctccaggtgcagtggctgtgggtctgggacctgtgggaacctcctgtgatggagtacagagcactgttaaggagaaaggaaacatcagagtcagctcttcttctgctcctcagggctccccttttcctgcccatctttctcctaggatagactggtctacgcagagaggctcacaggtgtgccttgtaaacttcagaaattattctacccgtcacactcagggtttgtttctgcctgctttgtgtcacctccaccccaccctctgctcctgaagcagggatgtttgtggctgaatgaggagggtggagtagatgggagtgtgtttacagcctcctctgggcttctgcctggtgactagaaggacctagatgggaacattgtggaagagatagcccacttctcccaggaagctcccagtctactgaggagatgataattgcttatctgatggcctctggtataaagtgatgcctgagctgagcgtttcttcattacctctcagatgccagcaccagtcctaggctagtgcatcagtagaagccggatctgagctgagatggtgattctgtcctctctggagaggccattgtccccaagaggcattcatgtggtgatttgcaaaacactgttgagtttctctttgcctgtttggggatttttatgcaaagggatctccattcctagaattcactgaaagcaatccctgacatgccctctgcaactcatcatgttaatgggaaagaagggctggaggccagccagggtaccctcctccccccaccacccgccaagccatgtcaggatggctatattgattgcagagtctgacggaagattacggcaatggatg

SEQ ID NO: 107967 - DNA, 1032 bp, Homo sapiens
agggtctcagtttcttgttgcagaggctgatctctggtctttgttatgtgggcctctccaacatggtagcttgtttcatcaaagccagcaagaaagagaatcctctggcaagatggaagccacagtcgcacatagcctagccacagaagtgatctcccatcacctttgccttattatactgattaagaagcaagctacaaagccagtatatactcaaggagagaggatcattgggggcctccccagagtctccttgccacaggcagggagtattaaccaagaaaaagactcaggagattgagagatctggtgccccagacccatctggcttcatctagtgcctctttaaccatctcactatcagcctccagacctgaaagatgtgctttatgcctgggttccaagtgctccttatctatgctgaccaaaaccgcatcttcacatctgttcttcctcattaaagattttcatactgaaaacacataaaaagaaaaataaagtgttggggaagaggagctggaaagttcaaaatattgagtatttgtatattatatatatagggtgttgtgaactgaattgtgcccttcccaaattcatatgttgcagtcctaaatcccagtccctcagaatgtgactgtagaaataaggctttcaagaggtgattaagttaaaatgatgccgttagagtgggccctaacccaatctgactgatggccttataagaagagaagattgattagggcacatggagagagactgtgttaagctgttcttgcattgctataatttaattaattactgggcaattttataattgctggttaatttataagaaaggaggtttaattggctcatggttctgcaggctgtataggaagcacagtgctagcatctgcttctggtgaggtctcaggaagcttccaatcatggtggaaggtgaagagggaacaggcatctctcatggtgagagtgggagcaagaggctggggaggtgctacactttacagtaaccagatctcatgagaactaact

SEQ ID NO: 107968 - DNA, 1068 bp, Homo sapiens
ggtttcttcatcagagaaaaaggatgttttcagtggagtatcttcataagaccttgagggaaagttggtagagagaggatacaggactcctctgaggaacagcaatgcccttagaataatgcagcctcagaaggggccgcccttgaggagcatagcactcctggatattgtgtgtcaggcgtctcttgaagacatttaccccagtggttaggtacatggattctcaagccaggcttcctgagttcagtcctggttctgttatttcccttctctgttcctcagcattcccaaatgtaaatagggtaatagcagcagcaaactccatggggttgtagtagggattaaatgagtgaataagttaaagatgattagaagcaatgcttagcaaatgtgtaacagatgctattttaaaaatcttaaagtgtgattgccttttatggtaagttccagaggtgagaccttgtcatatatactactgaatccatgcagtgcccaaccagaacctgtcctaagcaggtgtccagttatttactggatgaaatactgaaatctacaacttccctagtttatgtgttcatcagcagggagctaaggccaataaacatgttcctctttccctaggagtaaaaaccctctcacagttcccctagggaatcattcctttcagttcaacacagtccaaatttcaaccattaaagtaactcgttcctttgacttaagatgttttgctcctgaggcctcatcagtcctccaagcctgagtgtatccaattcctcctgagcagggtttttgacaggggtgatgggacacttgtttgccagttgggaggaggggtagaagatgggaatgatgctgaattatgcaggtgatttattttgaagggggatcttaatgacttggcagcattgctcagagctcaccttggtgcgggtgggatatcttgctgaaagacacagtaattaggacctggacatgtagattgaactatctttgttttttatcttttctttttttgagaaagagactcactctgtcgcccaggctggagtgcagtggcttgatctcagc

SEQ ID NO: 107969 - DNA, 1293 bp, Homo sapiens
tcactactctcttagtgttggacattttggatttttttttcatttaaaaagattgcaaaccctgtcgtttaccctttgcatacatccataatgattttcttgactagatttgccttatataattctgtctttgaataacatggtaactccagactcctagcatgttaaactttgtctctgtattctatattgtaagtttttatttggtttcctgaacatccatgatgctggggagaagatgcttactttctgcaggtgcattattcaagagcagccctcttgctaatcaagcccttgcttctggcctctggaagcaagccttgtgtgctacttataaacaaacacccagaacacagtcttctccttcttcttagtttatcctgttttcattttatcttgtctcgtagatcccagattctaccaaaccacatcttgccttcatcctcagccttgatccttctagctagaacacttttccggttgtgggcaagaactttcccacacgttctctgcctggttcaccctccagcccaacctcagtgtctcttgtggacatcttgtaaagatagaccattctaatgctgtttccaaggggctgccacttgctccagccctttagcagggacgtgacaggcagggcttgtcctctgccctgaccacagaccctatactgctgtgcatagggagggatttatcaggagccttcctatctgtttttcttgcaatgcagttcatctagaaatgttccttctatctgccaggtaattgtcctcgtcatatctccaaacatgccccctgcatgttcttttctgtccccaccttcagctgctctccgatggtttccaccagaatgctacccacagctctcttatggtgcacacttagtgattcaaatgacttccatggattcattctctggacccatatgcaattctccaggcactgtatgatttttaaaaaacaataccacatttatacagacccagagagacagacatataacaatgaggtattacttctctttttagctagatttctgatcgaggaattaaaagcttcgtgctaaatggggaaagaagggtagattttggatggcaagaggaactttcccttgcttactcctagaggtcatctaaccttgggaagtctctggagtgtggtgctgagaaaagcagacatggaccttggacaacactgggtttgattctgcactccataactcatgatttgtgcaacacagtcaagtttcttaacttctttaagcctgatttttctcatctgaaattgggataa

SEQ ID NO: 107970 - DNA, 1055 bp, Homo sapiens
gcagcacacatccatgtacccttgccttgttgtgtagagcacaggctgatgaggcggaaatcaccatttggttttcatagggatttgtttacttagcaaatatttttcgagtgcctccaagcgctgggcattatgaagtgggtgagtaaacagtccctgttctcacagagcttaccagtagaggagacagatattagtcaagtaacacatgagtggatatataaatacaactgaaaaggaccttggagatcattgagatcaactgatgaaactgagacccagaaatgctagttgcccaagcaatttgcccaagaccatgtagcaagttagggccagaataaagactagaactcagaactcctgattttcattcttaaactgttttccctaccctaatatgtcacactctggtctgctgcatatccataatagactgcccccaagccccagccagccatataatcatgttgatccatcaggacactattgccatttttagaaaaaaacagagagtattttgaaatgataattaaagagtatagtgaactaaatccctcagggtggcacttaccaaagcttgttttcagagttatctcggagcccagagcagaaacagagagaggcaaggctcccatgctgtagcgacactgactaataagggtgcttacaggtgtttcagtgttttggtctcaccccaatactttctcatctcccagattcagcagttgcttattcactcattaattcaacaaatatatactgagtgcctactaggtgccaggcacagttcttggagctagggacacagcagtgaacaaaacaggctgccctcatggagcatacattctagctgggagaaacagacaataaacaaaataaataacacagcatattagaagaatcaaagaaaaataagaaaggaaggtagggagtgccaaaggtagagatgcatttttaaatagggtagtcaggaaaaagaccttcctgagaaaatgatgtactcagtacatcattttctttatttagtgacaaataaatgtatgtatatacataca

SEQ ID NO: 107971 - DNA, 1044 bp, Homo sapiens
catatacacatacatatatatactatacatatacaaatatacaaatgaattggtgataaatatatctctttaagtgtgacagtgcatttgacatgatttaacatgtcgctgtgggcctagctctgaatagccagcatattgtgtaatttgaaaagtcccacaagctgcttcctactccttacagaaaaaggaaaagaaaaaaaaagcttctcatggcatgtaccaatgcccaattcctagcattccctttttgtggggcactaaagaagtagttctcaaacttgagtgtacatcagaattgcctggaaggattgttaaagcacagactgcagggctgcacccccggagtttgtggttcaataagatttggatggatacaaaactttgcatttctaacaaattcccaggtaatgctggtggtccagggaccacagtctgagaaccactaaattaagctgttatagctaggaggttcctgttaaaatgaagctattgcctgagaaatgaggcatccattcattaggatgcatggatgttatcaaagtagttatccttaaacagcagaatcgtttaaaaattggactatttttttgaacaggggtaagtttcagaagccacagccaaagaccccaagcatggaggaattaaacaagggatgtgtcctgaaaggaggtgccaacagtatttcattatttgtctatcaatgctttacattttcataacgtaatacttttataagcccttttgaccactactttcttttgaccagttaacctactaggtgggcagtgcaaatgaattattacattttataaataagaaaattgagacaaaaagaggttatatggcctcccttgagctatcaagtctgagactcccagatctcttactcctattccatttttctttctccattaacatttttcataacactagctatagctttcgcctgagacatctattctgggatcattaaaatccaggacatacagctgctcttggtcttttgccctgttcagaatcccacttgctgcaagtagatta

SEQ ID NO: 107972 - DNA, 1100 bp, Homo sapiens
ggtagagctgctggagcggcccagcgagcggcctggttggtgtctggtccgtaccaccgaacggagcccgcccttggagggtctggtccccagcagcgccctgtgcatctcacactcccgaagcagcgtggagatggactgcttcttccccttggtgaaaggtaggagaacagagcgggtgggaggcacagaccaaggaggccatgagcgctggcctgactctagctgaagaccaccatggaagtgacctgtctcacagacccatttttaccctgtggggtttctttgggacctgactgtgaagagaatgggttgggaacttggagaggaagagctcccgagtaactgtgtgtgactttgggaaagtcatttagccttcctgagtcagtttcatcttggaaatgaaggttgaattaagtaacctccaagatctcttccagttttcccatcatatcacactacattcgggaaagtcctcttctacctttggccaaatatggtttagactcatcctttctccactgacccactcccgctccacagcaacttctggctctctgacccccgaccaagtactcacatgctgacctggagacaccaggcacacccagggaggagccacagctgagtcagatctgatccttccctcagcccagccaggctttgaggtccatgactcctttatgtgccttcaacagataaagtattctagccttggcttttattgtatgtaagctctgtgttcccttcacatgcctgtttactcactttttctcatgccagggagactaaactcctcatgacagtgtttctttaggggtggtctctggattagtaatatcagcatgccctgggaacctgttagaaatgcaggtgccagcctgggcaacttagtgagaccctgtctctacaaaaatttaaaaatgcaaggcggcacatacctgtagtcccagctacttgggaggctgaggcaggagaatcacttgaacccgagaggctgaggttgccatgaggctgcagcaagccaagattgtgccactgcactccagcctgggcaacagagcgagactctgtctcaaaaaaaaaaaaaaaaaaattaa

SEQ ID NO: 107973 - DNA, 1076 bp, Homo sapiens
cctaggcaatggagcaagactccatttctaaaaattctaactttaaaaaatctgtgaaattgattaatagcacttaaactccaacaaggtagactttgcagtccagttatgccccaccaaaggtggtcagttaatgtgaagttccctgcctgctctttgtctaagttctgatacttctatagggctgagtacagggtgtttccagcctgaatcatccccaggattgttcaaggggtcagggttctctttctagtttccattggttttcttttttcttttttttaccagacagggtctcactctattacccaggctggagttcagtggcatgatcaggcctcactgcagccttgacctcccaggttcaagtgatccttctgcctcagcaacccccaagtagctgggactacaagtgcgagccattgtgcctccataggttttcagaggccccagcacaacctcctgtctgcactggctcccttccctcagtctctattcctaacctaccctgggtcctttctacagtccaccaacagcaggtccatctggctccgtgatttcccaagaaataatggcttaatcctctcataactttcttttgactttaacccagaggattgagataatatttgatatatttgagctaaaaattcaagtttttccttggcttgtacctctggcacctctccatgacctattctctgtcattaattctgtggtacttgaaggtaacatttggaccacattatggagatgggctgacctgtgtgatgggggttgtgctgacactgtgagtgttgggtgtatatgaggggaccactctttaattcaaagaagagcaggacagagaggagtttcgtggaaactgcctcaggcctgctttgttctggttgagatgtcctgcctgtggctacatccatctaatactatttaggacatgaaagggcttagaatcaaagcctcaaataggaacatgtcagggcaagccacatccttctctaaatacaactcagtgtcgtgctgtctccaagtagaactgaagcaggaagacccaggtgtccatggaaagagctggt

SEQ ID NO: 107974 - DNA, 1038 bp, Homo sapiens
tttttttgtgttgttgttgtttgtttgatgttgtttttgtcattgtttttgagacaggtgacatttgctctgtcacccaggctggagtgcagtggctcaatctcggctcactgcaacctccgcatcccaggcccaagccatcctcctacctaagcctcaagagtagctgggaccacagtagcacgccactacgcctagctaatttcttatatttaatagagacaaggtcttgccatgttggccaggctggtctggaacagctgggctcaagcaatctgcccacctcaacctcccacagtgctgggattacaggtgtagccaccacgcctggcctcacacacatttctaagtactctcaaggaaaagaacaagatgctctgagactatctggggacaggggtggggtgggggttagattgggcagtcgggaccctgcctgaggaactgacatagctaccaagagtcttgttactacccctcttctggcccgcaagtgggtattatttgtgttctctaccaagtttaaaaagtatttccgaaaggttttgctaactactatgggagaacgtaaggtagggaagtagagtaaaagcggcataaagctggatagccttatcatgctcacattttttaggaccttgcttgaagccgacttgcttcaagagctctcctgccgttctttggtctataagaacctctgaggaacctgtacctaagtcacaaaggatcactgccagggctcttacttcctgatttgcaacctgagtctcgtcataattatgttggcactgggatccagattaaaagaaccagagtcccattccctgcaacccaccttggcctttcccatctgtctctcatttctgttctgaggcattgccatccacagctgctgcctcctgctgcgataactgttattcagggtgtgctggcagggttcagctgagtctgcatgaccctctttgggcaatgctgtagacctgtttctgtaacatttgggacgttgtactcagtggcctttacgatcttttccaattc

SEQ ID NO: 107975 - DNA, 1150 bp, Homo sapiens
caaagcttctgcctcggtgagttaggatctctgctgcacaagacctactgttaaggaacaaaaacagggtttatctgcagtgcagataaaactcccgaagagtcaccacccacccatgagtccttctggacattaatgggcccttctgtggtcttgctatcagccttggtctttaattcgtgcttttgtttattaagaaagatgctcacccatctccccagatagaactaacacactttttctgggttttgcattaagggattatctttgagccaggaatagggctccccctgctttcactgtgtgatttttaataaagccttttctagacgtgtggactgttgctgctggcagtgactgtgtaaggaatcagaagacctaggatttagtcctgcctctgctatctactgtatagtcctgggaaaattacttagtctacttggggttctcttttacctcacttattagtgatgctgattctgtctattcaaatctaatcccaacagagttatgatgataattgagtaggcatgaatgggctttgtaaactgataatcaagcatctacaaatgttagttcttagccacctcgactgccttgtgaaggacagggaaagggaactgtgtcatccttatctcctgtagcttggtatgaagctgggcacatggaaacttagtatttgccagcaatagattggttgggtgaatgttgcagggtaatagtttgacagtctatacaatttggttttatttcccaagtttgagaaacaagagcttcctggccatgtgagaatctagtgtatctctaaactgaagtcctggagccccagaattctactatcttcctggcatgaaagaccaagcctctggaaagaaagcccctaggccaagtgtggtggctcacacctgtactcctagcactttgggaggccaaagcgggcagattgcctgagcttaggagttcaagaccagcctaggcaacacggtgaaaccccatatctagtaaaatacaaaagaaattagatgggcgtggtggcatgcgcctgtaatcccagctactccggaggctgaggcataagaatcgcttgaactcgggaggcagaggttgcagtgagccgagatcgcgccactgcactccagcctggggtgac

SEQ ID NO: 107976 - DNA, 1065 bp, Homo sapiens
tgactagcaggtctgggattcaaatttaggttcttttacccttagttccctctggagtaccatattcacccttttcacttgttttcttttgtaactgcatatttggtatagaattgcgatcgttagcattacctctggagctcttaactagagatagtcactttgacaatttcattatgtctgggaaattggcagcacatagatgccaagtacatcctggttgcctgagaaggtggcagctctgggctccctgctgcaggaggataaagtctctggtctgctagtgcttcactgtggtttggtgagaacagccttggctactgattttccatgttgtctgtggctaggctgggaggacacagggattccaaatgacttttcaaagtacacttctctaagcctgtttttctctcttttcagagtctagaaggaagctcataccgggggagcttgaaagaccctgcaggctgcctgaatgaggggatggccccacccacacctcctaaaaacccagaagaagaacagaaagccaaggccctgagaggcaggatgtaagtggcttccccagttcctccctgtggtgcacatgtgagtgcggtggacaatggacaaaggttggggaaaattcgagaggggttccccacgctgtttccactgacatctttcattctaagactcagatctgtacagcatagcactgataaacattgagccactttggcactgacttgattgaagtttaggctaaagtatattctgtgagatagcagctattactgacaaagtgtggttgtaggtctgttagaaatttaaaacatagtgataaaaggaaaatggcaaagttgaggaaactatgagactgttactgagggcctatagaatcagagagtctctgaccgtggcagatagtctgatagagatcacctaagaaaacatttccccaaatgtaggaaagttatatatagaggaaggagctgttgtaccaccaagcaggtcctgtctctactccttctccaaaggttttaattttgcatctgtttctgggattagttccaagagaacttc

SEQ ID NO: 107977 - DNA, 1099 bp, Homo sapiens
atgtcttagtcctttgtcaagtcaaagcaaagcttaagtcagaaaggtgacctctgaggtggcaggtgaccctgggaaaagccagtcactactctttttttttgagatggagtctctctcttttgcccaggccagagtgcagtggcactatctcggctcactgcaagctccgcctcccgggttcacaccattcttctgcctcagcctcccaaagtagctgggactacaggcacccgccaccgcatctggctaattttttgtatttttagtagagacggggtttcaccgtgttagccaggatggtctcgatctcctgacctcgtgatccgccagcctcagcctcccaaagtgctgggattacaggcgtgagccaccgcacccagccgccagtcactactcttagcatgtagcttgaaccggcctttgagcagtcatttaagccattgtccagattcaacaggccacaaaagtttgctgtctcttttgcccactttacgcatctcttctccctcttctcattcttgccaaaatccacacctcttcacatcctgagctatcttgaaaatgcagctgttagagtatctcatacctcttactatatctcatccttattctctcctgctgtactttatggtcttgatgaaagggtgttgtataggtgtttcactgtaaaccatatgtgaggccagaggctgaggggtgtagcgaaccaagactcaatccagaagatggcagtggggcgtcaaagggttaaatgagagctctgtggagaaaagatgaacacaaatagtcatttgtccaggagaagaaaaaagttgagaatggagttacttgtcttcaagttttagtcattcaacaaatactggtctaacaccagtatgtaccatcagtgggatacatcagtgaataagacaaataataacaacataagtctttgctctcatggcaagtttaaattctagtgggagaaatcagacaataaacaaaataaattatgtattatgttggaaacaagaaaaagaaaaaaaaatagagcagtgtaagggagatccagagaataaatgaggccatgctgcaattttaaatggccctggcattt

SEQ ID NO: 107978 - DNA, 1009 bp, Homo sapiens
ttcggtcatggaggctgcacgacagtgattatctgtgagctgaagtgacaggctgagccagtctctggcatgatcctgcaggttccctgggatcgtgtcactcacccagagacaaaaacctaagtactgtcctgctagatccagggcaaaatttggaagcttgtcctgaaatagaaactttgaggaagagtaatatgttgctgatttttaaaaaatcttttaaatgtaaaaaggatcaactcgttttcttccagatgaattacttggtcctggaggagaatgtggacaatgatccctgcaagtttgcactcatgaacagagagacttctgagagggttgttctgcaagccgccaacgctgacatccagcaggcctgggtgcaggacatcaatcaagtcttagaaacacagcgagactttttgaatggtgggtgctgggcttggttccttgcagggctgtgtcaggggactccacgacctctgagcttccttgggtctaggttcatgttgagttatgaacccagatcacattttataggtactccaactttgtagttttcagaaacactttagaatttttctgaagctgaatacacaagcacaacagatagggtatgaaaaagaagctccatctttctgatagaagagatttcacttataggacacaggatatatgtcttgtggccatcactaccacctggtactaatttgggcaaaagtctgagataggcacatcctctgtgtctaaggaaccaggaccggctagaaatgatatgtgtttttccacttttcacagcttctgtagtgttaactagagataaatgagagtttgaccaatcagttcaaatccctcctctgctcccaacagtgtgagagcctacataagccacattactagccaaccttaccccttttaaatgagagatgattgctaactttaaatttctgtaataccctgaaacttcctagaagaaaatttgtggttacacagagggtgtagctctttgtgg

SEQ ID NO: 107979 - DNA, 1059 bp, Homo sapiens
ttttctcaaggcatgtgtaagtagaaccttattgcaatgtacactgcagaagaagaaaatgatgaggagtgcatactgaagagagaggctataccttaaagatccaaattgaaatataggtgagcaggccacctcttgaaggcctctcactattcaagtggtcatttggggcatcattcccagacccagcctggcccccaacctcacccttgtcttctgaacttgatgctgcaatgggcgttgtctctctgggaatgtgtctgttactcttagtgagctgaatcctgtgctgagggtgtctctgttcctggaaccccagctgacataatgggaccatgcaccctgtgtgttcactccgtgctagatctccagatgttaaatcctgccctgactgactccctttaacctgaggccagcctgttgatcccagccctagctgtgcataggctctcatctcctgcctgcatgggaatgatgtcaccaaaacattctttactttttctcaataagtggaccaaatggttcctttaagggcagtttcctggggtctttacttacacactggctgcttgctaccttcaggctggcatttgtcccaccatggtgttttggggagatatacaggcgcatccttgaaggttaattaagaagaaaataaagcaccttgaatcctaggagtcagatttacaaagctttccaagaatacccaattaggtaaagggaggtaattctgctctaatgtttacatccttttccttcccctgcttgtgaatgttttcaagtacaactcctactcccagcagtacatgccacaccaatgccactgcaagattggctctaggtctatgccatcccctcgtggccaagtctcctgcagccaagtctcctgctgatctgtgaccatacctcatggagaactgttctaaagatgacgagtatcatccatagttcagcttacttctttaccttgtactgattaaactttggggtgggggtgaaaggggggcatcatacatgaaagagatgtttctacatggaagaagagtcaaaccaagctga

SEQ ID NO: 107980 - DNA, 1035 bp, Homo sapiens
tcttcagcagttagaaacaactgagacttccatctagttagcaagaattagttaaaataagaagctgccagatagctctaattgttaataacacaactacagttattcacagtaataacacaattactctgaataacattaggaattacacaattgaactgaaagcaagtgcttgctaccctatcccccgaaccaaaaccatttgttttattctactttccattatgcttattattttaactcttctttctccttctttcttattaaacaggccctatgcagttataaacccatttatttctgcatccttcttaagctgttcactcttgtgtctcccaggttagcacaaaagtattaatagtgagctgggagacacattttacaaagttcatgtttaccttagcattatccagttcatagttcagctcattaactaagttctcttgggcaaattgttcaatatttctgaggctcagtttctacatctgtaaagtaagattagcggtctctacctcactgggtttctgtggatttaagacagaattaactttctgtcttaaatctcatttaactatgagagaattatgttgaaaacaccttccacagtattttacgtgtacgtagtgttcaatacatgttactttccattttgtttccatttccaaatgcatattttctctcatgttattaactaaaaatatactcttctggccttattaaaagtttgccatgtgtcccctgtaaattctgtattatctatgtctttttactctggcacttgcacatttgaaagtgaacagaatctataggccagcttcttccacgcctctcaccatttattccgtcatttaggaaaccgaatccaaactaccatagttagcctacaggctttcagagcctgacacggtaaccacaagcatcccttgaattgaatgtgtctattttcctgtctttgtttgctgaaggtctttgaaacaatatccctttggcttttctctttccctctcctgggaaactgtacactaggttctcaga

SEQ ID NO: 107981 - DNA, 1176 bp, Homo sapiens
cctaactcgtgggctctaatcatggaggttatgggatagcaaatatgcaactcctaaaagacctaaccacctaaaaaaaaaaaaaaagattcaaggtttgtcctccaaaaatgagcagtccaattcatttctatgcatttaatttgcctgtgcatttaatttgtctcttagattcctgtgaggctgtgaaaaataaattgtggtatgagaagatattttcttctcacttctgccctcccaagtgaagaaagtggttgttgggttcttctctgtccttttttccagagcataaagcttgagaaggaaggtagcagttgctttcaagggcattttactcttcgcatctgccataagaaatactggagaaaacaacttatggacataagacttcatcagctctcctaacccttttcggtagacaagctcttaaatgatcgaaattataggctaagaccaaataacatttagacaaagagcacctgatacttccaactgaaaacaatttacagaatttaatctcatgagtttataattggtatctaaagacgtgaatattgaaaacctggaatgttcaaagttactatcaataaaattcttagcactggcagtgtgtagcacttaaaaaaatcaaagtattttatagatgtccccaccaaggttatttctcaacattcctgtaagattaatgtcctccctccttccccatcccccaactcccattttaccaatggggacatttggggaaggaaaaacaaagactttctgtaagaaaagatgaatcaggaatagctgagattgaaactcaaacattcctggtcccacccctatattcagatgttttcatttacaagatattttaaagtaaagaaaaaatgctgcaatatcagtacatctaaatgcaatgaacttctttatctcccatcctcccctctgaaaggcactactatttataaaggctttgtggaccacaaagcagtgaagctagctttctcctctgcttcctctactcccccttacattgtttatggctgagagagacctgaaggatatctccaacattaccatttttttcttaaaaattttaccacattcagctgtaagtggatatatatctatttaatttgaaacaaatgtaaaagatgtaggaaatcattatattaatacttcttaaaagtt

SEQ ID NO: 107982 - DNA, 1009 bp, Homo sapiens
aattgagtaaaggtccctgtctttgataacttatattctatttggagaaacatggggggtaaatcttggctaataactagcaaatataacatgttaggccaaggagtagagataattaagagaactagtcgagaaggcattggctattaaaaaatggacaggatttatgcaaactctcatgaaaggtgggacttcatgatcctacagtcaatctagctgttctgggctttgaaccccagcgaccccatccagaagaaaccaggagaagcacaaactggcgctaggttcgctaccatccacctgacccttgagcccggggaaacccacgggtgcagcaagccgggaaagctgcagacgaggcaggcggaagaggcgggacttcgcgggtgacgtcatcggggcgccggaggcccggggcgcctgggaatttgaagcaaacaggcagcgcgcgacaatggcggtcgctcgtgcagctttggggccattggtgacgggtctgtacgacgtgcaggctttcaagtttggggacttcgtgctgaagagcgggctttcctcccccatctacatcgatctgcggggcatcgtgtctcgaccgcgtcttctgagtcaggtgctggcctaggaagggaaaggacagggcttggtggcgggaaggaggacaaggaaatggaagagggtgacaggagttgggccgtgagtgagagcaaaagagccaagcaggcagaccgaccctactcttggtttggggagtaagcatgagaagcacagaggccaggggttgggctcctcgagagtcgtctgttctttcacccacacgcttagacacgtgttttgcaaaagtcgggaaacccagtttggaacgctttctggcactgaagcacacttgaatgaattctgtatatttaactctttaagaaaattagacttgcggccgggcgtggtgcctcatgagagtaataccagcactttgggatgcctaagtgggcagatcacctgagccccaggagtt

SEQ ID NO: 107983 - DNA, 1031 bp, Homo sapiens
gtcatgaggcagcacccacaggtttaaatcagattggggtatttggtccttgtgggattcacaagatggattactgactgccttgctgtgaatggcacaactcacaccttaatgtagcttcgcatacagcttgggaagaacataggaggcaaagttgctcactgcagtaatgtccctgactgctgcggcctctactatgttttgcacgacgagcttcttaatggtcttttccttgggcatgcatcggacatagtatgtgccactactggccacagccctttttggcacgatcattgttcctttcttttctttgtcatcttggaagtaaggacctgagagagctacagaagaattcttgacatctagagacttatggtcatgggaaatttttttttaattaccattttaaatttcagtttacatacatatagacaagtatgacagagggatcagtaaaagcttttcaagtataatcatatattactttagaataaaattctgtggacacagtggagtgaaaatatgagttggaaaaagatgtaaaaaattttaaacttttcatagtccagcaatttcacgttttgtttttttaaatggagatggtggatatccagtcactagcatttgtattccaagtttattccttaaaaagagtgataaaacagttctaagataatatgttaatatttttagtactagaaattacattctctgcaacttaaaatagtcatagtttttttttgtttgtttttttactctttagaagtactggtgtaaacctatgatctagttcacaaagcaactcagtgactgtttgcttttttaaaaaaaaaatgaggtggtcttgggtgggaatatgtatcctaacattaaaatatgatgatttatgtggaaaaggagattataaaatagcaattcacacaatagtctgtatttatgaaacttcctaattgaaggcttctttcaggatatataactaaaagatgataggtttagatactcagcctaatgggttactgaggaaaccagga

SEQ ID NO: 107984 - DNA, 2510 bp, Homo sapiens
aatgtctttgtggcagcgaatcataatggttctcccctttctataaaggaagcacccaaagaactcagcttcggtgcacgtgcagagctgcccaggatccacccagttgcatcgaagcttctcaggcttatgcaaaagaaggagaccaatctgtgtctatctgctgatgtttcactggccagagagctgttgcagctagcagatgctttaggacctagtatctgcatgctgaagactcatgtagatattttgaatgattttactctggatgtgatgaaggagttgataactctggcaaaatgccatgagttcttgatatttgaagaccggaagtttgcagatataggaaacacagtgaaaaagcagtatgaaggtaagtgtattattcaggaatctgcaagaatcagaaatccagcttaaactgaagaagaaaaaggaaatgctcatgtcattgaaagtccattcatagagcaggctgtcaagcgtggttggatccaggagctcaagtgatatcttcatgacttgctttctctccatctctcagctctgctttcttctctgttgacttctttctcaggtaggcatactctgcatgctcaccccaaaccaatcactctagcttgggatgtagaataccttcattaactagcctgggcaatttgctctgcaactgtgaggttgttaactctgtatgaccttcttgaaataagaaccagtcagggataatttccttaaagaaaatggatgtgctagtaccagaagaagggtatgtgcctgggcaagcaaatttgacagatgtccttggcagaatatgatgttttgaatgaaaattccacataaaggaaacaatgaaaaagaaatataaaatggtaagatttatttgtagcagaaaaagttctattgataaacattatttaaagatttttcttttatcaaatagggactcaaagtagtgcatgtgttggttgagaaaaatgcttagttctactgcctattctatgcaaatttctgtctatgtttttacaactgtgtgatcagactatatttaatgcatttttcacttaacctggtaacagatatttggttgtgtcatataacattttttgtaggcatctttgaggtaacttttctttaatgtatgcatgttcataagctatttctttaaaatagatttgtctttaagtgacttcttcatgtgcttaagatgtcctgccctcatcacattgcctagcttactttagctgattgactgacataagagttttatacaaactttcttcagctctgcatagagttttttcgaaaatcaggcttgttactgtccgcttttaaaaggaatatagttgcctattgaaattagatagctaaggagatctaaggaacacgtagaaatattgagcgatagtaaagctgctgagagacccctgcagagtgaaaacttgtcatcttcaagaagaattttatttttattattattttttttgagatggggtcttgctctgtcgcccaggctggagtgcagtggtgcaatcttgactcactgcaacctccacctcctgggctcaagtgatcctcccacctcagcctcccaagtagctgggaccacaggcatgcgccaccacacctagctaatttttttgtatttttggtagagatggagttttgccatgttgcccaggctggtctcgaactcctaaactcaagcaatctgcccacctcagcctcccaaagtactgggattacaagcatgagccaccatgcccagcttcaagaggaatttttaaatgttatccttgacatcaataaatgtttatcttcactggagtccctttctaatagcatgagctttatttgtggtcatgagcttcagccttcaaggaaaaagagtcctgttagtgttccagataagccaagtgcagaccttgaaagttttttctcattgtgatctctcacccagctacttacctgaataacagatacagttttcacagatggaaccatgggtctgctgataatcactaaagttcctgaagagttttgattctctcattaacatgttactgggagattatttcatattgtagttggttggttggacaagacgttagaggttttgtttgaaaatcagcaaatatcttttttcccccttcttcttaggaggtatctttaaaatagcttcctgggcagatctagtaaatgctcacgtggtgccaggctcaggagttgtgaaaggcctgcaagaagtgggcctgcctttgcatcgggggtgcctccttattgcggaaatgagctccaccggctccctggccactggggactacactagagcagcggtaagtggtggggggactgggtgagagggggcaggggctgctatgctgcatgctgcaagaagatatctcctaatctggcgtttctggaacctctgccaaaaaaaaaatccagctcttgttagtgtgacagtatattaatactagttggatagaattccttgatagttaatagcattt

SEQ ID NO: 107985 - DNA, 1046 bp, Homo sapiens
aattagccaggcgtggtggcaggcgcctgtagtcccagctactcgggaggctgaggcaggagaatggcatgaacctgggaggcagagcttgcagtgagccgagatagcaccactgcactccagcctgggtgacagagcgagactccgtctcaaaaaaataaataaataaaaataaataaataaataaataaataaaataaactttaccattgaaaaggagttggtgatcatctttctccatttgacgtctctggcctacccagtgagtctcttcagctcctgtttttacgcagttgctgtacaaaaggggaacgaaagtaggggcatgtttttatttaaagctggttagatactttttcagagaagtcatgtgacaggttttctgatttttgtattatgtgaaacaacaatttttgtgtttcttgcaggagataatcttggccaacagtacaatagcccacaagaagttattggcaaacgaggttccgatatcatcattgtaggtcgtggcataatctcagcagctgatcgtctggaagcagcagagatgtacagaaaagctgcttgggaagcgtatttgagtagacttggtgtttgagtgcttcagatacatttttcagatacaatgtgaagacattgaagatatgtggtcctcctgaaagtcactggctggaaataatccaattattcctgcttggattcttccacagggcctgtgtaagaatgggttctggagttctcatggtctttaggaaatattgagtaatttgtaatcaccgcattgatactataataagttcattcttaagcttgctttttttgagactggtgtttgttagacagccacagtcctgtctgggttagggtcttccacatttgaggatccttcctatctctccatgggactagactgctttgttattctatttattttttaatttttttcgagacaggatctcactctgttgcccaggatggagtgcagtggtgagatcacggctcattgcagcctcgacctcccaggtgatcctcccacctcagcttcc

SEQ ID NO: 107986 - DNA, 1024 bp, Homo sapiens
ccgccgtgttctgtaggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgatactctctgtgtgtttctttctttctgagcggacttaaaatggtgcccccagtggggattgaagcggccgtgtacttcctcagggatgggacacaggctggtctgatactccagactgcagcttgtcaagtaagcatgaggtgctcggggcagtgagggctgtgcaagggggaacactgagcagatacctttggccccttccagcttttactgacagagagttccaggctagacaccat

SEQ ID NO: 107987 - DNA, 1090 bp, Homo sapiens
ggagggtagttttagccttgagtcaggaggcactgcccaggcttcctgggcataactgtgggctccccatgaggacccggtgctggaaccatcatccacagctgatgggaatgtagaatggtacggactttggaaagcagcttggcagtttcctaaaaagtcaaacgtagaatcaccatacaatgtgccaattccactcccaggtatacagcctagaggattaggtccatatgtccatgtaaaaatacgtacaaaaatgttcacagcagcattattcgctatagccaaaggtggaaatgaaccacatgtccatcaacggataaatagaaaagaaaacaaagtgtggtccatctatacagtggacactattgagccactaagaggtgtgaagcactgaaacacgctacggcacggtgaggcctgaccacagtgcggagcaaaagaagccatgtattatatggttctgttcatatgaaatgtccaacacagagaaagccatggagacagaaagtacattagtggtgtcctgatgctagggagaagggaaaattggcattgactactaacaggtgtggatttctttctgtggtgatggaaatattcagaattagtgggaatggttacacaacattgtgagttgagtaaaacgactgattgtacactttaaaatggtttaaatggtgagggggaaattatgcaccttgaaagggaatctgtgtctcaggctcccctcactggcaggcttcccctctatcttcacctctggcttctgcaaactcctggcccccagctgcctgtctgtcttggtcctaacgtacatcttttgtagacttccttgttcccacctgcctattttgactgactacagtcacggcttctgagggttttttgtctcgagacagggtctctgtcacccaggctggagtgcagtggcaccatcatagctcactggaagtctcgacctcctgggctcaggcaaacctctttcctcagcctcccaagtagctgggaccacaggcatgtgccaccatgcctggcaaatttttgtttttgtagagacggagtttcaccatgttgcccaggctggtct

SEQ ID NO: 107988 - DNA, 1054 bp, Homo sapiens
aggtttgccaagcccttgaggctcctagatcaacgatgcctaaagtcactaacttccctgaggttgcagaatgaatgtcttttttcttccccactggaaaagccatagacaaccattaaagaaaacttgaaaaatacagggaagttgatggatgtgtggccagttggtgctgtctgtcttcttggtgaccaggagtaatttggaccatctgggaaaccagacctcttttcacccaggctgtttcgtgtgcatcacttctgaggctgtgtgctcagtcaagaccttgccagagagttgggggattagccttaggtcgagaatattctgagcagtagtaagaaatttaaaaatcatccataatttcatcactcttattttaagagattagtttatttccttctaaaccttcctctaagttagtgtatgtgtgtttatagctgcatacaattttgtatgatgctttttttcctataatattatatcctaaggagcacttgaagtcgaatgactttagtaaatcattgatgagaacattttgagtgtctttccattgcactcccaactagccttctccacctcttcactttaaaagcaacaactagttgaaacgtgacgctatccaagtctttccggagaaaatagtttctggagtgagatcattgttgtttgacaatttgggaaggacttaaactgagtccagctccaggcaggacttgataacatgttcatgcagtggcttctttcacagcgttatagcaccagcccttccttgtctctcaaaccttacagctcaggaggggctgtgaatggatgggtaaggaattccagtccctgggtccttggcacctgtggtcagcatggggctcccactccagaattgcgtgcggtggttttgagctcttgggtcacggctacatctggagttgttgtggcagagaagcctggttcccagccaccactctgctcttgaaggtgctgactcagagactcccaagcagctgacttcagcattctctcacagctttacaccccctcttccctgcagcctgtcttg

SEQ ID NO: 107989 - DNA, 1076 bp, Homo sapiens
ggagaggggtctgtcagttcctctgatccccaagacagaaggggtgcacttacagctgggaccagtctggttttcttaaccctggcccaagaaggcaaactttccatcccttctctcaggctgaactgtctccaaagcattgacagttgggctttggcaagcaggggtgctactgagtgtgtgagtatttccctctggacgtgtgtccccaagccatacatttcagaacttgccagtgactgtgctgacatccactcgtactcagtaagtgtttatgtaccaaatcccgtgctcactcaagatggacaaatgaggccacagatcaggggctcagagtctggtggaggaaataacatgcagaggagtcagccccgtagagggtgatgagtgctgtgggaaagccaggtgtggcactgcaggagcccaaggaagaagggcccagcactgcagagggagctgttggagctgaggctcagagcaccagtaggagtttcccagacagagaaagccggggtgggctggtcccatcagtgggcctcccatgtgcatattggcaagatgtgtctgctagggtgtgaagagcatcatcctttggccagtggaaagcagctgatggtgacggccatggaggcaagaggagtgggctggggagggaggggagagtggctggcttgggccacagtggtgaaatatacctgccaacctaaggggtctggccattctggccattgtttggcaagtgggttccattctttggtggcaggagttgggagggctatgggcaagtcagggaatggtggtgggggtagacaagagtatcaagcatagctggagggtctggggactcccctggagaagagggattaggaaaagcagacacagttcaggtgtcatcagggatctcagggtctggcctgtggacaaggacacggcccgtatgaggggcagccagatggacctcgcctcctcattatcacagcttcctgcagaggtggaagaggtgcaggctgtggttctgtgacaaccctgtgtgctctgggtcaagacagatgtctagcaagaagcaggagaggtgg

SEQ ID NO: 107990 - DNA, 2041 bp, Homo sapiens
atgtccaggtagatagtgtcagaattgtgctgaattagaagataaccaaccagtgtccagtagagaattgcatggtgtgtgggggaaaaatcctcacatctggtgtcagaagtgttgtgttgagtggtgtgtgagagtagagtaggaaaaacagtttgggtttttccttccaagtactcatcttacttgctcctgtcctggccaacgggaaaggctgggctgggcttcaagctccttgcacttggacttttcccaactttgagccccagcacgggcccctggtccatgtggggtgtgccggggcagcaggagaggttttcgtcagctctgctctcctttcacctgctccgcatccggccagagtccagtcacagctctctccagaccgcttgtgtttttgtcacctcaccgtccgagtggtttgtgttggatttcatgagtcatgcaacacatgactaagtgtgggtgttggcttttacctcccctagagtgctggcagaccatctgtggggacattctgagcagatttgggttggaacatatgtaacagatgcaatggctgtggtatttggccaggctgaggagggagcaaaatggaaagggtatgtttaatttcatgtcttgtagaatcaagtctggtgtacacatctctccgagtgtgaaatcaagttggatttatacattttttcttgctgtgccaaattcttcactgtgagaaatcaccaagtcttcccaagggagtttggcaatgtggtgctttgctctgtaataagtgctggtgagagaatcccctcctgagctcagccgtggagccctgggtccacacgtgcagagggggctggcctcatgttgcacccagaaaggcctcttttcagtgtgggagcgaacagaatgagttggaaagcactggagctgcatgtggagggtgacttcagaagctgtggtgtatttttctctagcagagcacatgtttctctttttgttgttgccataaagtctgctcccacccactccacagctggcccgacttaaagcaattgcagatgtgacctaacctgaccgagtatttaatagcctttacacttctgacattcccaacatcatcttgtttcctactggagaactaaggagtgcaccttgaggggcgaatctggtaggagttaatggaattttaggagtcacacataaaagtcttcatgtgtaagaactgcactttgactccatccattcacttattcaacagatatataccaacagcctaatgtgtgacagggatcatgctgcaccttggaaataaaatagtgagcaaaacacagtcctgccctccagcactcatagttttgggggcagagacccttacaaccacgatacaacctgatgatctctttccaaagtcacagagccaaattcctttttatttttttatttttgttttttaccttatctgtggacagagagccaatttccaaagaaagaagtgcatatcaggtgtggggattagaaagagccctggggtgggtcaagaaagcctgcacccggtcctgtgcagcagagtggtcccaggccaccttttccttgccctgacctccagcttccatacatgagaggtttgggctgcatcatctccacggttcctgctgcctgaaatgtcttaagagtttctgattccagagactctgtgggtagcaggaataatacaaactttatatcagaacatggggcttatggcctgagtagaacataagagtccatttccatctaattcttagttgctgactcacagagtaggagtccaagtccctcttgctttttcccagatcctcccttggggctttcgagtggcggcttgggcagatcttgctggggagcactggtgtttccttccaaagttttatttgtgaacgacagggcccccatatttcaagttatcgttcccaagtaatttttttacatgccttcactcttcagctcttttacaatactgttttatttcctccactacttattcacggttataaatttattttttaatatttgtctt

SEQ ID NO: 107991 - DNA, 1052 bp, Homo sapiens
atctctgtattccagagctttatgcctgagcctgcagactataggagaccagtgggctagtctggcgcagaaattcccaaagaaaccaataaatgtcctgagtgaatacagcagtctgcatatggatctgttccatttaaagaaactgttcctgggtcaccctggactgccgcatttagtctggggcaggaattcccaaagaaaccaataagtgtcctgagtgaatagagcagtctgggtatggatctgttccgtctaaagaaactgttcctgggtcaccctggaccatcttcaaaaactccccacatgaacgtgctccttctcacaatcacagatgagccaagtttgaattacagatctcctcggtgtgctcatgtaagctaaatgtaaactcgtctctgagattcttttacgtgatgaagcaatgagaacttaatctggaatccctctccaccctccacccccagaacagctggccatagttccctctccttcttgctcttgaatgtccacaaaagaacctttgtctgattgtgtttttctattgctcctgcctgagattatcactgataaaatgccacttatattttcttgagttctttatcctcctttagttcaaatcaatgttagaagatgaaacaagggaaaaggattgtttttctttttttgtttagtggaagatagcaggataaagcctattcagggcgtggtggtgtgtgcctacaatcccagctaccggggaggctgaggcaggagaatctcttgaacccagggggcagaggttgccgtgaaccaagattgcacaattgcactccagcctgggggacagagtgagattctgtcgcaaaaaaaaaaaaaaaaaaaaaaaaaaaaagcctatgcacttacaaataacgttttatgtttttagagggctcaattgcacagactgtattgggtttccagatatttccagagggaagaagtccatactggcttaagcatccttcctcagagctaaatacaccttgcttgggggaggaagcccatccagtcccaaggcaggcagaggg

SEQ ID NO: 107992 - DNA, 1032 bp, Homo sapiens
actctgctatacatgttcattttatttgccaagtgcagctgactttgagctgacttcttcctggctcctgttggcttcccatggagccaccttaccatatgggtgaaagtcaggtgggaccgagaccagggaaaaactgtggagggtggggcagagaaggatggaagctgttcttggttctctgtgtgagcttccttttttgtcagacctgtagccagagtgtgactcctttcagccttaagaagccaaattgctccacaggctggaagcttgcgtcctcaaactagtgaaaccaggtcctttactccctaaccatttgtttctctctctgccagtccctgttctctggggccagatgttggaagtgaacaagccagcgagtctgtcttcactcctgggaggagtccatttttgttaattttctcagtgactgggaagggctggtcttccatctcattcctgcttccccttttcatggatgactgagagtgaggtcagattttaaggaactgagaggaggaaataggtctgctggtcttaaaagagagaggcgagtgatgagagtttggtggcgtcgcagggtgaagagaaggcttgttattagtgggccatgaacatatttgtaggcacatggaagggaccagaggagacagtgacaatggaataaattctccaaagagggtggggtttgcagggctgtgtttcctcaaggagggaggagcacttcttcccttgggatggtgagatcagagcgaggctgggaggacatgccagtttgtttcagacggagaggagagcactggctgaaaggcatcctagggcctaggaccagaactgtgagatcctgggaataggtgaagggagaagtccttttacctatctctgtgggtgacgaaacaagtgaggtcgttccctcgcatgagtgtggaagcaggagttggaaatagacctcgtggtgaatttgacagtgaacaaagaaaagtgacaggactcgcagccctgaccggatgcctggcttcatgcatctgcgtc

SEQ ID NO: 107993 - DNA, 1074 bp, Homo sapiens
taaatccctgagccctcccctctccacaagtcctctttggtagccttcagagctcctagctccaagttgggctgggtgataggagcaagttagtgtgctggtggcataggctcttctgaatccctccagatccttctgtatactctcccagaagctgacttagatcttttcaggtattgggaactgacactggtggaaaaacagacaagaaaaagttttaaatacaaatgaactctaaattctttaaccacgaagaggcactaggcatcatcatttgctgggtttagcttcctcctggcgacaggtggccacagggactattactactttgattctgtctccaaggcccttttcagctaagtctgggtgtcaaatgtttttgttgaaattttgctgcttaccaggagcaacagcatcttaactgcaagccttaagccttttttcaattcatctgaaatagtgattttatttgcttcttttcacctctgtcctaattgggccctgtctccagacagatagggtgtgtccccactttcattcttccaaggcccttccactgaccgagacactagattggaagctggcagagaatcaagggctggctctaggcgctcagcatttaaatattcaaagttatgacacatcattacttattcagagctcactctctaagtcctctaaggcagagcctgttgcagacagtaaaactcctgacagtgagtacaaggcacactgaaaagctacttgtaaggcaggaagtccagtgaagaatgagaatgtggaaggaaacctcgggcctgagttatgtgaagctctcttctctgagctggggaggcacacgcagcgtgggggcacactgtggcttggtgagcaggccgagctttgtctccccacgtccaggcagcacggcatcctgtgtctcctgggttcaagtgattctcctgcctcagcctcctgagtagctggtattacaggcacgtgccaccacacccagctaatttttgtattttttagtagagatggggtttcaccatgttggccaggctggtcttgagctcctgacctcaggtgatc

SEQ ID NO: 107994 - DNA, 1036 bp, Homo sapiens
ttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattgggtaagtgaccagttgcccttctgttgggtacttaagggtgggagaatggagaagcaggaaaatttagctcaaagaaagaattaaggaaggcatggttaggaggggtggccaggcttaggcgtttaatttgattaatgataagcatacattctctcctttcctgacgtgtgaagaagtgagtgaactgtcacaaggttgtaaagataaaatgatcacaaccccttgattttcctgcctgccatgcacagcaccatttgctcacattaatagaattcagaaaatgtcctcagggagtgatggatccagattatcagggaggcagcaggcagggcaacttaaactttccccttgcttgtagtaactgaggtgctttgggagaaatgaattcaaaatttgtccctgttgtttttctataaataactataacttattttcacataattagattaaaatcctattttaaatgtaagaatttttttttcaacataaacacctgaactagaaaagatttgacatattattagaaaacaggtgtctctaactgctgccagattctataataacaaagtgtataatggctcaaacttgctggaagtttatttcctgctcctcaagtccaactgggtctcttcatccatggaacttctcctgcaagcagtgactcagggactcaggtgctttccatcttccaggctttaccatcttccacacatggctcctaaggtcatgctgcctagagggtcatgcataggaggataggcctttgccatgcccgctcccacatgctattagacggaaca

SEQ ID NO: 107995 - DNA, 1059 bp, Homo sapiens
gccaagaagtttcttgcttcagaatagatagcctcttaggatacaaagggacctatatatcatgccttctttccctcagccctcatgtctggaaaatttagggttaaatttgtatgcccaaggctgtagctgttgaaattcaagttgctggcaggattttctgtctctctttttatcctcacaggaaattgcttcagtaattgacttttgggaaaaccgaggccaaagttttctttgtgtaggaacatttgtgtggtgtttatctcttttaatccctataatagttaatatcctccccacttgactgatgcagaaaccgagcagtgagttgaagagagcctgagttctccctagtccttggtgacagggtctggattcaaacccagctttcctgcttccaagcctctatcccatagatgcctctcagcctcccggaatccaagccaattatttgtttcctggttttaaagtgcccatctgttaatttcttataattcgtaaaaaagtagaagtagattttggataaaataagttgtaggtgggaacttggggggacaggtggcagaaaatgcagaagacctgtgaaaagatcatggcatcaggcagaggaaataggattgcaggctctgtccatttggggtctgttgtctgcccatgcaagggccaaggagggagctcccttcccccaactcccccctcttccctgcccctccctcactgtgatgtggcacccaaggagccctctggcgggacaagctgtgtctgtctgaccaaaggcagacactgcagcagcctggaattcattctggaagaaaaccttgaacattcctctgtttgagtcagactctgatggtttttttttttgtttttttaaattattattattatactttaattttagggtacatgggcacaatgtgcgggttagttacatatgtatacatgtgccatgctggtgcgctgcacccactaactcgtcatctagcattaggtatatctcccaatgctatccctcccccctccccccaccccatggttttaaaaaataggcttatacca

SEQ ID NO: 107996 - DNA, 1072 bp, Homo sapiens
gttcttagtatatttgcaaggttgtacagtcaacaccactgtctgattccagaacattttccaaaaagaagtcccatacccgtgaacagttactgcttaaactaccgtctcccaccctcccctttcagccgctggtatccactcgtctactttctctctatatagttttgcatattctggacatttcctatacgtcataaaatgtgtgggtcttttagctggtttctttcacttagcaacatgtttcaaggttcatccatgttgtagcatgtacttcattcctttttatggccaaataatattccattgtggaggtatagatatactatattttagtttatggacatttgggctgtttctactttgggacaattcttttttcttttaataactccacagttaacaccctatactttggggcaattatgactaatgctgctatgaacgttcatgtacacactattgtggggacatatgttttcaataatcttgggtctatagctaggagtggaattgctgggtcatatggtaattctatgtttaactttttgaaggactgccaagcttcaagcaggattttgtgtaaatataggatcatgttttccattttatttcagtactggaaactacatgtcaggataagaaccttagaaaaaatcattaacaaagagcataaaatccttaagaaaggacataaacttgaaagtaaagcttattgagaaccgtcaaaagctaaaggtggttttgaaacactgagcaattaagaatagtttattaaagtcattattggcctcagtcctttaacctcttaaaaaatgacccttgattggtagctttcttacattttgaaataattttagactcacaagaagttgcaaaagtaacacagagatgttctatgtacccttctccgctgtcctcaatgatagcatcttaatataacaaaagtacattctcaaaaccaggaaaccaacatggttacaatactattaactaaactacaggtaattggttgcttttgggtttcctgccagcccctatttttttcctcccttctccttccaggttctac

SEQ ID NO: 107997 - DNA, 1065 bp, Homo sapiens
aattttaaacacctctcttttctcttttatattattaccacttagtaactaaaagcagcaaaaggccaggcatggtggctcacgcctataatcccagcactttgggaggctgaggcgagaggattgcttgagcccaggagttgtagaccagcctgggcaacatagtgagacctggtctctacaaaaaaagtaaaaaatcagtgggatgtggtggcacctgcctgtagtcccagctacttgggaggctgaggtggggagacagcttgagcctaggaagttgaagctgcagtgagtggtgatcacgtcactgcactccagcctagacgacagagcgagacccagtctctcaaaaaaaaaaaaaaaaaaaaagaaaaaagccgcaaaggacacttcaactttctattgccattctgctgcttttcccctttggagagtttgataagggcatttctggagaccagggatcaatgctttgtttgtgtacaggaacctcttccagcatagagcatggggagcatctgcaagcagttgtgttgtggcccattagaagcccatccttcttgcttgggttccttttgttcaaggaacaaaaggttgccatttttgcctgttgagatgaagtctcccctcctcttctataggttgaggctcctctgtacctgtttctctgcaaaaggatatttatccctcatgtttggtaggtaacagatctctgaatttggggcagcaaagaaatgctgccttcagaaggatggaagctttgggcccaaagttagtttcctgctgcagaacttggcagtggccttggctaaaatgggaggcggcacatgctgcaaagagcactggatttgggcccaagaagccagggccagatgaacttcaacttcttgggtgaacttaggtctgtggacctctgattccccacctgtggaagccaggggatggcaccaggtgatgcagtcaagggcccttccccttggaacttgctatgtctgacacctggcagagggtctgagtgtcaggtctctgggatctgaaactgttacgccatcagacatcaggatg

SEQ ID NO: 107998 - DNA, 1031 bp, Homo sapiens
gccttagcaaatgagccttaacctgcaattagcaatggtacctgcaccctttagactcagagaggcctcctgttaaagaaggatgtaattccccctattcaaaggcttgatccatgaagtttatagccaggaactaattagtgcatctttatcttgctttaaaggtctcaacatatgcactagtggaagtgccacctcatgtgaagaatgtctgctaatccacccaaaatgtgcctggtgctccaaagaggtatgtaggtgggggaggggaggaagaagggaaggaatgctgcgagggtgagggtgagaaggaggccaacaccacaacacactaattcactatacataaaaatcctgtgcagattctgtaagctgcctcttccccatcagggcagagtgatgacaaatccaagtttatgagacaataagataaactgggtttcttgatactgtggaatgctaatcctgttttggggaaacaagactttccttcccttttgtttggagaccagttaggattcatctatagttttctgatctttggtataagaactccaaaagacctgagcttgtgaattgagtttgttgcataatgattcaaaacatatctagatggctggcatgttggtggaagccagtcatcttagtgtgtttacttgagaataaatattaggaattagcctttatggaatgattttatttagaaataatggctgccatttctttaagccttttagaaagagatataggtttgggacaatgttaggctattggtatcataaagcaatatgggctgggtactgtggctcatgccagcattgtgggaggccaaggcaggaggattgcttgaggcttgagctcaggagtttgagtccagcctagacaacatagcgagattctatctctactaaataaatcaggaaagaaagaaagagagagggagggaggaaggaaggagggaaggaaatgtaacttggtggactaatcagaaaatgatcgatttctaaatttcctctcttgaaggaaatttc

SEQ ID NO: 107999 - DNA, 1058 bp, Homo sapiens
ggtaacatttagacatatggctatttagttgctggagtctatactgggactcttttgtccattgtgtgacaaatgtgagggcctggttcagggtgtggggagaagcattccagggcattgccatcttcaaggcagaaaggccatttcagcttctgtattcacttctgttatcctactgaatattttggatcaggaaattccaactgcagatgtatgttttagtagtagttgtctgaccttggacccatggggtgtacagaagtggagagaggctgaatggaaggaggccagccaggaggctatggcaggaatttagaccagagggcctggcttgggttgttggggctagaggttgcagacaggaagggttggcttaggataaacatttcttgcatcttgaaaggagtgatcaaccggatgcggtggctccttgaatgattgatgaaacacaggggtgagtcagtgaattttggaagaacatatttttagattacagtttgcagtaaacactgggcttcagagacgtgaggcaaaagagatacatggagttgccaccgagctgggaatagtcactatgcaaacagcaaagaagatgagatgtggctatcatctgggctgctagttcctgtttccatgacctagacctaacactgacatttgtgaactccgtgtgtttagttttttattcattgcttccttccttttcaaaatgcttattggtgccaaatgactcatccagcaaagtccaaactctgaaatattaataggtggagagaggagagatgccaaagggagtgagtctgacattacacataccagcacacagcctgtggttttggatcctggagtacctgtctggtacctggtacccggcacactgtgagttcctggacatcaagggctggtaggtcattcacctgtgcatttctagcatccccccagtccagtgctcagcgtttagggtgtgttaagtgcagagtttcttgaatttgaatgtgtcccaacagcaactgaattttagggcaatcattttgagtacaaacgactttacttttcca

SEQ ID NO: 108000 - DNA, 1018 bp, Homo sapiens
caaactacttaaataatagggcccctttcacatggcagtgtgcagctgggttaatgggatagggtctcttttcacaggtatttccagttggctggagccgagggccttggagaactgactgccgtggtttgttttccttctttccggttcgaatgggattaatggcctctataaatgtaaaggaatgctttatttagaggcacccatttgtttctgaggcttcttgcttccgttgaatgcagggtttacttcccgggcctcatggtgaaaagtttgctctaagacaggcttgactcatcccctaaggctgatgctttgaaggcactgcggggtaccctgccctctctttataggattccctccccaactccagccagacattttcagagctggttgtctcttgtagagctgggacctacttctgcaacttgttctctttagttattctcaactgtccctcagagtgatcctgagatccaactcaagtcagatcatatctctctgcttaaaaccttcgaatggtttcccagagtcctgccaggctccacgaactctccacctacttctctgactttccttcaccactttcccttcgatcctttgctccagcagcatgggcctcccactgtcccttcagcgtgccagccatgctcccatggcagcccttctccctgcctggaatactgtcctccaagatatctgcatgaccggcttcctccaccctgcaaccctttttctagcatctcctgctcagccaagttttccctggccgctcccagctaaagctgcaacctcctccctatatcccgagttctttttatctgcttttcttctttaatttttgtccttagcactcaccaccatctaatgtaactacatatcttcttcactatttcccctaagtagaattctcccccagccaggatgtgagctccgtgaataagggagtcttgttggttttattcatctctgtatcctccatgcctacaacagcaccaggcacatatttgttgaatga

SEQ ID NO: 108001 - DNA, 2039 bp, Homo sapiens
gtagaagcaggactgaaacccttgtctgcctgactcccccagctactctgcccactgtagccccctgccttactgtcctggcacacccctcaccatcctgtataccttaaatatcaaagagggcaagagagaaagggctttaaagataagttatttttttaaggaaccttaatattatttttaagaagtaaccaaattagtgacgtgaaatgcaaaaaaaaaaaaaaaaaaatgctgactacccttttgaaaatgtgctttcagattgttttttatatgtaattcttagacacttgtcattaagaaaatagtggctggcttgtgctcagcaagaagcacactggcacgtggctttggtataggaagtggaaggcaaggacctgggtttctgacaagtgcagtcagacatacacatccatctgagagctgcttgccttgttcccgtggtaaggccatggctcccacatactggaagcatatttttgtgaactgttttcagaattgggaacatattcagtggaatgtcttaaacgctgacacatcttcctcctttgaggggaagtatattttcagaagcagctaagacatttagagccaaaattgctgataggtggttcagtcaagttggctgatggcatctgaggtcaaaaactaagatgtgacgattgagttcttaaagaggtaactcttaaagtgggcccaagggagaaggcagcatctttggactcctaggctggatggctacccaagaatatgccattgaaggatgacacctattcagatgtgaaagttcccagagcaggcacctttgggtcacccaccacgtgtggctttttggtgcctgcatgaaactgtgttgccccctggtgagatgcccgggtgtcctgtaagccgatttaactctgcctgaggaagaggagctgtccactccagttgcccttggctaagtttagcctaacacacagggttttgacccatagttctaaaatacacaaattttgagactacagcacttctttggaaagaggaagaatgcaaagttcagtatttcaatactttgtattttacttgaaattacccttagtagcatcttttttttcctgtctgaaagcttttgtgtggatgagaagggacatttcatttcctcccttaacaaagtgtcattctgaggttctcatgtgtgtttttggaaatagagatactggttttgtagagtttgcctttgggtatgttttctttttttcttaaatctccaaggaagagaactgactaaaatagtaggaacatgaaagtattaaatgccaattaatttgttgtagtaaagtatcttcattagcgttatactccatcatatctggtgtaaactgctcacagaaaaccctatgaaaccaaagggggaccattcaggtctaaaaagcgacaggtccgagactgggtctgtcacctgggcattttcaaagaggacattttgaagaatttgcatattcagatttttaaaatgcacttaacatacttcattacagatttcttgggtagggaggatgggataggccagggatgggatggagtcagttctgcctgggaaactaatccgaatcatttacctttctgtattaaccttggcctgtcctaaaaagagaacgactgtttcatcatgagttgctctgagttttgttaatgtttgtgttggtggattgacggttaaatgaagcatttagctggaatatgaactttgggagttttcatgttgtcctggatttctctttgtaaacctttaaaccttagcccctggttgattgtgttaaacccattatgagaatgttatttaaagttgtattataattgcaacctccactaattattcagtactgtagcagcaaagtattatttgtaagaatttggttatttttatacttatatccactctaagtctggcgttctagtcagtaaaatgatgcaataaaattaatatcattttcattgtgtgttttcctcttaataacaagaaaaccagaccagaatgcaacaagttaccagtt

SEQ ID NO: 108002 - DNA, 1044 bp, Homo sapiens
ggactcgatcaccattgtggaggccagaggcagctgcgtatggaggagaaatgtcaaactgaacgcaggtttcaccactctaggaaagcagcttgttgagcccctgcagctggatgtggttagagggatgggctgaataggcaggttagatttcctgcatcaacagtgctttgggaagctgtgtggattcctgaggaagaacagggagccgagatggagccacacatgagtttgctcaccggctactgcagcactttgtacccagaatctcatgtccacaaaccccatgtaaactttcaaccactcaaagctgtttattcggctgaagaaataacttttttttctcacccagtcatttgtacctcttcatatggctatgtcgcaccctccagaaacgtggttatacttccagtcagtgtgggagaactgaagacttccggttggtcgaggaactgagggttgaccttcgggaaggaagttccactcatcttatttattatgcctgtgatgtgggtcctgccagggagacatccagtactcggtgtctttaattgccacctggggaactgtgtttattggccttctttggggcatcctggttttggatgaagtgaggggaatacagaggtaaaagaattgtctccaccctgaagcggggagtcccgcttcacatttctggaaatggtgcagccactggggacagttctgccccgggcatggttgtttcttcaaggtcctctaaatataatccctattcttacataatccttggccctgatggttttaagcaagaactcctgtgtcccatggtctccaccactcaccatcaccctgctgtagcaagagtcctagtcaggggaggtgcattttagtagttacattgcacttatccatgagataaataaaaggagaactgtttttatcagtggaggctaacctaaaatttcaaagtgtcgcctttttgaaatcttgggcctctctctctgtagaaccaatggccctttgtggctcacggcctcgcacctaactggagagttctgagct

SEQ ID NO: 108003 - DNA, 1047 bp, Homo sapiens
ccagcctgggcaacatggtgaaatcatgtctctacagaaaccgtgctcctctctacaaaaaattagcctggcatggtggtgctcgcctgtggttctagctacttgagaggctaagatgggaggattgcttgagttggggaggcagaggttgcagtgagccaagattgcaccactgtactccagcctgggcaacagagtgagatcctatctcaaaataataataataataataatagcaataataaacaacaacaacaaaaaaaccaactaggggatggggaaaaggtataaagagaacaacaattcaatgtcgtcctcaacaagcacttctcaggtttagaatattgtatactcagtaggcctttaataatttgctatgtccagcctggactgcatcatttggaaaggtaggagacaaccttgaacccttgctgcctttctcccatattgaatttaacctgtgtcatattcctgtaaactgcccagctcatttcatatcactgtatcaaccataaagcaaacacgaacaggcgtatctgagctgaaaagtaaacagttatcaggtgacttctcgtgccatgtggagctgtctgaggaatagcaataaatgtgaaaccttgccccatggggacttaatggtgttagacaatcttgtgacagaaaccataattcctctggttgctgtggcaattgaccatggggatgcagactttggatgggagggacaagtttgttcatgctaagaagctgtttatttccatggactctttttgaaaaatttgaacctagaggaagaacaaaaagttataaataaggaaaaaaacataaagaaatacaaacttagctctagcaaaaatattcccattgatatttctgcattgggctttgtttctctgtttatcaggaaagtccttttcctttactaactgaagctataactgagctggtattttaccctggtgtgtccccacactctcatcctttactcgggactcctcagccccagcacggttcaataactagcaacaaacaggcctgtgacatcat

SEQ ID NO: 108004 - DNA, 1032 bp, Homo sapiens
tttccaaattgccatcaaatcatcaaagataaaccatatgagtggaaataaacttcaggggatgagactaggaatggttacctagagggacataacctgagcgctcaagggacagaagcctcatatttgctacgtgttctgtactgtgtggtgtacccatttggggaaggagcctgtgcctgctggctcctgagaagagaaggtagttgtgcatgagtatgtcattgtctgagcccaggtaccccacccaccaggaagcaacacagtggcaggtctgttcccaacttccacaaagagccagcacctaagccacatgctagacatttggttttatgaccctgagtcactttttgccttccctagaaaacttatttgtactttaagtgaggtagaaagaaaaagatttcagattatcctatctgtgacaaatataatttaaaatttctgatcctggaccggttagataggtgaagaacacagattccaacaatttgcagtcagtgagatctcacgagtagcatttctgtaacctgctgaaatgagaatttgtacaggtgtataaataggtgggctttttcataaacaaaccattctgtttttatgacttgtgaaatatttgcttcgtgtagtagaaagagcactgcccggagagttggaggcctgaattctagttccacaccttctagtagcaaaaggtgacccagaggacaagtcaggtctctttactgagttggagctgccccatcctatccccagagctcctgattcagtcaatctgggggagacccagactcttcccatgtaaattctgatgcttgggcagcttgggatccactggactagaatgagtctaagggcccctctggctccagcattctgtgaatttatgacccttgttttcctggccacccccaagacacagtgatctctgtcctgtagaagagtctaaatctgccctattgctgctgtttttgtccccctaccccctgataatctggcccctttgggttggaagaatttttgtatcttttt

SEQ ID NO: 108005 - DNA, 1031 bp, Homo sapiens
acaccacttctgtgcaaagccgcgtgctgataacttgatggctggaaaatgcctgttttatcctgaaaataggaaactggttctaggtccaaggcttttgtctaactcactgttaacgacaggcttgttcttcctttcagttaaatatgtgtttttcagcgttacctagttacatccgatctacagttcacgcctctaggtaagtaacagaattatatttgcttgtgaactagtctgtacaaaggggaggctgttctaacatgggtgatagcaacaaaaccgggctgttttcacccagccatggggcaatccagggccaaggtcactgaccttcatgctctcccatcccgtcactggtgaatggcgatgacattcatttccaaaagccttgggacccacgtgtcatttcagggctgttaaaaacccacaaactttgcctatagggagtccaacgcggtggtgatctcactgcaaacaaccttttccctggcctccaatgtgacgctatttgacctggctgataggatgcagaaatgtgtcaactcctgcaagtcctctgctgaggtctgccagctcttgggatctcagaggcggatctttagaggtaagagggcagccctctgggaggatcctacccatatagttaggcacagacctaagatggaaatgcaaggcatccagggctcaggcccaggaaaggccctcacagagcctatttttggcatgggtgttaagtcaaagacctttgtgcacatgcatcttcttttatgtgtgcatgcatgtacaaacatgcacacacacacccagagtcctgtacacaagccttgaagacacctggtccttggcatgcagctccttctgtttattttatccagtgttgatgtgggagggggaggggcataggagctgatgtgacaaagcagaaatcactctttttccactgaaaagttcctgctctctttggggaaacagaatgtacatgcttgtcaatgacccaaaaaaaccttcatctggccagaggcagtggctca

SEQ ID NO: 108006 - DNA, 1036 bp, Homo sapiens
caggattgtagggtggagaaactcaagtaaagaagcttaggaggcctggctgacacagggatcaactgggtatctgcgtctggatcagatcccagagtctctgagtcaggggctccccagtcaccagggagcttcttggcgtcactgggcttctcttgatccagggaagcccaagctcctttgtctccgaaagagtgtgtggctagttgataaatgggagtggggagacatgtaaatgaaaagatggtgaactaaccttttcccacagtgaccgcacggccagagctcctttacatcacacttagggttgtttttgtagccacgttgaagttgctggtaccaggaaagtaaagccagccaaatgatcctttgtcatttaaggaacggtagaaggaagtaggatgatgcagcttttcatgtcatgttcaaagttacacttctggcttgtccagacatgggaaaggaaaactgctgttggaggagtgaaatggaaactggcgtcttagggaagaaggaaagaagagatgatgctttgtagtggctggagcagaaagctcagggagcagcacagttccaacctgtcagccacaatcaacctgggctggaggctcataagcaaaccacccccatgccaagccccacagtgcccctttgtatcagtgatctgagcacctctgggaaatgaaaggtggctgtttctccagggaagtttgggagccttgcttcaaggcctatagccttcagtttcagaggccacatatattccagtgccagatgaaatctaattcacaagtctcccttaaagccattagccattctgatgataactgtaggcaagtattaggggcagattcactggctgttactatattttttgtgccagtgttcatgggttagtgtttggctatataagtgctgtgcttctatgggtgattttagataacacttgacatggcaatacaggataggaacaccatctttaggtttagctcatttgttttcagggttactattttttttttttgagtgaagactt

SEQ ID NO: 108007 - DNA, 1062 bp, Homo sapiens
tatactttggtatttagaataacctttattcatatgagaactgttttaggaaagtgctctgactgtgctatatttatttgcattgtatttgttgtacataaccacacactcactctctcgaacactttttatgggaaagagaatgaaacactcaagcctataggttactttgctacttgcacatgctatttcaaaggtcccctgttcaacaagttatatttttttgtattactctcttgctgccacccaagagttttgaaataattatttagaatatgatagtgcataatacatttaataaacactataccaggttccttggcaaagaatctttccctagagaggtctcacttcttagttgccaagggatctctttcatacctatgtaatggcctttttttcctatattaccttacagcctttggagaacatcagcttgccagcagctctgaggtgcaaaatggaagtcccatgtctcagactgagactgtgtctaggtcagtcgcacccatgagaggtggagagatcactgcacactggctcttgaccaacagcacaacatctgcagatgtgacaggaagctctgcttcatatcctgaaggtgtgaatgcttcagtgttgacccagttctcagactctactgtacagtctggaggaagtcacacagcattgggagataggagttattcagagtcttcatctacatcttcctcggaaagcttgaattcatcagcaccacgtggagaacgttcgagtgagtttttccatttcatgcaactgtgccccatagaggagagagggactcatgatgcttatgaaatctgtggcgtattaaaaccacgcatgagggcctagcgtggtggctcacgcctgtaatcccagcactttgggaggccgaggtgggtggatcatctgaggtgaggggttcaagacctgactgacctacatggtgaaaccctgtctctactaacaatacaaaaaattagccgggtgtgatggcaggcacctgtaatcccagctacttgggaggctgaggcaggagaatcgtttgaacccaggagg

SEQ ID NO: 108008 - DNA, 1465 bp, Homo sapiens
gggtggaattaaatttgtggggtaataataagtatttcctgctggttagaaattctgttacttaataaatgcagtttggttaatagtctttcaaaacatagggcttatggtggccatgaggtagggaaaaataaagaacccttgatggtgacaagcctaggaattactgctctaggccatgagtgtcccagctgtgttctgcaaaaccctcggcctcctcaacagtgacctggggtggggcaccttgcagcagcttcacttttattcattttatattatgagattttaatcaataatagcatttgaacaaaaaggttacattgctaaaacaaagcagaacaaaataacaaaaaccttatcacagtggccagtcctgtttaagctgtaatgtagaattcagcagacattttcatctttctctttaaaaaacaaataatgcaaacaacgtataagcttctcattgtgcctggtgagggatctcggtgttctccaccttcctctgtgaggattagacctagtaaggggagagtgcaggcatgtgtcctggtagcatgcgtgtgtatagatatgtttgtatctatattaggtccatggtatttagatgtatccaccaaaatgtaagaaacgtcatttgtatctcgaatatagtccggattttcttaaactcctgagtaattttgaagcatatctttttccattgtagcttctgaaagtacagagaagcttaacaactccactggcctccagagctcctcagtcagtcaaacaaagacaatgcatgttgccaccgtgttcactgatggtggcccgagaacgctgcgatctttgacggtcagtctgggacctgtgagcaagacagaaggcttccccaaggactccagaattgccacgacttcatcctcagtccttctttcaccctctgcagtggaatcgagaagaaacagtagagtaactgggaatccaggggatgaggaattcattgaaccatccacagaaaatgaatttggacttacgtctttgcgttggcaaaatgattccccaagtaagtattccatctttacttgatctattagggacatttgtaaatcattgaattttcttaggggacctcttcaagaccatttgtaatctccagagaaaagtgtgctttttaatggcactattgcattttgatggtcactcttatgagaacattgtgaagttagtcagacaggtgtcattcctcctgctttcttatagatgagaaaactacggctctgagtgtttaagtaatgggtgcctggccatttagctcactcagtagagttgagaccttagcctcagggttcttggttccatcttcttttcactctacaggatggtcttcaagctgagagccggcctactctttatgttttattttgttttgaagacaatgtctggctctgtcacccaggctagagtgcattggcatgattacggctca

SEQ ID NO: 108009 - DNA, 1025 bp, Homo sapiens
cctcctgtgcagcctggttcctaatagcccgcggaccgctaccagtccatgtcctgggtttggaggtccctgatttacatgccataaagtttaccctttgaaagtatacaattcggtgggttttagtacattcccaggattcaggaccactcgtaaatacatcctcagtttagaccacagaggtaatgtgacatacagcacacccatacgagggctagctttgtgattatatatactcgggtgagatttattttttctttcacttgaaaccaagattgaagggccaggtttccttgctgtgcccttctgcggggccggtttgtttctatttgccttacacccaaggcatagctgtgtaaagtcccagctttacacagtggtttcccgttggattccctccttgagaatcgtggctcccatctcctgattcttggcagccatcagaacagaaattcaaggtcacaaatgttgaacaggtgcctccagggcagctgccagcctcaacattagctcacttctctggattcctagtcatggttcatttttggcctcagatttgattctttacttacttgccagctcagcagtgcttttagaaatttttttaaaaaaatattttattcagcattttgagttgtttatagtggcagggttatggaggatactgcaggactgttgtctacctttcagttttgtttatggtgtgcattttttctttcttacatctttagtcacccctctaggaagagagcgcaggtcagtgtgggtcctgccctgtctgcatgtggccattcttttcccctcggagactgcactggagttccctgagctgaatgggctctgggacttccaatcctggtccttggagaggaagggaacaaagctgcttcctcaaaggccccgccacactcaccaatggctgagtctcaccttgtctgaaggttgtaatggagccaagttcattgccttccctttgctcagagctggccagctttggggcatgggttttgagtgccttctgcttc

SEQ ID NO: 108010 - DNA, 1057 bp, Homo sapiens
tttgaacacgtatgtgtggtcggcgccttcacactccttatccatttaatcctcaaaacaagcccgtgagggatgttatttgccttttacagttctggaaacagtagcctggagaggttagatcacacggtaaatggaggcggcaggattttaatagattttgaccaaatccatgtgcttgtcccacaatatcaggaggtctcagttttctcatctgtaaaatggggtaccagttgtcctagatctctaagatcctctcctgctcatcattcgtcttcctccctccctccattccttgctcttgcttttttgtagagattaggggccagcattggcgtggggaaaatatgaggagatggcagtggcaatgaggacacctattgagtaaaaattttttaaaaattttgtttgaaattacctgagacaagaccacaagtctttaaaatgacattttatatagagattgtaaattatgccctactcatatgccaatccataggttattgatgccagaggttgctgcattaattataagccaagctgaaatgaattggtgactttcttaatgggccctctcctgggaacgtggagcagtggctgacattgtgaggcagttgttatgaatacctgcccagtaggaggcgaggttaaatggtactccatgcagatgctgtcaaattgctttcatttgaacatctatgctctcttctacccactcaccattcatcaggcatagacagaaacaaagacatttctatcctgttttttcactcttcttttgttggagtgtggcagatgcctctatttgtgtcacattggactgatttgtaaatcaagatatatttacagaagccttgctatgtggaagagccgtgtgaggtgatgaggttgcagtgcctgtctgtgatgcccccagggaacattcagtcttgttggagcacacacatcaagattgtaaaaagcgaaataacgatgcatgagtgattcacaactgaagaaatgccacaggagatcatactgaccaaaggaatggtgagggtggaaatgggctgctgca

SEQ ID NO: 108011 - DNA, 1040 bp, Homo sapiens
cccagccgtaggcccctccgcgcggcgcgacccagggtgggggctcctcgcccggcgtgtgcgggaccctgagggtcggcgggtagggagggacgctttcgcagttggctggactgaggggtgtgactatcccgttctcctccaaccctttggaagaaaacttatttcctatggggtaccctgtatctcttccaccccactttaaaaaaaatggaaaggaaagggaaaaagactgcaaagcatctctcccacctccgatatctggccagccggtccccagtttcattttttccgctatacagaactggcctctccaggtacagggctcgactttctcatctaaataactgatttttaaggggttctaggacgggatattgtaaaggacaaaggatgtacgtagtttgaaacaaaacgctctactggttcgacttaaaagcaaaggaacgcggttggggttgcatggttgaacccctgcaaggcacaggctgatacaggaccatccctgagcctcctccctcccctttcctttcccaatgaactgttgctccgtggtagccaccgcctgtcccacgcagagagaaggaactgacctcttctccctgctacctttgtgtccagttctttcttatgatctggaaaaatatgccacatactgagtggaattctaaccataataccattatgaccttgggactgctgtctctttgcgctcactttctccatctgtgaaatgaaagtgatgatccctgttccttctagcctcctagtgatgatgtgacaaaatgaaagtaaaaataaatggaaagtgctttgaacaaagtcagcaacgtggtggtgttagcctttgccttcctgtgagtgacacagggcatatgctctgtccgggctattcaaataagctgggttgcttgcaacactggacattgatttggagtttccctgaaagttgagttttttgtctgcataattgacaattcatttaagtttctcatctcatgcagactttctggcacgtgaattagcttgcttcctccaac

SEQ ID NO: 108012 - DNA, 1044 bp, Homo sapiens
taaactgagaatgcagagctgaatagaacatgacatagctctgaaagccctgttgtgcctgaaaggatgaggcaggatcatgcatttgtttattgccaggcccctttcccctcagccatttcaattgccagaggaaggaatcagaggagctattctccctccatctttctccttcatcagtttctggttgatacctgagacaggtctaacacgagctaactttcagagtcagaaggtagcaaagaccatctctcattagacaaaagccaacctgccctagcagtcccggtggtcacacctggaagccaagaataccagatgtctagttctcccactctaacaccttacatctgaaaaagaggggagagctgagcttccagttgccccagatgacatatctggacagttgtgccttgagcatcagaggaccttcctctccactctgtctctctcttctctttctttctcagatccttggctggtgggaggccataaacacttctttcttccttctgcaagagcaagccctgggagatgtcttttaggctaagttacaaaattggggaagaggagctcataggtatattttcctaaaaaacagtagagagttgatagcaatttggcagccaaatctttggctattttttagatttcttcctgaagtccaggctccaagaacaagatgtctggagaagatccacttctttctatacccacatgtgcaacccctgggtctccctgttgggggtgagtaacttcatcttgatctcagttgttcttgggacagagttcaggtggacacatgtgtgatcttgggctgtgggggaggaaagatggagggcctaattagaagcaatgtgatttgcctgttgtattagaatttagatgagactacatatggcaagattacatttaatgactgcttattttaatcaataatttcctttttaaataattgtctatgataacttctgggttactaaattttaaggtacgctaagttatcatactttcatcctaatttgtttcttatagggaggaatg

SEQ ID NO: 108013 - DNA, 1082 bp, Homo sapiens
gcctcctgagtagctgggattacagatgcccaccaccatgctcagctaattttttatttttagtagagatggggtttcaccatgttggccaggctggtctcaaactcctgaccttaggggttctgcatgcctcagcctcccaaagtgctgggattacaggcatgagccactgtacctggcctttagtttatatttctctgttggtattctttatttttaaagtcattgtcatccgaatttttttctcattaacattatcgttttctttaattctttaaatatatttttaacagctgctttgaagtttgaagtctttgtctgctaaatacaacacatgaacctactcagttagtttcttttacttgatgtttttctttcctgagcatggatcacagttttctgggttttttgcatgtcttgtaatttttcgttgaaaactagacaatttaaataatgtattgtagcaactctttattctgatatatatttctgagtttttggttttttgtttattttagtaaattgcctggatttcaactgtggcatctgcctcccccgtggtgtgtggctgctgatatcgttagtcagctttttattcttatgtgtttagccttgcttcctaggagttgccccctgtgtctgcatagcccttaaggctctgcatagcccttaaggctctgctctctgccagtggatctgtgtgtcacttgggaagcatagtcaaaactggatccaattagttccccattctcctctgggttttatgttttgccaggttctttcaggcctccccaggcgtgggcgtagttttctagtcatccagggaaatgtggggaggttatctagtctttctatggtgctctcatttccaggatctccccattaaatttctgctggtcttctgctcaccctagctgggtctgcactttcaggctagcaaggattttccccattcatttttctactgtgcttatcatatttagcatataaagccacagccttttgccctggcttcaaatcaactttgcccctctgacagcaaactgctggtttctgaccagcttcatgcttaatgggagcag

SEQ ID NO: 108014 - DNA, 1033 bp, Homo sapiens
ggtcgctgtccagctgcctagtcttagaaatgtcataggtgttgctgaccattccctctctcccactccctgctgcctttactttggtgcagacgctcatcatcttgtacctggactcttgctaagtctccaagactctcccgcatcccatttctccttcatgctgcccactgaatgatctttctaaaataaaactctcatcatgtctctcttacttaaaaatgcttgctggaatttaaccccttccgtgtaaagtcccagatagggtgtacgatgcaaggttcttcgcaatgcagccctaacctacgttcctggccacacttctcatgacaacccatgcactgtacgttccgctttcacccaaactgatgtcctaaacacaccatgttctttattccttcctgccttcatacaccctgttctgcctcctccgattgcttcacctcccccttctccatctggaaaactctgacatcatttaaaatccatctgacttttaagacccactttcaccccttttggagaaggattctctgatgtcttccactgtgcaaccataacatttgattcatattagtaatataaactattatctcatatttatatcacatcatatttatatcacatttgttcacacatttgtctttaggtttatttgtctatcttaaggaaataaatattaaactcatttctttgccactagattgtcagattcctttgttttcaaactatgtctttttacctctgtactcgtcacaatattcccatacagtacacataatgtagcaaacactcagtaaagcctacttgaattgatgagcaattgagcaaattttggctaaaacattgaagcattgatcaaatagaaagagttaaactattataagaacctaatcgttgacaaaccagatgctataaaataataataatcaaatcacaatggaataaatattcctgaaagcatggattttaaaaattaacttgaggctgtattttataccttatatacacaagaattatttatttacaacag

SEQ ID NO: 108015 - DNA, 1050 bp, Homo sapiens
aagaggcggaggttgcaatgagctgagatcacatcactgcagtccagcctgggcaacagagccagacccggtctcaaaaaaagaaaaaaaaaaaaaagttgctaatgcaactaatatctgtggagcttactgcatgtcagtctgtgtgaagcatttcgcatgcatgaactaatcccatgagtaggatattattatctcaagtttatagatgaataatcacatggggagaagtggctgagtcattatgagttgtgtttctagcctgtaacttctgaaatctctgaagcgttctatctgaaattttatggtcctgcatgttatttttgttcctgcagaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaaggtgagtgctctggtatcacactggggcctcttatttggggatgaccactgattatcctacctacccagt

SEQ ID NO: 108016 - DNA, 1037 bp, Homo sapiens
gcttctcacacaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaaggggtgagtaatcctctttttttggtttgttttttgaaacatgttttgctgctaacctcactgttggcccatcaattggttaagcttttctgatcagagcctctggtcaatttctttggggtgacacagaaaataatgcagaggtcatttctttcagccctgtcctctggctggcttaggttagggctaagtagatgaagcatcttaaatgtcccagccacccagccccttagcacttttaggactgggttagctaaccagtcctagtaccatcttggaccctgagcagcatgaaaatgcagtgccccatcctttaatgaaaatgaattcaggatcctccaggtttagcatagaagaaagcgtgttttggtcaggaggcgagctggtccttgcagctctaactctgcccttgagtttcaaccgccccttgggggttgctgtttgatgatttcctacacctctggcgtctacacttcctgttaaccatcatgaaccaaaccttaactgatacataaagggcagctcagttgagacatggctggaatgattaaaatagacattcctaaagtccaggggaggaccaaagagacataaacagagaatcccatttcccactaatatggtttgcaagctagagttcatttttgtcttgttggggtaccccagagggcctccccagccgcttccaattttcagcctctctctggtttagggaacacatcgttgcaacttatccttgatttcttcctttatcttcctccaaaaatgcagtttggttttggacatagtccgtttgagatcctattagacgttcactggaaatgttgagtaggcagttggatatgtaaacctgggtttcaggggaatgttttaggctgga

SEQ ID NO: 108017 - DNA, 1054 bp, Homo sapiens
tcctcctgagcctcctccaacccacaaaggtgcctttcacgccacagggatgcctccctagttgccaggggagattgaaaagcagcctatgcgcagagctgcagctggagggcttgcggtgggacagcttccaggagagggtcccgcaggagaggaaggggcagccctggggaaggcgatgcgtggaggaggctgctcaccccattccccatctgggtgtctttcaggagtcatggccggcttcaacatggggggcgacctcagggagcctgccgccagcattcccccgggctccctggcagctgttggcatctcgtaagttcccctcatggcaatcagtctgagctagagagtgggagagaaaaccccaggcagaagagggattgccccttttgttctgagagtgccccgactgtgaccaatctatttcatattccgatccttcttttaacactcggtgggctggaaaattcacgtctggtgggttcagacactgccctttcatgcgccctgcctgggaatgctgccgaggaggagtgtcgggacccagatcacagatcgaatcctttctttcctttcctcggcctcccgcccccgtccctcccccacccccattttgaacttggggatttttttaaccaccgagtttccaggatcactggagggagcataaagatgaagagttttgcaatcagacgaattggggctgcatctcagctctgccgctgattggctgcatgactctggacaatttactgagttctctgagcctccatttcctttcttgtgaaatggggataatgacactgtatgtgcttcctagattgcggcggggagagaaggcacacagtggaagctcagcacccagctcttcttcttcccccagtgagcctcccctccagctcccccaggccgtcaggcctctggggttttagttcacactgtgccacccacacaagcaggctgggtaaccttgggtctatttctgaccttttagaatattgtttctctctgtaccacaggaagaagcttctctgcccttcattgggtaggt

SEQ ID NO: 108018 - DNA, 1078 bp, Homo sapiens
tatcccaagggcaggcagcttcctgggaagagcggctggagattcggtctggtgctcctctggatttaggaagctgtccccctgccccctcactgcactcttctccattacaccctgtgctggtggctgcaggggtggagtggggggagcttggagtggatgctgtacttgctttgcttcttaaagtgcattccttctcaaagtgcattccttctccaagctccactaccaaactttccctgagaagcagacatctcctctccagggtttcacacataccatgtggatgcagccactccagggatccaggaacacgattcacagaggaactaggaaatggaaattcactgaaaagaatatcagtcatgtgaagtcctgtaacccttgttcccagattctaaactcttactggaagggataagggcctctttggccacagccaacacatgggcctgtggttgaccacacccagcacgaaaaaatgtggtaggaaacctacagcctttactgaaatgtccacagtcaccttccttttcaagaacccagctatttctgtgatgccctttgacctccctgggcctgactcctctctcctgctcatgtacacaccctgggaagctctgggaatttgctgggccctccaattggctggctgtctccaggcccctcagcccggctgttagtgctcacccctcctctggcctacttcccccattcccccctcctaggcgtcccctgggtctcctcacaagttatgtgtcttgtgagtgagaggacaagaacctgctggatcagaatggggttcccatgtttaaggactagagagccccaagtagggacagtctgaagatgggggctcactccactcccttcattctgatggacttatgggcagaaacaggagacaagaaggaagctttggctgggtgcagtggctcaagcctgtagtcccagctactcgggaggctgaggcaggaaaattgcttgaacctgggaggcagaggttgcggtgagccaagattgcatcactgcactccagcctgggtgtcagagtgagaccctgtcttaaaaaaaaaaa

SEQ ID NO: 108019 - DNA, 1163 bp, Homo sapiens
gcccagcttcgacccccgagtctgctcccactctgtgactctgtgagcaggagggatgggctggcccgactccctggctgggcgttccgggtatggatgcctgccacatgcagtcaccagctggggagggcccttccacacttctgagcctcgcccgcctcagccctgagcagctgggagttccgaggaagcgatgggtgaccgctgaggggtgggccgacacatcctgcctgtgcccccccgctgctggtttgtgttcctctcactgcacgtggcaggtgtcccctggctgtggggaatttgcagattactctccatgtgactgtagaagcgtccctgaaggcacttctggcttcaccattttgggggtacctcctggggtaggaggcaggatggtgggtctgtataaagcacaaagtgggatatgtgccctcaagtcactcacatttgggtggggagcaaggcagccagctacagacccagagaacaaggcaggaagtcctgggctgacagtgggcatgcagagagtgggctctgtggtgcgagcagcctgtgagtgctggccgagggttgggggtgggagtgaacccagaggtggagctggcaggagagtgccgcctcctgaggctggcaggagatgatgccccaaattgcaaatttgaaagttaaataatatacaaaggacccacgtgggccccccaccccactcttctccccactaccctcactccagggcccagacaaggccagtgctagagcttccaggcctgctcgcaatccaacttacatgtccctcttgcctggatcttcatgctccctggggactgaggcatgcaccttcatcttcagggacgtgttttgaagaaatattgaggcctctgccacagggttgacctaaccccaacacataggtgcccacaccccaggccagcactaggcaatggggcagcctctagacatctccctggggattgcatttgcctttaaatctctgggccccatagcgagttggcaagtggctgtccttgttggcctaatgtgaaagattgcatcacatatactacagttgtcagagacatggctttggagtcagacctccaggttcaagctccagctcagctataatttgctgcatagaattggtcaaggtagttaacctctct

SEQ ID NO: 108020 - DNA, 1008 bp, Homo sapiens
gtgttctactgttttccccattcttatggatttatatccttttaaaaatctctttaatgggtgcggtggctcttgcctctaatcccagcactttgggagaccaaggggggaggattgcttgagtccaggggtttgagactagcctgggcaacatagtgagaccccacctctaaaaaaaaaagttctttgatatatattagcaggatgtggggagggaacgaaattaggtacatgtattcagtctgccatcttaactgataagtctggtattaatatttttcaatgacaaactaaccatacttaaaaaatttttaattagagaattttattatttcctctccaaaaagtatcatttttcatttagaaaggtgtattcgtatatctctttgtgagagatcattgtctgtcttgctctggcaaactttacagtcctagattcaggactgtgatcactgtgaattctacccctgattctagggaccatttgtggaaatctgaatagtgctttgtaaacagatttctgagtctttttgaagccatttgggatggtatcatggaagagatatgaagaaggtattttctcttggtgggttgctgcaatatgatttctgacttagtgtcatcataaatatttgagactacttgttatcttcagtaggtgttaccttatgggctgatacttaatcacagcagtcagaaactgtgaatttgcatggtgacacccttccaaagtgactgtaagagccttcctccctgacttttgaggatttgcaaacagcagagaagcaagtttttaggtatcactccagggaaaatagtgatttcatgcttgaaatatgtgggaacaatatctaaagaaaaagcttaagttgtctaaagaggatcttataatagttggatacacttataattagaaaagcccactgggggcccaggcactgtggctcacacctataatcccagcactttgggaggccgaggtgggcagatcacttgaggtcaggagtt

SEQ ID NO: 108021 - DNA, 1056 bp, Homo sapiens
tttctttcttcccatccctttctgactctgactctttttcctcttcctctttttctggttctgatctctttccctctgcctgtatccctagctggacccttggtatgagctactggataggggtttctggccaggcctgggatccttcctcttactgccctcattcctctttgtgaatcaccattatgtatgttagttactacctaggtaggtacttgttgtattgcagatgctgataatgagcaggtgtttggaggatccagagtgggtagcattgatgatttagtcttgaaaagtttactcatttgctaggtccaagcgcaacataggccaattaccatgtcccgcctgccacttggctgtgacaagaaagttcttaagaccaaaaacaatctgaatctggaagtcctcgctggtgctaagggagggatgaaacccaggaggtggagttggggctggtggatctgcaccacgctcctgttgcttccaccctccgttggctttgtctctggtgacgtgatctaagggaccctgctgatgggattgatactgggatcgcagaaaggtggtttcactgggggctccaggagtcccaggtgccagggttgctccatgagtggcctgtctcagcaacatgagagccttgaggactggaatctatctcagtcaactctgtgtcctccaacaccagcacggggcttgctgtgggcaggggctcaataggtttgctaagtgaatgaattaaggatgaatcaaaaacagtaaaagaagtacaagagaaaggctctggaacccacatggaggtgtggagaaccctagccccttagctgcttatctgcagtcgcctgggcgatggatactccccaggcctccctccagagaggcgccaaccttcctgtgttggcagcagttcgcaggtattccgtctacacagaatggcagaggatcgcacaatgcctgtgtggaggcccagcccagggtggggccagcttgcaagcccagtcagaccttcttgggaagaaggaaggaaggaagggttgcaactgagaagaaact

SEQ ID NO: 108022 - DNA, 1088 bp, Homo sapiens
aaaatcttctgttggaaaactgtcactcccctgaactccctgagtatcccctaccctctggcatcctagtccctctccaggaaccttcagatgccccaacgatccggcacctaaagggttaaccccagggcccactctaatgctcagggccaatgtgatgtccatactgatcacctggagcccaggctttgcagcttgctaaatatttgacgcatctccaggaaggaaacagtgatttttttttttttttcctggccatgtaccaccctgcagagatggcccgcatatggagggagacttgctggcctttggctcatcaaactgtcagtgaaggaaagacagagtccactcaggtccctgattccttgtacttccccctccagtgacacggttgctggaagagctcaattagtgaaattgcaaggccgtgctactggcttctttgaaacctcacactagcctgatgtattttccttcttcttgattagaagttcttggctgctcttctaagttactccaaatatttttccttccttctggtcaatacattagtagagtgtagtgtgagatgaaatttattttcaatcattcccatagcaactggctcctcaagaatctgtttttggtatcactgatgtttcatatgggatattttctttgtggttaaaaatccaaactgaaaccaaactataaaccttcaaaatgaatttaacagagtgatttcaactcttaaaaaatgaggacatatacatagacatttgaaaaaaagactggaaggaactatgcataatagcaactatctttctgttgagattatatgtggctaaattatcttatttctacttttccttcaaatgaccagtgttacttttttaaaaaaaattaattcacttttagagcagttttaggtttatggaaaattaagcagatagtacaaaagttcccacataccccttttctctctcccccaccacagtttcccctattattaatatcctgtgttaatgtggtacatttactggaagtgatgaaccaatattgatatgttattgctaatagtttagggttcactcagtattatacattct

SEQ ID NO: 108023 - DNA, 1054 bp, Homo sapiens
acaggacaacaaatcctaatcttttgggttatatgttccactggacagaagttatttgcatctgtactggaaaaaaatccataaggtaacatgtaactttattaaatctggggcatataatgcatttaatcaacagcaaatagtgagtaaaatgaagtacattcacctagatagtccttgggtagcctttgccacatatgacgttgaaaaagacgtgccactcacttttttttttgctaagttttagataattttaaaaataatactgacctatagagaaatgaagaaaaatctggtttactgcagtgtccttttaaggctctgtagatgggaccccctgtgtgttcttgttctatatttagttcttgaataactcggactgagaaatccggaggcctctttagcccagtgtcccatcttcttcctcccatagtcttttcatctttgttatcactgacagccagctctcagcttgggttcctccttcattctttagttgagatgtagacaagtagaaatggggcctgaggcaggttcacgggtgggaagggctggtttaaccctgcactggtcccaggcactgtgccttggtgccagtgagtgtgtccgatgggggtgcagggttctcagcgctgggcggttctgcccatgggcccatggctttctgtcctgctgactcttctacctggaatcgcatgtcagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccaggtaagcctttcagagtccagtatgtggccttatggatcttcactgctttagagatgtttgtaggtgtgagtttgcccaccccatctccccctaacccccataggctttacctacaattgg

SEQ ID NO: 108024 - DNA, 1120 bp, Homo sapiens
gcacacaaagtgcctccagacagaggcccctggaacaaggcttggcctgccagaagttcggtgggtctccaaacacacactcacattcccaaaccactccagactcacccaggcctagaaagcacacatcatcctcaatagactgcccacccagcaggttgtctggaacaatgtcccacattctggtgttggcccaaggtatgattttgggtttgagactcctgccttatgtcttctgcctgactcagctgtgctgagtcatgcattgatttgccaatggatccttctgctcatttataccactaccccctggattaaatacatactccccttagtttaattattagccatttatataatataagctgaatgctgaccaggaaccaagcactataccaaatatttacacaaattatctcttttaattgtcttcattctctatggtagtttcaatcactgggcagtcattttgtaggtgaggaaacggaggcttagtgaggttacgaaacttgttcaaggtcacaaagtattagagccaggacttgacccaggcagcacatgcaccctcgaccaccacaccattaacactcagatctacagctccttcccagctggttcacttattactgaccaatctacacacacacacacacacacacacacacacacacacacacacacagagagagagagagagagagagagagagagagagctaccctatctggtcctaaaatgattaaagccaaaccaagagtccattcattcaccctccacctaacttccaagtgtccccacccttgccaaacttcctgtgagccactttctaatcaccgtgaccaagagaagagcaggtcaagactgaaggtggcatgacacccactagcctgtcttcccactgggcactgcctcctaatcttgtgttctgcaggccccaaagctcctagcagaatttctgatccccaagactggaataaaattgttcaaaggttcccaggaaatttcttgagggctagccactcctagagttcagcttccagcattttagccacctaacttactctctgttcccacgcagaggtccttaatttgccatctgggtggctttgcttataccatt

SEQ ID NO: 108025 - DNA, 2148 bp, Homo sapiens
gagacacttgcagagtgccagctaggttagatcttttgccgcttctttcatttgattaatttgggtttttaaagggctgtttaaaaaaaaaaaaaaaaggccgggaaactttaaaagtaggcattactgtagtactgcatttcttagaacattttaaactagaactcatttttttttcacagtatatttacttgaagaagcactataataatcattgagaagtattttgagtctgaaatttaatttaattttccgtttcaaattgctttatttcagggaaataattttccagttgttttgctatattctgcaaataaaaaccgtgtttccttttttcacttaaactttggtaggaaacaaactaaagcagacaaacatttcttgttatgtttgttgctttctttaatccaatggataaaaaagtaaaaccctgtaaacattattttatttttttatgcaataccatgctgtaaatatggttcatcaaataaggatgtacctatgattgaatctttaattctgcacagttagagtttatatataaacgtgtcttgacaatcaaggacttttatgtgagtcttcctttatgatgtttattaatgttatgcattccatttgttttgaagtgagtaccaatgtgctaatttgtattgtctgaaagtatgtaatgtttttacagcttgtttttaagaatctgtaaatatgtacaaacaaatcacagtactgctttatgttagaaggcatatgatgttgtactgtatgtaagcaataatacatagcagtgctaactttacaagtagcatcaggaaagttctaaaaacatttcagagttattaattatccttatttcatttaataatgattatctttaatcagtttttataagcaaattccattgttcctcctattggaacgtaacactgtttacacagcataattgaagttgcaggggagacaggctaaatctgacttcatctgtactcactttcactaagcattgaatggccttaccactcttctgcaagatggaggaagaccgcaaaacttagtgcccatcacactgaaggaagggatgtggttttttttcctgcttctgtactgctacctaactttgtgatttgctttggattttaatatttgtttctgttttagattcaagcccgtaagttttgaggtgacttcagctccattgtgaaatagatagttctcttcatatttcataactacatttcaataattctaaactttctacattgatttttagatacttatttttcaagcttggtttctcagctgatcagatgaatttattcaacttcaatacaaagaaagacaaacctattatagtttcaagtgagtagatattatactgtacaggacagctatttgaacacacacatcactgctttagaaataaaaccgccaatttataaatgtatatgacctacattttataggaaaaaatgtttttaaatgctagtcatttatataatgtgctttgaaggatttgctagtccacttctgtcactttttagtacactggtatcttttatatgtaatgtatgctttttattattgtagcaaagcatttcagtagaaagaattttgcaacaatatgggggaaatttttcattgttggatttgaattatactggattttatctgtgtagtcttacttgtctttattttaatgctgtctgaagggaacttggtatccaaataaagcaggtaacctcattttacttcaagggcatactgtgtagtgctgaatttaatctgaaaatctgatgattttgaaaagaaaaacaagtttataaacattgtacagaagaaattaaatgtgtgtgatggaaatcctgatggtggagcacgttgaattttctgatatatagtgttattttcctgggatcccctatgccttctttgtatttcaactaataaaggaaaaaccctgtcattaaaactggtaagataataggatattctgattatacagtattactattcctatcccattttctgaccttttctcaatcactgtaaatttttattttctatttcctattgataattaaatatgtacataatatagacactgttgtatagaactaaatgaattgggttgctatgcttgagtgggtagtgaaa

SEQ ID NO: 108026 - DNA, 2111 bp, Homo sapiens
atactttacagacagagtgaacttaaaagtttaatgtcaagagattatggcttaaataaattagtgtgtcctatagggggaaaaaaaccaagaaaccaccttttaaaaagaatgatatgccatatacccttgattttcattttgcattatattgacgtgtttttttgaaggaaaaaaagtaataaaaatctgatagtctaagactccactatttaaaagcctaattactttaaaaatatgcatactttcagaacttttaccaaaacacacaactgttgaagcagtcacttctctatggaagtatgcatattggtgtcagtttctttgtacagttgtacttagatattttttatgatttttcatgtgcaggtatcaaggttttgaagttttagtaaaagaaattctgtagattacattcccaagaacataatgcttacacaaaatgtatattccacgttttaaagcttaattgtattttactttacatatacacttcagttaacatagagcacttagaatctatttggtatttttgatttctcaaagtaaaaaaaaaattagatttttaggtttgatatggttgtgtcataatcatctcgtaattgacaattttaacttttggcaataaaaggaaattgggatatctttggaactgtaaaacctggtttaatctttttctttctagactcttgatagattggataattaaacagtatccagagaaactaaagaaatgggcattttaattgcatattttatcttgagttactttttaatgaacactgctcattacaactttacaaaccaaaagtgtttactaattccagtaactaccatttctttttcagctagatgagtgatcggaaaatttttgttgcatttcaaaatctaaataaactacagactttatccttataccatgaatgtttttttttaatactctgtcttaaaataatacagcatggtacaataaatagtgcttttatgtatatatacacacacacacttttctgaagaatgatggtttgagttatgcgttgggcagttttgatttttggaagttatattagttattgactctttgttacaactttttcatttttacattttaaattttctgccatcgttgtcacaatgcacatcctgatatagcaccagtgaaaatctaaaattaatacccttggaaaatgaaaatattcttaatttccattttgactcttatactggccctatagctctgcagtctttgtttcaatatagaatatgttatccatttaaattattttttcttttatttaatgttatcccaagactgttctcataaagaaagggaagaaataactatccacccttaacatccttcatttattttgaatatattggtgtttttatgataaggaatataaattatatttaatgtggtttcctgtatactttggttattaagttttgcttgaaatagtagttttcccgtttgacagctttctttgctgccaaagttttcaagaatttaagacttctttgaagtaaatatttaagttctgccattattgactcttaagattgtgtgtgttgtgttgtgcattacataattacaaaaaggcttcattcaggtgatacgttaaaaatggaactgtgctcaccctaaataggcattggtatttttctcttttggtgagagtaggcatttatttcttgagttgttttggagcctgatcaaaaattttgttcatggagaacttgatgcaattttgatacagtggagaggtttttttcggttgttttaacatcaccagcatagtttttagaatgtgactcttgctgagcatttagggtgagcttgggaaggaaggcctttgaaaatggtagttatgcaagcagactttcaggtgttgcattcctgttttcaacacatttctttaaatctacataatggcagacttttctaccaggttataagcagtttttagataagtgatactcagccagcataacttattgacttaccatttacgtatagtcatcactctcttactgtgaaattccaaatgcctaccagagttaccttgttctatcataatatgacaaacatctcaacagttttggatttc

SEQ ID NO: 108027 - DNA, 1621 bp, Homo sapiens
gctagtctgttcatattgctataaattcctggcactgctgttctccttggaaagagggtattacatacgcacataacaaaaagacaggaaaatggactgtgcctgtattcatccttttctttccaatagcatatgctaatccttttcatttttataaagcaaaatatatttgacaaatgaaattggaagttacaactttcaaaagccatttattttagagattcttatggcaaagcaattcattattttacaatatttgttttgttttaaactttctatattatgtgctaggtgaaaaaccatttcgctgtgatgaatgtggtatgagattcatacaaaaatatcatatggaaaggcataagagaactcatagtggagaaaaaccttaccagtgtgaatactgtttacaggtaagagagatggcttgaaattcttctactgtaattaaattatacaataattataaattagattagaaaatattacaacttagagctatttaaggggccttctaactcttacagattagatttataatagaaaattggctcagtgaatttgtttggaattatgtatgttattgcattaatatatctttatattaattgttttgtttcactttttcttttcttggttgaccaaaaccacaaacaacccactaccatcctctgaattcaacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattctt

SEQ ID NO: 108028 - DNA, 1085 bp, Homo sapiens
taagctgggcatggtggtgcatgcctgtaatgccagctactcaggaggctgaggcaggagaatcacttaaaccagggaggtggaggttgcagtgagccgagatggcaccattgtcctccagcctgggggacaagagcgaaactccgtctcagaaaaaaaaaaacaaaaaagatttctgaagagacttggttgtattggtgacctgagtgtgatttacaagaaccattttgatatggtgggtcattgcagcagccggatggaatggtttgaagagggaaaggaaggtttgcagttgccaaaaatcagattagtatgtcaaaccatagtgagctagattatacataaatcttatgtctttataactctctcatatatagtttaccttaacagttacccatatattatagtaaaaatttttatccataaacagctgattgtgtgcaatgtcagagttaccagggagaaacatcacattggggaaacagtctcactggaaaactgttagaagagaaactttagggcccttgggtaggggaaaattatcattttgtgggacacctggagattgtttttttccttaccgtgttattgctttcctggatgtaaaaaacatttaaaatttcttgatacttttcagataagctttttgtgtcattcttgaaatcactcaagtgctgtatagatttatcttccttttccagtagagaggctttagccctcaaggggaaaaatgataaagggattttctcaataagggaatttttcatttaagtgtttttatttttctcaggaaaaatagatatcagtcattttattcttatttcaagaatcaagaaacaggtcagacgtggtagttcatgtctgtaatcacaatactttgggaggctgagttgggaggatcacttgaggccaggaattcgagaccagtctggacaccgtaacaagaccctgtctctataaaaaaaattttcttaattagctgggcatggtggtgcatgcctgtggtcctggctacttgggaggctgaagttggggaggatcacttgagcccaggagttcacggctgcagtgagctatgattgtgt

SEQ ID NO: 108029 - DNA, 2330 bp, Homo sapiens
gagactctgtctcaaaaaaaaaagttttcctgctctcatttgctgtttcatcctaagaaacttgagaaatagactactttaaatattacagtgtatataaatgtgtaatttcataactctgcaaaagaaaacccagaaaaaataattttttaaactttctttttggggagggaggagttagtgaccccaatctgttattttacaaaatgggcaaacattgccaatctttctgaagtttgaaatgcagaatttgaagtttctcactgccctgcgttctagggaaagaaaaccattctatactagaaaggtgttatttaaaaagtttgatacccagaaaaattaattatttcattagttaccataatgcctgtgagttttttgccactttgatttaactgacattgacatgtctttgtgttagtgttgcagcttctcagtttttatattctacttcattggttgtaatttagtctcagatgatttcctataggatgtaatttcctgcatagtatatgggttctacttagcctgataaatgatctttccaacctcctggaagcactatatgccaaagatattctgatattttctaaagttttaaggaaaattattgggtatgtagttattagtccatggatttattttagtaattgtcattgtttcaccttttctcaagtttattgttcagcttaaggatattttcatttaggatatatagcccagacactgggttataattataatcaatatgtaagtatggttataattataatcagtatgtacgtataatcaatatgtaagtaatcatttgttatcaacctcctcattcctgttcttaatagctaacattttttgagctgttatactactgtgctaggcttctttcttaaattcctacttcacattaattatctcatttaacatttggctctgaggtatattctattatttccattttgcagatgagaatataaagtcgtagaagtttaaatacatgcttatttctcacagtaagaaatgctgagaccagcattaaaactcagctcatctggctgtagaacctgtactcttaagtactattttatgttgcatcacataatggtacatgatctttttttggttagtgtaatagttatgatgcttgaaaattttattgtctaccctttgtaatttattaaatatggatgtttccttgtgttgtcaagtgtgtttattatgccatgttaactttgtcatagtctcatcattatttttcacccagattttatgaagaccctttattattaaaataattttcacatatattctgattaatacaacagtggataccattttttgagtattaagtgctttacatttgctgtcataacaaagaattgatttggggaagttttgtagaaaaaaatcagcagaaaatgattatggaggtaagaaaaaagcatggtagtttaggaatagaaagaaagccactttgattagagctcagaaagcagagtggggaattgcgaagacaggtcagacacaagaaaggtaggggccagaagaatagaggaccctgttttaatttttattcttagaacagcagaagaccaatagtatgctttaaacatgatcagatttacttaaataaacagaggctggctgtaatgtggaattagaagaagataatagatcccagagaaactactccttaggaggatattatgtgataggctagaccacaggatgatggtgtcttgacctttgggtgatgacagtgggaagtggagagaagtgaacagatttgataggtatttagtaggctgaatcagtagggcctgtcaattgtccaaatatggagagaggataaagaagaaaaaagctgtacagttctctcatttgtgcagtttagaggggagaggagtgccatttgtggcataagctgtaagttgaagattgtattagtccattctcacattgctgtaaggacatacccaagactggtaatttataaagaaaagaggtttaattgactcacagttccacatggctggggaggcatcaggaaacttgcaatcatggtggaaggggaagaggcaagtcttacgtggtggcaggtgagagaaagcgagcaagagcaggaaaattgttttagaaagcagtcagatctcgtgagaactcactatcaggagaacggcatgaggggaaatgcccccatgatccagtcacctctcacctggtccctctttgacacatggggattatggggattacaatttgagatgaaatttgggtgcggaacagagccaaaccatgtcacagtccctaagtttattgtgggatatgatgta

SEQ ID NO: 108030 - DNA, 1068 bp, Homo sapiens
acactttaagaaatagacctcttgcagcagaacacttcgtgttcctggaacctgtagtgcttgtttattctttttagatatttaattgacagccaaatccagaagagatagctgctgaatttgtcactaattctgagtctgattctctcgtttctttgcataaaagtagtgttaatgctctgtgctcaaattagagcacctaaaccatgtttctgaaatacagtgtatatgaaattaaagtgtaagttgcagctagtataaaaaaagcaaatcattttattgtggcagaataatagtgacatcgtatgggtgggcaaaaagccacaggaccctgattaggaaaatgattttagtcatgaaaaaagtatgctttctgagagaatggtccttcatcttttataccctagttaatttttttaaagggaagaaagccgatgtgcatttttacagttctatatgaagagtaagctgatgatgggtttcttttaaggggactcaacatagagttatcagatttggtaagtccattatgggcttaatgtagccttcactgctgagctcttattatagggcacttgttttcaggaggtagctggaaattggggggcttatatcaagttcagaaatagacatgactaatttaaaatgttagaagtcaggatactttttagtaaacattgtttttaaaaatctgttgtacgttttgggattctaactcatttgtgtttggtaagaattcactggtgcctacatatccagccattttactaattttacatacgtcatatttagatggtgtttacagtaactgctgttgctttaatttaggtcttgtactgcataggtgccatcattggaacatcaattatttagtgttaatatgcttagatgctagtaccagttgtgtaccgagtgtataactggctgatagaaaagtgagatgtggaagtgtcataaatatatggtgttcagcttattttggaattaggacaatggtttttttgttttgttttgtatttttcatgtatacttcctagatcaactctcagatctttaatttgtgcatag

SEQ ID NO: 108031 - DNA, 1049 bp, Homo sapiens
tgtttcatacattctcctttccataaacctccaacacttcccccaccctgtatcaatcactgagcaaattgaagtaatcagacgagaaattcagtaagtttgtagtacttctgcttatcaataaatcaggaagttttgatcttttggagaaacatgggcaaatagtgatttattttattttgcaaaaaagctcaggattttttccaatgttttgtttaagtatgtttaggtatgtataggtagtttaaatcttcgttttccatgaagggaaatatgtgttgttgacctcagacttcttttaatgtacaatttacatacaataagctttaccatttttagtgtatagttctgtgcgtgttgacagttttgtaactactaccacagtcaagatacagactagttctgtcactccccaagggtcccttgcactttttgaagtgagcccctctcctaccaacaccccatgacaaacactgataagatttttgtctctgtagttttgcctcttccagaacatcatataaattgaattatatggtatgtagctttttgaatctgacttacttcacttagtatagtgcatttgaaagtcatctgtgttgatgcaccaataattcattgctttttattgctgagtagtattccattgggaaaataccttggagtgatattgctgggtcatatgatagatggacaggcatacctcattttattgcacttcactttactacactttgcaaattacagtgttttttttttaattgaaggtttatggcaaccctgtgttgagcgtctgtcagcatcatgtttccagcagcgtgcactcactttctatctctgtgtcatattttgataattctttcaatatttcagaccttttcagtattacctgttgtggtgatttgtgatcggtgatctttgatgttactattgtaattgttttggggcaccacaaactgcacccacataagagagtgaacttaatcgataagtgttgtgtgtgttccaactgctccaccaactggctgttccctcatttctctgcctct

SEQ ID NO: 108032 - DNA, 1216 bp, Homo sapiens
atttgaatacattatgtgtcattgaaccaatagtgtcaatagtgaacttcatttgctctggtgggcttaaccattatcagtgttccatgaatttctgtcagctatggaagctgaatgttctgatttactctattatatagcagtttaatatcttagaagtggtaaagtcttattgggagcttttgaatgtaaagccaaaattaaactttttctgaattaatatcaccaatctcaatcactgaagaatagctttagaaattagcttctgctgaagacttgaaaatgtttcttaataaattcagcctgttattacaagggaaaccagtgtttatatgtgaaatttctcccatgataaagttatcttgacagcacctaatattgaatcacaaaatgctgttttatgtacttcctatgctatcagttagaacaagaagcaaaatctccactctcacacaaataggcagtggatgtattttccaagctcaaactacaatttcgtcagattttggaccttgatgcaagtgcaaagaaagttttcatatttcagaatccacttaattgtgcaactctgcctactctttaattggaagtagttaatgtccagtgtaatacatgataaaaggcaaatatcagggatctaataaaattttctgtaaatgccttccaagtggtgaataatgcttgataaaatcacattttcatggattgatatcagtatctgtctttgtgacaagacggtttcaaagatgaaatgcataaaatctcattgcagatcagcattaacatacatttacaattgattttaatgatagggaatgctaattttgaagccctataaaagagaattccagcgttttcattagtagaactgtatggtgaaaagttatgcattattattatcatagtttgaatttcattaataaaatttttgtggaaattgttttctctcttatatgagtttgtatacagtatccttgattttaccttttggtctacaaagcttaatattatttactctgtggccctttgtgttaaaaaaaaaaaaaaaaaaacttgtcaacccctgtcaggttattttgaatgccccaccctctcagttcttagacctctgttttcttggtgacactgtcatttattcttcctctgtcatggtcatgttagactagtgctcaccaagctttagtcttcctgtgactgtagtttcttatttcccagg

SEQ ID NO: 108033 - DNA, 3985 bp, Homo sapiens
gtggtgaccgttgtttgcattatcttttttttaaaattactatttaattacattttaaaaacttatttcttttgtttttgcctttttttttttgaactagatccttacaataaatgaggatggatcacttggtttgaaaacccctaaatctcacgtttgtgagcactgcaatgctgcctttagaacgaactatcacttacagagacatgtcttcattcatacaggtatttcttgaattaaaatgggcttgtggccattaaagttattatctttgttattttcatcttcgtgtaactgtcattcattcctaagaccatagctaatctggcattccaaatcagagattttgtaggccagaatgtcagaaggaaaccaggaaaaactcttaagtgagaaaacaattagcatggatgtgtaaaattaattaaatagtcttaattggacacctgtttggcttaatgtgctccatttagctagagaaatgattaaagaatgtattattaaaagcctgtttatcagtgttcattttttgtgtgtgcaaaatgtccaggcagagtttaaaacatggatttggaaatcaaatataaataaatgatagctaagataatgaaattgtagagaacagtattaaagatgacagacctttgggtaaacaaactagacatgtaagatgaaatgaggaagaaaaacagttataagggagattcattgaactaggaaaatagtgtcccagaagctagtagaagatagaattccaagcaggatgtgaccaacagtgccagtgccctaggaggatagaggttagagaaccaagaaaaaatctttggaataaatagcaaggagatcacaagtagcttttcagaaagcagagtataagggttaaaccgcaagtgggcagtgaagaatttgacttagagtagactactcttttaaggaggtgtagtgaaagagaaggagagaaagtactaaggtagaagtgtttcaggactgaaacaaggtttctcagcatagagcaggccagagaatactttccttaaaaggaaaagccccagcagagagagaaagtttgaagagacaggatcttttaaaaaagggatgtttagaaagttctgaaggttctgaagaaaatatgtaaaagggcataaatggatggttaactagggagaaaacaggatgggcgcaccttcttccagataaaaaggaagaaaagatgtttaggacacgtgagaacctgtatttctttctcaccccatgatgttaaaattcaattttaaattgttttatttatttccttcccccccttgaatatatagatcaaatttaatcttatttttctgtgattgtgagaatatgaatttttaaatcctgggaaaaaaattgagaggacataaaattctgttaataacattaaaaatttgtatggctattttgtaattttccaaaatttgggcatctaagatttttctttcctcagaaacagtaactaaaaaccgttgttttattcagtaactaatttgtggatgtgaaattattttaaggtgaaaaaccatttcaatgtagtcaatgtgacatgcgtttcatacagaagtacctgcttcagagacatgagaagattcatactggtgagtgttaaccacccttactaggttcattaaaatgattatttcaaatggagggaagaatttttaataagtggcagtgacttgctgccatttccattggtttagactataaatcacaggttatcttttttctcccttcaataaatcaatgttaactgttaagacttaactttaatgtccaagcccaagaaattactttgaaatagagttgcataataacctaaaatatatgtttaaagtcacaaaaggaaggaagattttctgaaattgctatttccttaggtgtttactgaactcaaaattatcgttaattagtctggggtaggaagcaaattcctgactcctaaagcagcagtacaattcattctctttctttccctttcatgtatataccttacccttagacatgtaatcttaaaaagttgagaactgccaatttctcagtcaagttattaatgatttagaaattaaatattctagaggattactataaaggaacacataccgtaaaaacctaagtctcattttagagcaaatatttatttgcatctatttttgccaacggtaaaaccaacttttataagtaactttgatttagtagtctgttgactttgcctttgttgcctctaagcatgttgaaaagtgtttctttagaattgatttccagtgttttgctttttgtgatggaataaaagcagagttggtaaatttgtataactttgaattttacatttgaatagaattgagaattgtgataatatgagaatattgaaaatatttaagttcttcatatttttctgttttaagtactcaagcaagtacctgcccagtgttgttattttgatgtgttctcatgggacctgcagtatttgtgaaaggacagtttgtcatatagaaacaaccttttctgtctgataacttttttttcaattttctttgcccccaaaaagaagcctgaatgtgtctggtctgcttaaataaaactttaactgggctgggctcagtggctcatgcctgtaatctcagcactttgggaggctgaggtgggcggatcacttgaggtcgggagttcgataccagcctgaccaacatggaagaaaccccgtctctactaaaaatacaaaattagccgggcatggtagcacatgcctgtaatcccagctactcgggaggctgaggcaggagaattgcttgaacccgggaggcggaggttgcggtgagtcgagatcgcgccattgcactccagcctgggcaataagagtgaaactccgtctcaaaaataaataaataaaataaataaataaataaataaataaaactttaactgtgcaacatgtctgtatgcttggatgttctactttttaacaatcattttgcacattactagtttcagttttttaagtaaacgtattcatctctttttattagaaggggctatactaggcactgtgggagaaaaaaatttatagattttgtgtgacttatagctaaatttaaattcctatataacaataaaacctgatcagatacaaatgaaagtgattatttttgtgtgttcttaatacctaataggttttgatattttactcattcattcaacaaaaatttattgagcatccagtgtttttcaagcaccagaaatagataacagaaggcagtttctttctttggagtttacgttcttgtggaaaaacagacgtggaaaaacacacatataagcaagcacagtgcagttaagtgttgtagaattttatacaaaattctcaagatactattgtgccctgaggaagagacacatgtgctgtccgttcttagggcaggtgtcacagaaaagccacatgaggctaagttaagaatatatgtgtgtgggtgggtgtgtatctgaaaaaaatatttttgaaacaatactcaccttcattgcactgtgatattttgtgtgtgagtatgaattctttttttaaaaaagtgctggtcacaatcctgtaatcaactgcactagaccatggggaatcttggatttaagcagagtataatgggttgttaatgtttgtttagaatttactaagtaccagaaaactgtgttaaatatctcatttagtcctcacattaatcttgaaaggcaggagttattactgtccccattttatagatgaggaggtagtaagaagtgcacataagttaaggaactttcccaaatgtatatatctagtaaatgatggaaccaagatttcagctcaagcctctgtgagtccagagtacacatgtgaaatcactggctatgcagaatgggactagaagcagaaagttatatttgggcctttttgagtttttcttgctctgtcactaagccaattatggcttag

SEQ ID NO: 108034 - DNA, 1046 bp, Homo sapiens
tccaagaatttggtgtttctgtctttgaacttaaaaaaagctagattttcctgtgtgtttatccacaaggcagtggtagctgtttcatccataaaattcaccttgaattaaggcttgaatctacaatgaaaggcagcagtacctccagtgccagaaaacaatgacctagaactccttaactcttcataaaagggctttgtacagtcaaggattacatccgtttcacattaagcaacttgggccagatttgttctttacaaagcctttccttgcagttgctatgccacagaaagctattgaagtgccatgttttttggcagttggattttcttatttgttatcaacatacatgaaaaaaaatacctggtgctgtcttgtttttagttccattttatataagtatttaacatctttttgtttgttttatgtataaaatattttgagtcatattttaaaagattttgtgtgttttccttttgcacagtgttaacttgcttattattatgtgacttggaggggttgaaaaaattcaaaactgactggcccagagatgaagctttccactttctttgactctcctcaggaagctgtgacacccacttccattctcctgccaaatgtttcccttccatgactttggtgcatagactttgaagcattgttgaccacattggctgtttgcccagaatccaaatgccctgtataatttgcataataattaccactgatctgcatatagtataggctgaactgtcttcttgaatttaaagtaaaaatgttttaaggattaaagcttttttcccttacgtactgcccttttctaggtttgagaaggggtcatagctgtgtgtttgcaggccctaatcagtttccacagttctttatatttatttcccagatttctctacctttgttggacagtttcttagctcccattctgtatgcccacacctacagcattgtttccctctcactggccatacccctcctgatcagatcttctagttttctttgctgtttcagcataatgttgtgccttttttttt

SEQ ID NO: 108035 - DNA, 1541 bp, Homo sapiens
tactactggactttggtattcacttgttacatgaattagaaggtaacagtttccatctcagaagggttttaggaggattgttgggttaacattaatgaaatctaagaatttttttcagtaaaatataacaatattatctaaatcccatgttgtatatattatataggtcttttccacctccttagtaactgaatgagagagaggatatttttaattccttctctttattctgaaatgtatctctcttttcatttattcaacaaataatttgagtgcctgttatgtgccaggatctctcatcaggtactgaaaaaaggaactgggtttgttgtaacactttaggtgatctgaataaaaattcattattcaaagttatgctgaactgaggaagagcacttttcacacatcagatagattatataatagagaatcctttcccagcaatttattatatattgttggttcccagaaaagattttagactttggtatcagaaagattgaattatgtaaaataaggaaaatttaatgaaaagaaacagagaagtagatataccagacatttgccatgctttcttctacatgttaccttgatttaggaagaagtagctttaaagatgaactgattataagacggaggatgcaaacaggaagtatggaatagtaagaaaatgaaggaagaagattggcaaaataatagagttttatttatctaattttcccaggaaattgtgtgtcttgtataaattgtttttccatagaactgaaccctaactttgaaaaaaaatctgatgtaaatctttctttagaaaatatcacctacttctttgcctaatattcaggaaacagggaagaaacagcctttttctaaaacccagggtcattttgctgaacatagttgttgtgccatgcttatgatacagtgaatttcttgttctggtgctgtcaaaagcttaccatttaaaaaggaaatttggtgatgagaaaaatctagtactgagaaacaataaaaaatcttgatgaatgaaagaaagtgacaatgttagagtaggttattaacgatgaccaggacagtcaagttgccgtgatgggtattactcagggtgactttgttatttgtatatctttggacttgcactattttccatttctcattggatttggagagtaaagagaattgtcacagctgtcattctccatccccagttgcagtagaacgtctcataataggtgagaaatgtaaactctcttatctaattagtcttttgagttttggtggcttcaaagttgattttgattgattcaggaatatatgataaaaacctatagtgtttagtttaaaatatgctttaataattttagtagtacacatttgaatgtgaaaaatcatgtctgccttttaagaaaacagaactttttctcagtgaggggtgtcaggtttcatttattcagtggcagtgatccttatggagtgaaaaatctctgaatttgaataggcagaccttagggctttgcctgatgaaaatgggtatattatttaag

SEQ ID NO: 108036 - DNA, 1072 bp, Homo sapiens
attagctatggtgggaatatttacaccctggaaatcagcaaatgtttctatacctcctgattccttagttggtggttaaatatttgccagcataccactattttggggacatataaatatgcctacaatagcaaattttgaaaaacatagagactaaaataacccatagttacatttcctagagataactacttggattttctgccatattccctttcttttttcaaatttgtgcagatagatatggaggtataatatagaataaattagctgatttttaacacttgaaatgtaagcaacttttgtgcttaaagtttttaatgttttttgtaatcatttattagctacataatctatttcttaatagatcatgttatatttaatggttgttttattggacattattatgttgtttgaaagttgtagtccttttgtttctgttttaaatcatgctgcacttaaaatgtttgagtatgtatctttgtgcactattgatcaaagggtgtgaacttttggaaagatttcttgataatgttactcttttcagaaatgttataccagttacacttctacctgcagtggacctgaggtgtatctgtctgcattctcactggtcttgagtgtctgactttgcttaagatgggagcctcattatagtttaaatttgaatttctttagtttctggtcacactaaacttctaaaatttttgttggcattttatatttcatgttttgtgaaattctcccttcttcttttcttccctctccctccacttctttttttggggctttaatgtttttctcagtaatttatatcatttttgggggttctttacattaatgaacaaatcaagttcttcagatatagaataatactaggttttatgtaaaaaattatttctaaaatcatttgtgatagtgattggttgttacttcggattcattgctgatctatggggtatctatttcaagtgtactctcttcttgaaattctgactaaaacccagattatcttcttattgggtgttggactctgtatttggtgatatgttctaggtatttgtaaatatag

SEQ ID NO: 108037 - DNA, 1668 bp, Homo sapiens
ttctcaaggatctttactgtattttatagcctgagttgaaagtttcctagttttaaggttcttgttttacttcaaggatagattgaaaatgtagcagtgaggaggggatgactgaacaccatcaaatctgatgagaactgacgatggtactgttagtgatcttagaaccttggtttttcttttctttctttaaggacaagtaactctgagaattaagatctgaaaattgaagaacattgttgaaatcttaatgtttcttctagtatttctctattatgtagttagcatcatgtcttgtacagtgtagcagcctaaaattataattgcttctataaacacatatttggtgatggtctgttgtagagcccaggaaagtactggctgagatcttgagtcatatgacaaaactgttgagcatgaagataattagattttcattgttaatttgtctttcttttgacaaattatcttttagaatttgtgtggtttacttgatattttataaatacagagcccatctagaagtctaaatacctcttttattccctagtattgtgttgaattttggaccttaaccttttttgtgcgcttttaacttcagtatcagtttccttaaatgtgggaatgaaattgatgttacgatttcctgacttctgcttggtcttatgatcatcttttcccaggacgtctttgatcttttttctcaggtagattaaaaaaaaaatctgtttatccctcaatttatgtactctcaattcttattacccactgcctattaatgaattctatagcactgtatatagttaggacacacacacatagatcatcattctggaagcacctgtatgtgggtttagcaaaggattaaacataaaatggccttttgtcacaatgaactttttatttatgtctaaaattggcttttctttttttaaacagataagcgtaaagcaggaaattacttttactgatgtatctgagcaactgatgagagacaaaaaacaaatcagagagccagtagacttacagaaaaagaagaagcggaaacaacgttctcccgcaaaagtaagacaatgtattaaggtggtaatcacaacctcttaattccaactgttggttaattctataggcaagaacctggctggaccctaaggcagatgtagaagtcttgtgtggtttagtaggagggggtgcgtgcctgcatggaggtggtgggccttgctttcaatttttctgcttctctttcaccatgttcctgacttgtctaaaagtgaacttttctttttccatatctctatcggatggcatgcattgccctttcttctcatttgtattagttttccttatctttatattaaggtttcaggaaaatgtaataccagttattcatcaggaaaagatataggatccctgttaataggatgtaaacttcatgagggcagggacttcattttgttcacagctgtatcctaagagcctggaataggagacataatagatcctcagtaaatattttatgggttaatgaatgggttagtaaataaacaagtaacccaggctgagtgcagtggcatgatcatggctcactgcagcctcagtctcccagtctcaagggatcctcctccctcagcctcctgagtagctgggaccacaggcatgtgccaacat

SEQ ID NO: 108038 - DNA, 2072 bp, Homo sapiens
atagaattttgaaagctgagctggggagctgataatgaatactataggcaacagtctgttgccaattcctcactgaggaaatgttaaggaaatagttttatattcatttatttgtagaagaatacattgggagatgataatgctctaagtcagtgaggttggtatggttaattggagggaagtggatgtcactgggtatgggtgcaggatgttgagaatgaagagaagagtctaaaatgattccaaggagtcagtcatcttgtttggaaggtggggagagggggtagaccaaaatttgcaactgtagtgaaacatttattcatcacattgtgtctggcaacattattttaggtacaatttatatttgttacatcgcttattatcattattgagactaggtgaagttaagaagagtagcagatttgcaagaaaaagttaaaaggggggatatatgtgctaaacttgcagctgtcattgtctgttgtttcatccccaaagcctgatgcagttatttcacgttgtctttatttctccctttgaatttctacccttattctctgttctgttcagttagagtatgacacatgtgctgtctgtattaggtgtttttttggtaatgcatcagaaccctgcacgtacattttaagacctttgaaaaggaaatctgatatttagaatgtgcttagtatctagaatggcactttgcacatattacaatctcagtaaatgtttttgttatagtattttagcctgacagagcaggcacttaatagctgttgaatgagaaaatgaatgacagctattataagaaataccaacaaagagtatcttactttaaaatatcaaaacagtatacatgtacatgaaatagttaaatataaaagtaagactttattttggggtgagaaataagtcttgataaagcaagtcattctggagttgagttaatgattagaatcaaaggaagaatattttcagtatagggaggactctttaaagtcaggaaaataaagagggaaagattgaaaatgagaaaaagggtaattaagagatattttagaacttgcaagaaagaaccggcatagggagtggcaagaggagaggaagcatgacactataggtctctacttctgtcttaacctggggaagaagttagatgagtatagaagggagatatgaaaaggaaatcatgtctgaccgcttctgtagtatcaaagtgggaagcccagagggagactgactcagtggatgagcaggggctttagagttttaggagaaatgtctgagtttagtcaaatctgaagaaagaagggcaggtagagtggtggtggatggtggtggtggtggcatatctggactggtaataagaacagcattgaaattcaggcctgcaaataagcatgagggtactaatgggactaggtgaaaatcacagtattaatataatcactttccatatatgtggaaataacaggttcagatatacgtgttaatcttttttactgtttgcatttaaaggctcttggttggtttgtgaatggcagttaacagcagaacttatttatgaatttatcttacactcttcttgacacttgctaaaaagagttcctcttttttgttgccacatgctacatttccatggtttatttggaatttacacgctgacagaaatgtttgtactactttttggtactccttcaaaatagggcagagaaattccacagctgcttacatagtctgttatctcttcttgtctcatacccattcccagttattgtttttcagtaaataccacttcagaggtgataagaggtctgtattcccaagtcttgtaggtggtgattttaccatcgtattttgtagtcaaaataattgataccaacgaagccagaagagtggtcactgtacccttctgtaacttggtagaattactagctaaataaataatcatttacatcatgtttttgtgccagggttcttgatttgtgattctcacatggcctgcatttcaggaattcatgagaacttccactttttattttgtcagtatgaaattcctggcttaggttgca

SEQ ID NO: 108039 - DNA, 1069 bp, Homo sapiens
gtaaaatgccactgtatacttttaagggaaagagagttttaaaaagcagctactattgtgaaagtagttttgatgtcatgaatgacctgaaagggcataagggaccttcaggagtccccatgctatgctggctgtttcttgcaagttctaaaacatctcttaattaccctgacctttttctcattttcagtctttccttttttattctcccgactttaaacataaagagttaagaaccactgatgtagatttactgaaactgttacaaaatacaggcacatattactggaaggatggatccagaagaactgctatgaagaaaaggagagaacttaaattaggtgattttatggaacttggaagactagaatttccaagtaggatagggatggtcagcactgtttcaggtaaggtaacttgatttgatcagttcatctagttaatctttaattatgtaaactataagatgctgatatagtaaccagagtttacatttatagtgagaaatgtaatagggaaatagatcagaatgtttgtttccaactgtggctctctgaaccttttcgaaaatcaaaggatagctgtggactttcccctaacaaatgtagctcctttcaaaattttgcatgcggtcatggatcaggcaaacgggacagatatagttcgtgattcacacaggcctatccatcagtgtactgcttcacctccctgtcctgttctgtgactttgtgagcttggaatttgaagtcttcctgttgtctggttacatcaaactgttcttgcagttctatcttggaaatatacatgcaaattaaatttaaatcttaaatttctccttttctggactccatgaatacccccaaatattgctgacattcgttagacagtacgtttacagtacagttaattgtgttatacctttccttttacatttaaactagttatacttttagtcaccttgatttaacttgggtgtttcctaggcaatattttggaacaggttccttctagtgatagttaaacacatctttttttatatggctgtgtatactacttttactctcagaac

SEQ ID NO: 108040 - DNA, 1035 bp, Homo sapiens
gatactttgagaccgtttaaatatcctctctctcaaaattttgcccactaacttcagcatctattggtgggccttgcctgtaatggttattaccatgatgtttacctaattgtgatttttgtcttttccgcattccttctatattgatgttccttgtagctgtcccatttcctccatttatttgttgtttttactgtttcattttgtatctgtggatatgcattttattctgtgggttataatccagtactgttgttgcttacgttcttgctcagattccatctttggtcattaggagctctttcagtctgggtcttatgtccttttgacatcctctgatccttttttgaacactttagcttctgacattatgattttctagagtcatcttatatttttccccgacccagctctgggctcaaccacttctcagagaactctggttcttttttgtttggataatggcatttagaaactaagttctggatgctaggtgtgttgggtgtcgttgcttttcagtgacctcagcaaacaagctaggaaaatacatgtatgtctactaacccacacatgcacacaacatctatagtaatttctttatattggtagggcccgggcatctgtattaaaagagattgagtgaaagagagaaagggattgtatagttaagatgtatctagattagcagctctcaaatgttctggccgtggggtccctttatactcttaaaaaatactgaggactcctcagagcttttgcttatgttggttatatgtatcagtatttaccatattcaaaactaaagctgagaaatttaaagttttatgtattaatttgtcacaataaaacttactacatgttagcatgtaacatttgtaaataaaaaataactgttttccaaaacaaaaaatttagtgagaagagggaaattgttttacatttttttgatatctctttattatctggcttaatataactggatataatgcatatctgtggtgacatatattaagtctgtgatgatatcacatttta

SEQ ID NO: 108041 - DNA, 1210 bp, Homo sapiens
tgtcagtttattccttactgaattcatctctatttttaacacatttcaatatattattaatatattaaagaatatggatcccttgactgatgttacaaatacttttccctaatttgtttttatgtcaggcttatttttcaataataaagtagttaggatttgatgcctttatatgaaaatgaaaatttgtgttttattctaccagcctttggaaaccgatattggtattataattttaaaattggaggcagttccaaagtacatcaataaaatctttgtatttgaatgttcaaattcttaatttgaaaatttaaaatgaagtagtcatataaaactaatttactatgttttgttgccaaacttggttttctaggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctgtaagtaattcctttataagatattaaacttagaaacataattttttgttacgtaatactgcaagtcatcgaagaaatttcagaaaatgtttcagggctaaatagtgttcttgaatagatatactaaaatattgacataaatcatatttgaaaggcaaaattaagttcttgtattatattattttagaagcttatttctttcaggataacaatatttctcaggattattttggtattaaattttaaatgcttaattttaaaagatattttatctaacttctaggtttctccttaaagagtaaaacatttgaatcttcaacgtaactagaaaaatatcacacattcaagggtttttcctacaaattctgtaattcttgccttcttaaatttttctaatatgctcctattctctgttctctttgtatcctccgcttgcttgatctgtttatctttttaaagtatatcagccctttactctttcctatcta

SEQ ID NO: 108042 - DNA, 1111 bp, Homo sapiens
ttttagtttgttttctaagaaatgtgataaatgaaatttttgaagagagcagctatttggtgatgtatgtaacatctttgacctttatttttatttgtttatttttgagacagggtcttattctgtcacctaggtggagtgcagtagtacagtcacagctcactgcagccccaacatcctgggctcaagccatcctcctgcctcagcctcccaagtagctgggaccacaggtgcgtgccaccatgcccagctcattattgtatttttattttgtagagatggggttttgccttgttgccctagctggtctcaaacccctgggctcaagcgatacgcccgcctcggcctcctagagtgttggaattacaggcgtgagctaccatacccagcaatctttgacctttagattttaactttactacctaaagattttgaaaagtgaaatcagatgttttgtacagatatactgtatatattctaggttgataatacctggtaccagggaagaaagattagcaagttatgaattacacatttgtgtattttgctgtttataaggtttttttgagctgttcatttcagtaaagttttctctgttaatgataaccttagtaaaggaaagagtattttgatttcagtagtgtgttggaatttaacttaggtatttgactgctgaaaactatgatcaaagttggtcattacttaggtgattaatttgggaaagaagtgactaaactgaaatatacttaacattttcgttatggtattgactactgtagtgattttctgtgtctacctttgtttacattttttatttcatcaagataaattccaaaatgtagaattccttgttcaaagaatatgtacatttttatagcttttgatacgtttcatagcatttgataccaaatggcttttgaaaatagttgatctaatacatacttttattatcagtagatgagtgtctttttttaatacttcaacattggatgtattttttaagagtcattatcagtttggtagatgaaatatgatagtgctgtttaatggtaatttcttggattactgctgagactcttttttatatgcttaatgactatttctaaatttt

SEQ ID NO: 108043 - DNA, 2085 bp, Homo sapiens
gtcttatagataattcagtaatcacttaagtttgatatattagtatatagacttggctactgtgacagaggcttataaaggtagaaatatatttatatttacttgaaaagtctgtgtaaactatcttgagattaaatggaggctgcaaaatcactgtgtcccagggctcctttgtcttgctctgctcttcttctatgcagtttctgtattgtgggcgaggatggttaccattgtgtctgctaataagaagaaaaagagaagggcattctctttacctttaagaggagtttgtgtatatcactttcactcagatccctctggctctttgtcacgtcacaaccagttgcaaaggaggctgggaagtgagtgactctgacctaggcagccatatgttgcacttaatttttattactgcataagaaggagagaacagattctggggagatagccagctatctgtcacattaaggtttgagtcagatttattttcattaaaaaaaaaaaaatggcctcaggcctgtaatcccagcaggctggcaggctgaggctggtggatcacgaagtcaggacatcgagaccatcctggctcacacggtgaaaccctgtctctacatacaaaaaaaattagccgtgcgaggtggtgggcccctgtagtcccggctactcgggaggctgaggcaggagaatggcgggaacctgggaggcatagcttgcagtgagctgagatggcaccactgcactccagcctgggtgagagcgagactctctctcaaaaaaaaaaaaaaaaaaaaaagccgttgattatttaaacagttaacttttttgttgttgttctggaatgagtcttggttactgtatagtatgtattaaaaataaccattagcaatctaggcatagtggtatgtgcacagtcccatctcatgtaattaaaaaaaaaaattaggtgtttaacatttgttcatagtatacagggaaattttgttttaagaagtttttttaaaatatttattatgtaagattacagaaactatagtttgaatattaatgtttgaattattgatatttgcataaaatgtaatggatgcaatgactagatccaacagaatgtcagattctgctttgcgtgaactttttttttaccttttccctccccctctccttgttaagataaattatagctgtttcttaaactgtttggatttccataaatttgatgttttagtatttctaaatactactatcttcttgatgttacattgttttacaaaacagatgataagtatttggaatgcagaatatgcctagattctgttttatttgagaggggcttcagtgtggtatagaaatgcctgttaactttgacttattcaaatatttataaattatttttctgtggtgaaaaaatagagttttttttaaagcttttaggtttttaaagtcatataaaatgattattgttaacgtgtaagttttctgattaatacttgtgttagcagctattgaaatagatatttgtttaaacatcctttcttgttagcactgatcagagaccattttgtccagttaccattattataaatgatgttcctattaggatattttgaaatagtagtactttaaaaattaacatggtttagaagatatgttttatagatacaaaatggtagttatacagaggtatatctgaagaggtctttgaatgtacttagacaagaaatagattttgttttattaataagagatgaagtagtttctgcttagatcaaaactatacttttcaaggatgaaagcaaatacaaaacttcttcagaataacaaatagcaaatttgttaaaggttctggtattaatcatgggtttcatctcaccaaatgatctggaggccggttgatatttgtatttctaatgctgatatttttaaggtataatttctcacggttagaaacataggttagaaatgttaatatccaagttaatgtaactggcatcctccaaataacagagtgctttggatcagaagtaatttgtgaaatctagcttttttcttttacctgttttcagaacaagttcctttgagtgcttctct

SEQ ID NO: 108044 - DNA, 1894 bp, Homo sapiens
tgagaggaatgacatgtatatgcttttgaatgcttggctgcaaaacattgaggcaagcaattaggagcttagtagaaatcaagtattttaaaatagattttttttgtttgtaactacctcaataacaaagctactgactagctaaatactggaaaatgctaaattatcagaaagactgtactgtttgtagtccttgataaagcatatgtaaatacagccttgaattgatgtacttggttattttctagagattatcaatttctagaaaatattctgcttttacatttatggcttttattgatgtgcaaggtatttatggatccctaaacttgtattaggactgttacataaaatgctttatctattgtttctgaataaaattatatttggcttgttctttatttctgataattcaactttcagtcttcattactttcatttaatatacctcagaaaaatcccagttacatgaataaagtgatctgtggtcggcatcaatgcagtaccaatgtggaatgttaattttctgtgttagtctctgctaaaaggttagttatagcatgatgtttaaaaaatatcgatggaccattttagcattattaaataccttttgctttgaacttttaaaatgctgtttgtgttttcaaaaactgcatccttaatatatttagattttttcagctgagggaaatgttactgtaagagtttatcaagaaatagtgctatatgagtgttggagagtatcaaaatatgattttagtgaaacacatttgtgctttccttcctatgttatgatatttaagatgatagtcaagtttattgtcctgacttcaaagaaatcttaatccttcactggaagttaagtttgaaaaagtccaatttgtatgtgagtcattgttgtgatatcatttagcatttgatggctcattgcactcagactaagtgttagttgttactaattttatttactctaacagtatctaccatggaaagaattttggtagacttaggacacttaaatgtaacagttttacctgacttctttaagactatgtttaatcctgattcttttgggggttaacctgtatttgtgtacttttgtaggatagagggaggaatcagcagcttggaaattcaagcacgtgatctggcgggatgggcgtttgcctaacgtatttaatggaggtaattcagcattctttgagtcaatctttaatttttacctgtaatggatgcccatgttactacacatacttacaataactgttgggtataagtgtgcatttatggccaatcccttttctttttatattcatataaataacatggtatcactattataaatattataaataatatgtagatatggacatatgtacatagaaaagaacattattaattttataagatgaagtcaattatcttctcttaagattacttgcatatcttttaggcctcatttcctttatgttaggaaggcaaatgatcctctcctttcttgttggcctatgttggtgcatatattaaacctatgcttttatctttcacacaacatgaaagaagatatctaacagttttcaaggagtttacatatatgtcagtggcacatactcatgtcagttattaatgatcataaaaattcttctgtttgttgtatttttaatttttaattttttaatagagacagggtctcgactatgttgcccaggctggtcctcaacccctgaactcaagtagtcctcttgcctcagcctcccaaagtgctaggattacaggtgtgagccactgtacccggcctgatcataaaaattctaaaatttctctgtgcattttaaaatttgttttttgagaatttttttttttttttttttttttttgagatagggttttgccc

SEQ ID NO: 108045 - DNA, 1022 bp, Homo sapiens
caaatcttctgttgaactgcattgtgtttacagtttcacgtctgtgaaaaggtcagcaggtaacttgctttactagacagctttttactgggtattaagagcaaaaaatgtacacctgtatccttatattaaaaaaccctgcttgtctagtggtaagaacaatcctaaggcctttccagaattgggctgtggggcaaacttttgctctccagactttgtgaaacaccttttacgatgccaggaaagaactacttgtgcagtagaatgaaagctagagttggaaatgcaaaagttgaagctctttccaacagcttgcatttaaaacagctttttgttttatataataattgtgatttgttgagtttacatgaagaattttgcaaaattaggcatggtgtgattaaacaagagcgtttcttaattttatagagggcagtggtaaaggcaccactcagtttggaaatttcaagtatgttgaaatgttgctataaataaaatcctattcagatttttagatttaataaatctaaaaatatatttgcagttgtcctttgggtgcaggaggaagtcctgggtttctctgtgcttgtttctgggcagattttcagtattgttagcatgatacaggtatagaaccttaacctgagtgaataatttgcttgagattaccagtctgttttggagctggaatagactctgggtctcttatgcccagtctggtgaccaatcccagaatagactaaggaaactgggtgtttgtctgtttggtggaaaatagggctgagccaaaaaatgaacgtgtgaacgtttacttttctgttaaaacatttaaaagtaatttctccacactggatttctttggcctttctttaaaaacagaggacttgagtatattacccagtggtacttctagtgggatttgtaccacatttacatttgattacaacaggcagatgcttatggtttttaacggggggaagatatatttttcatgcgagtgttctcagtggttagaataggga

SEQ ID NO: 108046 - DNA, 1101 bp, Homo sapiens
ttgtgtgggttaggccaatgatgagtatcttaaagaaggtgatgggaaggattatagtagacatggagagaagtgtgttttaaatgataactatattaattcaacatagataaatgtcttcacaatacaggggtttgacctttgaacatctagggtggcatggagaagttttccctgtaaaattgagaagagccaatatccaagagattagaatgaaatgcacacttgctgttctgcaggcccctgtatatgtgtacttgtcatatgtacacacctgtatgtgtagatacatataatattaaaatttgtttatttgattaggttgtataattagttttaagggaagtgggactagtagtggaactagttttgagttatgaatgagttaaatgaattgttacagaatatttggaaaggtcattttcaaggttttggggacgagcctaggaaacagatttttctgtagccataggggcttctggaatagatgcacaaactttgatggcagtttggggcaaatttgtgtaagttggagagtgttagctttgaggaaatgagaacagacaagaaaaacgcagtgtttgagaaagttatttatgtattgatttggtaggagctgataaaaaattataaaagttgtggagagattttgaatagctaaagtgggagatatcatggaagtgatttatgaagcttttttttttctttttcttttttgagatggcatcttgctctgttgcccagagtggagtgcagtggcgttatcacgcctcactgcaacctctgccttttgggttcaagcgattctcctgtctcagcctcctgaataactgggattacaggtgcccgccaccacacccggctaattttttgtatttttagtagagatgaggtttcaccattttggataggctggtcttgaactcctgacttcacgtgatccgctcgcctcagcctcccaaagtgctgggattacaggcctgagtccccgcgccggtccgatttatgaagcttgttacttcaagtattagaaaagtaaaatggaaagatggtttagagaagatttcttttgggaacaatataaaacaagcaaggcaagaa

SEQ ID NO: 108047 - DNA, 2134 bp, Homo sapiens
tctctaccaaagataacaaactttgctgggtgtggtggcgcgcacttgtagtcccagctacttggggggctgaggtgggaggatcacttgagcttgggaggcggaggttgcagtgagctggtattgaaccactgcactccagcctgggtgacagagtaagagcccgtctcaaaaaaaaaacaaaaacaaaaacaaaaaaagggtaaggactttggtgggggatcatatgatttggaacatagattttttagtttttgtttttttttgtggtcttcaagagagcagttcagagaccagggtgcatggtggtttactgagtgggttggaagaatatggaagcaataaatacaggaattgattaaagaagtttagtttgagaaggaagaacaacaactcttattctaaaactggaggcaagaagtaacagatggatgaagttacagcattttagaagctgtgaagaggatttgattacaggtggagaaggtgtgatttgagggaattttatagaagggttcgagtatttgttggaattagggatttaaatatgaaaatgatttggattagtcaatgagacggagagttgtatttagaataaatctgttgtggaagatttcatagctttctggtggtgcttaacacccagtgcgtgggcatggagaaaacagatggtgaggattgtctatcactggggagatgcatagtgagaataatggaaggtcatgatattctggagaggacagtgttaaaatggctgttggacaggtttaaattatatagggagacaataaagccaagtggaggtaaagagcaggtctacaactagaacataaagtagttgtggataaagaaaaggggggtggtctctgaagttacaatcctagtggattgtaactatttttttttttttgagacagggtctcgctctgtcacccaggctgcagtacagtggcataatcttggctcactgcagcctctgcctcccaggttcaagtgattctcctgcctcaaccacccaagtagctgggattaaggcatgagccgccatgtccggctaattttctgtatttttaaaggagacagggtttcaccatgttggccagggctggtgtcgaactcctgacctcaagtgatccacctgctttggcctcctaaagtgttgggattacagacgtgagccaccacacccggcctagcacttttcagttgatggctctgttttgtttctttgtggctagctgaagtgcagatgaaggtcttaggagtttttgaaggtcagggtgtagaaagttcttgagcatctttgttgaagtcattgagaataatggctgaatttgggagcaagcagaattgaagttattgggtaggggaaataggagggtgttctggaggttggtagatgttgcagaaggaatggtttcagtgagtaatgtgactcccaagcgattttttagtgataggataacagggagtggtcctggggagcaagaagcagcaagtccttttttatcaagctgaaggagtaggagaatgatatagctagtcatgagagaagcagattgtccaggaaaagccaggtaagatgagacaggtggtcacaataattgggcaagagttgatagtgattggaatcattgagccacgggaattgagaaaaatagctagatttgttacatttaccagttctcttattattattattttttaatttttcagacagggtcttctctgttacccaggctggagtgcagtggtccagtcatggctcactgcagccttgcctcctgggctcaagcaattctcctgcctcagccttctgagtagttgggattacatatgtgtaccaccatacctggcttttcttttctatatatatgtatatatatattttttaattttttaattttaattttaattttttttttttaaagagatgtggtcttcctatgttgcccaggctggtcttaaacttctggtctcaagcgatcttccctccttggcctcccaacagtttgtttataaaataaataatacttgcaaaatcataaccattcatgtgtaatatgctgatataaatttagctgaaagatatttgtgggttaagaaatgagacattggaaacaaaagatgaggt

SEQ ID NO: 108048 - DNA, 1456 bp, Homo sapiens
aatttagagttgtagaaatattcaaatggcagcagctgaaattggattatatttttgggtagtttagtgcagtacattagagtataattttagtttctttcatgtagtaggtgctcaattatttgttgaatgatagaaactaaatacgtggactgtgggatgaattgtgagtagaagcagtgatgggtggatgtgagaaggagggttagactggaggatactttgatggactgccagaatttattcgttcagggtatatttttatatttactgtatgcaatggactgccagaatttattcattcagggtatatttttatatttaccatgtgcaaggttctatggtagggagtgtgaaggatacatgtttatatatgacacagtccgtgttcttcaggaatttatccagggacaaaacatacacatccatctatgacacaagtactgtggcaggtttgttcaaggttggctttgtggagaaattggtgcgaagcttagaccttgaaggataaataagataataggcaagaaggtgagggttggctttcctagaagaaggagtgatatgagtgacagtgagcaaagttcaggacatgtttaggggttggtggtctagattagctataatttagggttcatgttgaggaatggagggaaataaagctgggaagtaggcagactatctcaaaaattcaggctaacttggattttgaaaatgtatttattgagataaatacagtaaagtgctccaatcttaagggcacttaggtataaatttatgtagccaccacccagttcaatatacaggacatttccgacttccagaaggatgcctcatgtgccatttccaagctgatatctcatccaaccaaaaataactattattctgacttttgtcataacagagtagtgttgtgtgtttttgaattttgtataagtggaacccaatttctgtgtctagttcctttttctcaaggagcatgtctgtgagttttatccatgttatgtttggctgtttattcttttttcattgctgtgtggtattctatcatatgaatataccacagtgtatttatctattccatgattattggatggtttcaagttttttgaagtctgaggtgttctgtttgtttttttcaggcagagtctcactcacccaggctggagtggtgcgatgtctgctcactgcaacctccgccttctgggttcaagctattctcctaccttagccgccctagtagccaggattacaggcatgtgacaccacgcccagctaatttttgcatttttagtagagacagggttttgccatattggccaggcttttctcaaactcctcacctcaagtgatctgcccacctcggtctcccagagtgctgggattacaggcatgagccaccatacctggctgaagtctgaggagttttaacttaagtcagtatgcagtggagaac

SEQ ID NO: 108049 - DNA, 1081 bp, Homo sapiens
aaaacaagaagtttcataatacagtaactgtccttaacagtggcaggtgcagttggatgttatctattttgtttgactaaaaagaaaaaaagctggccaagggggaagaaaaaaaagctgattgtcactcattaaactgatttcatgaccgacaaaataattaatcacaatctatagtttggaacgcagagagttcatgaataaggtataatacaaggtaggagagtcagttggggttgggttgaaaatggatggccttgaaagctaagctaagtagtttgtatttgatatgatgtagtgttgtgcttggtaagcaaacagaagctgggttttagtcttggctcttctgtttacccactgtatgattatggagaattatttcctttctgagtttccattttctcataaaattgataatcatactttcctggcaagggttatggtgaggatgtgagaattaaagtatgttaacatatgattaaagtatgttagcagaaatcattagtgtatagctgttgaacttttctgagtagagaattgagccaaggaccgtatattagatagctggcaatagctataccttactgggtagattgcgggtaatgtggtggtagagtaagattgtatgtgaaaagaccagttagaaaacaaaaagaccagttaggtggctactggagatattaagaagggcttgaattagtttgatagcagtaggattagaatatggaagtggaatgcagttggaggtagggaagaggggaagatgactagaaatatgctatttatttatttattattgaatgaacgaacgtgaggctcttgatctgttgcccaggctggaatgcagttgtgtgaacgcagcagctcactgcagcctctacctcgtggattcaagtgatcctcttgcctcagccttccgagtacctgggaccacaggcatgtaccaccacgcctggctaattttcaattttttttgtagagatgtggtctcaccatgttgcctgggctgatctcaaactcttgggctccagtgatcccctccctcagcttcccaaagtgttgggattacaggtgtgagcca

SEQ ID NO: 108050 - DNA, 2054 bp, Homo sapiens
ccttagcctctcaaagtgctgggattacaggtgtgagccactgcgccgagcccaagaggcacacttttgtttgtttgtttgttttttgagatggagcctctctctgtcacccaggctggagtgcagtggcgccatcttggctcactgcaacctctgcctcccaggttcaagcgattctcctgcctcagtctcagagtggctgggactacaggcgtgcaccaccacttctggcaattttttgtattttttagtagagatggggtttcgccgtgttggccaggctggtgtcgaactcctggcctcaagtgatccactcaccttggcctcccaaagtgctgtgatttcaggcatgagtcatcacacccggccaagaggcacacttttaaataatacatggtataatcttattctgaatggtcttattgatgacagatctttttactttgaaattttgatttttagaaatgctgaaggttagtcaatatcaaatagagtgaatgaaaaatagttttgccttaaatccagttaatcacagaaacgggaataattttcttggttgacttattagctgattttgaaaacactcccaaggaggaagttggaaatattttgaacaggggtgatagcttcacatgtagttagttaggcactacataaatgttggttgagtgcatcagatggttggatggatggagtgaataaatgagtaagtggtagccttccaaagtaacttattttaaagaggaccatactgatttgaatgtgtaaataaattttttaaaaactcatttttctcagatgaaataaattctgagtatgtttgttaataattttattaccttgagcaagatagtttaagttcacaaatgagttttacagacagtaagtgctgtaggagttcagggaatggagaaatgaacattggctaaggtttggtgaaatgatttaagtgaaccatacttatatttgaaaagattccttagggatctcagagaggaactaaatgactccaaattcctcttgcagccctaaagtgaacctagagtctggatctatttttgtctgaatgctttctgcctgtttcattttagctactcctactggtttgttcctttcagattcacatttgttggtagatgttgagccccctgaaacaactatggggtctgttttccgtcttcgtatagtgtaacttttagttgttcttttatgagcctgtaccccacaaattacttggccttcatgagagaagagcatgagtcaacttggccctgttatcctggcattttcctgcatgcttttctcaaagctgctttctgaattacggaatagaatagacagaactgagggcatgtgtccagtagacacgagcttgttgaatgaatgaatgaatgaatgaatgagatatttgagataatttaggagatctgaattgtctatatgttttatgtttctttttcatttattcataacctgcctttttctacaaaggacttaacagggctgccaaactatatgcactagcaatgaattgaaataattcaataaatctggttaaagagatgatgaagaaaagaaaaatctgtttaaagaatatagatcaatgtgtatcggtgttagagaactaggaataaggtagaagataagcagatggggaaggaaaggtggtatctgatagaaagcatgattctgaaggagggaaaagattactgaaatatgacaggctatctttggaggaaagcatgagaagatggagggtaaagaggattatttgagacggctgttttgaggaggaagatggtaaggctatttgaaggataagagtcaacagaagtttggaatatagtagaagttattaaattatgttgatttataacaaggtttcagaaaatgatgggatgagctttatttaacagataatgcacatttgttatatgcaaaagcatataatgctttgctgtcaggaataaaacctttgggatttatattgtggtagggcagctggacttgtgcacaaatacctgtactataatcacaaatatatctgtgagtca

SEQ ID NO: 108051 - DNA, 1037 bp, Homo sapiens
ctgggcccaatctcctctgttaggttagagtcataaaatattaatgtttttgaaatttgtgtatgaggtgcaaatcactatggtggatgttgggagattagaaagataattactccacttctttttgggagtctaagtaatggcaactcttgagagtcttccttactttcagtagtaacagtattcacatgtagtttatgtattgctaaattttgtatttgtgacaattattctctttgttttgcaaatggtacattgtaacctgttctagagcagagacttcctgtagtctctagggaaactaacagcaggttgattcttaagtgcttaataaatacctgttgaatgactgatagaaagtagtgttcactgttagtgataatagtgggattgtatgaaattgctgagtactttgggggtattgtaggcaaaactgtgtgtgtgtgtgtttgacagcgtgaaggacaaaagggatatctggagaggacctttagatttaagggaagaagacagactggattagaatggaattgcagtggttctgtaacaacttggaagaggtgggaccaaggggtctcttctaaatttgaagctagtttaatctggagtaaaatctggtctgtagcagggtgctggtttaatttagattttttttttttacctcaggcataaatgactgttttaggactgtctgatttaattcttttttaggatagtaaaaataacagataagcttcttctctcaaggaatttgtagtatttacaatttttttttttttgagacggggtcttgctctgttgcccaggctggggagcagtggtgcgatctcagctcactgctgggttcaaactccgcctcctgggttcaaacaattctcctgcctcagcctcccaagtagctgggattacaggagcgtgccaccatgctcagctaatttttgtatttttagtagaggtggggtttcaccattctggccaggctggtcttgaactcctgacctcaggtgatcctcccaccttggcatcccaaagtagta

SEQ ID NO: 108052 - DNA, 1420 bp, Homo sapiens
cgcaggcctcagtcactgttgctgccggagtgtgctctttgggagaagggaagggcaggggttggagaaaagggaatgcttgcaggaaacgtagtgggagtgcgaacagggcgaggggccggaggaaagatgccggagaggtggaggaatgcggggaggtggctgtggaggagtcttgaggattctggggggtgttcattgtgcagatacgttaggtatttcattatggaaagaactgaagcgtttctcagggaaggaaagaagggagataggagttcccgtgaatagaaaggatcgcgtttgaagcaagagggagtgctaaatagtagagaagatgcagggaatgcataatagaatagacagatgtagtataattaataaatattggcctaagtactgaagagttattccagatgggccgggatggcctagttccgaacctgtgtgggctgttcagtagatgacatctggtaagtgtgggtctgggccgtggttggggtcactgagaattagattttagtctgtagtttggtctgtgacattttagacgtgcaccaatgagtatgagaacctctgaagcagaccttgagaaagggtctggcctgtggggattccttaggctatggagcttcgattttagaaaatttgaagtattaacacttacccgaggttgggtaaatactatcctggcaaacgctggaatggaaattaattgacttggtggttttcttcactgcccagtttatctggtccaggagaattggtgccgtattattcagcctggattgcagtacacaagattataattaatggtcggggggaagacatgcttgctggctcttctttagatacttcatttgtagctcaaattagttggctggattggttccataaatctgtggctggtgggagatcttctgccattcacagttcctgaagtgaactgtgagggagttctccagtgagagaatactctcattcaggcatgatggcattgaagaaaacgtatcagccagcaaagtgtgggcctgcagaatggaggagctagaatatctgttttggttttaggttgcaaggaggtcaggactagttatcagaaggtctaggggaacctaggagactggacgactctagagccaggttggagggaggattagcatctctatgtcaggaaatgaaccaagctctctctggatttgctgagctcacaccagaccagatttccaagagggaactctgggctagaaccatactcttaaaaactacccggatattattcaccttttattaagaaaaaactatatacagctgggcgcggtggctcacacctgtaatcccagcactttgggaggccgaggcgagcggatcacctgaggtcaggagtttaagatcagcctcgccaacatggtgaaaccccatc

SEQ ID NO: 108053 - DNA, 1051 bp, Homo sapiens
gcgggcgccgagtcgcgcggtcaccgactgcaggcggcggcagctccaacctttctaggggccttgagaggaggggaaggggggaggggggagaacttttgctgtggcagcttcggcaacagctcccacccctgcgcctttctcctcttcctccccctcctcctcctcctcctcttcctccttctcttcctcctcccagagcagtagagacgcagacatgccgcagctagagcgccgccgcggtcgccgccactgccggcccggtgcattgtgggaagccccgcacacgggaagcgctccgcggcgcccgccctcgtctggcgcagagacctggctggaaagacacagcgtggcttcgattccggcgcctgcgtgtcaccagcccagggtggccgtggaagctggacccgagccgcaggccccccaggctgggcctgggaggaaagcggtttgaaaaagatcggaactgaggaactctcttagagcgggggactccctgctcctacagccttaaccaatgcccagcgcttggaaagtggaggactcggggattcgggagcgtttcaggcctggggaaatggaagggtcggggacctaggtgaaaggttatttgccagaaatgtcttggctttttcatttattctgtcttacctagcccttcgccgccacctccagtcgttggcctcttaccaccttcaaatgccaccttttccggaagatgtagccctgcgcccttgaaactggcaaaccctattagtgtctgcaagctgagatgcagggtgtgggcatagacacagatcaagagatccggccctggaccctcttgggcagaaccttgcccttctcatttcacctgaagcccaaactttgtatggcaaagacttggtaatgatctctatagagctaggattacacagttgtctcatcctttgggggccctttagccaaactgtgacctccttaatggtgccttcgtcagctaacattaggcgccctgaggtgcttctgcatactgccatcgtttacaattactcatctttgtgtacacacc

SEQ ID NO: 108054 - DNA, 1197 bp, Homo sapiens
aactcagttttccaacaagttgtaggagttctttttccattttgaagataagttcgtattagagattctgtttctcttttcagaagcattagacatttgcttatattagccacttcccaaaatagtgtcatattttctcgacttcttaattattccaaaaagcaaaacttagtgtaccactaagccaagtacttgggttttcagattccttccaaactcacattttaaagtttttatttttatttttagggaattcaagtttggaccaatgctaaggaatgctttagcaagatgtaatcctgtgaattgaatttctcttcaatcaaagtgccccaaaacagaagcacaagtaaataaaagaaatttaagtcactacctagtatacataaacatatacaataagttaaataaattcagctttctttaacttaattgtggtcgtgttaatgtagcacaaaaaatatattttaatgaagattaaatattataatttgaggttttggggactggtgctgattccaaaaagttaatttaataatatataccaacagattgtttgtcacgcttctgaaccaatgactgaatgtcaagatgttcgttaatttctagatgtttgtttcaagaccagctgtttcagatctattaatgtagggaatttttccctaagattgaattcctatatttacttggtaagatccactaatctgttatagggagttgttttctcttgccttatagttgagctatttggtttgacaaagctcagcagaaacttgatgtgaaaaatctacgattttcttctacattcattgatgccccttgtaatgtttgcatacactagaaaatgccttcaatttgtgttttaccagaattttgatactggtcagaaattttatactgccaacaaagaagactcaacttctcagatctataatgggatacattgtcatcctctagcaactcctatatagaaagttttaactgaatatgttacatataagaattaaattcttctcaaataattcttaacctcagtaatgagcctaaatttactctgcttggctctctacacatggcatttcagggtataagatgtagcatttcaatgtgtaagatatatgtactaaacatatgtgttgctatcttcatcattaacatccttcttttctattgcttggctgtaatttttgtaaagat

SEQ ID NO: 108055 - DNA, 1076 bp, Homo sapiens
acacaacctggatccctcacatgcgcagttcacaatagggttcgtgctcctaagagaatctaatgcctctgctgctgatctgacaggaggcagagctcaggtggtcgcttgcctcctgctatgcagcctggttccaaacaggccatggactggtatcactccgtggctctggggttggggaccccctgctttaaattatctctagattattaatacctaatacagtgtaaacactggtgtctcatataagtggaatcatacagtatttgtctttttgtatctgtcttatttcacttagcataatgtcctgcaggtttatccatgttgtagcatatatcagatttgattccttttaaaggctgaataatgttccattgtatgtgtatgtgtatgccgcattttgtttatccattcatctgtttctgtttccttttagactgtgagaacattctctttgaagggaatgactaccaagctctttggtcaagaaactccagagcagagagaagccagaataaaggtgctagaagaacaaataaatgaaggagaacaacagctaaagtctaaaaatctggaaggcaggtaaagatgctgcgatgtttaagtaagctaggcttgtagactatatggtagattattttatttatttatttatttattttggtaacaattcccagcttcattggcatccctgaatacagcctattcctttaaaatgcattcctaagaaatttgagttatcacgctgggtgtggtggctcacgcctgtaatcctgacactttaggaggctgaggtgggaggattgcttgagcctgggagtttgagaccagcctgggcaacgtaggaagaccctgtctctacagaaataaataaataaataaataaataaataaaaataaaagaaagttgaattatcaaaaataatgttatagaaacagttgtttcaatgtgggggaaagagaaataaaagtttcaacttcataatattattttcctgcactattcctgatttctaccctttgtactttccctccaccatttcttctcccctcccctccttcagtacccagctgaa

SEQ ID NO: 108056 - DNA, 1032 bp, Homo sapiens
gtagcttgtacaacgtccttatgtaacaaggactttcttatctgttcttatgttatcttttacagagccaaagggaattctcttttagatagtcctacgtgactaggaaaaagttaatatatttttttctgatcagtttagaaaaaggaattattttcccagaataggtggcttttggtcagttgtcctgtcacttttttttttttttttttttgagacagactagagtttggctgtgtcacccaggctggagtgcagtggcgtgatctcggctcactgcaacctccacgtcccgggttcaaactattctcctgcctcagcctcctgagtagctgggattacaggcgcccgccaacacacccagctaatttttgtatttttagtagagacagggtttcaccgttgttggccaggctggtctcaaactcctgacctcgggtaatccacccgcctcggcctctcaaagtgctgggattacaggcatgagccaacactgtcctgtcgcttttaaaagcagtataagaattctgttaggaaaacaagagcactattcccttacctctgtggtgattggtgtgaaatcatctgcacattgttagctcgttttccttctagggctttgagtagtaggaagtctcaccaatgtattttcaagtcaccaagcaaaagaaagttggctaggtgaggtggctcctgcctgaatcccagcactttgggagcccaaggcggatggatcacctgaggccaggagttcgagaccagcctagccaacatggtgaaaccccgtctctactaaaattacaaaaaagttagccaggcatagtggtgggtgcctgtaatcccagctgctggagaggctgaggcagaataactgcttgaacaggggaggtggaggttgcagtgagccgagatcgcaccattacactccagcctgggtgacagagtgagattctgtctcaaaaaagaaagttgctgagtacagtggaattctctgcagctcttaaaaattataaaagggattaatgtatgttg

SEQ ID NO: 108057 - DNA, 1383 bp, Homo sapiens
tatgttcatcatccaaactgcactttttaaaaaaatgtgcaatggtttctgtcataaacaactcacttagcctgttttctctccatggtttgtaatagaatagttgttttggatgttatcaaaaggcctgccatttcagtgctggaatgtaaataagtgtaggattttagatctacacatcatattctttcatgttttttttaaaggtccgtgaaatagtttataggtgttaggccatcctgtgtctgtgctcttaaattctaccaaataaactaatttcagataatagtctgccatgacaaaagggactagaaatcaaggaataataattatacttaaccatatagttcagctgtaataggcaaagagggaaatacttctcagtaaattaatgtacctggaaaatgtaccatccgctctggtctcttgtggcaacctagaaggaaccttagaacatgcctgtgccaaaggcattgaaagagactaggataccaggtaaggtcacattttatgctgattggaatctggaatcctctttgttgttattattattattattattattattttgagatggagtctcgctctgtcacccaggctggagtgcagtggcacaatctcagctcactgcaacctccacctcccgggttcaagcagttctcctgcctcagcctcctgagtagctgggattacaggcatgcagcaccatgcctggctaatctttatttttagtagagatggggtttcaccatgttaacgaggctggtctcgaactcctcctggccccaagtgatctgcccacctcagcctcccaaagagctgggattatagtcatgagtcaccatgcctggccagaatcctcttgaaatgaaatatattgcctggaatttgttttaataagagtccaccgatgagcagtggagagtgggggcagttttaggagaaatgagtttggctatatagtaattactgaagctgggtgttgagaaatggaggtatatccttctgttctatatgctttttgtatgtttcaagatttccatgacagtacagaaaaaatacaataaaggaaaaaattcttctgaaggtcttatattgtcttgatctcccgtttaactgttcaagagtatcgttggactctttgaataaattataagataccttctcataaaagttacctgcgagaattattaggctagagtcaagaactgggtattagaaaggactgtggattaatgagataaaatttgtggacctttggttgcctagaaattacccagacaaattaggcaatagttctcgtgggaggtgcagatgggggacaaacattcagagagtctgcatcgtaccctcacattgcttctagttttttttttttcttaa

SEQ ID NO: 108058 - DNA, 1107 bp, Homo sapiens
ggctgaggtgggaggattgcctgagcccaggaggcgaaggctgcagtaagtggtgattgcaccactgcactccaacctgagcgacagtgggaccctgtcttgaaaaaaaagaaaaatgtatgaaaagttctttacttagtgcctggttcataatcattctgtagttataattttaaaggtgattgtatttatgtgtatgtatttttgtttataaaaaataacaagtgttgttctgttccttttcaggtcagttgaacataccgatggtcagagtgtcctaacagactcactatggcggcgatatagtgaatttgagttgttgagaagctaccttttagtttactatccacatattgttgtgccacctctgccagaaaaacgggtaagaagtgaaatggcagtagtttagaagtattcagcattgagactattcttaatgattattttgtttacctaggcagaatttgtttggcataaactctctgctgacaacatggatccagattttgtggagaggcgacggattggtttagaaaactttctcttgaggattgcttcacatcccatcctttgtagagacaaaatcttctatctgtttttaacacaggtatttttcttttatttagtcttagtaaaatattcatttaatttgggtttcttaaaaaaattgtagaatacttattttaaggatcttttcattaatttatatgcaatttattttttgttatgaatttctaattaatggattatgtcattcttttggttaactttttctatttaaagatactgatgatggtatttttggtatcatttaaataatattaaaatttgtcttcagtattttgaagcccagatctataaaatcttgggttcacctttggtaatcttttagaagttggattgaatgtttaattttgaagtgaaaagaaatttttttaaacttctctctccaattcctgctgaagtaagaacagaatgatagaaatttaatttacttaatttggaatatttgctttgcaataatgatttctaaaattaacttcaatttttaggaaggtaactggaaggagactgtgaatgaaactgggtttcagctgaaggtaagaa

SEQ ID NO: 108059 - DNA, 1039 bp, Homo sapiens
aaactcaaaagaaattggaggcgtagtctgacctgctccttctgggcctctgccttgccagttattattgggtctgttttctcccggaaagatcagagctctataaattgttaactttcagcaggttgagtaacacattcagcaaaaggtaatacttgcaagttttttttttttctttttgagacggagtttccctcttgttgcccaggctggcgtgcagtggcgcgatctcaggtcaccgcaacctccgtctcccaggttcaagcgatcctcctgtctcagcctccggagtagctgggattacaggcgcccgccaccacgcccggctaatttttatttatttatttatttatttattttgtatttttagtagagacggggtttcaccattttggccagcctggtctgcaactcctgaccttgtgatccgctcacctcggcctaccaaagtgctgggattacaggcgtgagccactgcgcctggcctttgcaaggttttgaggaaagtgaagcgttctgttgaagcagggcttgagttctgttgtaagtgtttcatgaagccctggagacctctgataattttctacaaacatccctttttaaaattttccaaacctgcttccttgacaagctttcactatggcaaccggatgggaaatgctcactggtggtaacagattgtggtaccttgaagtactttctatacaaagtcgggtctcaatttttcaagtacagaaacatttttctgcccacttagttatttcaagctgtaacacacaattttctcttcctggaatgctttatctgtcctgggagcaaattttcattcattcctaaaacctcagctcatttataatcttcaagtgctaagttgttcataaatctgttatgggctgggcacggtggctcacgcctgtaatcccaacactgggaggccaaggccggcggatcgcctgaggtcaggagtttgagaccagcctggccaacatggtgaaaccccgtctttactaaaaaaatttgctggacgtggtggcgggcg

SEQ ID NO: 108060 - DNA, 1132 bp, Homo sapiens
accagcagagtgacacatactatctaaaactcgaccaaatgaggttcttctctgtttaccctaaatcctcccagaatggagtcattgcactgagtgacctgcttcctgattgcgcagactgaaactagctaaacctgaatgtacctactagggcaccataatactgcagcaagaccaaagtggtaaagaaacacagtggaccttttaccaacctgttcatgtgatgtgagcaataccatcttaaaacttgttacctgaatcagtagatgaatcttttatccagttcttgctcctaaagttaagtttgaatcccctatttttgcacaggggcagcagatacacacaacaatgagaactcagtgactttgatttctttgtagtgaaaagtgaagtctccgtttcagagtttgtgtctttctttctgtccataactgaagtattcactactcttgtaaaccaaccaagaggaggagaaagatgacccagaagtggattcagccattgtgcctgaaatcagtgtttaaaaaaaaaaatcaaccaggttgtggtaacaaggcattctatttcttcaaaaagactgtatgcctgtgtctgaggaacttacctattatccacctctgttggaactctcttttaaaaagtacatttatagattgatcagaattataaccatggagaattttttcttctgagcattttaatatacttgaaaacaacattgacttgaaaaatttcagaacatttttcagtacctagttttattaaatattacacttgagagacactttttaaaaatgtgttaatgtcaatatgatgagattttagcctttctccagaactaaggcattaaagaaaatagcaaatattaaaaaataaaactgttacttttttccttctttcttttcacctttaggttaatatccagtattatgtgttatccctttggataagtatgctttattttacctctgttaaaaattaaaataaatgattctattcatatttgtcagtaattcaaaacttatatgtgtaactgaacgcgcatgtaaggtatggttttatttattttttttttttttgaggaaatttaaatgctaaagaaacaacgaaatgaaaaggtatcaggaaaaaa

SEQ ID NO: 108061 - DNA, 1030 bp, Homo sapiens
ctgtattattttttttggagacaaagtcctgctccgtcacccaggctggacttcagtggtgaaatcatggcttaatgcagccttgaccacttaggatcaagccatccacccgcctcaacctcctgagtagctggaactacaggcatgtgccatcatgctcagctaactttttaatttttattcttgtacagagtgggtctcactatgttgcccaggatggtattaaactcctgggttcaagcgatcctcccacctcagcttcccaaagtgctgggattagaggtgtgagccaccgtacccggcccccaaatcttgcagttagtaaataatagagtcaggatttgaatacatgtctaaaggactcaaagtccggttcttcccaatacttctaggtacaaatttccttaaaacaacttgacctgaggtctgacattaccattattttgtagctatgatatacaaataaaagttaggtacttcagagaaatattttacaggacaaagggaaattgagaaaataacccgaagaaataaaattctgctccgattcaaatctgtcattctgcttacatgcagcagcatgtaacagaaacagacttcctgcataaacagaagatacaaaggcagagcttaggaatttaaaagtaaaagcttgtaccaaactaccgtaagaaaggtatatttaaaaagttacgccaatgattaacacaaagcaaaagaagttaggttatggaaagcgatgctttttcttttctttcttttttttttgagatgcagttccgttcttgtggagtgcaatggtgcgatctcggctcggcacaatctcggctcacagcaacctctgcctcccaggttcaagcgatactcctgcctcagcctcccgagtagctgggattataggcatgtgccaccatgtcctgctaattttgtatttttttttttttttttgagacgtagcctcactttgccgcccaggctggagtgcagtggcacgatctcagctcactgcaagccccgcctcccaggttca

SEQ ID NO: 108062 - DNA, 1029 bp, Homo sapiens
atgcctgtagtcccagctacttgggagggtgaggcaggagaatcgcttgaacccaggaggtggaggttgtagtgagctaacaccactgcactccagcccaggcaacagagcaagaccctgtttcaaaaagaaaaaagcagttaagggaccgggcatggtggtgggcacctgtaatcccagcactttgagaggccaaagcgggtggatcgctcgaggtcaggagcttgagaccagcctggccaacatggtgaaactccatctctactaaaaatacaaaaatgagctggatgcagtggtgcatgcctgtaatcccagcgactctggaggctggaggagacattcttcactctttttgaaaaattctattttccccccaaaaaagaaaaatagttcttatgtgatatatatggcaaaactgcaatatgttcaacatcagcaataatggggctctctgaaggaaatttataccatggacaaatagttgtatttctgaaagatttttgcccatactcagattcacttaggtcaaatacaaatgtcttcaagtctgatatttattgttttgttctcaatggatatgaataggtagttaaaatactagacttttgctttgttttccatcaaggagcctgaagaaataaatgcagatgatgagatagaggatacatgtgaccacaaagaggatgacctgggagctgtagaagaacaacgtagtgtcatcctacatctcttgtcacagcttaagctgggcatggatttaacaagagtaagtaatggcataagctggctatggagattgttaagggctgtaccagtaattgttcatgtttatgtcaggactttttatttatttactttttaaattttaattttaattttttttgagatggagttttgctcttgttgcccaggctggagtgcaatggtgcgatctcggctcactgcaacctccacttcctgggttcaggcaattctcttgcctcagcctcctgggtagctgggattacaggtgcccaccaccatgcccag

SEQ ID NO: 108063 - DNA, 1030 bp, Homo sapiens
taggttatctctttaagttatattaccaagtagcattactgagtcaagagtaatgcatagtttatggtactttatatattcgtaaattacttctttaaagaaatatatggcacagggacttccaaagttggcaaaagttttggcttgataagacaggcattgcaggcaagggttggcaggggagaagaaaaaacaataatgtataaaatgcttatttctctgtagctgtttgactggcttatttgtagaaacagcagttagtaagtatttattaagcttagtatatggcaagtacaatgctaagaattagaggagaagcaaaaattagaagatacaggtttttcactgaagagacttataatctgcttggagtcacaacatatacactaaaatgagatgataatataaagcaatatatttttttcttaattgataccatgtaggctattgggataggggcattcagagaaaggaagaagacatattgagtcgggtacatgagaaatgctttggggagaaagtgggattggaattgggctttgaaaggagacaggatttgaagggaggaggaagagaatgggaatctcaagatgaaggactaacactagcaaggatcctaaggcatgtgtgtttattgaagagaaagcttgcctggtaattttgaacccaggatatgccattcactgacatgtgaaccaattaattaaccactcttagcttcaacttcctcatcggtaaggtagggataatatactaccttgtaagatccttatgaggataaaatgaatttagtagaacacctggcttatgggaaatgatcacagtatttttggattttacaactctgaatggcactattcatgttgtactctgtggaatgaagcttccaggagcactgctccatagaatgcagtgtaaattgtgcctccaaataacataaaaataatgcagaagggtttagtcttaatgacaatagcgtcatgatcatgggtaagaatgtactatgtttaagaagattggtacatgatac

SEQ ID NO: 108064 - DNA, 1068 bp, Homo sapiens
acccgggaggctgaggtgagagcctcagagcctgggaagtcaaggctacagtgagccgtgattgcaccactgcattccagcctaggcgacagagtgagaccctatctcaaaaaaagaaaaaaaaaatcacctggaacagagcctctgaaagctaaaagagtctgtccactatatagagtttctatgtgaactaaactagtgttcaaaggatggtccattagagagccttctgctcacacctgaaggtcattaagcatcataaattcacttttcctctaaaaaattggcttgctcatcaatcattgttactccattggttctattaggaaagctggacaatgctcctaataaaagcagagtgtattaaaatcttttaaactgaaaagcttgcatccagtacttggtccaaaagcaacataacaggaccagaaagtttggttaggaaagaggaagcaggaaagccattatgcactcatagtaggttcaaattgagcctgaccaaaggtataagaagtaagtggttgagagcccagactggaacttaatttaactttggaatgaagtatttgattttcctgttaaggatcttctagaatctttctgataacttgatggcttaatattcccttttttttttttttttgagacgtagtctcactctatcgcccaggctggaatgcagtggcgcgatcttggctcactgcaagctccgtctcccaggttcacgccattcttctgcctcagcctcccaagtaggtgagactacaagtgcctgccaccatgcctggctaattttttgtatttttagtagagacagggtttcaccgtgttagccaggatggtctcgatctcctgacctcgtgatctgcctgcctcggcctcccaaagtgctgcgattactcttaataaaaagtgccaggtcttttaagttttgttgcttccaaagaaaaattgcagctgccttagataacaatcttttgcccaattgataagcaccattaaatgttcattaaatgaagatagccaaacgaacttttaaaaagcctaatatggcctaatatgtctttt

SEQ ID NO: 108065 - DNA, 1093 bp, Homo sapiens
aaaacaaaacaaacaaacaaaactaaaaaacgaaatcatgctatgaacctcaaatatacacagtaaaatttattaaaaaaaaaaaaaaaagaagagcaaagcagagctctgagcagcttcctgccccagcatccctggttctgctgctttcttcttcccaggcagccgtgtcacacagacctgcagctgagatgggtgccatctccctgggttgcttctgcagaggaggcctctcctccccagtggagcctcctacctgccggctattgactgagtgtccagctgaggacagcatccctgcagtgcatttcttgcccactgatgtgatgtgttcatgactcccagcctctctgtttgctctgccactaatacaaggaggtgccccagcctctgggcccctgcagctgtgccagcggatggtgctgttttgtattccttaatttgtgcagcaccagctgcgtgcaggcactgtgcttggcaccggggctgtaataggacccagacagatgcgtgcctgccctggccaggctcatgctctgcaggtggggtcagaggtcaacatgcagtagaggaaaggacagcagatggggtgcacaggcaggctgtggttttatacggggcgatcagggaggcaccccagagaagggaacacaggcctgcaggaaatgaggtgtggagtgggcagcaggaagggcagtccagggggcagtggggcacaggcctggtgtgtacaggccagaaaggaaaggcaggtggccgtgtgaagccgcaaggggtgggggggagtggggaggcactggccgggtcttgcttcttgcagcaaagcatgctttgggcctacccaggtccctgccacctggggtcccaatgcccctacctgccctggagggaccggccccaccagccctctgttccttgcagctgtgccataagtaacgtgaagaaggtgtccctggaactgggcgggaagtcacccctcatcatctttgctgactgtgacctcaacaaggctgtgcagatggtgagggccgggcctggagggggcagggacagtgagcgggaacagggactgtagggaccaggaggccctgtc

SEQ ID NO: 108066 - DNA, 1045 bp, Homo sapiens
tagtgcgagcagtcttcaaggcaaggtgtgagggacagtgcgggtctctggagcaatagccagtggaggagcctcagaagcctgtaggctgtgtctcagctcaggagtatgggttgctgtgtggggacccacaggggccctgccagtgaaaggttgggccctatgggacgggcctgagtacattgtgctggggcctctgtgtagggtctgggccatcttgacagcaacagaacattatcttccccaaaccattctgaagtctgctcagcccatgagagactgagggtcagagagcacccagaactaggggcaccagctcagggactcctgcaagtgtctaagaggaagctggggttaccagctgtctcacaagagcttggtccactgtccagatgtcatcagggtgggaggggagtgaggagagaccagctgagcacacacaccttgctccccacagatcaactgggaccagccggcagaggccattcacaactggatccgcgggaacgacaaggtgccgggagcctggacagaggcctgtgaacaggtgtgtccctgcatggctggaatccagccacgtgcattggtgtatcccactggccattaaactgtcacacatgtttgaactggttggtataataaatagctactgccctggcccctactcccactgggtgccccctaaacatcccagcctttccccaggagtgagagacctacccagcctgcagtagctaaaggatagatgtcctgcgtagctggaggcctccaggcccttgtagtgcccctggggcccagctgtattggtggtgaaatattttgagtctcaccactgggcttgcggagaccccaggcccagtactcactctgacttggcctcaggcagggtggagcagcacattcagggccaggctgaccgtgggcaggccagatgctgaagatggggagacttgggggtcacaggctctagtgaggcatcaggggtggcgggactgtgtgtggtggactttgtgcaaaccttgagggcagtcttgtcccccacaca

SEQ ID NO: 108067 - DNA, 1014 bp, Homo sapiens
acaaggtactctgaggggacagaattcccaagacaacaaatggggtgacaaggcagatgggtggtcaaagagggaagacatttgagttgagaaaagagagtggatttgtagtcggactggtctgttgagattcaggctctctgatctttgtgggtgtcgcttcacttttctgggccttagtttccctatctgtaaaccgagtatacctgttatccctgctgtgaggactcagttacataaggcatatagagcttttagcacaattcctggcccatggttgttatcaatacatgctgttttccttcttccgtttcccgccggagccggtgtcagtcctacccctgggaagagagggcctcctggagggtggcaggtccacgggcctgtacccaggacatcctccgtggcccttcatcgtggactccaggtttcactcttctgcttcctaggaccctcattcacggagataagaaaggggggttttccatcttctgggcggatgatggtctggacaccggagacctgctgctgcagaaggagtgtgaggtgctcccggacgacaccgtgagcacgctgtacaaccgcttcctcttccctgaaggcatcaaagggatggtgaggacctggagccggccgcgccctgcccgccccgacgcaccctcaagcatcctccctagacccagcccaccgctcctggaggccaggaatctgttccccaaattcaggattctggagggagaggagctctcacttcaaggtttcagaggcaggattaggacaaacagtgtattgtattaggagggaatcttgctcacaacggacagaacccagctcaaaaagcgtttggcaaaaaggggacattttggggcccgttcaatagacaaggaaggctaaaggcagggactgggtcacaccctgctgaatccaggagcttcaattatgacatcgttaggattctatttctctctccttcactcgttgattctccttttctctgtgtgatttgtttcattc

SEQ ID NO: 108068 - DNA, 1030 bp, Homo sapiens
acatatagacagagaagatagtaaagcaactgtggcaaaatgctagcaataggtgactctgggtaaataataagtgggcatttgtactttttttttttgagacagagtctcactctgtcaccaggctggagtgcagtggtgcagtctcggctcactgcaacctctgcctcccaggttcaagtgattctcctgcctcagcctcccaagtagctggcattacaggcatgcgccaccacgcccagctaatttttgtatttttactggagacggggtttcaccatgttggccaggatggtcttgatctcttgacctcgtgatctgcccgcctcggcctcccaaagtgctgggattacaggcatgagccactgtacccggcctctttgtactattcttattcttaccattttccttcattctttcatttccaaatgaaaaggtaaaaatctattcatatcttgcccctcgacatctcccatataatcttcgcttcttgccttattagcactcatatcttgtttcacagattttccagttttttagagttttattgagattgctttgcaaatgtttgctgaaatgtacattttgcttttgtagtgagtagtctcaacaaatatgctcttcctctgtgagtgtagcttcctgacaacttcctcaattttgcccatggcggaacattcagtctctgtcttctctgatctagaatcttttcaggcctcatttccccctgtttactcctacttgaaggagaggagatccatatggacctggtgcttgttggtaaacagagtggatgactgcccctcccgctacctcttgaaagaagggtaacttgagcaaaacatttcttgccaacttcctggtggcctagaggctttagtgtcgtgagcctctgctgtcctgagagttgagtcttctgagagcctgtggtctggctgttcttccacaaaggcatgagtttattcccgcagcttgcagcaatctgcagggttttcctctggcaagaaaaatcaaaacccaaagcgcaagg

SEQ ID NO: 108069 - DNA, 1690 bp, Homo sapiens
atctatgaagctggtgtacatatgttacaattacgtatattttctttggtccttcataaaaatatatttactttgccaataaaaagaaaaagaactcacagcttttggcattcatgtgctgttttcctgctttgccgggatgtggaggtgactctggggccgagtctatgtctccaccttcgcagagttcagggaactctgttttgtatttggagggatagaaaggccccttggggtccagccccggtccagcagggtagggttcccatacagctcagctccaggccagctgctgagattctgctcatcccggctccctgacctggagctccgtaaacccaaatccagcccacattccgacagcacctgtgggaagctgcctcaggcctggccagtcctgcgaggctcacctactctgctatcggagaccctttcttgcacttcctacccccatccagtccaccaaacctattacacatgccctatatgtttgctgtgccttggcagagtatttacccccttaggaacgtggctgtgccatttcctactggcgtgggtaattgtgaaagtgttaggaatcctgagcaggcagaggtgagactcggagaggccagtatatgcagttacgtcctgtcctccatcgtccctaactccccaacatgcctggggtcttcgctgtgtggttgcacagttgaggttggacccatccacacgtcctgtgctggctggagcctgggggaagtgggggcccaagcacaaggaggggctatgagccccacagggaatggcaaggaaatggaggctgaccagggcctgcttcagtggctcagctggtatgaagcacacacacacagagagggctgccctggttcacccagtcatgtgcagtgggaagcaagaaccttctagaaggatcctttgctttataagaactggatgcaagtcgggtcaagtgtttctcggtgaaaaccttggagatctggaggctgggggtagggcacccatgggctcccagcagagagatgtctgaatgtgggggtctgtgtgaggtcgtgcatctcagagggcagaggccgttgttctcaccagccgcccagcacacagcacagctgataggaggatggacatcctatcctgactggccatggtcccgaggaggaggctgggcctagtgacctctgtcctttgcccctgaccggatgtaccctctgtgggcaaacacactctagggaagcaaggcattgatttccagccttgttaacatgggctttcttcatccataaacaagcagttcagccctagataagaggtacgtcagagggacagggaggattgttgtctggtcaggatgatgacatgggacgtggaataacctcgggagcatatgcaccttctgtgccaaggaccggccggacacgctgctcacctcccctgggtgtgtgtcccaacatcctgctgttgtcttgtggcagggagtgtgtgtaaggggtggtcttagtggtctcctcagtctgggcttccaggcttgcacctgaattgtgtgtacgtgcacacatatggtgcacctccccgggatgagtgtgcctcctggaggtcttggctgagtcgtggagagtacagcacagtgcagggaacagggataatggggccgcactgcctgttgatcctgggctccagctctttatgtgtg

SEQ ID NO: 108070 - DNA, 1001 bp, Homo sapiens
ggtgcaccgcttcccgcggagcagccgctccgtgcgctccgtgaactgaaagcgccctgaaccccagcctgtccgtcaccccggatccccaccccatccccatttttttaagcaataatttatttgcctcctccagagggacatggcaatgttaccagcccaccttctgaagcctgggaggtgtgaacccagggcccgccaaccgctgcctttctcgggagtacttagagcctcgaacccgcgtccctgggggctgggccccaggcgcacggggctggaggcaggccttcgtgccttcgtgccttcgtgccttcccgcggtggccaggcctctgctgcagccgctggttgcaggcagagttttggggacctggcccttctcccactgggctcccccatcctgggccaaggccagaactttagtgctaggggaagatgaaatgtgcagttttgaaatgttgggtttccagagagagtcatgctggaggagaaggaagtaggccagaagtccagggctgcactgtggtgtgagggtggctttgtctaagatgcctgctcagcatgatcaccagagggtgtgggcaggtccctggagccgggggggggggggggggggggggggggcaggaccgggccgctgggccctcatgtgggagagaggtgaaaagcgtcccccactagggggctggcagtgcatgtgcttgagttaaatgtgcagggcagacagagccagaagggcctgtacccaggggctcgtcccctcctccggtttcccagacaaatccagacaccagcctttagggtggccttgggaggagagggccaggctgtcctgggtgtgagagaactagatagagcctcccaaccctgatttagaaatgcattccttattttgtctagaaattaataaatgaactagcttgttttgacaggtttatttcacatcctatgaatgtatgtaaataaactgtacataggtccatccacataaaatatctttta

SEQ ID NO: 108071 - DNA, 1013 bp, Homo sapiens
tctaaaccgttactggttgccttgtacaatcctcacagtcctcaggaataggtcttttgttctccctttgtctgggtagagaaactgaggctcagggagcttggtgactttcctagtttgcctggttggtaagtggcagagcttactgcctacaagggctgcatcttacccaccgggttcccacatcccccactgtagtccccagggctctctgttggctgctgtttgggagaatgtggcatgcaggggtgaggcagggggtcttctgagggctcagttcccagggaagttcctctcaggtgccaggaccctgtggcagcagggagggaattcaggtgaggacagcatgttgtccagcttggttctatctcatctgcctgtccttcccagggtgtcaccatgaccagagatctgtgtggccccacgtcaccacctgtggcctttgagatgagtcttggaaggtgggcaggaatgccagagtcttcattggatgaatgaagaaattgaggcccagaaaggaccattcagggcacccagtggggtgggaactgtcaaggcaggagcctgagactctgtcccctgggctgtgtgacttggcctctttaaacccttgccatggtcttgccagtccaatggggctggctcatcctggttccctggccagtgagatgctgggtgaccccagggctgcagcctgggaggcgtggcactctgtgtctgcagctttctgcttacccctgccctgggccagctcctctgctcagaagctgtgtgcccagctgcagctgggggcaggtgtcctgcccaggagcacaggtgtcagctttgactgccagggcacatttatcccatttcctcactggcacagggccctgtgacacacacacccatccaggcctgtacaggaggctggggggctctgctgactgggagtccaggtcatctgccattgccagggcagggggctgtgtcaagacctctgctccagcctcaggggccctgtcttgtcagtg

SEQ ID NO: 108072 - DNA, 2004 bp, Homo sapiens
aggtcactctgctttgtgaatgggatttgaacccagaggccggattcgagaggtcacatcctgaaaatgctgcttccccaaccagtgggactagcttcattcacagatgtctctggacacatgggctgggcctcgcctatgcttcctccctggggacgtggaagcatgtttgggaggctgcaaaggccaacccagagggaggctaggccagctggtggtgctgtcacaggtggcagaacccaggctgtctggtctgcatggcagtggggaaatcaggcctcaaatggtaactggtagtctcccaaccagggagcacccttccctgagcaccgggtgctgctcaacctccttgggagtggctgtccaccttttcctgaaatgtaggctgcttgcgaagagctcatgtgctccggggtgccagagccagccctctgcagttcctgatgcccatcccaaaggaatctctggcctgcctggggggcgctgtgtgctgttggcacattccaaatctttgctgctgtggctgctgctacgtgtgtgagacggggcacactcatctgtatccctgggggtgtatacaggcctgggcctcgccagcaggtgtgtggctgtgtgtgtgcacacccacatgtgtatgcatcttgctttctttgtgtctgtctgtgccgtgtgaccatatgtgtttgcacacatacatgtcttaggtgtttgtgcaccatgtgtggctgcctgtgtgtgcatgtgttatgtgtgggtgcaacacccggggagcagtttgcagcttttgttttcttgaccatactctggttctgagagctcttgagagttgtctggggcagaggttctggccagtgaggctgagctgtggtcagggagctgtgagtggaatgtatgttgtggcactggtgccacctttccattgagtgccaatctggccagagaagggaattttcctgaacagtgtctaggtttatggaggcccctcctgagtgaggacatcactctgtcctgtctcccaccccattcagacagaccggagaggcttctgtgagagcccaccctggggcctcacaaggtctccatcctggagtccccacctctctgagctttgtacctaggcctgccgagtgggtgcatggctgacaggttgcttgtgagaggaggacacagcagcaagtacactgcataggaggttagaggagccgagagaagggccaggagtgctcttgattgaagcaggaaacttgtgcagagaaggcgagggcacaggtatgtgggggctgtggtcttgagcctacgcctgggtcagccactaacttgtcatgtgcctttggggtggtccccctccaaacctcagtttcctgtctgcagagtggagggctagccctttgcagcccagggcaggcgtgcagggctccacagcggcctccttgttgtttgtacatcataaggatacaaactcatacacggcagtttctgaggaggaaccctgaaggcattctctccagcccccaagagggtggtgcctattgtgaagggaccccctactcccagggaccctgtatgcactctcctcttggtgagggcgggcaggggctgcagagaggcagggaaacctccctccaagcaccagtctggactccttagtcgggctcaggtttcagcgccgtctcctggccatagtcgaccgttggcaagtagctcctctagatgccgtgaggctgggtagggtgatggggagggcaggtgtggtcctcatccaaggccagccttcttcctggatatcttagggccagagagctgataggcccctcagcccaaagtgtatctcagtgaggcagatcttagttctctatacagtggcctcaggaggtaatgagttcctcatggcagggggtgtacatgagagagtggggacctgtggaggggattcagctctgacacatctgagccctggcactggtcgtgctgcccaggacccacttggcaagagaaggtgtagtg

SEQ ID NO: 108073 - DNA, 1048 bp, Homo sapiens
atgtccatctataaaacagccttgcactgctactcttaaggaacacactgaaggatgggaaaggggaggcacaaaacatccgtgcaccaggcacaggtgccagggacttctcaggctattttcttgcacaattctcacaacttcccagcaaagtcagtgtgatctctgggatgtagagccctcagtctcacaggggagggagctgaggttgagcctttgtgtgtctgagacattccccgcctcaggctgtgttcacagttctcatgggccaggggagtcactgctgcggccctcacttttgtgtctcctcagagaacagcctggaatccatgaacatcagctcttcttcaagcactgaagagaacccaaagaaacaggcaagaaaaaacgaaggtaaccttcaagctgggaggctaaagtccaagttggcaggaggcaactcctctccctctgcccccagatcccctcagaccaggtctctagagctaagggcagaaggaaatgtttctctttccattaggaattgggttgacttgaaataacaggcatgtaaacaaagtaggatttattgctccctctgttaatgagaaatgtgggacgaaatgcagactttcttgaggctccactaacagcagttccataaaatcactcaggtgaccaggtccccaagtctctctgctccaccagaaaggaattagggctttcaaccacaattagggctttcatgctcacaaaatggctgctgcagctccagcctcagcacatctgattccaggcagggaaaagtaacaaagggaagggcaaaactacccttcagccaacttagccttctaggggaagggatttttcccaaaagttccaagcagcaatgtcttcccacattccagcagctaaatttgccatatggccatcaggatctataaggagggcacactgctgccaccgttaggaggaaggagggcaggtagctagctagctgcatgtgcctcaccctggtagccctgaacagggcatcgctgccacctgcactgtggctccgacctccctt

SEQ ID NO: 108074 - DNA, 1092 bp, Homo sapiens
gttcctgcaacccacaggttttggcagggactggacagggacagagccagaggggcaggggtgggggcagggaaagagaggggcgacttccgaattccagcccagcactgggccattcacctccccatcgctgtcggtgtcctcctgcgtgggggggatgggagagttcgacctgcgaagagatggcagggtcgggactctgggaccagcctgagcagacaggagccaggggagggggcacagaggtcttgaaggcgttggcagcatccccatccctcctctcccagctgcccacaagttacccagagggcagcaccagcttcctcacagtccccagctgccacactgcagccaggggatagtttcaatccactcattttcccaaggccgtagccactttgacatgctggacaaaccatgttccagacctgtcgccagaggccccagtcctgggtggccagatggccctcacccatcccagctccactgcacttagaataaaacctgctctcctcttgggtcatgccaggcagccctcccagcactcaccttgcctccccttccccagcccctctgccctgcctggccaggtcccatctctctaggtgctgccctaccccaggcctctgcacctgcggctccgctgctggggctgcccctcctccctcacccttgtttactgagtgccacctttgaggcctttcctgccctgcctcccccatctagggtcagtcttggcccctgtcctgggggtcccactcacagcaatagagggactctcagggctgcctccaggtgatcctgagtgcccaggggcaaggtctgtcctggaccagtggagaggggctgggaacaagctgtgtgagctttaagcactcagtgtgggccccagaaggccccactcgatggggacctcacctgcactgacttccaaacctgccctcccagcctgctccaccctgggcctcacctaggatctgcaggtcctgctgactgaggtggggggggctgcgctggcttgccccaggcacctcagggacctaagcttgggcttggagatgccagcccctgatccccagaagcagagaggca

SEQ ID NO: 108075 - DNA, 1427 bp, Homo sapiens
agcactatcaacctgcaggatctgcagtgacggcagcctcggcctgggcaggcccaaggccacggtctaggacacaccttccctgagactcatgacatgagcctggggagacctcatttggtttccgttcagaagaccagcgtagcccttttgagacttttgggtacatttatcaaaaatgttttccttttgttttaccaggaatgagttcgggctatactctttgaaactgcctttgtgagcaaagtgctttggcaaggcaagggtctccctcagcagggctaggtgcactacagcctctttccccgtgtcccgttggatctgagctgtgtagcacttgttgcattacaaagaaaaagacttctgcaggaaatagggtagagaacaggctgtctagtcagatgcagcttgatctgtggcaaaaccaagtgtggtctttcagcttcagtgtgttagcatcccagcacctgggatggggtttgtgggcaagttgattttgccacactgtagggcccaggtggtcccattgccaccgtgaagccaaattctagcccaagtctggtagagcagtcgggcagctagttttcgggggaggatgatgtggtgggacagaggacctcagtggcctattacggagccctcttcccagactaaattcatagccgagagctcggggggatggtagagttaaaatttaaaataattttctaaattctgtatttggatattagtgtttaagtggtaatttggcaacagtttataaagtgatgttctgaataccataaattatgtgtaggactgtgatggcgcgtgtatgttttattattgaggttgatgtgcacataatacgtcagtgtatatttttaccgagtgaggtctgtcttgtaaaaggagacaaggtgatcaccttgcccatgtttatttgtaagtctgtcaacttagcaatgacacagggtcactcctaaatgacttttttttttttttttgccttgtgccttttgaagtatgtgttcattcagaggctgttttgattctcagactgaatcattcaaactctgccctgtgtttgtttcttgaatttgggggtgacatcaagtttgagtgagtcctccctctgtcttgtctcactctgaggtgctgtccccaggtgctgttccacgtggaagaatccacacctcgtcgacaaatgggtcttctccacagaccggcgctctgtcaccaactaaaggcgaggggagaacttgcccacctggcaggctctttagccccaaggtggcccggagtcctcctccctccatgggaggcttttggccaccatggcgggtggagccgcacccaccccatctccatggggaggagagtcttcccccaggaatgccctctcggcctctatttttctcccatgtgcctccctgggaacgtcaccg

SEQ ID NO: 108076 - DNA, 1975 bp, Homo sapiens
tcaggcaagttcctgaattcagtaccatcattattatttttgtgtaagactttgacaaagtatagcccctgccaccagagcagcctgtacagtgggtctctaaggtgggacctgccccgggcctgccatgcacgtgtgtgaaacagcgtgaaaagtgtcgcggtaaggtgaccctgggttacccaggcaaggctcggtgtttgtttcagaaagcagagaagtatgtaattgattttaaaagtttctgtttaaaatatttggctatgttttagactatgaaggaatgaactttgcttctctggataagaaagtcacatacattgttccagctccaagtttgttcggccctcgccacaagtggatgtagcgtttggccctttgtgtgccttgctggtgactctggttttgggagctcggatatgtcccagaagcaggcttatggcacttctgtagctcccttgctacccttcctttgtgtctagataagtgactgacatgcttttctttggtctcaggaaagtgggggctcagcaagaactgattaccgagccattcaactagccaaggaaaaaaagcagagaggagcggggagcaatgcaggtgaggccgtgtgtgctgcagccggacgagcaagggcctgagggttctctgtcactgttactggcagaagaaacacagcaggtgtttctgtgctcttggttttacttttctgttcagaatacccttttatcaactccttagttttatttgaacttaagggaaaaaattagtaacaaaattcccagcatcagtatgaacatattttatttgcctaaacaagctttgtgaaagttaagcgttcaaacaccagtgtcagttacctggaaggctactaaggtaaataagcaaagcaggccagttgtcaggaaagcagagattgtgcctggtgctgaatggccttggggcctgatcttggcatggcagagacctggggactgccactgtccccaggtacgtgtacatggagccaaactgtgtgtcctgtggcattgtcagagttatgttgaaatcttatttgaaaatgttagcaacttacttgcatttttaaagaccaaacaagagctggtaacctatggcctcaagcatctgtccttcctaaaaatggaatagtgggatgtagtgcttaatggaaactgctaaatctttttctaaaaactaacagtggatttttaaaatatattgttttttgtgtatttcatttgtcctttgtatttatctaaaagggttgatatgattttatatcttgctctctattcctaatagtattatgacttcttatttaaaataaataacaattgccggttttctgttaatcagttttcttaaagccagtgtttcactatagtgtatgcatcagtgtgaattgtgacttaggaagggacacctcaacagttcacaaagtaccagaatggaacttgcagagataatagaaggaagtgtggtggtgaaatttgtagaaagagttgaccatataccaaggaaagttcatgaaggaaagcggatgcctttattgaacctggtagataatcttgaagaaaaaagagacaaacattcaagtatataacacgtgtcctatttattacattgctttggagtactatctataaaggaggtttgatgttttcattactgtttttgtaaatatttcagcattatctttaaaaagtaaggacattggccaggtgcggtggctcatacctgtaatcccagcactttgggaggccgaggtgggtggatcacctgaggtcaggagttcgagaccagcctggccaacatggtgaaacactgtttctactaaaacacaaaaaaattagccaggcgtggtggcacgtgtctgtaatcctagctacttgggaggctgaggcaggagaatcgcttgaacccaggaggcagaggttgcagtgagccgagattgtgccactgtgctccagcctgg

SEQ ID NO: 108077 - DNA, 1266 bp, Homo sapiens
gttcagtcctctcgggcagctccggtggcacctagaggggagagggtgcaggctttgaagccagaaagacatggatgcaagtcttactttgcttcttgctgttaccagttggcctgaccttaggaaatgttatttaatctctctccagttgtttcccctggagaaagccctgtcagcctgaggatccaagacgcgtacgtaaagtgtctgatttcagccagtgtcccttcctgtcccttcctggggtgtgtgtcggttgccctgagcgaccggccatgggactctgtcgtgataaccaagcttcagggtgtgggaagaggacagtcagtgcttccttggggcatcactcggtaacatcatgggcataaacaaaagtactcagtcttcaaggtcataaagtaaccagagtgtattcctttttttttcagatctcttacctcagctagaagctccgagttctcttactcccagcagtgaactcagcagcccaggccaaagtgagctcactaacatggatcttgctgcactcttctctgacacacctgccaatgctagtggttctgcaggtgggtcggatgaggctctgaactccggaatcctgactattgacgtcacttctgtgagctcctctctgggagggaacctccctgctaataatagctccctagggccgatggaacccctggtcctggtggcccacagtgatattcccccaagcctggacagccctctggttctcgggacagcagccacggttctgcagcagggcagcttcagtgtggatgacgtgcagactgtgagtgcaggagcattaggctgtctggtggctctgcccatgaagaacttgagtgacgacccactggctttgacctccaatagtaacttagcagcacatatcaccacaccgacctcttcgagcaccccccgagaaaatgccagtgtcccggaactgctggctccaatcaaggtggagccggactcgccttctcgcccaggagcagttgggcagcaggaaggaagccatgggctgccccagtccacgttgcccagtccagcagagcagcacggtgcccaggacacagagctcagtgcaggcactggcaacttctatttggtatgaagcactctattcagtcaccaccatataggtcacttctctcatactcggtcttgaggatattctggattaatcctttctatgcagacgtttctggtttacaaaaggacgcagccctggactacaagtctggaactgacaagttctta

SEQ ID NO: 108078 - DNA, 1022 bp, Homo sapiens
ttgagaagtctgcagaggcccagtgttatactagatgcactttccttaaactctagtgggatgtgagaccctcttctgtagcaacctatgtatcccaggattgaatttcctgtgtgacaatgacttatttgtgtgtcatccccctgccagctgtcaggggtagaagaccaggtgtcaccctttcgtctagtgaaaaacaggcactcgagaacacccagttaccgtgggattatgtcacgccctcaatgggttgtttcagtccccctaatggtggtcctgggagtgggttcctcactgctttgtcactgatgaaaccaagatagaaaggacttgccagggtcacacctgcaagaagggctggggctgggctttgaactgtggtgatcatgactgttttgccagatgctctgctatctaatgtttatttagtgattgtgttaatatctggcccttgtacatgtctggtctctggtagtaaatgtttatagaattagtaaagtgctaagtaagaaatttattaataagtgggtatcatttgcactgagattattcatgatctcttcacagggagctgagtcctcaagagagtcaagggaatttttaggaagttttgaaaaactgacatagttttccatttttaatttctccaaaggatcactaccattttctttcaaaatgcttcattggtactaagggatatttattgaagaagtgatactatattgatactttttttaatctttaaagtaatatgacaactaaagaggatacattctgaatttgattttctttttgtctagaatagacttcttttgtagatttgcattattaaaaatataaaatataatagacattctggccaggtgttcacagcctgcaggtatgagcttgggaacagtaacagctggcatgggagaaataggatcagagaaccgagagcagcttttcctctgggccaggtgctggcacagtcaggaagctgctggggacagtcctatggaaagcgtgacatcaagtcctta

SEQ ID NO: 108079 - DNA, 1048 bp, Homo sapiens
gcgtcaggcagtggggttgtgggcgtggctgccaagccaagtggcctcttttgcactctctgccactttcttgcctttgaccctctaatccctcccatgtcttttgttttttgagacagggtccctctctgtcaccctgactggagtgcagtggtgtgatcatggctcactgcaacctcaggctcctgctcaagtgatcctcccaccccagtctccagagtagctgagcccacaggcatccaccaccatgcccagctaatttttgcattttttatagagacagggtttcactatgttgctcaggctggttttgaactgctggccttaagcagtctgcccacctcagcctcccaaagtgctgggattacaggcatgagccaccatgccctgcccctcccatgtctttgaaatgctttcctggaagaatgtttcactttgttgactttccctagcatatgtcccctaagcctgtgtctctcactgggacttttgtcctgaattctgaacctgcccctcctgtgtttccgtctgcctcagctattctatctccaagtaacaaaggctagagcagagttgtgtttcaggagtggactgggagtaacgagggctggagagggcagggttagagaggaaagtgacggtggcctggtgacctgtgaggggaatgctgagtgtgtgagtgcctagtcattgggcagctttgcagcatgggactaggaaacctaccccactaggccttctccacagtccaggatacagaagtgcctggcagctgtggtggcggcccctctggggagcacacccatgtgccctattctctgggccctggtgcggttgtcgctcctcaccgggcctggctgatggcatcctagctggccctagagttacttctgctgctcagtccgtggaggctgtgtgtgtcaccaactgggtcctcacgtctcctgtgtgaccagcagcaccacagcagagcaccggctttggggcgcagctgtgtcacagctgccgcgttggcaagggacaggcctccatgcctcgcacagagttt

SEQ ID NO: 108080 - DNA, 1034 bp, Homo sapiens
agaaaggctgctgaggctaggcctgctgctgtttagttctccttgtcatattctcatttctctcaaagataagaatgctctcggataaaatgagcctgtgctcatgacagctgctctgttactcagggaccagtgcagggctgtcttacgacacttagatgagaaagtagacaaggaaagaggacagcagtgggcatctgccttgtggtcttgctgacagcgagaagcagtgggactgcttccttgacgccttagcttggagccccgttatgaggtgagccaaggctgactctcgcaagccaggactgagcttccctcggaaagacctttgagtggcaccattcacctaagttagcttttctggtcgctattgtttttatcccctttgctttgttgtttctgtgaaaatatattttcagttaagaaatgctataaagtagtggttttctagtgcgtgggcctagaattcacacatgctcactggtgaacagtgtctgtgggctgctgtgggctgcatttggatagctgtctgcattagcaggaagctgtacacactgtgtagggttagtcatctcttttcttttttgaggcacatttaacctactgtcaaaacgctgactcatgcttcaccctcacactcactacttggtggtgataaccttgaagctattctcccctaattaatatctcgagactgagcaaaatatctcatgtaagataaaagtacttgaattgctttttcatgttcatcttaatagtattatttccaaaagtttttaatactgtattatgtgaaatctaactaatttatctgtgaaataattccatcacagtctgtttaatgatgataaagttccataaatgaatacaggtaatattaagtggttgcatgggaatttacaaacatgtcagcatttcagaggtccttcaagacagaggcccatccaaggtccttttggaaaacctctgtgttcttgagtatgccacacagtagtcaatgcaaggctcttttaggccacttgctctcatgagcc

SEQ ID NO: 108081 - DNA, 1062 bp, Homo sapiens
cccaggagctttcagctggggaagtactgctcagctctgttaggagctctgtggccgtgtggtggagttggcgggagacggatgactggggaagggccctgctgcattagtgggtggggtcaggaatgctgagtataccatctcatgcaaagaaaaattgtcccaaacacaatgcaatagaacattttgcaatgtgtgtaggcagagtagttggtgatagggaagtacaattgggaaggaggctggaaaactaatttggtgccagatcatcaaaaatctttgccacaaagaagaattggtagggccttctctaggcagtagggatctgttgagacctttatttcccccaactttttatttagaaagatgtcaaaagacagaaagagtagtaaaacaatcgcccatattgaacctttcacccagattccccagttattcacatcctgctgtttttgttctgtctctccttttctgaatatgtgtatgtgtagttcatattccttttttgttttgctgagctttttgctgccactttttgaagtggcaggcatcaatgacatttttctctaactacttcagtatatatctcctaagtacaaggatgtttacctccgtaactgcagttctgttgccatatctgagaagttcaacaaaagtactataatattcaatttccccagttgttccttaagagtgtttgtgtgtgattttttttttttttttttttttgagacagagtctcgctctgccgcccaggctggagtgcagtggctcgatctctgctcactgcaagctccgcctcctgggttcatgccattctcctgcctcagcctcccaggtagctgggactacaggcgcctgccaccacgcccagataattttttgtgtttttagttgagacggggtttcactgtgttagccaggatggtctcaatctcctaacctcgtgatccgcctgcctcagcctcccaaagtgctgggattacaggcatgagccaccgtgcccggccaagagtgtgtgtgtgttttgatttgcacagtacatgtggctcttttgacgct

SEQ ID NO: 108082 - DNA, 1047 bp, Homo sapiens
gaggccaacaattcttttgtaattagtttatagttttgacagaaactatacatttatgttttatatactctttttatgtagaaattttttcagttaaaaaaatgcagcgtagagaaagaacatcaacaaagcaaaaaaacatgtaacaaaaccaaaatccaaaaatcaaccttattgagattttgattaggattggattggatatataggaaaatttggaaacacttgacttctttgcaatattcagtcttcccacccatgaacatggtatatctatccattaatttagatcttctttaatgattcccagcaaagttaatacatttctccttagagatcaagaatatctgttagatttattactagatacttatgtaatttatatgtagtcacaaatggtattttttttgaaaatgtcactatctttaagtgtttctagtgtatacaaatgctgctcatttttgtgttttgatttagtattcagtaatcttgctaaactcttactgaaaaatttatccttagattgtttcagatttcctgtgtacacatttatttatttgtgaataataacagtttgtttcttcctttttactggttttctctttttttcttgtataaatgcattagttaggacctccagtacagtcctgacaagaaatggcaatagcaggcactcttgtcttatttacaatatcaaaagaaaagacgtttcactaaaaagcaatgttttctgtagggttttgttatatgctgttaatcaagttaaggagctcgttttctattttttgttacctaagtgtctttttgtttatgttgttttgtatatttaagaaggaatgtatgttcaattataacagtgtttcgtttgcagctgtggatgatgaattttttctttaatctgttaatttgttgaattgcattgattttctaatattcaaccaactttgtatcctttgtataaacccaacttggtaatgttggacttcgttatttagaatttatgcatttatatttatgaatcatattggcttgtaattttccttttac

SEQ ID NO: 108083 - DNA, 1056 bp, Homo sapiens
ctgccatccacagtgtgccagtgcatcctaggcaggctgtccccatggttaatgaaggctgttactgccccacaagtcccatgcagacagtaaaaccctcagtagaagaagagaggctgtgccgacccttgtgtctctatcacagggataactttcctagaagctcctggcagaattcctcttacatcacactggcttgaattgtaccaggtgcccatggctaagccagtcctcagcagaggggatacagagggctccactgactgcagctagggctcttttctagtcacattagggaggttgcatatccagctagaattaggactgacagcaaggaagttgggggagggaagcatggctgtgggcggcatctaataacatctgctggaggccatgaggtttgagaccaggaacagccttgcactactttaggtgggtagcctcgtacacacggtgctgtgtagaagggggttgaacacgatgtgaaagcatcatttgggattgtgctctcctgggaggccagacatgctggctgggcacaggccttagcttactaatttgatgactacacaaatgtttgaagtgtgcagtaggcacataaatgcactttgaaccaggccctctgggaaatacaaacaatgtaggatcctagccctcgggaagttttagtctgtggagaagacaaactaagaactttgaaaaaggccagattggttacagtagttgttaaattgaagaaaagatttggaaatgcaaatgtataagctgctggtggatcagagctggtagatcagagacggcattaaactcagccttaaggctgaggggcagttgggctgagaggcaggtgttgagaaggtgatcggatccagtgagaagagtgaggtttgaagctggattttagaaggccttggatgtgctgaggagttaaccctcaaagtagcccgcatcgatcctgaaacagtcaatggttcctgaagtttgtaaggatgggagtgatgagatctgacttgtgcttttagaaccccatggcatcctggtgaggaatcggttgat

SEQ ID NO: 108084 - DNA, 1044 bp, Homo sapiens
tgaatggtgattaaatggcagatcttgagtgggtgagggtttggatgtgttactgctttgaagcccgctgtgcagtcgtctgttatctttccctcgtgatcccattgcagtgccccattgctaatagttggaagcaagcacccatcacagccttctatagaatgggtgacaattcaaaggtctgacccttttcaagcaataaaacaaaacaaaacaaagtttaaaaaggctttcattataatgatatttgggagtcaactaaaaagatgtttgtctcctagtcagagtcttacagactttaggtttatctttcttagaacaagggagagagtgggctttgggaattctggtcagaggttgtgaagtatactacctgacattcagccaaggcagtcctgatatctgggtctagctgtttggcatggctgttttagaagtttagtgatctggagactctggtggccttgtcccttatacctcctccagtgtgagtgttatgtggagatctgaaaatcctgtggagatctgcattgcctgtgctcagatgactggtaaaaggcataaatgggagaaaaaaatcatgacatccatagcccctttctttacttccttgttttactttttcttctcttcttttgtctactgagcttagtcttttgattagatcagaggttgacaaacattttctataaagagccagatagtaaatattttactctttgcagtcacatgtggtctttgccacatattctttgttgttgttgttgttacaaccctaaaaaatgtaaaaaccatacttagctcagaggccatacaaaaagagactgtgtactggatttgactggtgggcaaaaaacctctcctggactagactatgcagctccagagattttaactttttaagtctctctgagtacccaggtgtctcaagaaactagcgggtgggagcactggtggtggtccaagttgcttagtggctattatttcttgtgagaggtttcttgtcttggtatttgacaacttcagtcttctgatatgtaaaat

SEQ ID NO: 108085 - DNA, 1103 bp, Homo sapiens
agcatggtgtgaattcaggagccgggttgcctggggtcgaatcctgcttcccagttgtgctccctgagcagggcactgaatcctctgttgtccctgctggtgatcctgcctcctccctggatagtcataagacttcttgagataagggacaagcttagagcagcaccaggtgcacagcacatggaatgtgcctgtactgccctctgaggtttaccagttatgcccctccaaagccttgtaccctgtccacctctgggacacggcctcatgcatagtaaaattcactcatctaatggccgtttaaaaatcacagcttttaggccagagtcttaggatgaggccagagcttagaacctgtgtgtgtgagtaggggcactctaggactagcattttgaaattggcattcctgtcccacgcatatcctgtgcttcactggggacaggctctgggtgcaggagctgtttgggcttagaaaaggtggggaagaaggccaggctctgagaatgcagctcactccttcctatttttcatttgtcactggtccctgggaaacggttttctccagcagttttggttgttgccacagccagagagaaccccactgtgccttgtgaatgaagtcctggaactgttggcaggactctggtcacagcagcccctcttctgggatccggtctcttcctgtggtgtgtgagcggagcccactaggtggcaggcctgggccacttgttggctggaagaacaggcgtgctgggagaaggccttgggcagggtggggagaaggccccttcccccgatgtcatcctctgagggcctgtaacctggtagctttgagactgattaaatctagctgaggaggctgaaaggccctctacccaaggcctgatctttcatctcctgccctctttttgttgggagacctggctttttagtgttatctgacctccctttgttgtggctgccctgggggacaggttgaccaggtttgtactgccctgtggggacttagcatcccgttcgttctccctgcccctttagcgcggcttgctgaggaagggcccgcttttctctcaccctgttctcctcctcatccagaaagttac

SEQ ID NO: 108086 - DNA, 1121 bp, Homo sapiens
gtcatagcagttagagctgcagttctttggatcacagtctgaactgccttgagagaaggtagcaggtagtagaaaaggttaaaagaatctcatctgtgttactgaaacaagttgtgtggccttggttaagtgtctctgggcatcactttccccatccgtaatacagggacagcaatattgacttcacagggttgttgcaaggatcaagtgtaaacatcttcagagtgcctagctcagtgcttcacctgccataggtcctagaaagcaatcattccttccaagagatggtgccagcagctggctctgtcagcatatactgcccttcagcccctaagccatgtacctagccctttgggatcatgcaaatctccctgtggacatctgtgccagaacacccagtggcaccctttgtggctgagctctttctaaggtaccggctattggcagaggagcaagctggggtaaggaggcgagcatgtccaggaacattctttcttttcctctccaaagcaggctgcctctaacagctcggcttccgaagtgaaaatcctgtgtgctcctaattggttttcaggggagattgatttttgccagtgtaactgctgctaggaaccctgatgtctctctccttagggatcacgtccctccagatgaattttgtttttagtccccatcgaatccacttgccaccttttctagcaggacctgtttaggagccctggagatgaaatggtaggcacctttggtgctttggcctttgggaggctgtctctcagaacgtctccaggctaagaagctgatgggcaggaagggcagtggctgcaaggagggagtgtggctgctgccagtctcctgggtctggcatcttcccattgggggcaatgagttgtcatattctaaaatcctgatgaagtggggagtgtggagagaatccaagctcctcgagtacctgaagaacgatggcctggaaaagaggaggccagctgtgttctggctctagcgagggcagaggaaagtggattgggcataagcagtgccagccaagaacatgaggagggagaagggttcaaagaaatcagagttgagaactctcttcaggacctgtcctggatggcaggcag

SEQ ID NO: 108087 - DNA, 1005 bp, Homo sapiens
taggacacaccacttttgcttagtgcatagatatcttgaggtaggtaccatgaggtggtacaggttagaaatctaagccagttttaagaaaactgatgttaagcaaacttaataccttctggacaagtaggccacagaagcgagtaagaaattgtaagaaaacacagcagggattggtgagcacctacgtaccacagagctctgggagtatgagcccaggggtgcccagctgccgacaggggtatctttgtgaatttttgggtgtcagcaactaattcagactttaaaaaagaagagggaggagaaagaggaagaaaaggaagaaactggtatggtataaacaaaacaaatctgaaagctcaatgtggcccagtgccctaccagattataaactggtttggatgaacccactctcaggtcttttagtggaaggcaggtttttggtaagtttttgagctggaatttgggaccagatgaactcttgggcaagccctctgtggcccgatgataaccttcagtttgcatctgtgaaacaggccactgccagctgctccatgtctgtggggagctttgaaatcttgattaaaaggccccagctaaatagagaagatgcttctggtgtattgacaatctttctgtggccatcagcgcccatcagcaggtgctgccctcagcgtcccttccagcctgtagctgtgtctgctatttttagctcttctgcaactccattaaccatatccacctcctcatgccacttgtctgtatgtttaattatgtaaatggcattacaaatcacagtggtgttgaactacatctcatttctcacagcaaatcaaagcatgttacactgtgtctttttggccattctttcaatctgaaggtagacacggtagaggatgattgctttcttcttgtgaggaagatgagttgggaaaatggatgttttggtaaaagtgatttcatgggatgcatgtgggatctcactaagcggctgacttttgttct

SEQ ID NO: 108088 - DNA, 1036 bp, Homo sapiens
ctccagtgcctgattcatccaggctaaaaagatttgtagttgctgaacattctaaggccttttgtgccttggtcagttgctcttgtatcctggaatgttccgtttttctttcttccccaggttaacaggagaagtttcaggattggcttaaatgtaccctccttcaagaagctgtctatgccctctggtgctggtgaggtgttcccttgcatggacccccatggctcctggacttttgcattaccaggcttggccctttgttaacattgtggtttatttcccatttcctggagcacagcttccttaaaggcagagtctgtgtttttgtcctctcggaatctctagcattcagccaggaacttggtggggactgaaaaataaaaaggtgttgaacaagtgaaggaatcactcttgtctctagctgtactcaacagatgggtgtgggcactacaagctgaaaaatgtacttgcaacagacagttgtgtagaaagccaaggacaagcccagagggagtgcttattagatgagaattgctaggataggacctcaagatgccttgacaaactactgatgtatttattcaacacccttctcataaaatgtatttgtttcttagtggtctagtcatttattttcagagtactcctgtgataaaacgtggatccatctttctttagaaaacaaacaggacgtgaagagatggccatccaggtggtctttgtgtcagggtcagaactagggatgagccagcttgtcctgactctggaagcagagattctcagagctcgcatcgccccacattcctgggtgtctctcgtgtaccccactgacagtatcatagcatagctacagtctgcttgggggatgcctgatctcttcgcctggtgtccttttttctcctgggttggggttaggtgagaaagtctaacagaacagcaaaaagaagaaagaaacacccagaataccacggcctggagaaaaagaaggctgcgccatcttggtctctgtccttccaaataatactagagttttggg

SEQ ID NO: 108089 - DNA, 1124 bp, Homo sapiens
ttctcaacattgtctcattccttctaaaacaaggtatctatatgtaaactgctgatttctttggggcattacccccataaattttgaaaagcattaatggtttcatcatttttccacctaagtttcaccataaatttgatgtttgttcttgcttcaattttagcagaattcatgttgctctggtaggagctgttttcaaactgatattttatccttctcagtgctcaaactaaatcctgttcagatgtgttataataagttagtatgagtttattttggtgtcaaaaaattgaaatccatgcatagttttaaaataatatacattttccatgaactttatgaagacccctcatatacagagagtttaagaatcagagtgtcttcatacaacagcaacactggaagctacaagacaatggatcaatgtctttaaaatcccaaaagaacaaaatttaatttcagagaaaacaaagttatactagaaaggaaatataactaaagtacagtacatggctcagctgtgaataatatttccagtcatcctgtgaacactaattgttgaaccatacacatgttttggttaaacttggggaattaatacgggatgggagacttatatggaggaggtacgtgtgcaagagcaaaatctttacctgtcatagtgggaagtcaatagatgccagaattagaaacatggaggcaaatacttgaagaaacagctagaataatctaggttgtctcccaggaaatggggagagatgagccaagtactacagtttgtggtgatagactatttatgtgctatttgatgttgatagaaataaactttaaaaactaatgagatcaaaatgtagtgtgacacctaggattgggtactagaacagaaacaaacagaaaaactggtgaaagtcaaattgtttcaagtttaatagagtagtaaagtgggttttttagttgtgacaaaggcactacaataatagaagatgttaacattaggggaaactgggtggggagtgtatagggactctgtattatctttacaactgttttgtaagtttaaaactattccaaaatggaaagcttattagagaaggctcagtatggatgctatcatactaccgtgt

SEQ ID NO: 108090 - DNA, 1045 bp, Homo sapiens
attggataaaatgtgtcagacatacacagagttaaccatccctgagcatttccaccgtctccttccctgctgtcttgttcttttcttacttgggcaacacggaggagagcaggctctggttgcctgagaggccatctgtcctgtgatccctcacacctgaagcctccgttccctcattctcccagccatgggcaccatgtccacagtgcagatggggcgggggagcagtgtcagcactgcagcctgcaggtggagatttggaagaaagcagcatgagcagacacaagccttcagaatgagactaattttcatgaggctttccctggtaataaaaggaaatgggggctgcagagagcctacagtatttcagcagatggtcttgtaatagaatgttttttcaaagtttccttgtgaggcatcagtgactcttggaaaatttgtatcgtgtaatgaggaacaaagacatggctttgagcatccctcttcttggcatgtttctgagttgcctctccctcctggcacaggtaggtggttttggaaagtgaggaagatgaccctagagaagcagcctctcctgatttttctgtgcctttgaaggagctgggacttggtcctagggtcaacaatgcctgttcagctctgcccctcctcactcttccaggcttgggcctcagcaggacccatttgatgtcaatgaaggaaggtctgcatttctgcagtcccttaatcagctgcatctccctctgaattgtgccaacctcatggaatggtgtgcacctgtccaagctggcttatggaaggaagggagggacggattcttggtgatagtttcttcttcagactcatagtagacaagcccaagcattgagaacacctacagcagggcagaatcacagcaaacccttatggcagccctatgaggaaactgaggcacagagaaattgcaaataattgttagagccagaatttgaacccaagcctcttaaacatcacagtgtactgtactgtcttaatgattagcatctccttttcccaaaatcaactt

SEQ ID NO: 108091 - DNA, 1035 bp, Homo sapiens
attatttttcctgtctggtgattccctgaaagagaccccacttataaggccgtctttatacaacctgactcagaggttgcccagtgctaacagctttttcccagaggacatttgtcaaaaacaagcagaggcaattgttgaatattatagctgcctggggaggtagataacaatttgggcaaacaatagggtaacctgaaagcttaaaaagaaaagctagggaatgaggtggccataggaggctttgaaaagctcatatactattcctgggattttaaaagaccaagactatgtatgtggctttgcacaatatttcaaagggatccacacttaagtacttcacaatcaagctgtcaaaaggcaaagtcaaagaaaagattttggaaatagcaagagagaagtgactcatcatctacaaggaatcctgaataatataaaagactgatttctcatcatgaacaatggaggcaagatagttttatcactctgtggaaattctctatatcttcacacgtgatatttacctttttctactaggttctttaacatattaatcatagttatttaaagtccctttgtattaattccagtctgggccattaatgtgtctggttccagtattttatctctatatggagggtcattattttcgcacgtacacgtgtttgtgtgtgtgtatgtgtatgtgtatttttaaagttttgatttaatgctcaacattttgtgtaaacaaaataaaacagtagacagtccactatatatttatgtccagtaaaggatttcttttcttctgtaagaccattagtatgggggcttgggtttcttctaagtagcaagtcgttagggtttttttcctttcttttatccaaattgataatcatttttcttttaagggtgagattaatcagttcatatattagttaacagttactaagtaacaaattacaaaatgtagtgacttaaacatttattatcttgtggtttctatgggtcagggatctgggcctggcttagctgggtgcctctgccctaagg

SEQ ID NO: 108092 - DNA, 1028 bp, Homo sapiens
gttactgcttttattggtagcctttttagaaattctatttcttcccatatttgagattcagtttataggttcatttggagtggaaagttcactatttctattgtcacctacacctgcacctcagtgcaggacgaggtctgattttggccttctgaggcctgtctccacagtggtcctggtgatattgcagagccaggaactgagtgactaggttcatttgtggtccaggggcgggatctgtagcttccaggctttctaggtttaagtaaactgaaaaccctggccctcagtggaggtcttcagaagttttttatatcagcttcttattttagggagatccctaggctgcaggtcgccagcctggcttcaggcccccgcttgtgcggaatgtggtttattctgaccctgcacgataaagagggttcctgactgcctctgcctgctccagacttggagccagcaggcctgtggcttcagcctcacccactgctttgcatttctgtttggtattggacactttaatcttgtttttgaacttgtccgtgtctttttgtcatctgttctatattttatctgccagtgctatgtgtttggagtagggtagaggcatcaaagtgtgaactcactgtgttgtgttgactggaggaggtccttgaccaaatcatgcagattccctcaattctctattcaaagactgtcatctgctaagtacatgttcataatgatgacattttacctttatattagagtcaacattcttaatttcaaaatttttccctgaagactttcttagaaatctccttagggaaaatagcaacccgctaaccctacaagtgagtctgtcttatggtcttcccagcacatctctctgtaattatttatctgcacacacatttgtgtctcccactgggatctaagcttcatgatagcagaaattctctctctggcttccctgttgtgccctcagcccttttacaattctgtctgtcacatagaggtgtccttcatggtgttctggtaagtgacgc

SEQ ID NO: 108093 - DNA, 1042 bp, Homo sapiens
ctaacgtgggctttgttctcttccaagcaggccagggagctggagagcagagaggcagagctaagacgccgtgacaccttctacaaggagcagctggagcgtattgagaggaaggtaagactcctgcttggctgcattcctcggggccaggtcctaaaggcatctgaccagaacacatcactgtcatggggggagagaggagtccgcagacccagtgcccattcgcccagatgccagtcactccttggacatgccctcctgcattctgcagcaggcacccaaatagagcctttcaacaagttgcattcatggagataattggtttttaattgtctccccctgccccacctttttttgttgaatgtggctggctctacggtagttcaattttagaaaaaaattcactttcaccacagggcggtgctgagtcccagtataccttttccactttagttaagctgcatttggtaaaaataataataacgtgatgtcttgctatacaaatacattaaagttttattattgattttctcctgggagtcgggaagatcaaagtgcactacggctgcacactcactgcttttctaaggataagcctttgaaatgaatgagatttaaaaacatatcatcatgcctttaaaaaaaaaaaaaaaaaacccctaccacgactcttgaaaattcatttggtaacttgcttattttttggtttaatttgtggatcatgacagatttttcaaagaaatggcttaaaatgtgggaggggatggttgggaggttaaaaaaaaattgttccccctcatgcctgagacagcatgccaagcaacctgagccatcagcttattgcaggcaaatcttcgcaaatcatttgtcatggtttggagctttgaaattgacagtttgcttgaggggcctgatttccacaggggttttctcctgtggcatgccacagtggaggctgacagaaatatgggtttctggatttccaggccatggggaaaagagggaggttcttccttgccccatcaacacctgcttgtccacc

SEQ ID NO: 108094 - DNA, 1024 bp, Homo sapiens
aatggatacatccaaacttctcaatggtacatcaaaaacatgtaccaacaaaaagtgttttggagtttcttgccccacatctataccatcacagcatggtgatggtacaaaattttgcatataattattgatacggctgagcatcttttcataagtttattgggcctttgtatttcttcttttgagacttgcctctaaatatcatttggctagttttgtgttaggcagtttgtctttttctaattaatttttaggacttctttatataatatgaattattaacttctaattatttattgttactctgttttcctgatctgttggtttaatgttatagatactacttttggcatttagatatttaaaatctgtgtaacttattgtaagtttaaaagctcccccttccctatttttgtcattttttaagtttgttaatttgatggacaaaaaattgtgttttggatctgtacttatttattaccaattaagcagtcacattcattgctttctgaaatcctgttttattcattctaatcattgttggaatctcccctgttagaaggcactttcaggatgttttcctgttgtctccccagctggcgatggcttagctgctgactagcagctcccaggttggaaaagcatgggctttgggttcatccctgggtcagattcttgtcctcagcacttgctaactgcgttagttaactttcctgagcctcaattcctcattcttaatggaccttactggagtgttgctaagggttccctgagatactatatgaacatgcctactagaatgtatacagagatattcagtcacttcttcctcctgaggtggttcctctcattagtggtcactcatacctgttctttatgttggattaaactccgtgttccagtatagaattaggacccgttgcttctactcccaccctgtggagtcgccgtggctgttacagaaccacacagcatccacctgcagccccctgtatgtgtggaggtcggggagctaagggctgac

SEQ ID NO: 108095 - DNA, 1054 bp, Homo sapiens
tcattctgaactgccactagtggagatggtattccatgctccctcagggaatgacccacccatctctctgggccactgcagcatcctccaggcctccaggcctccaggctgatggccacttccactctttcttcccagtcgacaccattacacggcagccagcagtccttccagaatggatatcagatggggtcctttccctgattaagcccagtggctccctaccaactctggaacgggctctgcggcttgaggcccaaccctgctggccctccctgcatctgtgcctcgtgcggtccaacaccttccgacagcgctcatcttgctgctttacgccgggtgtagtctcatcccagacctctcccagtcttgacttacttttctcgttcacatgattcggacttctgcccagtgtcagccgggggtcggggagggatgagccttccctagccagtcatttacaacaatacccctaccttgttgttccttttcactttatttagcctgctgtggttttgtattttttccccctccatatccagagcgttagctctgtgaaggcaaggacttcacctctcttggttcctgctgtgctcaagtctgtttgcgttcattattcattggatcctcagcacccctgaaagctaggtaggagtttttctccctggaccaatgaagaagcacgttcagggaagggggagtcatcatccatgtcacagcagacgctggaacaaagaacccagatgactggtgggcatctcttttgagggtatagggaccatgggtgtgggcagaggcatgcctggccctagtggaaagtgctgggggtacatatgcccagcagcagctgctgttgtctctcaggtggaaacacggtcatctgatggtgggaattcaggggtaacaggtaaaggctgagatagctaagaaggggaatgggcaaagacgccaacctagggtctcaggaattacaagttgcatggaaggttcagttgagctgactttgcattgactgtagtcagggcagatctctgaatctctttagggtctctgc

SEQ ID NO: 108096 - DNA, 1066 bp, Homo sapiens
tttcaagtcctacagcaatactaggagcctgagaggaggagaatcttccaaaaggcagatagagacaaggacaggtgttgaggtagaagcccagccctgctgatgctaggaccccacagggcctgagtgagtaagcaccaaggctgcctgcatccaggagttgaagggtgctgcactgccctgcagggtatgagccaccccacacacagacaccctgcccccactggtggtcagctctcgacctgtttctgaagggttccccccggtatgtcctgttcatctggggctgagaaatacttggaatcacagaacattgagaaggagagctgtggtggcagccacatcaaagaggctgctgagtgacagctacagcatggatgtgatccccggaggtgggccaggccacagctcctgcccattctcttacccgagcagcttcttccaaggccaatggcccctccctttctacctggagccaggacccacctgccaaggagaagatgcactgggggagaagccagacagctttctgttggtaaccataatgcctgtcacctgccaagtggcccaccatcatgagggcagggactcctgccccaccagcccctttgtgaatttggctttattgtcatagcctttctcatcctcatatcccctgaaagcaaggtgggatggatgtgaatgtatttttaatctgagtgaagcctaaggtttttttgtttgtttacagcatcccttgataataattagcactatttactaagcaataagtactctgcaaggcgtttcaactccattctatatttactcttgttggtttcatatacaagtgaagaactgaggctggagaggtcgaataactccttttgtccgtggtcacagctggttctgtggcagggctggggttgctcttcctttgtttgtctttgcatcattgctgtcccttgcaggccctgcctggacgtaagatggcagcagggtggagctctcagagcctgcccgggttttggactcagaccaggcctcagacctcagccctgccccttagcaagtcacttcacttcta

SEQ ID NO: 108097 - DNA, 1051 bp, Homo sapiens
tcatgtaaattaacacctacttcagatgggtatggatttctaaatatggattaaacatggatttttaaaataaaggaggactgaggaaatggtcacatcaattctggacgagaagacagtttttatgaaacagttccattttaaagacacgtctaatcagagttgggaatcgttttggaaagaatatctatcttgccattcgttccagggtttacttgtgagcacgaatcacctgctgtctccggccacctgggatgctcagccagtgcctttggaaacatttctgccttgaatgtcaggtagtggtgagcgggatggcagggctggcatgaggcagagggctcagtgtatcccagatgtggtgttcccttttgagagcctccctccctcaagatgagcaggtgttaaggctggcctcatctgtatccctcctgaccgcttaggtgatcttgaagtgtggaccctcctgggacacacagcatctcctgaccaagctcagccccagaataactagtctggaaggcccaggcttacatgataaccaggttaagtcccaggctgatgttccatagacaaggacagcattgcatggttgaagcacagaaaagttctggggctggtgagtgcagagtgggatagctattgtaacagaaaggcgttctgcactcaggttttgttactatgcagattcctgctacatcagctcaaaaccgtgtgcggcttagtctaaatgcctatttaagcaaaggccaaaagtctgtttgaagatataaagggaaaaatagtgttcataatacaaagcttgaggctagtcatagatgtacaatttccacgcagtaaaagtgagtaatgaaactgcatttaattgttcaaaagtagcagaaatgcatctttaagaattaaaaactacaaaaaggtgattatacagcatagcaaatctctaacatggattaaacagaattgtttaggagataaaataccagcatgaacatgcattttgaaagagggaagaacaatgctgggtttaggtagggagagcccagcttctgct

SEQ ID NO: 108098 - DNA, 1991 bp, Homo sapiens
cttctgtaggggacggtggtggagtatgtccccaccagcctcaggcagggagctggtgcccaccctgggagtacagagctgtggggagggtcctgctccccagtgcatagggaggctctgggtgaaggctgctctccaggttggtgtcagatgttggtgtcagctggggtcccattccacacctcaggcccttgtcacctgccttcctgttcctggcctccgccagtgatggcagggcacaggtgccaacggagtgacctcttgccaggtgtcctggggatacctggtgcaccccacagcttatagggcctcaggccagggaggtgcccagtttgcccctggctcctcctggtgggtcaggttctgcctcctggaggtgcagtgggcacgcccagcactggaagggctcacactgggagatcataatatcatgggatgggccatgcctgcattcacatgccctcttctgccccttccccagggctgaagctcctggcaccatgatgctcaccccagcaggaccagagcaccgaggcccaaggccccagcctgccatgccgctgccaccgcggagcctgcaggtgctcctgctgctgctgctgttgctgctgctgctgccgggcatgtgggctgaggcaggcttgcccagggcaggcgggggttcacagccccccttccgcaccttctcggccagcgactggggcctcacccacctagtggtgcatgagcagacaggcgaggtgtatgtgggcgcagtgaaccgcatctataagctgtcggggaacctgacactgctgcgggcccacgtcacgggccctgtggaggacaacgagaagtgctacccgccgcccagcgtgcagtcctgcccccacggcctgggcagtactgacaacgtcaacaagctgctgctgctggactatgccgctaaccgcctgctggcctgtggcagcgcctcccagggcatctgccagttcctgcgtctggacgatctcttcaaactgggtgagccacaccaccgtaaggagcactacctgtccagcgtgcaggaggcaggcagcatggcgggcgtgctcattgccgggccaccgggccagggccaggccaagctcttcgtgggcacacccatcgatggcaagtccgagtacttccccacactgtccagccgtcggctcatggccaacgaggaggatgccgacatgttcggcttcgtgtaccaggatgagtttgtgtcatcacagctcaagatcccttcggacacgctgtccaagttcccggcctttgacatctactatgtgtacagcttccgcagcgagcagtttgtctactacctcacgctgcagctagacacacagctgacctcgcctgatgccgccggcgagcacttcttcacgtccaagatcgtgcggctctgtgtggacgaccccaaattctactcgtacgttgagttccccattggctgcgagcaggcgggtgtggagtaccgcctggtgcaggatgcctacctgagccggcccggccgtgccctggcccaccagctgggcctggctgaggacgaggacgtgctgttcactgtgttcgcccagggccagaagaaccgcgtgaagccaccaaaggagtcagcactgtgcctgttcacgctcagggccatcaaggagaagattaaggagcgcatccagtcctgctaccgtggtgagggcaagctctccctgccgtggctgctcaacaaggagctgggctgcatcaactcggtgagttgggcaggggcgcccctcctcccgcggccccatcccctccagggacgacggcatcggtgtcagatgcacgcccagtggtgcctgctgtgtgcctggcctggcttttggcttggccatccccatggctcagctaggtggggctgcccttttccatcccccagagagtgggtttggacccagggtgctagccccaaaggctgctcccagccatgatgctgtcttgtgcctcagaagatg

SEQ ID NO: 108099 - DNA, 1002 bp, Homo sapiens
cactccctctcctcacactggaaggcacacagggctctcgagcgcatggggtgggtgttggagtgggttttgccagacagaggaccgtgcttgtgtggaagcccagtgcagcagcttagagacattttgtggggcgccccagagcctgttacccagccagtgaccaggttcctctagccctaccctgttcctgctgcccagcactcaccctcttgtgccccaggggcaccgtttgggtcagagctttgctgagggagcagcaggacacagctgttcctctgggtgccagttggcctgtctcccctgcctcctcaccccagtcccacagagggaaactgaggtacagaacagggaactgcagagttgggcttgggcccatctatgggaagaggctgcttctgggttgagattctaccaactcttccccttcttcctgcccccattccttctcccaattttccccttcccacccctagtcccaaggaggaccgttctcagggaggcaggtatgggtggagcctgtcctctgctccctgggccaggtgcctccttgagcctggctttgtgggcagctgctggatggtgcagctgggaaggtggaggctgcgtcctcatggcctgacatggctagttccttcctggtgaccctggccgggcccccacccctcagagccccaagttctcctcagaggctctaggtgcccatacctgcctcccagcacccaacctgggtaccgcctccctccacccccaaacaagtctgggctgggtgccgtgggccatgtgtgagtggcaccctttgggagcatctggggtcagctgtgcccaggggttgctggcctggcagagtctgcagtcggggacttgggtctgagttttgttcggaggcccccccaggcaaggcacgcctctgctttgtccccctggatgcagacacggtcatgttggtgaagaacctgccgcctgtactctttcacccaaatccacctgctctcaaactgt

SEQ ID NO: 108100 - DNA, 1004 bp, Homo sapiens
gggagggtcctctcaagcagggggcggcatgcatgggcagcgccagctcctggtttgtgctgggaggtgggagggtgggctgttggggccagttgtggaaggttctggtggtctttggggaaagatttgcagagcaaggaggtgacagctgggggaagattccagggcatgcctgtggcccgttcccatgcccgggacacgtcaagcctctcatttgctctgccagctgcccagctgctgtgggaggggcttctgggcccagccacctcgagggtgggctgcctccaggcgggtggcccgaaagtggacagctgtggccagggtgtgggcgtcggcacgtgggctcccggccggcgtgtgcccttctgtcctgccacccgctctggccccaggttcacctgccgtctgtgcccctgtgctctggttctcctggaataccctcctgctgggtactggctcccccttcccactttacgagcagcctctgtactcctcccaggtgcagttgcgggtccagggcccaaggttcctctggcaggtgctgtgtgagtctcagcttacctcctgtctgtgtggtttgataaagctggcttggctgcacaggcccttcaccctgaactctggctaggacacagacacatgtcctggggaccattgtcctagctggatgccctgtagaacatgtgtgggtgcacaggggccctgctgagtctggaccgtggcgcctcagtgaacagtgtggggcctgcacctgcgtcacatccatcctctggtctggtgtgctgtgccgtagtggcctccccagtgccccgctcacactggccatgccatggcctctcctggggctctgtctccctgggcccagcctgtgtgtgtgaaggggtggaggtggcaggtgggtggacagatgggtacatggcggatggacagctggacgcgtgtgctcccggctgcagctgtcagagccaactgtccagtcggcatgctgctgggtggagcggggc

SEQ ID NO: 108101 - DNA, 1033 bp, Homo sapiens
tgggcctaggcccctgccctgaggtggaagtggagaggtagagcgggagcaggagtgggtcaggctgggggaagcaggccacagcccgcagcctgagagcctaccctggactcagagctgggcagacacgccccaagagtcccatctctggaaagccccgtgggtctctctgttaattaaatacatttgtttggtaaaagcaactaaaaatacttgcagcatcgtgagctgcggagaagagctggctaattaacgcctggtttgtttgggatctggaatacatttccatgccgatgagacgcccaccctcctccactgccttgccaggatgcccccacccctaggacaccccattctggagtctcctggtccactgccctagacttcctgtgagccctggcctctgcccccgacaaccaacatccctccttcaaaagcccagcctggccccagggatggctaggcacccgtgggactcctgtagccttcaccctgggtgtggccatgctgctccgtggtgggtgctgggctgtggttgtctccaggccccaataccttctggcctctgctgactgttaaaggggctgaatcacagactggcctgttggggtctgagtttgccctgcactggggctggggctggggctggggctggggctggggatgtggagagtgagtatggctggcgctggtcctctctgctcatgcatgtctgggcagctcagggaggggctttagacccctgaccttctgtggggggtggggctgggtcagggaggtatcagcacagctccagttagggccccttgctgccgcagatcctggtggacctctcaaaccccggtggccggcctgccctggcctacgagagcgtcgtggcccaggagggcagccccatcctgcgagacctcgtcctcagccccaaccaccagtacctctacgccatgaccgagaagcaggtgggtgctgcaccagtcagacggtgtggctgaaggtgggggccctcctaccaggaaccccagtcacagagcag

SEQ ID NO: 108102 - DNA, 1050 bp, Homo sapiens
gagcagggcagggtaggtgggatgaagggaccacatggcggagacctggggtcttgcggggggctgcaggctgaaggtgggagtgggtgaggggtgggctatgtggggcgcaggttgggtgggggacagtctcatggggacttggggtgcaggacccctctggctgccacagcccgttggacagtcgctctgcaggcccttccacaggagcaggcagcctgggggcctggggagagtctcgcggttctcaacccctcacactgagcaggaggcaagcagggcagatcccaggccctggtcacctgggggctgagggggctggatgcgtgtttgatgcgactgatggtggcagctaggagggtctccgggcaagttgttcccctgtctggacttgccctgtgtgggagtcctgggcaagcagtcctggtgactcagccatgctgctcgtgcaggagaccagcgggtggtgaaactctacctaaagtccaaggagacagggaagaagtttgcgtctgtggacttcgtcttctacaactgcagcgtccaccagtcgtgagtgtctctaggcccctccgcccgcctgggcctgggctacttgccccactcccgtccctgtggtcccactgtgcttgctgtctgcagacctgtcctcatgtggccaggcagcagatggtgattccatgattggggctcctgaggctgggcggtcagggagggaggagaggccactgtgagagcagcttgcaggtagaggagccagccagggcaaggccatgagtgcagagggtgcctgaggctggggcaggcgtaccaggaagcagcagtcagagtgggcggcagtgcctgccccacagggatcttgtagggccccaggtggctgtgtatggctgcaagggcacattgtgcaatgttgccaccgtgatatggacagtggcccatgggcactggcatggaggggaggcgctcagggaggagctgcgggctggtttgggggcctgagcaggggcccagacacggcccctgggtacctgctgcttctggttgtggcag

SEQ ID NO: 108103 - DNA, 1029 bp, Homo sapiens
tgcacctgacagtgattttgcctgtctctgccccagtccggggacacggatctcccacctcaaggcagggcagtcctggcccattcagcaaagatgctgaggtacacagagcatgctgatgcgtattctagggccagctgggagtcttggtttcccagcctggctgactgtagggagtggtcagaggctgcctgtggttggaggtggtctccaagggggtgccacagaggtgactgtgggaagcacagaggttcccttggaagggcacctcatatggttgctagcctggagagagggggctctggagccaggaaggaagtcctgtgtaggatgagggtggagagggagcggttgtggctgcagaaacttccccctaagctggcgccctggtggctttgtgggcgtgaggcttgggaggcctggaggccgcttagctgggaagcctgacggtgccatcacctaacagtactcctacgaggggaacgatgtcagcgacctgccagtgaacctgtcagtcgtgtggaacggcaactttgtcattgacaacccacagaacatccagggtgagtgggcgccccggcggggtgggcagtgggcgggcccgagctgaccgcacccctccccacagcgcacctctacaagtgcccggccctgcgcgagagctgcggcctctgcctcaaggccgacccgcgcttcgagtgcggatggtgcgtggccgagcgccgctgctccctgcgacaccactgcgctgccgacacacctgcatcgtggatgcacgcgcgtcacggcagcagtcgctgcaccgaccccaagatcctcaaggtagggcccccagccctgcccccacaccccatgccccgccctgcaccaccgcacaccctacgccctgtgggatgcctgtaccccagcctctgcctccctcagctgtcccccgagacgggcccgaggcagggcggcacgcggctcactatcacaggcgagaacctgggcctgcgattcgaagacgtgcgtctgggcgtgcgcgtgggc

SEQ ID NO: 108104 - DNA, 1044 bp, Homo sapiens
ggaggcattgagagggagaacgtgagtccctgccctcagctgcccacctcggtccaggccttcacctgggatggggctcctgctaggaatacccgtgtccctgcccctgcccctacccctgccccttcccagcttatgccaaccttggctgtgcctggagacccctggggaggcacctgtcctgcctggcgggtagaaggtctggctctgggttgctggctgcacacacctctccttcaggccacatgtccctggtccacgtcgggtgggtggcccaggaccagccctgctagtgcctggcatcatctgtgcagggagcaggcagcccccaggccaggggctctgtcactgggagctgccgggccactcgcggaggtcccgcccagcatccccaccctgtgtctccagggctgcctggtgtacaatgacaccaccatggtatgccgcgccccgtctgtggccaaccctgtgcgcagcccaccagagctgggggagcggccggatgagctgggcttcgtcatggacaacgtgcgctccctgcttgtgctcaactccacctccttcctctactaccctgaccccgtactggagccactcagccccactggcctgctggagctgaagcccagctccccactcatcctcaaggtgggtcaccattgcccgtaggctgggccaagccagggaagaggcccctcgtcctgggctctggctcacccccatctcctacagggccggaacctcttgccacctgcacccggcaactcccgactcaactacacggtgctcatcggctccacaccctgtaccctcaccgtgtcggagacgcaactgctgtgcgaggcgcccaacctcactgggcagcacaaggtcacggtgcgtctgtccaccgggggtgcagagctgggagagccatgccccacctgtggaccctgccccactagcacagccccagctctgaccttgcccgagactcacccctagctcagagggcgcccggctccagtgcaggccctgccgtagccttcagcctgccacctcctt

SEQ ID NO: 108105 - DNA, 2951 bp, Homo sapiens
ccagctggggagcaggcccctgggaggctggagctaggcggggatcctgctgagaccaggggagacttctgggtgaaataggcctcggccctccctgatgcaggtcccgcgtgccacgccatgttcctcgatacactactgcgcctcctggctcatgtgtaatttagggttttcatgtgatatttgtgggatggtgggtatgttttgtttcctgattttcttgcagtctctgctgggctttgggactaaggctgtacttgcctcccaaagagttgggaagtgctgctcatttctccttgccaggaacaccatggctggcactcgacgggtggaggggcaggttgggggtaggcccgggggtcctggctgcagcctcatgccgccacccccgcaggagtgcgctggggagccgctgttcatgctgtactgcgccatcaagcagcagatggagaagggccccattgacgccatcacgggtgaggcacgctactccctgagtgaggacaagctcatccggcagcagattgactacaagacactggtgagcgtggctgccctctgtcctgggtgccctggtgccccccaccccccagttgtggggctgacgctgcccccttgctccaccccgcccgcagaccctgaactgtgtgaaccctgagaatgagaatgcacctgaggtgccggtgaaggggctggactgtgacacggtcacccaggccaaggagaagctgctggacgctgcctacaagggcgtgccctactcccagcggcccaaggccgcggacatggacctgggtgagcgggcggggccacggctgcccggggtgtgtgctggagcagaggggcagggccatggcctagtactgagcttggcggggaaggccaggccagtcctccacaccaggctggtctggagggcagtggaatggcgagtgggctgtccagtcccaggttgggtatagagggtggctgccctgctctgggcagagactctgggaggtggtgggttccagtgcactctgggaggcagtgggctcttggagccctgagggggatactcaggctcatgagaggggcaggtggagccattgagggccagaggggatgggacgggtttggggtggggcccggagtcctgctgcagatgtgactggagaggctgggtccccacagaagcctcggtgccaggctgaggagttggggccctaaggcttgcggaaggcagggcagacccccttaggctggggctgctgtggcagattgggagggctgtggcacattgcaggggactatggcaggttaagtgtgctgcagcaggggcggaggtatgtccctgccctgtgctggtgctgagagctgcaggcaggccccgtcccactacactgctgtgatggaggagggaaagagggccccagcggccccaccctccagctccctcctcccccagagtggcgccagggccgcatggcgcgcatcatcctgcaggacgaggacgtcaccaccaagattgacaacgattggaagaggctgaacacactggctcactaccaggtggctcccggccctccgaccctagcacaggcctccctccccttggggcttccacagcgcagccaccaatgtttgcagcatgtgggctggacagcagctggatctgtcagggagaggaggggaggtggtcacttatgtgtgtggaccgtcccaggactcgagctgggcttgtgggattgcctagcatccctgggctgtcctgatatagagttccagactgagtgaggtggctgcctccaggcacagcactagggtgtcaccggggtccccagccggggagtgggagcctggtggtgcaggggcaccctggtgggtcacagggtccctggccctctgcccacaggtgacagacgggtcctcggtggcactggtgcccaagcagacgtccgcctacaacatctccaactcctccaccttcaccaagtccctcagcagatacggtgaggggccaggcagcgggcgagagggcagcgcatgggtccctggcctgggcaggacgtcccccgggctcccacgctgcagcagccggacgggaggacccaggggcaggtgtcaagcctgtcactcgcactcttggccttaccctccagctctggaggctgcgcctcctcgcgactgtgtgtccgtacacaattatgccacctctgtggtgtcatcggctgccccaaaatcccacatgggtgggggtgccatccccagctttcagatggggaaacaggctcgggcggggggtgcggggtgccagccaacgcgggcgctgacagcctggtgctgcagagagcatgctgcgcacggccagcagccccgacagcctgcgctcgcgcacgcccatgatcacgcccgacctggagagcggcaccaagctgtggcacctggtgaagaaccacgaccacctggaccagcgtgagggtgaccgcggcagcaagatggtctcggagatctacttgacacggctactggccaccaaggtgggcctggctggcagatgggggcaggggacgctgggccaactgagctcagagaaagtgccaagcccagagcaagggcctcacccccatgctcccatggccacttgcctagtcacccaggaggtgtaggcagccaggcagcgccctggggctcagtgtccctgcctgccccccgcagggcacactgcagaagtttgtggacgacctgtttgagaccatcttcagcacggcacaccggggctcagccctgccgctggccatcaagtacatgttcgacttcctggatgagcaggccgacaagcaccagatccacgatgctgacgtgcgccacacctggaagagcaactggtaatgcagggcagggggaggaggggcatcccccagggccaggccagatgtgttcccagggccctcgccctgttctgatccgga

SEQ ID NO: 108106 - DNA, 1050 bp, Homo sapiens
ggggacggccttcacttaaccatgggccctgcacctctgtgggcctcgtttccccgtctgcatggaaagccatgcccactttggattcggagctgggagggccacaaggtcactgctcaggagggagcagaggcctatctgagcagcgcctggactctcgcctgcagcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtaggtggagggtgcaggggtcgggggcaggggcccgggggcagcctggactctgctcatgtgcccacctggccactcacctgcaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgaggtgaacaccgtgggagcccacaggctgggctaggagggcttgccggcccctgccagagtcacctgctctgccccgccctgccactcctccctgaatctctgggctgccactgaccaccttcactcctctgcaccctctggccacctggttccttggggccaggagggagcctgccaggccgagcagagaaggccgtggtggagtcactgtgtgcagccatgtggggtcaggggtggggaagatgggatggcagcttcttcctgaggcagagggtgtgtgggtggtgagcaacttccctgaggggctcatttcagggttttctagtctgggccagcatctccagggctgggcataggctcttggcagagctttcctttcagtatcttttctgctgacttggagtgaggccacgtacatggacctggggacgggg

SEQ ID NO: 108107 - DNA, 1025 bp, Homo sapiens
ggaggcagacaggaggcagagggctgtcctcaggcaggtgccccaggggagcagaggagcagccagagactgcatgtattagggtggggagtggggacaaaagcctggggtcctggggctcaccagggaaaggggagctgaggctctctggggagctctgctttaaaggggcacagaaaccccagggtgtgaggactgggtggggacatgtcagcagcatggccaggcagccaagggatcagagcctgctgttttagggggtgagagtaggatgatgacaggggcagggctcattctccatattggggtcctggagggtccaggctcacaaccaaggtcctttggccaggggtagatggggttgaacctctggcacctactctggaggcatctgccctgggcctgctgagtgcatggaggctggtggcccggcatgctgacagttctcctggccctgcagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccgggg

SEQ ID NO: 108108 - DNA, 1516 bp, Homo sapiens
gggcccgttgccaccgactcccacctccagcacccatgcccgctgcaccgctgccatcctcagattcaccgcgtgctctgcgcggccgaggccggagcaccacatccacctcgccccagagaggctctgctccctcctatggaggggctgtgggccaggctgctcagactcctgggtggcttccagacggaccgggcagcccctctccgtcctcagggctgtgcctctgggagccactgggccaggggccccgggtcgcagagagcacgttcccgttatttattcccctccgcgtcctacacaggctgccctggcagctgtcttcaagggtaggctgagctccccaccctggagcccctgagggcggcccctgagcactcctctctctccactctctctgtccctgccccagcggcttccagtgtggcatctcagcagtgtcctggcccctccagagcagtgggacatctggggactgtttttgtgtttaggggaaaaaattctgctgcactctgcttgggccttgaggtctgtggcagggctcctctggcccgcagtggcctggatctatctgggccatgagtgacgggcagtgaccagagggactggaggccagcggtgtccacccttgccctcagcaagagagaatgcattcttaaaagaaagctgtacatgtatatatatgcatatatatatatgtggctctagcctcaggctccagccccagtggggtactgtacagttaactgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatactagaggttgttagacccttttttatgttttttaattaatcagtcacttgtaaaagcaaacaagcggtccatccccttttcaaggtcacttttttgatggtaccgaagatcccatggacattaagggacagctaactgtggccagactcagccccatgtccttggccaggcccaaggagaggactcggccccatggggtgtgccagtcttgcagtccgccccagctgagtagcgtgagccagatgacgccacagagacccgcctcttccctgaacgcgggtcggtgtggagtcagtgactgctgactcagggagctccttggccccgtgggcactgtgccagggctggggccttctgctgctgccacacccagctcaggcctgggccagcccctgcccccagcccactgagggggtgggcttactccctgggcagtcttgggggccagagctgaggccagtccatattacagtggctgggctgtttttttc

SEQ ID NO: 108109 - DNA, 1308 bp, Homo sapiens
ccaacccccactctccttaggccttgtgctctgctctgccctgccaggctgcccttgtccatgtgagtagcatgggcgggtggtggggacggcagtggtgatgaagggggtgcaccacaggcctcatgaagcagttcccacatgggcgtgtggctggggcgtggccaccacagagcacatggctgtgtctaggcgcaagcactttagcagtatctgtttacatgcgcaaggatcaagccgactacctgtgctgtctactgggacagcagtctccgagctactccgtacctccctctgccaggtcgtggagttaggccccagtccctacttgtcactggttcccactgtgctcctaactgtgcagcacctgggagctctggcctggggctggaggccctggtaggagctgcagttggaggccgttctgtgcccagcagcggtgagcggctcccatgggccctgtgtctgcagggagccagggctgcggcacatgtgctgtgaaactggcacccacctggcgtgctgctgccgccacttgcttcctgcagcacctcctaccctgctccgtgtcctccctctccccgcgcctggctcaggagtgctggaaaagctcacgcctcggcctgggagcctggcctcttgatatacctcgagcttcccctgtgctccccagccccaggaccactggccccttggcctgaggggctgggggccccacgacctgcagcgtcgagtccgggagagagcccggagcggcgtgccatctcggctcggccttgctgagagcctccgccctggctttctccctgtctggattcagtggctcacgttggtgctacacagctagaatagatatatttagagagagagatatttttaagacaaagcccacaattagctgtcctttaacaccgcagaaccccctcccagaagaagagcgatccctcggacggtccgggcgggcaccctcagccgggctctttgcagaagcagcaccgctgactgtgggcccggccctcagatgtgtacatatacggctatttcctattttactgttcttcagatttagtacttgtaaataaacacacacattaaggagagattaaacatttttgctaaaagctcttggctccaggttttccttgctgggaagcaggggcggccgcaggagtgcagccacatcccaaacacggaagcatatctccctgggagactcagccacacccaggacagatggccacactctgtgagttgggtgcgctcagcccaggtgacacattggagcccttggcggagactaaaacacca

SEQ ID NO: 108110 - DNA, 1172 bp, Homo sapiens
tattagttctatgtctagtaataaaagttagtggaagactactgcaacccaataacgtcaggaccacggagagtgcaggtccttcaggaaggaatgggagtcaccccatcaataaagaaccacaacagaagggctggctgaaatgaaagagagcttgaaacagacagcaggaggaggaggtgatgaaaggtcactctggccacacagtcaggtacagcatcaaggatggtcatgccactttccttcgcttgctatgtctttattcatatatatttacaagttatttctttgtcccctgctcttttatataaggcatgtttgtgatgtctaacttaaaattagccttgtgccaaagaatattcgggttagatggtgactgaactggaaggctgcctaaagatgatctgacccccttttccatccaggggcaggaatgtcttggtttgtgcaagggattattgtaagcatgctcctgtctttgctgcttttgtatggaagcgtgaagaagtgtaaaaggtgagaatggcatggtgctgaggatggggactgtgatagtgactcaactgtagacgtcagccctgctctagcccttcatgtggctgggaggctggatgcctgcaaactctggggcttcttataagctggctccttgttagattcagcaaatggaaagccctagaaggagaatggaatggagatgggaagcagcagatgtagcatggggccacagacacagctcctgggctccagcccagccctcctggttatatgggccattggaactgtccgtggaattggaagggcacatcagcagtgggttcggcagtggcctcagcagcacagtgctcatgggcctggattcttgtgtccagggcagtgtggaccctgcctcctgcacagaggtggtaggagggatgaacacacagcaacagcagcagcaagtcctgcagcagccacagcaacccagccatcatgggccccaggtagccccactttctctttccctccaaccctggatggtagactcttcctgccattataagtatttgggtaaacttaccttctttccttctttgtagcccaacccttccagtgcttttctaatgaatttgctatataaatccctgttcctggctgggcacagtggctgacacctgtattcccagcacttt

SEQ ID NO: 108111 - DNA, 1094 bp, Homo sapiens
ttgtggaaacagatcactaggactattcaattgtttaaatctccagcagcatatctaaacatttgtcattgtttaaaaaaaaaaaaaaaaaagatgcccctggccaagccctgctctaggctatcgagagtccctcacccagcagtgtccatccccccgcggcatccatccccctggcagtgtcatccacccagcagtgtcattcccccagaggtgtcatccccccgccaatgtcactcacccggcagtgtcatccccccgccagtgtcacccacccaccggtgtcgcccatcaagcagtatcatccccccaccagtgtcatccccttgccagtgacacccacccaccagtgtcatcccccaccagtgtcaccacccaaaagtgtcattcccccaccagtttcaccctcctgtcagtgtcacccacccaccagtgtcacccccagccagtgtcacccactcagcagtgtcacccccagccagtgtcacccacccagcagtgtcatcccccaccagtgtcacccatccagcagtgtcatctccccaccagtttcctcctcctgccagtgtcatccccctgccagtgtcaccccctcgccagtgtcaccctcgccagtgtcacccccaccagtgtcacccctgccagtgtcatccctccaccagtgtcacccacctgccagtgtcaccccctcccagtgccacccacctgccagtgtcacttgcttgtcagtgtcatcccacccaccagtgtcatccccccgccagtgtcacccacccaccagtgtcatctacctggtggtgtcatccccccgacagtgtcacccacccgacagtgtcatccacccagcaatgtcacccacccagctagcacttgcagtgcaaacgggttttggacccctgcctgtgcttcccctgcccctggggacctgggagtgtcccattttgcatcttcgtttgccctccctggtttctcctgggctctctgctggccctcttgtctccaggcctaggtccccagatagctctctgtcttgttcaccccacactggggtccagtagtaatacccactgtgtccgttccctggtgttctgtat

SEQ ID NO: 108112 - DNA, 1034 bp, Homo sapiens
aacagaattggggagctggtactagaggggaggggaatggatgctgggtggggaaaatgcccactgcatcctccatccattcgtcccccatctgtccattctgtgaaacctctttggagaagacatcttacttgctgggagagcctgcattgtcaccacttggtggtcctggcacgtgttgcctggggagaggtgtcagggctgtggttgagaaggcagctccaaatgtgggctctcctggtataggctccaggtgtgggctgtcccagtataggtgccaggtgtgggcttcaggtgtgggctgtccaggtgtgggcttcgggtgtgggctctccaggtgtaggcttccggtgcgggctgtcctggtgtgggcttcgggtgtgggctgtccagctgccttccttcagggcgcccttcccctgtctgcagggcctgcctgactggagtcctcccttctctgtggcccttagataccaccacatgagagctgagtggctccctggtcccctccttgtggtctagcccagaacttcccagtcagaggagtgggctgtgggcaggcagagagacagacaaggggctggggaagcctggaggttgtagtggcctgatgtccctcacacctacaagatggtggtagacaggactgggaactgaggcctgctttctttgcttctctcccactgcttctctcaccatttattcatttgtgtatttattcaacagatattaaacacctactgtatgctaggcagatgtccttttgtggggtaagggggagtgcaggcagggagaaagagccagggctaaatgtccaggaacatataacagggcccagcccatcaacttttggggactttgtcctaaagagttcaggaggcagtgttaagagtggactcaggaagtccagctctgaaccccagccatgctgctgtgtgacctggggccagtggcttggtctctctgtgccccagtgcccttctgcataacagatgttgatctgctttagctatggtgttcatgtgagcacctat

SEQ ID NO: 108113 - DNA, 1080 bp, Homo sapiens
agcgcccgcacgcgagggggcggtccccggaggctccgccccgacggtccggccgcggcccaggccgggaggtggagcgcggctgccgccagctggtccactgacaactgctgccagctggaaggcgcgtagggcgagaggtggcgcgtcctcagctttccagtcttcgattccgcccgctttccgagtgagaaacgcaggcctctctcttccgtgaagcagcgtcttgtctctgcacctcctctgtgctgtctctttaagaggtcagcgggctgctccgcctcttgggaatttgattggtctctcccacttttttttttttttcccccagtgatgacttattcctataggctgctggaggttagagggcgggcctgagtgataacagggactctgggactctgggacttgtgggactgtggccgttttcgcaatttgggctggacgaaaaagacggtcttgctttcccggtcgccgctgtcgggaagggctgcagggtgtccgcgagacccgcggcccggcgagctgaccccgcctcgcctttcctgcctagccctcattccacggagccggtcgcgcccggtccttgcgcgacgcttcccggcccaggccgcctggtctggcgctggaggccggagtcccgcggcctgtgctggatccgcgcacacccagtggcggcggatgggcggccggggcggccggggcggccggtcctgagcgcggcccgggctgtcaggtaaggaggggccttctccccgtctcctgccgcagctagagggggagccccgtccctcgccccggcgggaagcccagccgccgttcccctccttgctccgcgagcggcccatttccgctcgggcgcagctcggacggccaaggcggcgtttgggagggaaggccctggatgtgggaacccacgggaggggtgccgggcagtcgggagtcgctcggggcgcgggggcacgcgaggcccgggagggagccgcacgtagcggcgtcgggctcggccccggctggaggcagtgcgggtggagatccggacctcggcgacccggtccggcgcggggtggcggcacgggc

SEQ ID NO: 108114 - DNA, 1942 bp, Homo sapiens
gcccggcctctgttgtcttgtcagcaaaatggccctggtgtgaccgaggtcacgcagccagcaagtgtcgtcgggtcccctggagcctcagcttctacctccgctccagctcccaccacagcgcaggcgagcgcacgcgcacagcgccgggccgcacacctccgggctctgggcggagcgcctcgggcgttgtaggcgggaccggaccctctggcccgcccctccgtgtcccttctggtcgccagtggacgccgacgtcatgacgtcgcgttccgtagggctcttcccgggctttggtgggtcacgtgaaccacttttcgcgcgaaacctggttgttgctgtagtggcggagaggatcgtggtactgctatggcggtgagcgcgctggcgcgtggcgggcgggcgccggggacatgggtgcggaggctgcgcgcttcccgtactctggccccggcccagggcggcgctctgggtgaggctgggccccaggctctggggcgcagctactttctcgcctgcaccctgcgtgaggcgactcgcctacctaccactgacctggggccctgggctccctaaggcgagctcggcccgttcagcctctgtcctttattcaccccacacatacttattgggcgccatctgtgtggcgctgagcgtacaaaagacaggcccccatttcactacactcctttaaactttttttttttttaatttcccaatgatccttgttccaaacactacacttacttttgtattaccttcttgtccctttgtcttgtatactgtctgttccacatctgagttccagacctcttgttttggtggctcttctatgccatctctatcacaataccttgcgcactgtgtgtgctgaaataggtctaatgcttaaggggagataatagacagtaaacaggtaaataggcaaatgacataacctcagtggtttttcatggagaaagcacggtgatgtgggtgaccccgatatttgagctggcttctatttgtttggaagccactgactcagattgctcagctgagagcattccaggtgagagaacagcaagggcaaagatctggaggctggaaggggtttggtgtgttggaggacaagagtcacaggtggagagaaagaagggaaggcccctgatggtaaaaaggaagctgtatcatgcctcaccagcttcctaggtttctgacaaccgcaccttctcttgcaggaatcatcggaatccttcaccatggcatccagcccggcccagcgtcggcgaggcaatgatcctctcacctccagccctggccgaagctcccggcgtactgatgccctcacctccagccctggccgtgaccttccaccatttgaggatgagtccgaggggctcctaggcacagaggggcccctggaggaagaagaggatggagaggagctcattggagatggcatggaaaggtaatttcattcaaggccctggactcagcagatagttttgcagagagcccattgtgtgcctggtggcctggctttgggagctgggagcagatgaatcgatggcattcttgcctttgagcacagcttgatccagggttctgaggagacaggtttacagagccatgacacaggtctctttaacttactgcatgtaacttggaaagactagaccctaagctgaggataagccccgactccataagcaccccagagaatgtaggggtctctaatctggaatactccaactcaaaaagacaggaagcaggaagcccagtgtttcccagtaacttttcaaaggaaaggtgcatgggggaggagggatctgataaataaagttttagagtcaatcagcaaacatttattgtacctaatgtgcaccatgccctttgttaggaatggtcttgtttattagtaaacatgtggtggctcacacctgtaatcccagcactttgg

SEQ ID NO: 108115 - DNA, 1072 bp, Homo sapiens
cggccatcaccgccatccatccacaaaagtcttttcagtttgaaaactgaaactgtctcggttaaacactaactccccattcttcccagcacctagcaaccatcattttactttctgtttctgtgaatttgaccgctcagtgagtggaaccatataggatttgtccttttgtgcctggcttctttcactcagaatcatgtcctcaaggttcatccatgtgccagcacgtggcagaatttccttctattttaaggcttcatcgtccatcatatggacagatcgtgttttgttcatccattggagatcttttctgagccttctgtgtttctgacctggaagcgctgagcctacccacaatggggctcctgaaccttagggaacaggcccagttcctggatggggtttggtgcttagggttttcctttttggcagtaaccacatctgttttggtgctccctcagggactaccgcgccatcccagagctggacgcctatgaggccgagggactggctctggatgatgaggacgtagaggagctgacggccagtcagagggaggcagcagagcgggccatgcggcagcgtgaccgggaggctggccggggcctgggccgcatgcgccgtgggctcctgtatggtaggtccagttgtctgcctgcccgagggactgggaagctgggaaggagtctgggaggggagtagaaggtgctggggatgaccgcagtagcaggtgtctcttgcctccccagacagcgatgaggaggacgaggagcgccctgcccgcaagcgccgccaggtggagcgggccacggaggacggcgaggaggacgaggagatgatcgagagcatcgagaacctggaggatctcaaaggccactctgtgcgcgagtgggtgagcatggcgggcccccggctggagatccaccaccgcttcaagaacttcctgcgcactcacgtcgacagccacggccacaacgtcttcaaggagcgcatcagcgacatgtgcaaaggtgtggcttccctacgcccccgcctcagcccctgtagcgcctccctaaatcctccccagaaa

SEQ ID NO: 108116 - DNA, 1482 bp, Homo sapiens
ttgcccgccttggcctcccagagtgttgagataacaggcgtgagccaccgtccccagccaggaattgacttttaaaagggacatgtagatcttgattcctgcaattccttccactgctttttgtcctgtgtttgtcagtttcttcctggctcttgtaaggcgtttcatgtttgtagctgtgtaggcactctgctcatatttaatttaaccccccagcaactttgtacactgtgtgacatgcccattttacggagtaggaagttgaagctcaggctatgtcacagctgaagtgtggtagacctagaagtgaaagctgggctttctaggtcaaaatcaatggtcggggtgggtaggccttgcttctcacacaggcattgttgcagcccagcccaggcctcatgcttagttaactctcttcccactgtgcccccttctagagaaccgtgagagcctggtggtgaactatgaggacttggcagccagggagcacgtgctggcctacttcctgcctgaggcaccggcggagctgctgcagatctttgatgaggctgccctggaggtggtactggccatgtaccccaagtacgaccgcatcaccaaccacatccatgtccgcatctcccacctgcctctggtggaggagctgcgctcgctgaggtgagctgagggcaggtgaggatggcaggtccgagctcagtgctgggtgactcggtcgtgattcctgaagagcgattgtggtgtgggcggggagggtgcagccagcagcatcctcatcgcaggtgagttgtggttgcacaggagtgtgatgggagggatcttcccgggctgggggctgggcccaatttccaggacagtgtgttgggacactctcgtctgcagcctggcctcaccctggctcacggcttctgatgcaccctctgcctccgcaggcagctgcatctgaaccagctgatccgcaccagtggggtggtgaccagctgcactggcgtcctgccccagctcagcatggtcaagtacaactgcaacaagtgcaatttcgtcctgggtcctttctgccagtcccagaaccaggaggtgaaaccaggctcctgtcctgagtgccagtcggccggcccctttgaggtcaacatggaggaggtgagagaggacacaaggtctgctgccagctgtccttaggggtgcccagtatgcaggacctgactggcctctcaggctgtggaagaccagtgtgggcagccgcaagaagcaagatagaattgtgtgttggccacaccctggggtggacccagtctgtctggccagtggacttagcttggcccacacgacgtttttaggaattcaagtcaatatttaagtcaggcgatttgtttaaaccatacaagtttatggctcctcttgaaacatgagaagatctggcaaacagggcccacttcttgccaggtcactccttcaggatgtgtgcttaccagtctccatggtgcc

SEQ ID NO: 108117 - DNA, 2046 bp, Homo sapiens
agccaccttgccagaaaatgcctcagaggttccacctgtggccacctacagccaaaagctgacccgtctcgtctcgggtggggcagctgcaggccagatgccagctgagccacgtctttgctcactcttcccatgccctgtctgtctccctcaggccttgcttctagggacctgagatagtacctggtagagggttaacagttacagctatcattcatggagtaacttaccagtgccaggtggtgggtggtttattacctggtcctttttcacagctcatgaggcaggaactgttactggccccactttgccgagtgtttagagaactggctgaggtcacccaaccagaatgtgtgttagaggtccacagctcaggcatcttgatctagagcatgtgcttttaactgcagtgccatgttgtgagataatgggtacgaaatgacatggcacagtgctggcctgtgatacttgacagtgacagccaaaacttcctgtaacttaacatttatcagatgctggattaggttgatgtatgtatgacttgctttaattcttattgtgaggttgcagagaaggcacagagagaggaagtcacttgcccaagatcacacagcttagacacagaacccaggcagcctggttccagcatcggtactcaagacagcttagctgtaaagcatagagcaggtgctgagtctggccgtcagaaggcatcccagagggatggtgtggcaggagtggggactgtcaactgatgtgctgagtcgccatgaactcattccttgctgtctttggctctccatttgccactcaggagtcggaatcctgcctgttctccctcctgttcgggggtcaaggttaggtgacatagtaagtcagtgatttgaggccttctgtgtgtccctcgcagaccatctatcagaactaccagcgtatccgaatccaggagagtccaggcaaagtggcggctggccggctgccccgctccaaggacgccattctcctcgcagatctggtggacagctgcaagccaggagacgagatagtaagtggccggggcaggctgggagggagccaagttgcagagggaactggcagaagcagttgtggctgggccggtggcggtgtctatggtcgcaggggcactcgggctaggatctgtttttgcatggctgaggcaaagaactttcttctggtggatgggttgttggaatggtgggtttaggaggggttttactgagttacttatcttggtgtctgtagtgtggagcacttgcaataggagaaactggaggaaggcagcacggaggtgggcacccctgggttaggctctgacttcttggcccctccctttccccaggagctgactggcatctatcacaacaactatgatggctccctcaacactgccaatggcttccctgtctttgccactgtcatcctagccaaccacgtggccaagaaggacaacaaggttgctgtaggggaactgaccgatgaagatgtgaagatgatcactagcctctccaaggatcagcagatcggagagaaggtaggtggaaggcaggggcaggggctgtcaggatgctgtgagaggatatggagggttgctggggctgtggtaggcacctagggctcactgctcaaaccttgccttattcccctggagctcagtaagcttgtctggaagggaggccctgtgctccagggaagaggtaaactcgcattggggatgggtgaacctggctgtggctccaccatgggccagcgaggtagtgggataacttggatgacctctctgagtctgtgtggtgggaggagtcccctgctgaggacggggttgcgacgagaagagctcttcctttagcagatcatttcaagctgtggtttgaaattggaacagaggcagggcaataggataacttgtgtcatgagggattcctagggatccagctgtggccaacgggaatttcttcagaaaaacaacccagaatggtggtgttttttgtttttttttgtgatggagatggggtctcactacgttgt

SEQ ID NO: 108118 - DNA, 3097 bp, Homo sapiens
ggcaggcacttgcatgaactgtcgcatttgtacccacccttctgtgagttggatgttgccatctctcttttccatatgaagaaactgaggcttgaggtaggccagtgccatgacagacctggttctggtcttatttctgctcttggtctgtgatcttgggaaaggcctttctgaaatatgtcaagattaggggttcagatgaaggttcttctaaactccaaagttctgtgactcttgggaagagccaactaatgaaaagctttagagtcgggcacggcttgataccagggcctgatgcagttgcagcagctgtggaagtgggtgtctttgagctggggatgtcgtggttccctgatgccagagcatgtgggtgacctactctgtgagtatctgttcccattcttgtcggtctccctccctttctcagatctttgccagcattgctccttccatctatggtcatgaagacatcaagagaggcctggctctggccctgttcggaggggagcccaaaaacccaggtgagcacccacctttcctctgcaggggtgttagcagctttctctttggggagccagcattcaaagaaggacacagtgtttttaaagcctgggtgctggggagaaagaatgcattaaaagatggtctggctgggcgtgactcattcttcaagggagagggtggccctgagttgggcattctgggtgttgggctgttggtcagggagccagtgtctgcctgcttttgtgatttaagcaaatgagtctttgcttctcttctatgtaaaaaatactttgtcttttaaaaacctgttttaagtacaaaaatactattgacacatgagtttgtatttatattacacttttatagaacactaaaagtcatgggtgaggctgatttccccattgacccccacttctcttcctagtccctccctttgtggccatttacaattacacagcaaccacagggtttcatgactacacgtgtttatttgtacaagcgcagcgtcccctgtgtgtgcccagtgctgtgcctgtgcgcagtgcatcccaccgagctctcccgctcagtgccacactgcagcatcttttcttgttagtgcatacagagcaattgccttcttttaaatgactatcatgccaccagataacgcagtttatttagctctccctttggagaacacttagattgtttctgatatttcacattcgccaaggacatctcgtgcaaccctcctctgcacccgtgtgtgtttccctgggagtgcccagagtgggactgcatggcgtagggcattgtatccctttctagagggactgtgccttaccattcctaacaagtaggttgaggaattggtgggggatgcaactgtgccctcctcctctcacttcccactctccccctcccccgcttctactcatcccctccaggtggcaagcacaaggtacgtggtgatatcaacgtgctcttgtgcggagaccctggcacagcgaagtcgcagtttctcaagtatattgagaaagtgtccagccgagccatcttcaccactggccagggggcgtcggctgtgggcctcacggcgtatgtccagcggcaccctgtcagcagggagtggaccttggaggctggggccctggttctggctgaccgaggagtgtgtctcattgatgaatttgacaaggtgggtccctgggtcacggaggctggtggaactcagggggtgtgtgtgggcttgggccttagcgacgggaatggtgttaatggggtccattgggacctcatcggagacttagtagtaggggcgtgaaccatgctaagggtgggccattttaatcttgcagatgaatgaccaggacagaaccagcatccatgaggccatggagcaacagagcatctccatctcgaaggctggcatcgtcacctccctgcaggctcgctgcacggtcattgctgccgccaaccccataggtgcagcaggcaccctgactgctggggctggggtgggacacagggaggtcccgcctgcttgaattgggagcccacggggtccccaggagccgatctgaggaagtcattgtgcagcagagggttcccctcttctgcatatcctgccagagtggggaacagtgaaagtgggacctgggacacctgggtttcctgttgagtcatgttcctggaatcaccttggatgttctcagaaggcatgggaggagagcccagtgcccctctggccaggatggagttggctgttggtctcagcagcgaatgcgtaaaagaacccaggctctgtcacccactgtgttcttggtttttcctcctggggaagcagttatgctttctgtctaaattaggctattttgggccctggttagggtaagctctttgctgtctcagacagcaggtgctaagtacccacctatgtcttcctcttccactgccctcatccccttctgccatcagagcagcctggggtccctgagatgggaggataggggaatccaccctgatggaggtgctcccctgtgtttcaggagggcgctacgacccctcgctgactttctctgagaacgtggacctcacagagcccatcatctcacgctttgacatcctgtgtgtggtgagggacaccgtggacccagtccaggtatagctcacatgtgcccggtttccatgaactgtggtttggggacctcaggtgaggcttggggtcatacagtgtgcccaacacaggggacaggtgctgcaggggccataggctgttttctagtcctgttccctcggtctcttctcatgtccagaagtcgccctgatttctctttccttcacagcacccccgacccccaccctacataacccacaatccaccaaatcctgttgtcccaactcctgagcctacccacctccctcacttctgcctctgacttgaggcactaccatcatctgaactggcctcctggcacccatgtagactgtcttccagttgaaggcataaatcagatcagccccgtccttaacaactgcttgaggctttctgctgtcatcagaatagaatccagggtcctcccctccggcccgcacccgccatctctgcagc

SEQ ID NO: 108119 - DNA, 1068 bp, Homo sapiens
cacaccactgatggctcactggacacttcctccttgcaggctcgtcagatcaacatccacaacctctctgcattttatgacagtgagctcttcaggatgaacaagttcagccacgacctgaaaaggaaaatgatcctgcagcagttctgaggccctatgccatccataaggattccttgggattctggtttggggtggtcagtgccctctgtgctttatggacacaaaaccagagcacttgatgaactcggggtactagggtcagggcttatagcaggatgtctggctgcacctggcatgactgtttgtttctccaagcctgctttgtgcttctcacctttgggtgggatgccttgccagtgtgtcttacttggttgctgaacatcttgccacctccgagtgctttgtctccactcagtaccttggatcagagctgctgagttcaggatgcctgcgtgtggtttaggtgttagccttcttacatggatgtcaggagagctgctgccctcttggcgtgagttgcgtattcaggctgcttttgctgcctttggccagagagctggttgaagatgtttgtaatcgttttcagtctcctgcaggtttctgtgcccctgtggtggaagagggcacgacagtgccagcgcagcgttctgggctcctcagtcgcaggggtgggatgtgagtcatgcggattatccactcgccacagttatcagctgccattgctccctgtctgtttccccactctcttatttgtgcattcggtttggtttctgtagttttaatttttaataaagttgaataaaatataaacgctggtatctgttggcttccattccgctttagtaagtaacctggacttccgctgaaggccctttccaccttctccgttcagagttctgtaggaggtaggtcgggttaaaaaagctgttttgtttgtggatgtagagaaagcaaaaatgatatagatatccccattgaacttggtttgcagtcactgcctctgtgatatctaagtggaatccatggaaatcctagttagacgtgtataggactagaggtggtgta

SEQ ID NO: 108120 - DNA, 1232 bp, Homo sapiens
ggtagttacatggtgcacacctcttttggccatcaccactcccacccgcccatgtgttcatccccagcaccatgcacttgagcactaggcacagggagcagttctcccataggccttaccactctgtgtacccagtttctgggcttgtcactgtacatggctgcgtgtgtgtgtgtgtgtgtgtgtgtgtgtgtgtgtgtgtgtgtccccagcccccgccccgctcaactgcatgtgtctctgggacaggccccttgactttctcatggctagaggccagggcaggaaggagcacctggtgtaagtgaacaaatgggtgtacatcttggggttcccacattccctggcttgcagctctcagagggtctccagagttgaccagagctgcctctcttggaacagccagagggttgagggtgagtacggggctgggcctagaggcagagggctcagtagagcccctttccttcactgaacacggggggctctttctgcccttgtaggaggtgttccggcagcaccgggggccacagctcctggccctggtggaagaggtgctgccccgccatggcagtggccaccatggggcctggcacatctctctgagcaagcccagcgagaaggagcagcaccttctcatgacactggtgggcgagcagggtgagcgagggcaggtgatgggagggcccaggagggcagtgggaggcgggcggcccctgagggtcacgggaaaaaagtgcacgcataagggctttgaaacttggaactccaggacagtagtttgagctacttagcttagtggtcaaggtgtacccaccagcttgggttctggggacaaggaggagggtgtgagaattaaggatggggaacaggaggcaggggaacaggtgtggtccagcacaggtgggagatgaatggacactgtacctggtgtggcaggggagaaggggtgtgttcagaaggcagtgtgtgggcttcgcaagtggctggctggtgttatacaaatcgatgttctaacagatcgatgcagtggaaagcatgtctaagagagggggaggcatgtgccttgaggatctgtgtgcaatttgagccaggaagggagacagaggctcaggccagctgttggagagcggggccagagcccttggaggggcacgcacctcagccatggtcacactgatagtggtgtttcttaccccccaggggtggtgcccactcaagatgtcctttcc

SEQ ID NO: 108121 - DNA, 1031 bp, Homo sapiens
gcgcccaggagagtcactgcctccccttgcagatgaggacacctatcgatgggcactctcctctcaactggcccccagccccacctgtccccacactcaccacgtgcttgagcttgggcagccggcgctgccagcagttgtagagcaggccaagcgcaatgatgatgatgcagatggccccaatgaccaccagcaccacgaagagcgtgccgtagtcgctgcgcacctggctggcccgcgcctggcagctgctggttgtggaatagttctggatgccaatctaggggtgggaggggccagtttcctcagctgaggtcctggggtgccatggctcctctggggtggttgcattgggctcgggtggggatgggggagcaggcttagaaggtgctggcactcccggctcctgaagttccctggcgcctgggcttgcctctaccccatgcccatcccgtttgcctcagtacacctggaggcctctccaccccatgcccatgttcccagcctccttcacatcccaccatagcttctgccccagccgctgagtctgagctcactgtggccctaggcctccagtgagagtggacccatgctgctggacaccatccaactagagagagtgcccacacctatcctaactagttagagagacaggagatgtgagccccccacacatcctccaccatacaaccgcttccacctcggtggggaggggtggaccagtcagcttcctgatgccagggccggtgcagggagggatactgagggcatgcaggccacatggggggccaccccggctgcccagcttcctcccttcccatggcgtgttcactgctggcatgtagctgcctgcatccctccacgctgcaggttgtcatggtcagtcctgccttctctggccaaggagatcggcgccaggggccaggcaggtgctatctccacagatcagcatcttagcagagagaagcaggagggcgagcaccaccaggggctcctcaggtgagggatcagggcagttcccagtgctgagg

SEQ ID NO: 108122 - DNA, 1904 bp, Homo sapiens
tgccgggtcacagccctcggagcgcccccgcggggcagaccacccggacccccgccgcagccccccagcggaagcgcgctggggcggggacactgatggccattgacccccggagggcttcctgtaagaagggactgctcagcggaggcccgaaggcgcagaagtgggcggagagaaggcgggccactgttcgccctggtagggcccggacgtcagaccccccgggcgcagggcgcgggtataggcctgggactccagacgtggcccctttctctcgtgctctctggacctggcgcggggaacacctagagcccataatcggcctccggtccctgaggattcggaaactcctgacgcagctaaagtgaatctggcgctgagatgccccctccatgggccggacgcggagggaaggggtgcccagttgggttctggggcccttcccctccttgggcttccactatcccgtttgacctccttttttcttggcccttcctcccccttgacctggtgctgactgactgcttccacctcccctgggctggcgccgggctgctgtactcccgtagcctccctgggccgctccctgacatcccgtgccactcaagagttagtgcatagtgtcaacgctgagtgggttcacagcacttccaggtgcagcctggaggcctcctttgggctgcccccgcctcagtggggctgcattagcattggcgactcccctcgctcaccttccgcatcccatcagttgctgtatcccgcgactcctgcctcctagaattgtgtgccctccacaccatcaggaggcctgcagcagctttttcccgggctccctgcttctaacagggccagcttcttcctgcagtagagagctctggtgggagtgaaggctccatcacctcctctcccaaacgctgaaaggccaaaggtccagcctcggcactggctctggcttctgtccctgtagcccatcgtcccccagcactgatagcacacagtgtctgcctgttcgaccccacctccacatccttgcctgcactttgccttgagtgcctctcctgctctggtctgcctgtcacctgccctcacctgggggaggcttccccataccaaaagggatgttttctctccgttcctttccacgggccttctttctcagaccatgaacccgtcctgacccaggctctgacctccttcctgcccaggtacctgctggagcagcgagacgtggaggtgaatgtgcgggacaagtgggacagcacccccttgtgagtgctggagagaggggtggggagggtgggggttggtgcaccccttcagcactgaggactgcctcctgtacttccttcctcccttcaggtactatgcctgcttgtgtgggcacgaggagctggtactctaccttctggccaatggtgagagcagggagcccggctcacgggtgtgcgtgggtgcatgcatgtgtgcgtgtgggtgcatgcatgcgtgcgtgcattcaaaggccttgatacacatttgcaaagcaccacgattcctctcttaccacccagtcgaatcagcaagtactattattgctactttaaaaccttttctctgtccaccttgcccatctctacttctacgacctgggcccagtcatcagcatttctccccggacacggtgcctgcctctctcttgccattgcagccaagttgatcttttcacaatgaatctgatcggctaaaaatcctccagcaagttcccattgcctctaggatacagtgagcctgcctggccatgcccaaggctccacagggtctgccctcccactggcctcattccttcggctctccctgcttgcttgctgcttgcttgctgctacactggcctcgctggggctccactgtgctatgcatgcccctgt

SEQ ID NO: 108123 - DNA, 1055 bp, Homo sapiens
gcccaactcacttaacttctatgcatttcactctcatctgtaaagaagataaatcatctgatgactggagagttagaaatcttgcatgtggagttgcagaggaacgggtgcatagtaaatgctcaggaaggtggcagcttgttctcctcctcctctttcccctcatcaccatcagcagcagtagaagttggtgggtatcgctcatggcatttactccgtgcctgaaggagactctagctctccgtaggtcttctgctaagaatataggtcttgaaaattggatagtttggaatctaaatgctgccacattcgcccccgagggaggaagcaggccctggtggaggacctgcctgccccgcgccagcactctgcctgggccattggcatcgattagctcccatgagcctcacaagcacccacagggcgatgctcttcttaccatgttacaggcgaagaaatgaaccttcatgggactggagctctgcctgagagctcacaggaagagcagggatttgggctccattctgcgtgactctgaagccccgcattttaacagcaaactcctcttatttgacaatgcctggagcccatggtgtggctcctggtgttgctgaggttttgtaagctctggtactgctgcagcacagtggcagccatctgggcgtttcttttcttttctatttttttggagacagagtctcgctctgtcacccaggctggagtacagtggcgccatctcagctcactgtcatctctgcctcctgggttcaagcaattctcctgcctcagcctgccgagtagctgggatgacaggcgcatgccaccactcccggctaatttttttgtatttcagtagaggtggggtttcactatgttggtcaggctggtctcaaactcctgagctcaggcaatccgcccgccccggcctcccaaagtgctggaattgtaggcatgagccaccgcgcccagccccgtgtgggctttcctaaccaggctcccttcttgtctctgcagggccctcatctttgtgtcccatggagccggagagcacagtg

SEQ ID NO: 108124 - DNA, 1113 bp, Homo sapiens
gttctagaacaggcagaataatctatagtaacagtatcagaaaagtggttgcttggagtgggagggttgactggaagtgggcacaagtgaattcctggggtgatcaagacattctgtaccttgattgagtgttggttacatgggtatagatattagtcaaaatgcattgaattgctcactaagatctgcacacatttcactgtacgtaaaatttacctcagtaaaaaaaaaaaaaaatgcaaaattccccaaggaatcatagttgcttctaatatttacatataaaatgtctttagaagtcttctagtcaaaatctcgcattactaatttagggagcactaatacaattccatatataaaaactaagaaaatgtgggtgtggctgaggctgttatttcaaggaaatcttgaaaacgttgttagtaatcatttgtaactacatgtcaatgtcttccaattggctggtgagaaaccttaaaatctcacttctcccagccagtatttccagggtgtagtaagggagcaggacttagaattctcttggtcattcccgactttttaagtccctgcttccactgatcttttgtctgtgttctagaacacagatctagattttgctttctttgctttgtccacactgcttctttttcttagggcaatactcataaaaccagcatgattatttcacttttccaaggaccactgattcaaggtccaattcagagactctttgaaaatgttaagcagcggggcagtttaatattgcagcatagcacattgaatcataaacatacttccgtggagcttttattgccttttttcttctttttttgagacagggtctcgctgtcacccctgcaggagtgcagtgacgtgatcttgactcactgcaacctccgcccccaggttcaagtgatcctcccacatcagcctcctgagtagctgggattacaagtacacaccaccatgcccggctaatattttgtatttttagtagagacacagttttgccatgttgcccaggctagtcttgaactcctaagctcaaatgatcctcccacctaggcctcccaaagtgctaggattacaggcgtgagccaccgtgcccggcct

SEQ ID NO: 108125 - DNA, 1412 bp, Homo sapiens
cagcaggtaatgacggagacctactaggtgacgggcgccgcggtagacgctgggataaggtccctgctccagggagcttacggtctattcactaacgtcaaagagcagtgagtgctgttacgtgtatgggagccaccagggtctccgcctgcctgcagggccacgcgcgcactcgacgcttcgcgcctgcctcagtttctccgtgaggccgcacagccccagtctcgggaggcgtgacacaccctccccgcgcgctctcgcgttaccaagtctgcgcagccgcacacccccagtcccggcgggccccgcgcgccaggccccttcccgacaggccccaggagccccgctgcatgccggggcttgaggtctcggcgaagcggcgcggcgcggcgaagcgcggcggccggcgggcgcgcgtggcaggaagcggaagcgatccgaggcccggccccggccccgccccgcgccgcgccgcgccgcttgccgccgggctagcactgacgtgtctctcggcggagctgctgtgcagtggaacgcgctgggccgcgggcagcgtcgcctcacgcggagcagagctgagctgaagcgggacccggagcccgagcagccgccgccatggcaagtgagtcctgtagggaagccctattgaggccgggacggaacagatcccccttccccacacccgtgcggtcgggcgcccgccggccaaccctgaccggccccctgcagaacgcggcccgtgcccccggcccttctcgagtatccccacgcgtccggggtgcggccggctcccctggcccctgctctcactcgtcgtgggcagaaggcgtccctgggtagcgcggaaggttacttctctgtgtcccaactcttcctgttttgtttctcccatcaaagtcaaatttctggaagtcatcaagcccttctgtgtcatcctgccggaaattcagaagccagagaggaaggtaagtaccccaaatcgccaacaaagaaggtttcaggaaactgtctggactctggaagtttacagtatgattaaaaatggcttcagcacggcaatggaaactctcccttctcttcccttggagtgtagttgtgctctgttattccggagagctgtcgaaaggtgacctggttgtgtggaaatttccactgaaatcactgtgctttatttggagcatctttggtggatgttgctccgagaacaaagcctccggttgccctgtcccaaaaatggatccgggccatgaatgaataaggcctcagttaggatagcagattgagttaccctccctttttcacctccaacgggagcagatcacgggttggttttttttcccaggagatgccctttgtatccagctgctaaagggaagggctgtcactttagtatttacaaatgattttgtacc

SEQ ID NO: 108126 - DNA, 2617 bp, Homo sapiens
aatactgtcagtctctcacaaggtatttcaacctcagaatcttccgtctgtacaataattaatgtttgttaagccctctaaagccattaatgtagtgtaggcagcaggtattagtgaagacactcagtttcagaggcagaaaacctggaagagttcccactctactctttagtgacagaggttttgggtgggaggttttctaatgatacttaatacttaatagtcatctttacagtgattcttgtcacctatgcaacctatgtacctgagaagatgtgaaaatccttaaacaaatgttactagtaggttaaacatgcaactctcctgcccttccccaatatggtttattacactgttttacccttaattcatagaaaatacactattgagcaattccaaattacttgactctagaataacaaggttttgtgactgaaactcaaatgaaaagtggttgctcgtgtgttttacaagtcatgttctattgtgacattctttgttcttgagtcttaactgttaatgctaatggttaaaagcacagtttgggactcaaactcactttagcattggggtttggtacaaattatttagctcttctaaggctcagttgtaaaataaaggtaatgctctgtggtgtgaggtgagctggggtgatgcctgtaggtccttgcattgtgctctgtgcagaggaagttacgcagtacatggtacttatgtttggtacatggtttggcttctctgctgaacagagaaaagagtctggttggagtccatttttagagaaaggggtctgattggagtccatttttattaatttgcttttcaaagtaactccctgcttcaattcattctctcctactctagattcagtttaaggagaaagtgctgtggaccgctatcaccctctttatcttcttagtgtgctgccaggtaagctcaggcttgtatttcgtattggggagggggataagagtggctggaaacaggagtgctgactgttttgctctttgcctgttcccagattcccctgtttgggatcatgtcttcagattcagctgaccctttctattggatgagagtgattctagcctctaacagaggtaggactctggctctgtcttttctctgtagagtgtaggcttacctagcttcacttagttaaattaataggctttggctttatatggaacttagagagtgacttggaaaatagagtgaagaatgttaaagtgctgtgttgaatagccttattaaatgctgagttcagcaccaaggcataccatcatatttggaattgtatttgaatgcagtacaaaacctgtaatgagaagataagtctatgctatagagagaataaaaaacatggaaaaactagaatactttttgaatacctgaaatgatgacatttccattgataacattcttcagaatatgtaatttgtttttcagctgtatctttttcatatctataggttacatatagtgtcaaaaaatatgtaacagtgttttatatcctctaaccagttacttatgggactggggaggattctgaatgtgtaggttgatactgcatttgattaactcatttaaaaaatatagttcaattaaattccaaatcagttggaagtgtagctcattttaacataatgggaagtagaggcttattcacaactagatacaattgtacaggctccttttccagactctggaaattatttgaatgttatcctttttttattaactgatgaagagacgaacatttcttatctctaaaaccagaatgaatctgtttatggtgaatttaaatgcagcagtctgtttagacaccatgtgacttcctaaacagaataagctgttgcctggcaggctgaacagaatgaattgaattatatactaatcgttgatattttggggttctaaattaaacacagctaggaaactgaaacacattggttttatataaggggtacccagtcaaattttgcgtattcatttttaaaataacgtactacgtttccaagctgatattgactgttttgcttccccgtttcctcaaggcacattgatggagctagggatctctcctattgtcacgtctggccttataatgcaactcttggctggcgccaagataattgaagttggtgacaccccaaaagaccgagctctcttcaacggagcccaaaagtgtaagaaagattgtgaataatctgatgtctatagttggaaaatttgaatttgctataagattttggtatcagtttttctttttttatttattttttatttttttttttttttttgagatggagtcttactctgttgcccaggctggagtgcagtgacgcagtcttggctcactgcaacctccacctcccaggttcaagcaattctgcctcagcttcccgagtagctgggattacaggcacgtgccaccacacccagctaatttttgtatttttagtggagacgggatttcactacataggccatgctggtcttgaactcctgatcttgtgatccacccgcctcggcctcccaaagtgctgggattataggcgtgagccaccatgcccagcccaaacagtattttcttttgtgctgcaacctccttggc

SEQ ID NO: 108127 - DNA, 1049 bp, Homo sapiens
gggagcggtggctcatacttgtatcccagcactttgggaggccaaggcaggatgattgcttgaggccaggagttcgtgactagcctgggtaacacagtgagagagaccccatctctacaaaacaacaacaacaaattagccaagtgtggtgatgcacctgtagttctagctactagggaggctgaggtgggaggatcacttaagcccaggagtttgaggctgctagtgcaccactgcactcctgcccgggcaacagagcctgtctcttaaaacaaaacaaaaaacactaagaaaacaaaaaaagtacaagcacaaattggctgttttctctttggtcttcacaatgttttgaatgttttcctgcattaagaactaattgttgtggagcactttttaaaaagtcaaatagggactgtatttgatggccactttggagtaaaattaattttacatgacagattaaataggaaagctgaaactgaaggtcagactgtacttagaggacccatctagtactgtggaacttgtcaaatgtgtccattcccttgtgcctaacagtgaaatagagtgagttgtaagaaatgaagacaccctacaaaaaggaaagcttttgccaggcgtggctcatgtctgtaatccccgcactttgggaggctgaggtgggtggatcacgaggtcaggagttggagaccatcctggctaacacagtgaaaccctgtctacactaaaaatacaaaaaattagctggctgtggtggcacgtgcctgtaatcctagctactccagaggctgaggcaggaaaatcgcttgaacctgggaggtggaggttgcagtgagccaagatcatgccaccgtactccagcctgggcgacagagactccgtctcaaaaaaaaaaaaaaggaaagcttctattagaccaaaatagcttggtacctaagggaatgggaagagcagccaaatcaatggtacgtggggttttccttttaaaagcacattaaataaaaacttgagaagggatcactttaccccagagctaataattctgtcct

SEQ ID NO: 108128 - DNA, 1109 bp, Homo sapiens
tttcttttgttctgtgtagtgacccacttggaaaacacttctttctttcaattctagtatttggcatgatcattactatcggccagtctatcgtgtatgtgatgaccgggatgtatggggacccttctgaaatgggtgctggaatttgcctgctaatcaccattcaggtaattattatgctaacatctccctttgagtagcccctcacacttacctacaattctcacataacgaatctcaagcacacctaaaaggaactcctactgaaaggaagcagaagcctaagactctgggttagccctctgaattcagcagagaaaggctttactgaccgctctctggggctgaggatgtgatctcattccgtcttcagcgtttatatcagagaacccaattactgaaggacggaaccatgtccgtggggagcagtaacacatagtcttgtatttttgaatttttacagctctttgttgctggcttaattgtcctacttttggatgaactcctgcaaaaaggatatggccttggctctggtatttctctcttcattgcaactaacatctgtgaaaccatcgtatggaaggcattcagccccactactgtcaacactggccgaggtaagggccctgtgctcccctggtggcgacagctttcagcaaaaacaattgagcaatgcaaagcagaagacaaaaatccccccattccacagaaaaataatgtcagttttaggtttatctcttctggtgtttgggtccatctgcaaagttttaaaaacacaaataggcttgtaattatgatgatacctaacttgcacttttcatataaaaatatctcctggacgtttggcacgtcagaatacacaatcctgcctcacttttcttagcacagtataagcttatattgcaacgataaagcaacgttaagtcatttccaggtttttttatcgttaacattgaaaccatgactgtcctcatatgttcatctttgtatattttggcagctgctctcagtgaataagtttctaaaaatgaaattcctaaaccaaagcacttggtcatgcaaggggcagctttctgaaaaaggcctgaacttggagcttagcacctgcg

SEQ ID NO: 108129 - DNA, 1677 bp, Homo sapiens
acacccggccagttttgtttattttttgtagagacggagtctgactgtgttgcccaggctggtatcgaacttctgggctcaagcaattctcccacctcggcctcccaaagtgctgggattacaggtgtaagtcaccacgcctagccttcagtgtatttttaaaccagcttttctgggccccttctggatgtgccaagtgcaggagtgcagtggtgggtaaggagtgggcacaagctctcggaactgggagccccagaaccagcacacaggatttcctcccttgtggcccactggacagtccccggccgggctgtgtttctgtgcagcaggctgaaatgaggcagtgaaggggatttggttctgtttggcttctcagggcttccgagtggacctgccaatcaagtcggcccgctaccgtggccagtacaacacctatcccatcaagctcttctatacgtccaacatccccatcatcctgcagtctgccctggtgtccaacctttatgtcatctcccaaatgctctcagctcgcttcagtggcaacttgctggtcagcctgctgggcacctggtcggtaagtaggctctttgaagatgagctagcaatgcagctaagttgcagtggtttctatcagtgtcttgctcatgaacagatatttcatccaaagatattttccattgtgccttttacaaattcagcacattaaattatcttttcagtaaaaaaattgtactgtgggcaccgagtaaaattgcattctttcatctgctcagaactatttttgccttgatgctaaagtaaaatgaaggagcactcacatgcgtttggtttcttcttccccaggacacgtcttctgggggcccagcacgtgcttatccagttggtggcctttgctattacctgtcccctccagaatcttttggctccgtgttagaagacccggtccatgcagttgtatacatagtgttcatgctgggctcctgtgcattcttctccaaaacgtggattgaggtctcaggttcctctgccaaagatgtaagtagaagcaaaactttctggaagggtgatgaaagtgtgactggtataaggggtgtggacttgtcacctcatcataaataatggtctgtgacgtgtgcagatagatcgtcgtcctttagggggcagttcagaagctttaagggctgacagatggagtccagcagtagatcagctgtgggtatgagaatctgaatccacactgtaaagttagactttttcatatgacttccttgcggcagttttaaagttctctgtatgaatattgtcagtgctcgaagaggcgatctgtaactgttcagtaccacttggaatgcctatttccccttcagcctccaattccaacttctcccctgtgggcaccctgcaggttgcaaagcagctgaaggagcagcagatggtgatgagaggccaccgagagacctccatggtccatgaactcaaccggtgagtggtggccccaggtccccaacctcccgtctgtggacatgtgttgtttctttccatgcagggcatcctgataggccctagcacttactgggtcactaaatcttatccttgggttacaggacagaattaaatgttatatatttataaacttgctaagtgctggacactggagacgtaaaaataaacacttac

SEQ ID NO: 108130 - DNA, 3033 bp, Homo sapiens
gaaattaaatttaatatatttaacctagtatatccaaagtatcatttcaacattataattaatgttaagaaaaaccatgatgaaatattttacatccttgtcttcaaatctccaaaatcttatgtgacatctcagtttggtctagtcacagtcccctggccacgtgtggccagtgtggccactgcctggacagcagcgccttggcctagagcgctagcatgttagtagatgactttctaggagacagcagaggggcctttgaggcattaggtcccaaagtctcaggtgagcctgttggccgcctggctcacggggagctctgtgggtgtccaggagctgactgtgtcccctcccccaggtacatccccacagccgcggcctttggtgggctgtgcatcggggccctctcggtcctggctgacttcctaggcgccattgggtctggaaccgggatcctgctcgcagtcacaatcatctaccagtactttgagatcttcgttaaggagcaaagcgaggttggcagcatgggggccctgctcttctgagcccgtctcccggacaggttgaggaagctgctccagaagcgcctcggaaggggagctctcatcatggcgcgtgctgctgcggcatatggacttttaataatgtttttgaatttcgtattctttcattccactgtgtaaagtgctagacattttccaatttaaaattttgctttttatcctggcactggcaaaaagaactgtgaaagtgaaattttattcagccgactgccagagaagtgggaatggtataggattgtccccaagtgtccatgtaacttttgttttaacctttgcaccttctcagtgctgtatgcggctgcagccgtctcacctgtttccccacaaagggaatttctcactctggttggaagcacaaacactgaaatgtctacgtttcattttggcagtagggtgtgaagctgggagcagatcatgtatttcccggagacgtgggaccttgctggcatgtctccttcacaatcaggcgtgggaatatctggcttaggactgtttctctctaagacaccattgttttcccttattttaaaagtgatttttttaaggacagaacttcttccaaaagagagggatggctttcccagaagacactcctggccatctgtggatttgtctgtgcacctattggctcttctagctgactcttctggttgggcttagagtctgcctgtttctgctagctccgtgtttagtccacttgggtcatcagctctgccaagctgagcctggccaagctaggtggacagacccttgcagtgatgtccgtttgtccagattctgccagtcatcactggacacgtctcctcgcagctgccctagcaaggggagacattgtggtagctatcagacatggacagaaactgacttagtgctcacaagcccctacaccttctgggctgaagatcacccagctgtgttcagaattttcttactgtgcttaggactgcacgcaagtgagcagacaccaccgacttcctttctgcgtcaccagtgtcgtcagcagagagaggacagcacaggctcaaggttggtagtgaagtcaggttcggggtgcatgggctgtggtggtgttgatcagttgctccagtgtttgaaataagaagactcatgtttatgtctggaataagttctgtttgtgctgacaggtggcctaggtcctggagatgagcaccctctctctggcctttagggagtcccctcttaggacaggcactgcccagcagcaagggcagcagagttgggtgctaagatcctgaggagctcgaggtttcgagctggctttagacattggtgggaccaaggatgttttgcaggatgccctgatcctaagaagggggcctgggggtgcgtgcagcctgtcggggagaccccactctgacagtgggcacacggcagcctgcaaagcacagggccaccgccacagcccggcagaggggcacactctggagaccttgctggcagtgctagccaggaaacagagtgaccaagggacaagaagggacttgcctaaagccacccagcaactcagcagcagaaccaagatgggccccaggctcctccatatggcccagggcttaccaccctatcacacgtggccttgtctagacccagtcctgagcaggggagaggctcttgagacctgatgccctcctacccacatggttctcccactgccctgtctgctctgctgctacagaggggcagggcctcccccagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaataagtgacaaataaagccagttttttacaaggtacttgatcatgttctcttgattttaaattagattttattcccaaaaaggccagtgaggcgcaaagcttggttgcagctttgtgtgtgtcaaaggcttggttggggcactcaggcattttgcctggaaaagttcccttctgatggtcatgtcaacctggtgctcacatttgtgataaagtgatatgggtgctgggccacatgtggagctgctgcagggctctgcccgtgaggcagagtgcactggctgtcccgtgagaatgcagaggcctccgctgagccagggcgcctgccaccccgtggaagagtgggaaccttctagcaggagcctagggccccataactcgaagccctttgagcctcagctccagtacccagctggtgattggagaagtcttaacttggttgtgaggctggcctcagacccgacctgtagccaagccagaaggacccagtgttgtgtgggtggga

SEQ ID NO: 108131 - DNA, 1001 bp, Homo sapiens
ggctggagggtcacttgagctcaggagtttgagaccagcctgggccacatagtgacacccctactcaccaaaacatcaaaaagttagccaggtgtggtggtgtgtgcctgtagtcccagctacttgggaggctgaggtgagaggatcgctttagcccaggaggtcgaggctgcagtgagctgtgatggtgccactgcactccagcagagtgagaccctgtctcaaaaaaagacagatgaggacactgcgacctagggtaactaattcgcccaagttcataacattagtcagtggctagcaggtaatgggactggctgtaatccaggctttctgatccggaaacccgtgttcttaatcaccgtgccacccagcttccctcctgctagaaatctctcatctcattgtcattaggattcatgaggtggctttcctctggcagtttgtgagcaggacctttcctttggagcagtcagggcctctcctgggcctttcctggcacttctgctgctctcctgtggctggaggcccagcctgggcctgccagcatctcttaccgcatgcaggagtgctgtggggatgcatcaggagagtcacagatctccctttgtaaccagcattggcaaattactgaagcagttatggttcatagtagcaattgtatatgttacctaggagatggtgtcaatggccgggggcctcatcgccacgtaagggtgtcttgccaggtgacttgcaagggtgactgccaggttgaagccaaggcattcactgaacggaggcagaagcagaaacagtcccaggcaattcttggaaaactggcccattcttactgcgggacatagcaccttactgttgggtccaaaaccccatgtgtcctgccaaaaaaggcagcccagcacagatgtgttcagggccagagacaccatttgcctactgaatgacttgagcaatttggtgcatctcaccgagccttcaccttctctgttaaatggaacatctcc

SEQ ID NO: 108132 - DNA, 1142 bp, Homo sapiens
ctgcacaagtttaagaatgccagaagtgtagcctttctgctgttaggacccccagaggccaaggcagaagcctacagcacttgggccctccaaacactagctgaaggctggccccatgtgccaccagtggctgcgcagggcacctcagggtctggtgggttggcaaggttcctccctggggtgttattcctatggcttggctaagggttcaagagaaaaataggcaaaagatgggattggacccttctcaaaaagaagtaaaataatatatataagggaatacattcaaatgcctcattagtaatcaaagaaatgcaaacttaaggtgttacctttccctctttttctaaactgttgaaatagcaaaatatttcagaatgagaatactcggtagtgctatgatcctgtgagattagataactcatgtgtagctctataaattaggatagttattcattcaagtagctattcagggttctgtcaagcactacaacagttgctaaggaaatgcttatggctgtatgcatcaaattatcaaaatatcaataaaaataatagcaacaattggaaactacctaaatgctcaacaatttgggttaagtaaaatatttaatggattgttaagtaaatattaaacataattattaagactgttgcaagccaggtgcagtagctcacgcctgtactccaagctactcgggaggctgaggtgggaggagcccttgagcccaggagtccagggctgcagtgagctagaatcatgccactgcactccagcctgggccacagaacaagacccagtctcaaaaacaaaacaaaacaaggagactgaagcaacatgaaaaaaaacaaaaaaaacttgcatacttagtataatttgtaaaattatactatagagtataattagtatacactatatattatactatagggcataattagtatatactatatattatactatagagtataattagtatatactataatatagtatatactgtatattatactatataatttgtttatatatgaatgtttggcaaatatctagatgattatttttgagtatgattttagttatttttttcctccttcccagttttgctatgatattgatgattaccaagataaataagttg

SEQ ID NO: 108133 - DNA, 1064 bp, Homo sapiens
cgtatctaagaacccattgcctaatctaaaatcacaaatgtttatgcttgtgttttctcctaagagttttatagtttcggcttttatatataggtttatgatccatttgtagttaattttcatgtagggcataagtaaggggttggtccaacttcattattttgcatgtgaatatccagttgtcccagaaccatttgttgaaaagactgttctttttttattgaattgttttggcagcctcatcagaaaatcaaatggctgtctttttagcactcttactgtgtgtccactgagccaaggttaagtggatattaggtgagttacccatcacattacccagagaggtgtttttactgtgctttctgtcagcagaaaagctttgtgttatccgtgtccctgtagttacaggattacataaagaagcatttatgtagtgattcttaaccaggggcaaatttgttccgctggggacatgtagcaatgtctggagacatttttacttaacatgactcagaagtgctgctggcatctagtgggtagaggccaaggatgctgctgaacatcctggagtgcataggacagcccttcaaaaagagttaatttggtccaaaacatccacagtgtcacagttattgtaagaggaaagtagtcacaaatgagtcagccatgttgcacatgtggtggtatatctataggatacttttccagaagtatatttgtcttgcttttatagatacgctgtattggattccaaggagatttgggtctgtggcttcatagctccaaactgtctatctggaggaagctcactaatggccgagtttggacaattgctgaatggtaaaatgttaaaattaatagtagactgaggccaaagccagaaatgaacttctaagatgcaagaataaatctgcagattgaccaaaatgtaattattatccagcttcttattagcagttttataacattaccattatggctgccttgttaaactgtgatcctccccaccccccgttcccccagctcctgctgaggtcagcacatggcctagcaccgctgctggc

SEQ ID NO: 108134 - DNA, 1088 bp, Homo sapiens
tgccctgtgagcaaggggcagggcggagggccccacattctgagatgctcttgcggctctgtgagcacagtcgccctgaggaaatgcctcagaacagttctttcttcctcatagcttagagcttgactctagcctaagtttctggcggcatttaggcagccatatagcacactgtgtgctatctgccccactgcagtcacagtttctggcccctatgaggccccagaaatagggatttgtgtcgcccagctctgctggagcacaggctctggagccttggggctgtcagccccctccctagtagagcacagggcagctccacagaccagctccacatactgccctgcccagtttgtgggcacttcccagagctccacaggggacactgctgctgctcccctgtgaacctttatttaacctgctgctcttcccagctttcctgttgctgttttttttctaattccacctacagtttcgtcaccttaagatgttagttaaacattaaagcaaatattgtctttaaagtttaagccagggcagcaatctgagacctttctgttcgagttgtcagaagcagtttctttcttttcacacggttttcggtgtgcatcctctttggacaatccccgcctcttgcctttggtggaagacgctgcctcagatcttccagttttctatttgtgagctgctccctcctgatgataacacaggagctggtttggaaaatgagcactgagaccttagctgggttatgtaacttttgagagactcatccctctaggagctctgagattgggcctttcttcagagcctttcattcctcaaaggtttctgctcaggattctaaaagcacccacttccttagtccaggcacttgattgaaagttaattaacctaagcattgttgtatgggaccaaaagaaagggtcatttactgagtatagaacaggtaaatttgcatgtgaaaactcatttcacccagggctcccaaactccaatgtctcccagatcagacagagctagattgggtatgtgggaagtgataaggcatggtagggagtgtgacagcagtgagcgtgtgctgtgaa

SEQ ID NO: 108135 - DNA, 1022 bp, Homo sapiens
cccacctgaggtgaggcaaatgaaggagtgaagtagggatgatgatttcaagaggggtgatagggcctgtggtcctgtggacagtgggggctgggcccacccgtctcacggcagccaggaccatccttataaaagcgctgctgccagtttacagcctttggaatcaagggaaagaggagagtacgtgtcccctgtgtccctctcatgctcgttacatagggatgcaggtatgctggcccccctattttctccctggtgtgcttagtcccccagccagtctgttgtgtggtacttatgcattcacactcctgcaggtcccagtattcatgcaaacgcaaaacaggctttctccatgcacctgctagctacctcagatcccttacggaaaggtaccttacatggtgtcagaaggaaatggaatatgtattacacttctgatttacatttttttttttagctggaccccagcatttttgaaagtttgcagaaagagcgagtagaagctggagatgtgatttacattgaagccaacagtggggccgtgaaggtaatgccttccttgggacacagcattgtccctgatttgtttgccatgagaagacctaagtgacaagggagttgctttcttcagagggtgtggggtgtgtggggaggggctggtgtctgttatgaggctgatggaaggtcaactagtggccctttatgtataataaagtttgccttccctttatcttcattctttaaccttctcgcgattaaaacagatagtctgttagaaaaaatactaaaacctgttcagagggggaggacagggtgagaaaccaaaacaactttagtcactttcaaattgaaatgtgcagtgtatttaatcttccttttatctctttggtattttcttcccaagatatatgcatgtgggaaggaacgctgcattcgttggcattcttttctatctgattttcagggtcctgtacagtgttcctcactgtttaatggatgggcataatacttcatatcataca

SEQ ID NO: 108136 - DNA, 1060 bp, Homo sapiens
catcctggctaacatggtgaaaccctgtccctaccaaaaatacaaaaaaattagccgggcgtggtggcgggcgcctgtagtcccagctactcgggaggctggaggctgaggcaggagaatggagtgaaccggggaggcagaggttgcagtgagtcgagatcgtgccactgcactccagcctgggcaacagagcgagactctatctcaaaaaaaaaaaaaaaaaaagttgcatttctaatagtgcctctaatttacattgatatgtttgtattgcctttttacccatcatgacaccctggaatgtacattattaaggttgatttggcagttctggtgacatggaagttttgggctctcagtgtgagagaaaagattctgcttctcaccatggcccctctgccacctcttccagggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaagtgagtacatgtatgtggcctcttttcccttgactctcccagcactgtgtggctttgggcaggtggtgtaacctctctgcatcccagtttcctgacctgtgcactgcaggtattgatttctcacagaattggttgaggatattgtgtgtataaagcggtacctagcatagggcttgcacataggaggactcaaggaagatagctcttttcttacttactcctaggaaactctgcatgttaaaatgtgagctgtgtggttaagtcaagaaactgcctctgccatcccatgtcccatattatgaccatgcatcaaataccctgggctgggtctgaacctgggcattaatttttccagttatcagtgcccatgctcatagaaagaaacagcattgagtaatcaaataagagttgtataaagatgatggatgggcttcccaggggccacatgcagaatcctgactgcagttgcttgtgtcaggaacctgtggtcgcttca

SEQ ID NO: 108137 - DNA, 1053 bp, Homo sapiens
gggatatagaaacctgagccagcagatgaaacctgtgtcatttgtgttgtcgttgccagagatagcgccagctcagcccctttcctggctaacagccggtttcattgtccgtcacccacgtcccctgccagcttgtcagcacagagcaacttctaaacaaatgtgggggctagtgagagacgggaatgtctttcttcccctccttgaggaatttcatgccacattcatctagcagtaaatataagtaagcattccatttgaaggaatttatcgctgtgggatataaaaggtttgattttaaaaaatcaaagttcactttaaaagtacaggattttcccagtttaccacagtgttctgatatattcgtgttgtttggagaatttttgtctaagattaatgttcaggaactaagaatttggtaaagcacaaatgaaatgggtcctctcttttggggctattccaaaacttccatttataggctatcagatagaatgaaggtagagtaaaacttttccttaactttaatatctgagagtctttgtcctgactgggtttctggggtagagaaggcaaacagcccaatgataagataatgaccacatttaaaagtgagaagttacagagcgtacctgacactataggtagtgtttcttagtgccattggaatatttccatatcagaacggaggtagcttaatggtgagaacaccaaatccttatcaagccaccctgccatcagaactagtttatgtctccacatttgtgagttgaatagtttttcatttattctttagataactggatctcaactgtgtctgcactttggaatcatggggggaatattaaactaatagtgatggcaggggcccatcccctaggatttggaagcaagtagtctgggtacagccagggcgtgattcattataggggcccctcaggtggacctaaaggttgagaaccatgaccataggctccagcggagatttagagcagtatttcgtaaacttaggccatcagtggtcttacttcaccgggtcccactggtattatttac

SEQ ID NO: 108138 - DNA, 11614 bp, Homo sapiens
tatgacgttcaaatgtgctaatggataggacggaaggattaggagtggtacccgggggccactgcctcgtgcaacgccccagccctagatcaaatccggggcgtggtcccactgtgctcccgaccccagcctcggcaggaagcgccggctacgggggaagccaacccggagacacagacggaagtgggtgaccggagctctagcagcagccgcgatgggcgcagccgtgagcctatggagagcggaggtgttcccgcttccaccaatggaaagccggtctaggcgggcctttgcaaattgccctagtaacggccgcatggtaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggtgtggccagtggaccagggagttgggggctgcaagcagggctgctgcggcgagagagctgctgaagtcggtggctcggggcgggatgcgcgcgccaggggtctcccgccattatttcctcagggaagtgaaaatgggccaggggctcggggaggggcgccgccctggagctgggtgaggggccgccccaggatacctagtgacgatccactgggggcagttgacggtttgccaactcatggacaagtgctgatataaacccacacaaccccgtccccttaattcgtaccaggctctattcgcgacactgggatacagcgggaattaagataggagcttacattttagtgtagtgagagacgataaacgtgtacaccaataaataaaaataattatcttatcttggtggggttagttactgcagggctttgtcggccacggtcaggaaattggattttattgtgaatgcagtggcaggctatgggacggtttaaagtagggaattgactaaactttaaaagctcattttggttcccaggatccgggaactgagggagagaagtgggaattatggagaagagcaatctggtttatccacccctccaagcatcctttttgaccattccaattaaatctcctttttctaagtgctggtgatgccaagtactttcacatacatattattttttggcaggtgaaaatattgagttggggagagggcacttcacgtatatgcttgacactcgttttagtaacggtaaacctggggtttgcacccacgtgtatttctgactcccaaatcagtgctctatgatgatacagccaccctctctgcctgctgttctctaaggtcacagccatgccccttggcctttggagagccttagcttctacaaaaatcttcacttaatataaagttaagctactgcctcttagcctgatttttctaaatggaaaggcctcaaagaaaagcctcaggtttccattttgagcatcatctttccaaaaaggaagtgtttgaccctggcttactaagcagctagtactgcaagtagctaacattggttgagtgctttccatgtgccaagcactgtgctaagtagctatatgtccactgccttgtcatatccaacgtattagttgtcccttccccgctttagtatgacagttttcagacacaaaaaaagttgaaagacttgtaaatacttgtgtgcctaaattctataattaacattttactgtgctgctttatcatatatcttttcatctgtccctctcccaatccacttttacatttcaaggtgaattgcaggcatcactacactttacccctacaccctttaacctgtgtgccattgactagtatgaactctgttcaagtgaggaaattctggttcatagaggtcaaataagtaggtccaaggttactcatctggtaagtgcgagagccagtattttaactcaagtctatgtatttaaacccagagtgcatgctctatgcctaagtgcatgctctatgcctaagagtgatgctgtatgcctaagacccacctcagctaccaggttcttgtgtgactctggtcacatcagtaacctccctgaaaaatgagagttagactaggtgatcttttaaagacccttccaattctttttaaatgttagaattcaagcttatctcacctgagagtagttggagtggaaattgagggagaatggatggaagaggtcctggtctgtaaataaacgcacatctccaaggtttgtaaagtctcttctaccttgggtttcccaaagagcttcagtgctggggattatgatatgacagggttgtgtggaaagaccatagtagttttttttttttttttttttttttgagacgaagttttgctcttgttgcccaggctggagtgcaatggcgcgatctcggctcactgcaacctctgcctcctgggttcaagcgattctcctgcctcagcctcgtgagtagctgggattacaggcgcctaccaccacgctcggctaatttttgtatatttagtagagacagggtttcaccatgttgaccaggctggtcttgaactcctgacctcaggtgatcacctgcctcggcctcccgaagtgctgggattacaggcatgagccaacgcgcctggctaggttttttatctatttagaaatatagcatctgggccgggcgtagtggctcacacctgtaatcccagcactttgggaggccaaggcaagtggatcacctgaggtcaggagtttgagaccagcctggccaacatgacgaaaccctgtctctactaaaaatacaaaaattagccgggtgtggtggtatgcgcctgtagtctcagttattcgtgaggctgaggcaggagaatcacttgaacctgggaggtggaggttgcagtgagctgagatcgcgccattgcgctccagcccgggtgacagcgagactccatctgaaagagaaaagaaaagtagcatctgaagaatatcttctaggttctattaagggcagtgtgctttggtaactgaagtggaaatgggatggatatagcatacccacacacattgcttacatcattttttttttttttgagagggagtctcgctctgtcgcccaggctggagtgcagtggcgccatctcggttcactgcaagctccgcctcctgggttcacgccattcttctgcctcagcctcccgagtagcaggtggattacatggtcgggagattgagaccatcccggctaacatggtgaaaccccttctctactaaaaatacaagaaattagctaggcatggtggcaggcgcctgtagtccttacatattttttgaggggctgccataagtgtgggaccaaggtacttcacagtccatgaggaatagaggtagaagagataagatgtattcacaagactctggcacagtgtggtcactgcccagagagaagagcaccttttagatagtcacgtattcagttattaaatcagtgtagcaaaccttatattatgtaatcctgagatatagatgctcagctagtgtaactttctcagtgttccccccttatagtcaaatattctaaaatatatgaagttccatagcccatttatggaatatgtgtgtgtatatatacacacatgtgtactgcaaatggttaataaaattcagagatttataatgtatttaaaatatactaacagatgataaagtaatttaaccttgaggattcaaaacatattcaatggatctaatagtgccataggtttaacttcacattcagtatttacagtgttcactgatggccagctagtactctatgtcattgattcttaccccttaataggttactctgggaatttgatgaaagctatggatcctttctctggaaaaaatgtatatatgaacataaacacagtttcgttcccaacttcaagaggtatttgggcccctggcgtctatccctgtaccctgggccaaaaatcagtgttcccacttgtactcatactgtgcattcttcacacagtagtagctagcaccatcttttaaaaacaaatcatagcatgacacatagtcttcaagaccttttcagtggctttgtattatttatgtagaataaaatccaaactttaccacacactgtaagttcctgttctgcgttctggccgctgtctacctcttcaacctcatcttcctggtctttttcgctatactttggtcactgcaacctttctgtcccttggatatgccaagcttgtttctgctttggattttctgaattcgctgttttctttgcctggaacgctgactcctgctcctcccagaggttcacatatcaaattaaatgtcatcagaaagacactccaggatcactttctagccactcgttctctctcatcatccctttttcttcatagtagtgatgaagattatgtgtgcaatgtttgtatgtttgtatccctccctaaaacatgagctccacaagtacaaggcttttctgccttgccttcgttaccctcggcacctagaacagtgactgcagtgcactggcactcagtgttagttggatgagtgtgtgacttgtgtaggccagggactgagatttttccccttgtgaaacattttaatattgatttattatttctttccattgtggtgtgtaggcatgtggcgtcatagtagaattaatcaaaagcaagaaaatggctggaagagctgtcttgttggcaggacctcctggaactggcaaggtactcattttctctcattttttaaatctacccaggagaatgatcctagtgtctaagccaaattgaattcatgtcttaactagtctttgtttagctaaatgggttatatgtatgtttttaaaattaatatgcaataatacaattgggtatctaaaatccctgcttctaaaattcaaattatcctggcctacctccagagaagaaagaatgaagtccttgaaggggtctcattgtctctagaatttgtcctttttctctttcaagtctcctttgctgtggaaatacatttctgttggcctagggcttcataaagatcttctgagtgacatcttacttgaggggacaaaaaaatgagtcaagcattcttccaaatgctagctttacgcatcgctattgtggctgtgtgggagatgaaaaaaaggaaaacaagaattagagacatgatttttatcttcaaggggcttacagtctctccagggcagaaagaaaggaaatcatgacagcacaggaggactcagtatgagtgctcagctttgaggtattgactaatattaaatgcagctggaatttaaggaggcagcactgtgggctggtacagctggaagggttgagacttgacattttcccttcagagctgggagaggatttggctttgcagggaagataagggcctttcaggcagaggacaccgtgtggcttcttgggattcgtgaggggactggccagatacttgaaactcaccagagttcccaatttgagcttgcttattcttcaaaagggccgcttgatgtgggcaagtaggagcttggggttgtgtgtgaaaagaaatgggctttaaattccagctctagtattgacttgctatgagacctgaggcaggtcccttaacttttctaagcaaaagcatactctacctatttcaagcaattattaaactgatcgattgtaagataatgacttgcattataattttgaaatgattactgattgtgtatcttatattggtatcttacaagaggaagaagtgctatatttgtgaacagttttttctcttcctatataaaagcaaattgtgaacagttttttaaactgtaaagtgccatacagatgtgagcttcagttacctctctccaggcaacattagcttgtccagtgcatttaccatttatttgcttgctattccttatatcttagaccttctctttccctccatttttcttcttcctaaagtaaataatttagaaatttcttctagaagtttgttggtgggaaagtctctcacgtttgcattcattatgttgcccttgttttgaaaaagagctatgttggctatataattcagttgacagatattttcttcagtactgtttcacagtacttctctctcaatgttatttgctcctttggcttctgttgtttttgagaagtctaattttgagggttttgagtcttctttctgcatgtttttgagatatttttgggtttggtgtttcactattatatgtcagagtggattaatttttgtttatcatgcttaatgctaattgtgcttcttgaatctgagtattatgtctctgctcaattctggaaaattgtcagccttaggagaatcgcttgaacctgggaggcagaggtatcagtgagccaagatcatgccattgcactctagcctgggtgacagagcaagactacgtctcaaaaaaaaaaaaaacaaaaaaactgtcagcgttaatctcttcagctattgcctttccccattctctttgttctttccttctggaactccactgagatgaggttaagattgcagtggttttcaacctggggcagttttgcccttgcaggggactttgacaacgtctggagacatttttggttctcacgacttggttgggggtgctactggcatctagtgggtggaggccagggatgctactaaacatcctgtagtgcacagagcagtttccataataaggaattatctggccacaaacgtcatggagtcaagctgagaaaccctgggctagagcttctcgttttgtcctctttgtcttttagcctctcatatttgttatctttttgactctgctaaattatgggtaatttcttttagatctttgttccagtctaattgtctcttaagctatgattaagtgactgattaatccaatctattgaatatttttttccttttcattttgaaaagtttggaacctacaaaaaacttgaaagaatagtgtgatgagcccctctataccctatacctagatagccagttataaatattttgtgacatttgctttttctctagtttatttctgaaccacttgacagtaagttgtaaggatgtcttcctacatgaccacggtgccatcatcagacccaccttgctaatgctattatattcccccaatttttgtcaattaaaaattaaattaattaatttttaaaaaatgagcagcagagccagggagagaatggtgtctcaggaaccaagaaaggagaacctttaaagaaaggagtaggtaaccatatccactgtggtagagaaatcacaaagatgagggagcctggcagctcatcatatgattccatgagcagttaacaaatgtgctttcaaagacaacgaagttaaattgttttaatgaaaagaaaatataggtgatagaaatcagaaaacatctttccaagttgtttcagtttttggctttttaaaaaacaccagaatatcaaaatgcaatcaaagattacacactgcataaattgttacaagttataatgtcttttttttttttttttgagatgaagtctcgctctcttgcccagggtggagtacagtggcgtgatcttggctcactgcaatctctgcctcccaggttcaaacgattctcctgcctcagcctcctgggtagctgggattacaggtgcctggctaatttttgtatttttagtggagatggggtttcatcatgttggtcaggctggtctcgaactcctgactttaggtgatccacctgccttggcttcccaaagtgctgggattacaggcgtgagccactgtgcctggcccccagatgtattttgttatggcccaccttttttactcatgtgtggcccttcaagagtcctcttttatgttttttttttaattgtaatgtttttgtttgtttgtttgttttttgagacagtttcagtctgtcgcccaggctggagtgcagtggtctgttacccaggctggagtgcagtgatctcggctcactgcagtctctacctcttgggttcaggtggtcctcccacctcagcctcctgagtagctgggactacaggtgcacaccaccacgctttggctaatttttgtagttttcgtagagatggggtatcgccattttgcccaggctggtcttgaactcctgggctcaagcaatccacctgcctcggcctcccaaagtgctgggattgcaggcttgagccaccgtgcccagtcccggttttattcaggggtttctatcttaagtgctataccttgctgagctttcctgtatctacagtctctgaactttcaaggcaaatagtttactgctctgaatgttattatttattcaattctaggtgttttgtaagaggagaggttttcagtggacccagtgtgccatattgctagaagcatatgtctttcattttttttggtgatattgtattgctttcctcccaggaaatatgagaagtgctcagcactgtggtattaccttataagtttgtccactcccttccaatgtgtatgaaggaatttggtgacttctgcttaatggtttgctgcagggtcccaaagtttaggcaacttacctgggtgacaggcagaaatactgcttattttagagatgcaaatgcatggttcatatgcatttccactcttgaggacctcacactgttaataatgggtttgggttttagaagaaggagatattcagatgagattgaaaaatagagatttcttcaaccttcttttggcaacaacctcttttttgtgccacttgtcactcacatggggtgagtacaaaaaaaaatggctttggagattggggtttgcatcctggtgctgctgcttgcggttttaccttgggtgtgttggtaacttttgagtttgtttcttaatctataaaatacaaactagatgatcaaggtcataggctagttggggagattcgatgaggtctatgcagcactctgtagtaggtgtaggaatagtagccatatcatatactttccctctggaagtctttaaatggaggaaacgagacacacatgaagctttttttttttaaccaagtatttatcatattttaatggaagtatgttcatctcttctgtattagttaaagggagggagagtgccattgaattggatgtggtcactgtctttgaagttcaaaactgagggtagggaattggggctggcagagatacaaggaagagaaaggagtaactgggaaggggtggtcctgtccagcctgtggccccacggggagtctgctgttagagtgctgctcctctcattgtgccctttcatgttccagagatttttttcctttgctcttagaagaataccagttttcaaggtgtcagccttgagctcacaagtgcagatgcctaatgaggcaggcaacggggatgagggaagtggctgggtgcactgtggcgtgtctgccttgagccccaggtgctcggccttgctgaaggtcaccatgagactgcaggccaaacagaaccaggctgtgagcaacgagtttgccacttgtgatctagcatggcactttagtactttcatttgacagatgaggaaatcgggcacctgagatttgctgagtgcccaaggtcacactgaaaattagtggcagaaccagcactaatctttctgttcctggctagtgcattttatactgtgctatacactgattctctaccagattttactacctcaaaactatcaccaaaagggcatagaaaagaaaatctgagaggaaccttgactgttaattttaagacaccgtctcagtttcactttgttcttcagtaacaagcttgttttcagtcttagcccatatacctggggagctggccttactcgtgctcctgtttcagagttgaggaaagatgaaaatggcatttagaggccatggcattgcccagttctgtaccaactttaaagcatttgcttgccatacttgacatttgaccgtacacctgtgaagtctggttctgtttagcatttgccagctgtaattatcttgtcaaaaatcaatttgtagtttaccacagggcgtgtttaagtgtaacttgttaagaccaactcatagcttcaaaatcctacttgaggtatccttcttcactctttgtgggctacataacataaaatgaacaatccattcattcattccttcattatttctgatgggttgtagattggtgttttcctgtatttgtaaaaagagaaagcaggtatctcaaagatccagtggtgtattcggagcaattaggtcagagccatatattgatattgagagaacaattttggatgactgtaaagttggcccttcctatctgtgggttccacgtatgtggattctgccaaccacaaatcaaaaatactcaggaaaaaaacaataaaaaataaaaatacaataacaaaaataatacatacttaaaaatacaatataataactatttacatagcatttatattaggtattgtatgtaatctagagatgatttaaagtaacaggaggatgtgcataggttatatgcaaataccctgccattttataccaggacttgaacatccatggattttggtatccctgtggatactgaagagtagactcttctaattatgataacatgatctttggagtcctgctgccagagattaaatctgcgctgccattttctagattatggtacttacgttgcattacttaatgtctctcagtttctcatgtgtaaaatggggagaatactagtgtctatttcataggctggttgtgaggatcatgtgaggcatttggagttgggcctgcactgggtaagtctgagtgaatgataacttgtaattatagggaagataagagatgccatttatgatttaaattgactgtccacaaaagtcatcaaacatttattgtgtgaaacatgctaaatggtaggactagatgttcagctgttcctagttcctggtggttctgtagcatgtgtttctgaactgtcatgttttcaggactgtgaactgtgtttccgttgctttcttttgtagacagctctggctctggctattgctcaggagctgggtagtaaggtccccttctgcccaatggtggggagtgaagtttactcaactgagatcaagaagacagaggtgctgatggagaacttccgcagggccattggtaagtagtgtcacatttgtgggaggagttggtctcacttcctgaagcctgtgcaccgaagcctctttgtggtgaagatgcctttatgactggtattcgtggcactgctgtttttcttttggcacttagtagtgcattatttttcaaataaaacaaaaccccagtttttctcattgaagtgcgttagcaattggagcaactatggaccctagctgtgagcctgcgcttcttcatgcaataaatagatgtgtctaaaagtgtttttttaatgagtcatattttcctggaagtcttattttgccattagagatgactatccactgaaaaggttttggactcaagccagaatctttgtgtgccatgtggccagaatgcccctggtcct

SEQ ID NO: 108139 - DNA, 1051 bp, Homo sapiens
gaccgcggcgactaccgagggaggtgaggggcgggccgggcgggtgtccgaggcggcggcggcggcatggcagggcggcgggtgaacgtgaacgtgggcgtgctgggccacatcgacagcggcaagacggcgctggcgcgggcgctaagcaccacagcctccaccgccgcctttgacaagcagccgcagagccgcgagcgcggcatcacgctcgatctgggcttctcgtgcttctcggtgccgctgcccgcgcgcctgcggtcgtctttgcccgagttccaggcagcgcccgaggccgagcccgagcccggcgagccactgcttcaggtcacgctggtcgactgccccgggcacgcctccctcatccggaccatcatcggcggtgagcgcgggccggggcgggagccgggctcagggacgcgggcggagcgaccgggccccgtgtccgaattcgctcgagcctttgccgggacgggaaatcgccccacctcattggtggggctcctgacgccccaagaggcggacgtgacttgcctagggctccgcagcaagtgagcggaggctttgagattcagcttttcccatccagcagaaccgagctgcaaggcgccttccttaaaaaaaaaaaaaaaaaaaaatcaaaaaatccctaccaaatgtgtttataatacatggtcaagtaaagaaaactcaaaataagaaaactcacaagctacaaaaagggtatacatacaaaggctgtcttcattcacctgtcatttggtctgattcccgttcctagagccaaccgctgctaccagtttttgtatatcatttcagaaaggctccacgtcaatacaagcatatctgtgtgtatgtataaatccctctttccctcatccttttagacacgatttcactcaacattgtgtctggagagtgccccatatctgtacacaaagctacatcattctttttaaagctcacatagaattcaactgcacccttgtaccaacattttctttttctttttttttttttctttttgagacagagtcttgttctgtcgccc

SEQ ID NO: 108140 - DNA, 1028 bp, Homo sapiens
ctgttgccaggaacttgcatctatgcaataccaccctgtgtggtgggagtgttagttagccttatttctcagatgaggaaacccaagcaaagtgccttgggctagtgttggaacctaactccgccacccctaacctggatctggttaataccttcatttcacctcatggtccacaaacttgtgggcatctttgccttcttgaaatggcccccaaggccatcctggcttatggcacctggacttctacagttctgccccctgcctgcttattctcctcctccctctgattcattctctgcacagtgggcattgctctccttttacaagtgttcatcagatcatgtcagccctacacttgacaagactttccagtgagttctcattgtgcttggagtaaaatccagccactttgtggcccataggacaatggtctggctctgctttcctctgatcccatcaacgatcccatcaacgactgctccccactctgaccttcagtcacggtggcctcatttctcttcctccagtgggcccaccagctgcttccctcaggacatttgcacctgttgttgcctctgtttggtacatctggctccttaagtctctgctttaatggcacctcctcagcagcctctcctgccccacctatctaaagttgtctcttcaaccctcaccccctcatactttctcatgtccctgtttcattgccccagcagcccttttcactacctgacgttcttcatgtgtttacttgttgagtatctgtcctctgctagaatgtgagctccatgagaccagagcaggaaccttgtttgtctcattcaccagtgttctcagcacttgggccagagcctggcataggatagatatttagtaagttctggatgaatgaagcctgtgtaccagctcctgggctagccagttttagtgagcagagaaccttctttgtgggttagtggacagaaggcaactagcttagggcctggcctgtagtgaattatgcaggttggttctttgtcctccccttt

SEQ ID NO: 108141 - DNA, 1022 bp, Homo sapiens
atgtatgttttaaagacttgggtgggtgtgagggacttagactcatcctcaatctaactctggcaggaaagaggagggctgaaaaatgctggtatcttggcttggcaatttatagtcctctggtggctgtgaggattaacagtgtattgtctcccagtcttttgtttcggttgttaatgaacagcactgctacttgtcgcctggacctcttgccttctgtacacactattttagcggtgcctcctgcgtgggtctgaccctctctgagccctccctgccaagagctgaggagggctgcaaaagacttctaagtctgactcaggttactctccttgaaggagagaaacatccaagagcctacaagatttttgtctctgcagcctggagagaacattctttgtaaaacttaagcgactttgccttttccttttttccagccttctgtgttcttggcgcccatgtggagaaggctcttcccctttcatctgttttattgaggtgtgtgcccttcattctttctgcagatgccctctcttgactcgtaaatgaaacaaggggttcttgtgtgtgaatgaatttcaaccagatttttttgtgatacccgttaggcatctgcacatatccccggaaagcagcctgctccaggcagaaataacatactgggggcttgaccaggtaggccttggtgtccttgaggaatttgggtgttactctaatgcaaaagcaaacaaaccaaacaccacttttggttttctttacccctagtcttttcaggagaatctgtgtaggaatatattatgtgaaattgtggtaattatgtatgtttgtcctaaaatactgaggcatatttgaaggagttctaagtggaaatgctttcttcagctttacttctttagttcctagtatccatcaggccttagttccctgtttctttgtgcccatccagtgagagctgtttctttctcttcttcactgaaaggtacacaccataactagaagattctactctccagtactgcttc

SEQ ID NO: 108142 - DNA, 1095 bp, Homo sapiens
ctgcctcttggagggagatgaaagaatggacttttggagaacgcttgctgtctgctggacactgttctagacccgtggctcttgctgcatcctcccagccagtctcctagggaggcgtttccatctacattgctcagctactagaaatgaggctctgagcagtaggcagtttgctgcagggcgcacaagtagccagtgccaggctctgtttcagaggccctggctttgcccagaagctgctctcagaccttagcacatgcctgcttccatagaaaattgtggctcctgaggaacactttatatataaatcaaattgtcaaaaatagagatttctgcttctattctcccctcgattatttgagtttttgtcttttgttaattgggtcttttattttcttgtgctgtgtgattaggctcctgctgctttgaagtggcctttgttgggtgggtagggaggacttagttaatgtgggtgatcctctcttggcaggagaaaaaacaacttttgctgttgagagagaagttgactttccctctttccatatctcttgtgttgtgatgattcctctcttgtcttgaggccttcaggaagactaaaataatttcctttgtctctaacctacttcctgaggatatttatttggtgccatgcacaggtgctgcttaaagataaacctgacttttttctttcaaaattagtgcttgaaatttgctagcattgccctgtctggcagcaggaacttgccttgcttggcctggtggctacatcccttaccatagatttatttgggttgcttagagctccagagggtcagtggcttgtccttggtcatttgacattggcactagagctcagtcttcccagatacatgacggtgtggcacttgaggaaaaaatggccctgtttgtggtcatttccaggtgagtttcaggatctttcgccatgaacagtaaaggccctcgggtttgtgttctcagcattctctattttctaaaaagatgatccaggggacattcagagatgatcttcagaacttacgctctagagaggaaagactttacataagaaggactccatttcttcggcacttgctg

SEQ ID NO: 108143 - DNA, 1835 bp, Homo sapiens
ttgtagagttgggtttgagctgtcccctacatgtgatttggttataagaactgtcatcttcctgagatgtcctggcctggggtgactaccacaggcccttagattccaccctctcagcttcttcaccttcctagtgaaggacacctccactctcccaaggtgcggcccttgaactgctcctcagtgtgtcctcctccttcacctgcctctggatccatcaccacgccttctccctcctgcttgctctctgtctttgcatttcccatcaccacagctgcgacctgaagacaggcttctgctagttcctggccggatgagtacagcattccctcacatagtctccttgattccaaccccccgcagaaggtatagggatagaagagagtttaaaaactacttccctgtgtagaagtctttgtttgctctctgctggcataaaggcttaactaagtcttagctggctgacgaggcccctcctgaggggttgagatctcaggactccaggccgaatgaaccacatgcaggtctgtggacagacagactgtgctctctcatgctgcatattctggctacgtgcacttttctgggaagggtcattgtccaccctcctcaggctagattaggtcaccctcatttgagggcctgtaacatcctacacattcccctatgatctcattttctccccatcttatgccttttctgtttactggattatgttttccactggacttgatctctttgagggtaggggcctgttagcattcaactgtatgtccgagggcccaggacaggccttggtacagagtaaatatttggtgcatgcatatcggaatgaatgaatgaatgaagaggtcatttcccactgcctgcaccaattacccatgctcttatggtgctttaaacaactggccaaatagagttcaacagtggaggaagcttgccttgaggttagacaagttaatctttcaatggaaattcaatcctcatatttcattttcaggccactttgcgtagcaaagtagtttaactcatagcagatttctgccatgctgatggttaatttcgtggcccacagagggtcagcacactaatgccgggaacacggcgacctcagtgcagctcaccgcacacagtgagggcccagcggccctgttgttttagagaagcagttctcaaacatccttctgattttgagttaacaggggtgaccctttcaagaacatttttaaaagctataacatagatccctcccagatcgtatattttcctttctccatgcagttcaaaggggctgagttgtctcataggtttttgccggcaatcttcagcttgaccctggttgtttaaatctgccggaggaaatttgaacaaagttgtactttggtaattcttctgcctctgtgaacctttaaccttggggtttcttttcgagccagggctgcattgtcaccagtcgtccctgctggggctttcaaagagcattgtctagggcgtctgttttcactttgctactggagttcttttgaggaagggtattaattcagacctgactctgagacaggacgagcacttttaaacttgccccagagcttggggatggggaaatgagcgtaatgcaagcctgtggctgatgccagtaattgttctgcaaatagtctgtgagggtgaagggagaagaggccctccagaggcagaggaatgtgccagctgtccagtgggaggccacagctttgcccagggtttgttgactacatgacaaaaagaggtcactgtctctgatcactagttctgggtccagagttcctcctgaatgtaaaattcctggagtgccaggt

SEQ ID NO: 108144 - DNA, 1008 bp, Homo sapiens
tatgtttcaaagaaggaaatgaaattcttgaatttttttaaggcaaagaagagggaaaaatagatttattgttttagttggctattcaataggatgcaggataaagctggcctctctcctgtctaatgtcatcatcggcattctctctttttctctccttctcttcctccctctcctccccctctgctctactcctcctcccttctcttcccacgcctccccccgctcctccttcccctcctcttcttactagtactgctgcaaacccccccttttctccaagtcaaccccaggtcctgagcctgggattaaatctcatgctctggagatactctaatgctaggaattatttcctcttttgtggtctttggtctttccttcaggtttcctgttgctttctaagggaggtgccaggtgctggccctgtggctagttttggctagtgaggaatgctgtaaagcagctgtgacaccagcgtgcagcagtcctactgctgtgcagcctgggcagtgggtggtgacagggtggcattggagtgaacaaggtgtggggaagacgagcgtaggtggaaaaaatgtagaccgaccttctcggtaaaactggcctgggatcccaggcaacatgaaggctggcagatgctgagggagttctctaggggaggctgataaaattcgacatcaccttaccatttaatgagtcccagatacatgggctatgccagcccaacagagtgcaggctttggaaagcccaaatgaaaacgacatggtccctgctgttgggggaactcatagtgctgggagaagcctgctgggcctctttttcagaaggagggagaacatgggtttagtagtgagccctctaattaggcctgcaggtaggcctcagcgtggggcctggatttgcaccctgtccttcggttagaggtttgtgacacccatagctgtgctcagttaagtggagcagtggaaagagctgaggctcagcatgctggtccacgtttgaatcct

SEQ ID NO: 108145 - DNA, 2254 bp, Homo sapiens
gaagctcatggcaaaataatgtaccataataaatgcaagttcagcaaataaaacatagttcagagtcgagttatgtggtaaaaatgcatgaactaagtaattttcagtgaaggttttattattttataaatgaggtctttttaattgccttaaaagactctcttttaggaaaatttgaaatatgaaagtcatcttattttcatgtaaaatgaaacatttaaataccttttttctcatgaaaatttctagcatataaagtgaaactggaagtagttttgttaagtaacttgtattttgggggctgaggaaaagcactagaaaattcagctcctaaagatcattcttcatgagatgtcaatagcctccagacaaattatcatgtgaatattttctaaaccataaacaaattttgctaccattgtgtttagactcaaagttagtttaaaagagaaatttctaaatgaaacttcctaacggtcattctttcgggggcaggcagattggtagaagtaatatataaaacccaaggacaaaatggcactttgttttttttctattaaactcttttgctgtttgctgtttcaaaaattcatactgaatctttacaatgaaacatttgtgagtccaggagcccagaaccctaaatgaattcagattgacttctttttctgtacggtctatcaaaaccttttcactttaccacagaccagaaattatttctcactgttttctgtgccttactcctttaatctccaaatacctgttactactattgtaattgttattttattgtaacagttattgttgttactgctattgaacaagctttggatgtttggtttgaaaagattcaatcaagtattttgattatgatgactagtgcctgtgtatagctaagcagtgaagcaatgcagagattttataaatatttttagggcatttttttactgtgattgtagggagtaagatatttgtttttacaggctggaaagattgctgtgaattttaacacttgggagtcacagctttaattctgatttagtctactaaaataaataaaaattagccgttgatactcttttaaatgaatggaacctatttctgattctgatttttctgaagcagtctctacatttcccaaagtgccacttcccaaggtggacaaaacatgttctgtgcaggcgaaatgtgagatgctggctgcataggggaggaagggggagaggaagctgtttgcaaaactacttaaaataaatttgaagggtcaaacatggaacacagttgcaaaagagaaaggaaaaaatgccttaggtcagttcagctagaatcgtgtaggcattcgcattggctagagggttagttgtgtatttcttgctaatcagatacaattggagcagataatatttgagtatctgaggctagatctcattgcctctatatcagggaaatgaaccaaaaggggcaagttttaaaagtttgatttggggaaacagataccatttaggagagagatggtaggctgtgtttacctcgttgtccgaaggctgctcagactttagtcagctctccaacttgcagcttgtccctcagagatgcagtagtggcttgggccggcagacgggcttgcgttagcatttcatttaaaagcgatcggtacttttaaattaaacatgcaaagttatcttggtgaggtattgaatgggaggttgctggattattgaatttggcccaaaatttagccagttcagcagggattttggggtctgaagcaattaatatgcaagtacatttgagtcagcaaggtaggagattactgtcttatcagagtaaaaaaaaaaattctttttccaagatccatacttttttggaggtagataaaaactccattgtttgagattcatgtttgtgagtgaccacctcaaattgccaggttttaaccactaaaacacagaggagggaataattgcatttaaaatctctgatctgttatttgcattatgcttagcatagaggagaccccaatttccttcctcatgtttttggtttttttttgccattttgttaacatagattgagaggaaacttaattttctttcttgaaaaaatcattcactgaactgctcaaaacacatgaagttgtttttgtctcatcagatcgagtacttaagacaaaactacgaaggacttcaatatatggttaacctctcatgtgctctgtgaatctagacacactccatccgagttgctgtatgat

SEQ ID NO: 108146 - DNA, 1040 bp, Homo sapiens
tcatagactactggagagatattcgagaattcttcaagtgtttgtagaatggcttgacataagttgctttccattccttatctgtgtaaggagtgatgttctggagtattaaattgggtgagtgtgggcacagtttgtgttctgaggtttagtgtgactgtgaaaacatgctttttgcattgcctgagaggatacaatagaccaccagcaggaacagcagtgcagaccactgagcagctttttgtagccctggacccagtgttcagtgttccagagagatggtaagaataaagggagaggcatcgaagccaaacaattcctagatttgattgatctggccttccagataccctcaaattccaccaacaactacttttagtgttttttcctattttcttccaagttaaaaaaaattgtgataacatattcataatataagatttacctttttgactatatttaagtatacagttcagtggcattaagtacatgcatattgtagtgcaaccatcactgctatccatctccagaaccttttcatcttctcaaactgcaactctgtatccattacacacttactccttatttccccctcccaccagctcctggccaccgccattctattctctctgtgacttggactactaagtggaatcatacagtatttgcccttctgtgactggtttatttcactcggcataatgttctcagagttcatacatgttgtagcatgtgtcagaatttccttttttaaggctgaataatattcctttgtatatatattttcccatgttttaaaagtatagggtaagtatgtaagtatctatcagtatatttatttatagccatctctgtagttctgtattttgctttggcttaacgtgtatttttcaagttattacttaaattttgtgagtattgttagtgataccatactgttctgattctgtttaaaatgaaggacattttttttccttatctcttatagaatgaactagctgtattacactgtttgcatatttctagaattgacatttcca

SEQ ID NO: 108147 - DNA, 1047 bp, Homo sapiens
ttttcccccagcggcttagggattaggtaataatagtagattgctactgagccatggggagggctgtttctccaactcctcagatatccctgtgcttaccttcccagcctgtcttcctgtgtgagctccatggcacaccctagggacagtgtctgaggacagtgctgaggctcatggccacaggagtggtagaagcaggttttcagactgataatgccattacatttcaaactttgaacatttcaaaccttgaacatgaatatgagatgttggagatcccaactgggaaggtgtagctacccagcaagtctcccatctctgaatactctgctatacaggagtgggtacccagggaccacatttgaacccgggcaccctgactgcctccagccccattgatatttaattggttcagggatagatacctgagccaagatgtactaaacaagttcttctgtgggaatttgaaactagggaaagagaggcagggacactaggagttctggaaatcagcatgttgatagaaatagtgtgctagaccagagagaaggctgggagctgttctgcttctgggctttcccagagcttctgtgaggtacctggaatccttcttgtaaaccctcctttttgtttacaattcttcagccagttggttacttgtaagaaaaaaaaattcttcatcaatgaatgtgttcacttggtgaagagtggatgtcatttttgttatttttttcttttgcaaatgtacatttagcacctgctgagagcaggacattctgaatgttaggcactgagaacatctggcagataaaaggtggccctgccccttgggactcactgttcaatgagttggagggtaggggatagaccataaagcagatgtactgaatatgagataggtgcatcaaagaccatacaatacaccagagggtttcagaggtgcgagtcagggaagacttcacagaaaaagtgacatttgtgtggagtcctcatggatgattaaagtctgcctggtagcaatgagagattcagtttcagaaaatgggc

SEQ ID NO: 108148 - DNA, 1426 bp, Homo sapiens
ttttttttccccaaggctttttctttcccaatgttattttctaaaatttctacaatgaacattattagttgaatagttaccctcctccctcctcgctcctccttcttggagctggtcagccagtgctgcttttctcctcctcccacccctccccttctcccacccgagcactgtggctggtttccagtagcagcagtacaattaatattttacacgatcttcgcctaaagtctggtggtagtttgagatacttcttttagtctgaactcattttcaaatttagggcccaggctgttctatggctttaggagttgaggaaacatgaaagaaatctgccttctatttgtttaaatattaaagcatttaaaatattttttccttctttcagataatcaaaacacagctgacttgccattgctgcacagtgctgaaaggtagctctcaatgtgggtgattaacaccatggcaatggagggggcaagttttaaagaaataattaaatagatcttggaaaatcattattcttttgtctcataatagaaaaccaggcctgtgtctgcagctgagcacagtatttggtgatcagcagataaaaggacactccaaagccaaacttggagccactgtcgtctaccagatgcattttatctggcggaatgtgtgggacctgacagacacaggggaatccaggctctgcgaacctctgctgagcctcgtctcctctctccataatggagatgaaggcgcctcccattcacaagtgtagttattgcataagtgtttccctctgtcagttttcagtggctaaaccttcctatataatatccttggaagataggttggggcttgggcttgaggtcaagatggtagagacaagggatttgtcccagacttcatggcaagagtgagactggcatgtctagattagtgattagagagctctttgagaaactggggagagctctggcccttctcccaaacagaacgcatataactatttcaggaagtgtttggacccaagatgaagaactgctcttcaagaagcaaccgtggcctggctagacttgggcaatggcatgaccctgtgggtattgcccccaccgcctttctgcgagggcctgcaaaacggggcccttgtccacgtgtgtgggtcagtgctgtagccaggaggaaggcctgagacagtgtgtctgtgactctctgctgtttgattgtgtgagagtctgtatgtgaagaggaaaataaaaaggaaatgaaaccaatttataataattgtcttctgacatatataactccaaaaaactgcaaagacaaggttctgagccaaatgaaattattcgtttatgatcaattaaatgatgaacataaacacaagaaacacacgattttccttgctcaagatttggcatgtgtattttctgattct

SEQ ID NO: 108149 - DNA, 1076 bp, Homo sapiens
tggagtctcaccctgtcgcccatgctggagtgcggtggcactatcttggctcactgcaacctccacctcccaggttcaagcgattttcttgcctcagccttctgagtacctgggactataggcatgcgccaccgcacccagctaatttttgtatttttagtagagacagggtttcactgtgttgaccaggctggtctccatctcctgacctcaggtgatccgcctgcctcggtctcccaaagtgctgggattacaggcttgagctaccacacctggcctgtgtgtatgttttttcaagtgtgtgcattttttgtgcatttttacatgtcaacacaccctgtttgtttttaaaccttttttctcactacaaagcttctatgactccagcattttataaatgccttcagagaatgcaagagcctcctcacccctttacggtgatgttaacagagggttggtgcctattcatctgactttgtccacatatatgtatatttatgcttatgttagtctattagtattgtcactttaaaatttgtttttaaagttaagtgtggggctatactacatctgctattttgcattttgttttccctctgcttagcaatgtcttggagcatgagttcagagagttcaaattcactctgtttagtggctgtaggatattcccttgtgtctatttaccatttaaccagtcttttaatggatgtttttggtgtctccagtcttttgctaggtgaacgtaatctctttgcaccttgtagaagtgtttctgcaagtttctgtcttagaattggaaattgttggggcagttgcattttaaaaagtattgccaaattgcccctccctgcaaaaaagtcatactggttgtctgttttataaaaataattttttttttgagatggggtctcactctgttgcccaggctggagtgcagtggcaagatcttggctcactgcaacctctgcctcccaggttcaagtgattctcctgcctcagcctcccgagtagctgggattacaggcgcacgccaccacgccctgctaatttttatatttttagtagagacagcgttt

SEQ ID NO: 108150 - DNA, 1098 bp, Homo sapiens
gcacctttctttgctttagaaagccagtttgtgtacttttatggatggtggtggttccgaatgggtaagactggaggcaggaaatccattgtttaagaaaaaaagaagcccaggggagaaatgcagaggtctgggctttggggctatgcccatagaatggtaggagaaactgtttcgttatttagtagagagaatggcaggactgggggacaaacagagaagggggtcccagaaatgacttggcttggtctcctggagaggtcatagcagctcagactgaggttggtagttggcagagaggcagattgagtagttggcagagaggcacgctgacttgaggcttctgcaggaagtcagtatgtaggtgtccaggggagtaagggattatgtgtatgtaactccagatctctggtgggtggaaagagaactgattttagagccaggtaaatctgtgcatgacccatggcttcacccctcacatctaggatcttggtttcctttttcgacggtgaaaaattgtaaaccccaaccttaaggatgattgggaaggttactagtggtagagtgcttgggataactgtggcacagggcagagcccagagtcagcaatgtttattttaagttccttctagcttcccaattacatctctgaattttttggagaaagctagcctcagattcagccaattcctacggatttcccctggaatgaaagaagccttgattcacacgtgtcatgacattgagcattcttgtgtttggtgggaattttggtatagaaaatgctgattgctgaccttttatcttctgcagaagagctccttctgtcagggttcagagacttaggcatcaggccagctgggcatcactggcattttttcctgcccatttctgtctgctttctaggcagcagaaatgaaaatgtcctgccaatctgttagactgacttcgccaactgccaaatggccttgaaaggagtagtgggaaagccagagcttggtggtcagacatcctctgtcgcttactggctgtttaagcctggacagtggcatgtccttaagtctctatgttgtcatttgcaaaacagggttaataata

SEQ ID NO: 108151 - DNA, 1031 bp, Homo sapiens
agccaacatgatgaaatgaagcaagcataaacaggacgagtgttgcgagttcaagccggccaccagcctccccaggcagtgatgggctggcgctgccacatcagccagctccttccagggctgccttcctgggagcatggcagccacatcccggggagcagcagtcctctgctagcacacatctgcagcgccagcttccatccttggtctcatgttttaatagcaaatctgacaaattctcattgaccctcagtgggggttggctgcccaccacaccttctgcattgcctcatgggtggtatttctcccaaggaaagccttggctagggtgagtgggagggagagcaaggacgctaggtccgagacctgggttgtggcagttgctgcattacttataggctgtgtggcctgggcaaacctttcgtcttccggatcttaggctcctcacctggaacatgggattgatgatacccctggttggtgataccaggtgaagggtctggggagccttagctgtgacgggaagaaagtgcttggcatgtccttggcatgtagttggcgtagtagaaaatgcagtctagctgatttggagggtgtgggtaagctgcttaatctctatgagcctgttttcttgtctgtacctgaagaattgacacttcagatacctggcccagtgccattcaagacatggtagaggtcacaggcatgtaggtcctgaacgatccagaggaagaaggggctctgtagcccaggaactgccttacacagtgccagggcccttggggatgctgagctcctgcttgtgggggagtcaggtgaagctgggcaggacccagcagggttgaggtcatgtctcacggggagtgccgggccacgtgagggaagaccagtggacaggcacattaagttttaaactcacatacttactttaatgtacgttagaaaaaaatcaaataagtagtacatcaaatctgtactttttatggaagtttttgctttctttttggttttatagttttagtatttaaaaa

SEQ ID NO: 108152 - DNA, 1149 bp, Homo sapiens
cctgtcactcctcaggtggtctggtttcatgctgctttacagaccaaagtgctgggcacagaggcagatgtgtcttattgtcttctcagagtgttaccaattatttctagtttcagttgaagagactcagttcattgatgcaagagattgactctcaggatatgccggagaacagagccccaataagaatcggggcaggagctcaggggctgtggaaacactcgttgccagcaagtgtgctgagaacacaaaggaaatgcttgtgatccttttagagtgactgggagtaaacatttatttcaccttgaaggaaatgaatgtttcaggaagaggcccaggagcttgacgaagctagacagcccatgccgtaagccacataaaggaggacatcagaaccaattgggttagagagggcctaataaattgtgtccctcacaaggacccagcattttctgttccttgggtgggccacatgtgctcttgagaagattgggaacagctgtactgagttgttgccattgagtcatatctggtccaggggccagcggttggtgcctctggtcattccgtccttttctaacaaagctcgaggtgatctggccatctccccaaagatcctggggaagtgcatgctcagcatcctccgtgcagcactggcagctggggcttccgtagccccctgctgtgtcctgtgccctgaatggccccttcccttagctttccggcctgctccctccctccagttgctaaattcccctcttctatgcttgcttagcagaaacttctcatttaacttttacatacttcactgtgttgatgttgtctgtatgtgtgtgtgtgtttcccccagaagactctgaagcttctcgagggcagggactgggttggattaatttctgaagttcagaacccagcctagggacagccatacagaatgtaacagaagcaaacttttatttctgtgcccagatatggtggtgcacagagggttgtgtggtgcacagagggtagctggttttgcaggtacagtatcaggcatcttgagaaattaatagtggggaaggagagcccactaaggtgggaatgcttgcctgggacaccagcctggcctgcctgtcgcctccaccagggggcccccctgccccggcc

SEQ ID NO: 108153 - DNA, 1074 bp, Homo sapiens
atgagctgatgtatgcaatgcacttagaacggagcctagttatagtgaacactacattaaatgtcacctataaaaacagtgctcatttcttgtggaaagggcttggtaagaataacttctgtcccagaggaaattccagcctggtgtctctgaggttttcctgcttcatgatccagggaaataattgtcttaggttattcctgggctttctacctcctggggctatattgagactcagtatgaaaacctatgtttgaaattctagggaaaatccccactagagagaaaataatgtcagagactgtttggagctttcacatgcattaactccttcagtcctcctaacagtctatgaagtaggccctgtttttacacagcatatgtatactgtggctatgatactaggtgtggggcctcggtccagagtgttggggagcgagtgtttggcagcctctgcacggccttttcatcagctttggaagaagccaaggctagagagcgaagtgctctccccacgtggccccactggaggggcaagggctgagtgagattcgtctgctctcatttggaccccagagagcccattgtcctttcctccaggatgaccctcctggcatccaccttccccacccccaccatgggcaaaacatgtctcatgggagaaagaaggagtgggctgtcaaatctgccctaccccaggcatagcggactgattcctgagtgcttttctgactccaatagttacaggcctaaaaggctagatgtttattctgtttcttcgaactttcctttctagcgaaaactccagagttctcacactagggagctacaggccagtcttggcccatggacatgttttgtttgggccatgctgtttaaacatttttttcaattggttgtcaacatttaaacattggcgaatttcatataatattccagatttttggcatctcttaaaaaatcagaggatctggcaacttgaggcctacattcctgtctggccatggtgtactggagctgaggagaaacggtcccctccaaatggggtgcgggagtttctgttccctttggtct

SEQ ID NO: 108154 - DNA, 1049 bp, Homo sapiens
taagaccctgcctctaaaattaaaaaaataaataaataaataacaaataatggcacacatttacctacataacaaacctggtcatcctgcacatgtacccctgaacttaaaatataagttggaaataaatttttttttctttattttaaatgtaacattttttctccttcttataatgcccatagctttgacttttttaaaaaaaaatctgattttgaggttgctaaaatatgttcaaagtataatgttaagtttctccagctgaaatatttttttctgaacatattttattccttcagtcccaaaaggaaaattacacctcacagataacttatgctttgttaaatgctgacccttgtaagtttttcattatttttgaaatgattaagatatataatttacagaattggaaattgtaatttttaaatgtactgagaaactttaaccctattataattattctgcaaatcttttaaggatactatagtcagtacaactagatgaaaaactctgatagattgggaaatatagaggatcatttataagccttgatttttttgtcttgtgtttcccacccactcactcgctatgtccctctagtctcagagcgattttctaccctgggttcatgggaattgggaaggacactgtttgattcattctatgaaactactagggattttgaaaaaggcaagacgggccagttgtgtcacttcctgtcgtctgatcaaaagtttgatgaagaaaagaaagtaactgagagctgctgccaggcagcaggcagttgcctggtgatgaccccgggtttccagtgctagtctggttcccagtgtggccagtcaagtccctctgacctctgggctccttagaagtccctggtgctggctgcgctgcacggggtccgctcaagagcctggccttttggaacaaagacggcttttggatgctggatcaggctgcagatgaaatcccaactggctcctgagtgtttgggtcctatctatgcttagttttctgggtctgtcaatcagtttcatttcccatccaca

SEQ ID NO: 108155 - DNA, 1196 bp, Homo sapiens
gatgctgtccactccctaatcctcccccttctgcctcctctactttctcagtcttctctcatttcttagcaagggcaagtatctagccatttgccaagcctagtacgaaacttttttttttccccctgctgagacatttcttcctctgtcaaatggaatgaaagtgataggattggtgcaatagaaaggcacgggttttggagttagatgagcctatacctaaacccagccctattgcgtgttagcagtgcgatcctgggcaagctctctgtgttttgtggacctcagtttcctcatctgccatggcagttctgaagcttcaggtccaagtgcctagcacagggcctgtagccagaagctgtgtagtcaccatttattccactttgctcacttttactgcagtgctttgacctggggcattgggcaactttctgtggggctcaccaccccttttccctttctaaccttctcttctcttattccaggggcccagatcattgatctgatgatgctggtcatcgatgtgaccaaggggatgcagacccagtcagcggaatgccttgtgatcggccagattgcctgccagaagctggtcgtggtgctgaacaaaatagacctcttacctgaaggaaagagacaggcagcaattgataaaatgaccaagaaaatgcagaagaccctagagaacaccaagtaggtctgctaatgagagcaatgttcactgcataagaaggcttctggggcctcccatgttcatttcacaaacatgaattggacaggcaggtgtcagcctcccgtcctagtaagtgagatctcaacctggcatttgctcacataagggctgcattaaatgaggtaaaggctaacgtgtttttaaaagaggccaaaaaccacaggagcataaagaaactagaatttgatgaggcacaagcccttctgtgtctcagctcacaggaaggagaaggagcacagggactctgtgcccagtgtgcaaggcctggactggcaagggttcagatcctttctacttagcttgtcttgataaaaacttagtcccgcctacatatattggccatactttggtgcaagagaggctaggactgtgttctcttgctatctgcttctctacaactcgattatcaaaaggggaagatcaattttggtagatgactggttgtttctgttacagaagcttg

SEQ ID NO: 108156 - DNA, 1944 bp, Homo sapiens
tttttgtttaagtcatctttagttttttttggttttttttttttttttttagcaatgttttgtagtttttagcgtacaaggcttttgtctcttcgatttattcctaagtattggattcttttagaggccattgtaaaggaattattttcttaatttattttggattgttcattgctggtggatagaaacacacctgatttttgaacttgtaccctgcaactttgctgagtcctccccccatcttttctttacatatagttgtagtcatgaggcatgtacatttttatttctgcttttattacttaacattttacatatcatttgctcatgtaaccaccactctgttgacctactagactggcttaagtttctgttcttaaaaataaagccttaaggtgaacatctctgtacatcattaaactgtattttcacctttttcctcatgatagatttgcaggtatgagattattagatcaaggggtctgaacatttctaaactttttgctgtgcattgccatattattttccagaagtgttctaccattttacacaggtgtcagcagattactttggtttataattttaaactatacttgaaacttagtagaaaatagtgttttagtagaaatggtaacttagtagaaatggtattttgttcttgttttaatttgtggttctttatttcctgaagtgttttgaacagttgtgcttttgtatgtgtgaattatgcccatgtaaaaattttgtctgtttgcctcttgcaattttaatttttttttaatttttgggagtgtttaatattagtaaagatattgctgttaacccttctatcatatttgctacaaataagtctttggcatttgttgtctttccattttagttgctttttttgacatgcagaagtttctaatttttatgtagtcaaactctttgttcttctttgtgatttctttatctctgaaagcatttaaaattactcttgcataagcatttatcaatgttaacagaaatcaaaacagaagataaaaatgtacccacaatcttctcaatgcatcaaattaaagtgtttttcccccaggatccctgtcagtctttcctgcgtgtacataatttgaggtagttgttatcacagcattgacactgttctgtgttctaggcttttctgtttatttttccactaaatgttatcatctgacagcatccttgatacatcattcccccagactccctttgtgtttcttcctgctttttaaacactttctatttccttctgtctgttttagccagagccctctgtctggagcccaccagggactccattgatcctgcctccctccctgtgaatgggttgaatgccaatctcaaggaatttctctgctactgagtggactttgactaggtgtattttccatactagctttgtggctgactaactgtgtgtgcttgggcgactcactccatctctctgagctgctatttcttcctttgtaaaaggggagctgaaaagttcagtctcatagcgtttaatatgagggagcatttcacgtggagcctggcacaccatggatatgtaggaataatagctgtaacatgtggagaacctgctgtgtacttggcactgtactaggggtttcgcatgcatagttcgtggaatcagtcggatccttacagtttcctaagaggtaggttttgtgtctggcttgactattgagaaaagtgaggcttaataaatgttggctgttttgaatctactatcccaaaggtaaaatttatttatactctatttgtttatatatctttatatggattataaattcatatatatatgtatatacacacacatacacatatatatttatctgaaactttttttgtgtgctaacgaacgtcagcttgcatacacagtcagcacgtctaggcccagcaagcaccgcaacatactgt

SEQ ID NO: 108157 - DNA, 1555 bp, Homo sapiens
ctcacccccattgctcttgggagccctttgtgtattcattgtgcacgttccgtggagactggcgcagaggaagtacttagtaaatgtcctgcacttaaaagggaaggagacagaagtgaccttgtaagaaaatcagccataagctctgatgggtaaacagaagtgggatttgttttgaaatatgagaagaaggagaaattggatgttgattgaaagtggcagggtgggggtgtcaagcaagagggcttttgtcccaagaggagagaaatctggggctgtaggagtctctggatgtgagtccagggaagagcttggaggggctggggagcggggccggggctggggtatcagcatgggttcctggaaggcccccatagacctggcagcaagcttgggctcttcccttcaggtgcctcttcttgggctggatccttcgcctggcttctgtttggggctatagtgggggaatgtgaggggatggcctagggtctgaggaagatggaggcagtattattcagagtgagggacgtgcaccacatgtcacacaagatccatctgggactgtgcttggatgtggcaaaattgcaatgaaagttaaccttcttcagttatctttaaatctcttttattaagtcagaaaaaatgtctcaaattggtactgttgtgtcttaaagatttccctaactttttaaccaggctcagtgccttcagcaggtaatagtatctagctagaatttaatagctctattttgttttctttgtgtttatttttgtagctacagtagtagaagatttcttgtcccctgagattggactgtggttggttaatcaaaaaagtcccttgaagcagagaatcataaaaaatgacacattcatgccttaaacataatattttaacttaaaacatatacgtgcatatttatttaataaaatcaacaataaaagctgttacagaagaaatacaacattcgcagcatcatgcctccctttcctcatcagcaccaagacactggcagccgggccaggctggtctggggcttcttggctgcatgtggatttgagttctgaattcgggcctgactccacttcttcaggctgtgcttttgaagaatgtttggtttttgtgtcatttataatttcagttttccatgcatgatcacttataatctatatgttatctttaattcatttggtctgaatacagttaagtaagctatattctgtatgttcttcttggtcagtatgtatgtatgtatttttgagacagagtctcactttgttgcccagtctggatctcactataaccttgaactcctgggctcaagcaatccttctgcttcagcctcttaagaagctgggactacaggcatgtgctaccacatctggctaatttttaacacttgttttatagatgggttctctctgtgttgcccaggctggtatagaactcctggcctcaagtgatcctcctgcctctgcctcccaaagtgctggtattacaggtgtgagccaccatgcctggcccagaatttatgtttttgaaagctctagagtt

SEQ ID NO: 108158 - DNA, 1027 bp, Homo sapiens
aaatatcacagcttccctcaggcagctgtgatgttaaacaattgcctctgattattttcaacaaactcccccagggaaaaggctatttgcactaagcaagctccaaggcaggtcaaataaatatagcattgtgagtagggccttccagggagccaccagactggaaaatcatgatcgttctctggaagaagggctttgaaggagctcaaacccattctgcccctttcagtgcctggcatgctactggttttcaccatgattggttttcaggacagctgcagagttagcataggaagagggcaagttaaaacatcaaaagctcacttggttttactgagactcttcttgaataaacactccacagattgctcaagcctttggttaatttccagagttctgaacaagttgattctgatcatttttgccagtgttctttgtttccatggaagagggcttttcagatgtccttgctgtatcattttgctgatctattagtgagtattcactcttagatgtgtaccccacgaattcatcccacagccaaggcaaaaaaaaaaaaaaaacattcatgcccgctgacatgtttatcacagtgtaatttataatagtgaaaaatttgaaatatcacaaataagtaatggaggaaagcatgtacaagcatgtaaattctgggtcgtaccattgtccaggtgtcaacaatgaaagaacaggcccaggtggagagaagtgtgacaaagagactgagagccctggcttcagactcagatgggctgggttcaaatgtggctctaaggtttatagccaacaacttggagcaaatcagttagactccctaagcctcattttctcatctataagatggcaacaactccatcatgtgttgtagatgctttcatttaaacctcacattataggcttggctcagccatgtaagttgttattgttgttgctgtcattcaacagaaagttctttgtgatataatggtaaataaattagcaggatatgaaatcgtatacatactataac

SEQ ID NO: 108159 - DNA, 1033 bp, Homo sapiens
tgggtgaggcttttgttactttttcatcaggctcctgagagcacttgtctgggagcctgggatagttgtttttgttaaagcgaaatcctcaaaaatgctgctttgaaagatgtttgtatattcctttaagaagcccctacataaatctcagaccaagcctgttttgtttgaatctctagtgtttttccaaaagaattgttatcacaagactaagactttggaacattcaccactgaatacttttttgacagcctgttcccttacgaagtgaaaaagtagcaaacacaaggaatcctagtctttgttttcatttgtttattggtgatgagccctgacagcatctcccggcacacaggtggcatgaggagaatcggctggtgaggctgaggcgtgtggagtccgcagagaaggaaggaccctgggaacaatcctttcctcctccctctccccacatccccttgtttcttcttctttcacttgtcattctctcaggcatgatgccagctactggagatacctggctctcacagccctatgggggagataataaagagatgatcacaggagagtgttagctatagtgatgggggcaggggaaacgtggccatacagagaagcctgtccagaggaggtattgctgcagtacaggcgaggctcagccagctggtaaaactctaggcctgctggcggctggcttctggcatacgtcagggagtggcggaagatgaggcctaaaaggtacctaggggctagatgatgaggagttttaaattctgaaggcatcaggaggctggggaaatgcatgaggccagggagcaatgcgacagggtgtcctttagtggctactctcctgcagcatggagggcctggcaggacagaccattgtagcagtcccacgggagaagacagacgaggcttctccaggtgccctttccttcagactgagcggaaagagctgagagcatggcagaagcttggaatgcagtcagggagttaggtggttttgatctcctgtccaccttgccagggcatg

SEQ ID NO: 108160 - DNA, 1035 bp, Homo sapiens
aaaagaaaggacttggctctggccaggttccagagctccttggatctagtgggaggagtcgaatggcagggccccaccatatccaaggagccctggaacctggccagagctgggtgttaggatgtcccccagacactgtgagtcacagtcccctcctttacctgctgtcatgtcctcctctgaagaccattggtcccagaaaaagaccacttgaataaaatctagtttaagccagggactaaaagtgcaaatcttcaaaaataaagcacaaaagtgtaaaagtagattcagtttatatttaacaaaattaagattactttggtgactgtttgcagattctttgctagaacagaaaatgaatcagtactaaatttctttccagtctctgtgcttcctaagtcagacctctgggggccactctgacctggcatcccttccactctgggagaagacatgcttgcagcttgggagaggacctgggagtatgaaagaggtgtcaaaagagggctctctggggggtggggtagactttgaattgggggtacctgaggttctagagggagaaaaaggtttttgataagagtcagtggctgcaatgttagggctgagggcatggagaagggctgaggcagagaagtcagtagtggtaaggaggcagggatgttcgagtggggtcctgttctgagctttttggccaccctctttgtccttataaaggtggaacttgcctatcaggatgccagttactgatctttagtacttgggcacatggcaggtgcttggcagatacaaatttaattctccttttacttttgtgcacctgtttttccccagcctactttttaacacttttggtgtctactgcctgatgatctaatttactagtcaggaaaagcagaacttgtaagcaatgtactgagacatttggttaaggagatttctaagcaaactgtgaaagatgctgccttgtttctccattgatgcttatagtaaaacatgagggaaaaggaatgaattgaggaaggaactgttagc

SEQ ID NO: 108161 - DNA, 1283 bp, Homo sapiens
cctattgggcaccgggacatggggggccatggccctctttccaaacacagtgacatccctgtcagatttcactaatagacttggacacatctgaccgcttgaactcccttggaggcagggcacagccattccaaataaacagtcacattcccctcccagtctgggctggcctgcggagcctgccataccctggcccccgtttctgttgcccaggtctgttcccagctggggccaattagctgagcaagaaaatgttggggaacagggagtgaaggagaaaaaaattccatttagtccctagaacagtttaaaggccacttatcctaagaatcaccagctttctgctgaggcattttgactctctcgatcttcagcctgagaaatccctctgataagatttgatcttcggggttcaggctagtgatgtttctggtgatgattggctatcagggttgtaacatcagaaactgttgaagccacagaccatggggaaagagagcaggggctgggagtgcagagggactcaaggcaggcatgtaccagctctgtgtccacaggcaagtcagtcaacctcttcgtgtttcactggttcagctcaaacttgggatgaccactgtgtgcttggctctgtccaggacctctggaagatgggtcagggtggtgtggtgtggactagggataatgtatataaggttcctggcatctaggagatacaagctttagctgatactcttgtcatgtttattgttgccatttgatattattctcatgtagaatttttgttgtgggttccggaagtagtaagtgtcagggcaccttcctgggtgtaaggtcctgttcagggctactaagtgagttattgaaatgcaaatatgctttgcggaccccactatgtggaccccactatggtccactatgaatccaatcaatgttctgataatgatgacaaacattattagatatatttggatacctatttagttgataaagcttttagggaagagttcagaatttgataacatagtcctcccaaatcaagtctatattcagattgattttcttcttcattgaaaaccccccagaaagggaaaagaaaaccttaaatactggtaggtgtttttacttttacctttgcctctgctctttgaagctaatcacaagggtgagataagattatgacatctggaaagaatccattttcttgcccaaacaagcctgcagtcttgactcttccagatctgcccttcccccacctccagcaacgctgtgcactccccttccca

SEQ ID NO: 108162 - DNA, 1024 bp, Homo sapiens
ggctttcccctacctgcagtatgctcactttccagcacagctcagggctcacatcctttgggtagaggtgtgccccgtcctctgtgctgcctgctgcttgtatttgtctttgtgcctgcatctcctgtggaccctggtctccctgggggcagaagctgagtctcctccatctttgtattctcggcatccatcctgggctcggcccagaaaatatttggtgaaaggaataataggaaaaagccaataaaggaaataaacaagttgtttttcagtaggattttgattggaaataggtaatgagtgacctgagagggctgtgtttggagtcactgccaccctggggccatttacagaaacccagagctgggcagccccccacttcctgctggggctgtgcccctgtcttcaaggctgcatcctgatgctccatcagtaagcagcagtggagatgctccctgtgtccctgtgctgcctcattctgggagcagtgactgtgaatcaggtgcccgaggctgcagagctggctttccaacacctgtggatatcggctctcaaggctgagctccctctgctgccatgtgtttttatctagaaaatattgagtgaccttcatcctgaactattttctgttccagaagatacataaaggaaggcagtttctgtgcatttgatgtttcatggttgtctggcttttggcagtggaagcttacgggattctgctctctgtgcccatgtgtggtgcaccagatgcacagggttggagctccctgggaaggagagaaggcagagaaggaaaccaggaaggttttgggaaagccagaggaagccatgctaggccctttgagcagatcagcccacccttggttgtcgccctcaggagggacctcgcagatcaggcccttcctctgcagcaccatggccactgctcaggttcaaactcccgggccctgcagggccgcttctgtggcatgctgctcctccccttgcctcccaggtcttcttcttgagtccagcccagccctgc

SEQ ID NO: 108163 - DNA, 1272 bp, Homo sapiens
gactctggccaatgatatgtgaagggacatgtcctaggggtttggggaaaagcttttctgctttttggaactcaacaggaaaagacagcttttctccttcactggacattgaagggaggaaggatgtgacgcctggactcaggggctgaacggccaccttactcccaggctggaggtttgcagaggctgggaggcaggagagttgcccagaagcagagcctgcacctgagggctgctgtgtgtctgccccgcctcagaacttcgtgtattgtgagagctctgtctccacacggttccagtcagggctatctgttacttttggaccaaagtatcatttatgatatgagagcaaaatggcatctctttcctagctgttaggaacacaattaaggaacaggctgctcctggcctggttggacgggagctcatccctgtggatgagtacagtgctctaattgggctggctgggttacatgtccacccctggagctggaagggacaaggtgggagggatggttcactaagaaatttgggttactcctaggaaatgcagaatagacatcaggcaggcaaaactgagaggtatccactggcttggtgcttcccagtgtccacaccatcacagctcaggtgctggacacagatggactatgtttgagtcctgccccatcactcacggggcagttacctcccctggcttcctccagaggttgtcatgaggatttgacaagagccacgtagcgtgcttgcagcagggcttgacgtaagcctcactgtctttatcaccaccctgtacaactctgcatcttgtcttttctttaatgggcctttttacttggcccatggagtgcagagacttggggtggggtggtctgagctctgcatttcctgcctgcacccaggaccccaagagcctctgtgaggtcttgcctttctcctggcttgaggatttgaatcacacctgcagccaagttgtaatatcctgttgtctccctaaggaggcacagctgaggaaggacagtcgccaggcaaagatggaaggttgacctcacaggaggcagggaactcaggaagacttctctctgcaggtgctgttgtcagagatcaatgctcagtgtcctaaagctctggcaggttggaggatgctgcccctgcaggcctttttcctgtggaagcttggagcttgttcttaacccccaaaccccaagtgaatggcatgcccttttccatcaggcccctgagaatctgttgcagctagacgaactgctacca

SEQ ID NO: 108164 - DNA, 1054 bp, Homo sapiens
cccttctgggcagagcggctctgcctgccccctctcaccctctggcctggcacctcagggagggcagaccacacctgcagtctgtgtcgggcccctcactgccctggcatcactctggggctctgctgggactttcttgtttgttttaaaggaaagttgagtgtttcctgagtgtgcgtaaagccaatgtactacttaaactgagtatttataattctttcttttaagaaataaaacaataataaaataccataaaccttgctttaattattcacaggtgtcaacttgtaatcatcatggggaaagggccaatgagatgccttatttaaaaaaggcacttgcctgcttttctttgaagttttgctaaaatgcttcattataacatgttcttgtttataaataaattccagcctttcaaagtttgggtgttttttgtttttgtttttgtttttgtgtgcgtgttttaaaagtatttaaatgagatgattctagatgagggtgattgattcacagagtgagccagccagagctgtctgtgagtgacagctgtggctcccctgccctcctggggcagcatagctaccttagcttgctgtcagctgtggtgtttgtgaagctatccattgtggatgtgtagattagggtgaatcccgatttgtgtgctcgcatttgcctacctgctggacttactgcctggcagacagctctgcacgtgagcacatgtgcacatatggcctgagatggggccttcccaggacaggggagagttctctgagggcagatagcaagggaaccaacctgggctgaagtcaggggaggcttctcaggtccgaaggaggaggaagacttactaggagaagatgagcaaggtgtgggtagagaggattctgggcaaatgcaaaggccccatggtgggagagagcctaatgtgtttgaaaacctaaaaggaaggcatttggcatctggactggagcccagagacaaatgtggggtgagaggtgctgtagaggtaagtggcaccagaccatgcaaggccagttcaagttctgtctat

SEQ ID NO: 108165 - DNA, 1150 bp, Homo sapiens
cagattgaggtggcttggatcaagctggcagcaatccaatgggcattaaaggcattcaggagatggaattaacaaggctttgtgatggactagatatagggacagtgaaggggagaggcatattaccgatggaccccagatctctggcttcagtgacaggccaggtggaggagccgttggtgagagagaatccagaacaatctggaggggagagtgaacagagccaggagtatggcttgggcttcactaagttggggacgtttggggaacccacttggaaaggtctaggaagcaagctgacataagtgtctgaagctcagagaagtttgggataggacatatatttatgtgctgttggtggctccaaccttggtagttggggcctctggctagaaaagaaaagttaaaaagcaagcttcagctgtttcatctaaagttataattccgatgctttaaaggctcccaaccctcttcttgttcatggtgggggagccttcctagttgtgaaagggtctgagtggctccagctttggcatattagggtgcaggggagggtatttctagggacactctgggagaagctgcccagcctgcatggtgctagtgccagtctgcaaaatctccaggtaatagagagggcaggcccctgcccacccccttgcagcctccaatgctgctgctgtggcagctgctgctgcgaaacaaaccagggtgactgggcggaaggtcaggagtttaagagcttgtttgattcaaaactaggctaaaagacaggaggggagtgagctggttttctgtgtggatcctggtattttcctttgagttggggaggagaatggtggggcagggagggaaggccggccgccagagggaacgctgccaagcagagcgcagctaatgtgaaccatacggcggcggcgttgggcagtggcggccatctcccgcccagcttagtacagcccttactgcgggcaggggtgcagacaggcaggaaggcagctcgggctgtgcggccacttaacccttccagtgctgaactacaagcagggctccttcacctcagcacattgatgtttcagccaataatcctctgtcctgggcactgtagatgtctagcagcatccctggcctctacccactagatgccaat

SEQ ID NO: 108166 - DNA, 1028 bp, Homo sapiens
ggagctggcccctaatttggctcctccatggcccagctttctgcatgcagctgctctggggtccctaggagtgattgcagcccctccagggtcacttccattttagctgagatttggggtcttgagagagaaggggcctgatgtggtgtggcagcctccagcccacttctagtaagagtatgttccagaaacttgactttgtatgcagaggtagcatgggtaagttggggatggggtggatgaggatgtgagacatgaagataccagcctcttggaggttctagaatcccaaaacgccaggcagtaaggggtttgggcctggctccaggaagttcctggagagtttcaccaggatggggtttggctgggtctcactgtcttcctggatggaccagggaggacagaaccagcatgccacctctgggatccactccagggcctggctggttcaagcatgtcctaaggacagataggggaggaacctctgaggcaggcactcaggggtcctcctctgggccctgtgcgggggttttgagccttatggctgatgggggcctggcgacttgcactctccggttctcagctgttttgtagttgacagtgtgtgggaagctggggcgttcccctgagttagtggtggtcgtgggatctgagcaggcagttgcagacctgatcctgctttggctctggagcctgaatggatttctgacaggagaagctgaggctgtccagcctgccttgggaacttggctgcttcaccaagtgggagctctgagactctcccacaggtcccgtgctccccacgtgcccttacagttacctgcccaccagggcccagaggaggggctacctggagcaagggtgcctggactgggcctctgtcttcccctgctgtgagcagagttctcacctcctgaccccgacttggtctaaccctgtgacccacatgaaatgccagccactggtggtgggaagtgggtggctggtctcttccaagccaggagtgcatcagctccagcctccttccc

SEQ ID NO: 108167 - DNA, 1082 bp, Homo sapiens
tgggtccaggtgagggttgatgacggcttggtctagggaggtgttgggagagtgggagagaacaggctgggcttaagaggtacctagggtgcctcaagtcttcatgatgccttgagcacggggcaagatgaagaggtggggtcatgggtacttctgggtttctggctcacatgatgagatgggtgatggtgctgtggatgcagaaaaccatgtgtggggaagaaggtgcctctggcgtgggagctatggtgctgcagagcctgggaggcatggggtggaaagcccagtgctgtcagagccagagtcgagagtgtccccctgggtgctcacactgtggggctggagaaatcagcttgggagaaggccttgcttttggagaactgtagcacataatggctgggcagcagggacaggcctgtgaaagagatggctgggcctgagaggtagaggggagtgaggagggccagggctggagcactgccgtgtcccctcctcctcaccacctgtagcatgtccacttcctctgtccagcctgcaggatcctctgtgtttgggtctaccctcttgtgcttccctactgatccccaatctgtagttgttttcaaaaatttagccatggtttcctccctcgcacagccatcatggacaccaacccagctcccctcgcccacgctcccttagcccattcctgtccagcgtcaggccagtcccacgttcctggagccgccagcaccctgccactccctgccccttcacagccatccccatgtctacgctgcattcttgtgctttacctgtgctgtgtgtgcttcaccttaggcgtttaaccatcattctttaaaacattttcaaatttatgtgaaaagagaacttgataatatctgtgaactcatgagtttgctctgctagttatattttttctatctggaatttgatataagtacatctcccacatgggtttgtagtcatgcatgtgtgtacagcattgtttgctctgtcttgtagataaatggtgacgctctgtgtgtaccctatgccaagcttgctcttcgcattcagcactatgattttcaggtttctct

SEQ ID NO: 108168 - DNA, 1053 bp, Homo sapiens
atcgttatctccttttttcctgtatattaatgataacatagtatacacattgttttgtaccttgtttccccccgccccccccaaaaaactctgtctttgaagatactctggtatgagaacagatagacctgcctttctttctttttcactgctgcattagtgataatacaggtacgccatcattcatttgtactggtcttccagtgacgaacacttctgctgcatctagtctcttgcttgacttctgtatttcttcttttaaagtgtaaatgtttggcacaggtgcttttttcagttatttcaagtaagcgattttggttttcacaggatccctaggagatggctttggcagacaaaactcggctctgagggatgatgtgttttggtcaaggtcatagagttgacaaatgggaacttgagtttaggtctccttactccacttccagtgtccttttcactgtattctagaccagaagaataaagaatatataaatccacatataagtcgtatgtgccacagcaaaagcctgagttcctgcctttctttaccagtgatctgcaaatcagggtctgttgagtggggttttccttgttgtgacttgtctctgggaccccaagatagggccaggcccagagcaggagtcaggaatcccttgttgaacaaatgtgcaccctgggccctgagatttggggctcactgtggccattgacttcagggagttctcctaggatacagcaagctgccagtacattggttggagtagaggacctatactttatactttgcaggtgaacatgttgacttaaccatcagaagtctccagatggaaatgtcttgccccatcactgtagtttaagtggtattcctttaagaagaataacttggatgccagaaccaaaggcctgtgctattggactgggccagtgaagacagcacaggcattttccagtttcagtgaagttatttttggtcaaggcatttcctatttgaaaacatttgcagctcctcatgggtccgttggtgcctggaggtatagggcttttcagaggtta

SEQ ID NO: 108169 - DNA, 1048 bp, Homo sapiens
cagtgtcctccttaggcacctcttccttctgtccttttccctagtggcaactttgtttctctcctggagctgtggagttactcttgacagactggaggggagaagtcctgaggggtgagcctgggaatggggcaggaggaaagagactggtgtgcagaagggacttacacatgtcgcaacatttaatgaggaggggtagagcagcagttcctgggagaaagaactcccatggggggcaggaaatgaggctcagtggaagaccccactgggaagctggcaggcagaccagtgtggtcaggccatgcagaagggacctggggggctactcaaagttacctaatggagtgaagatgaatttttctcattgaagtggaaaaactgctgatttttatcagggcaagttggttagagtgttagttaaaccatctgtcaaagctcatttagttgtcaaaattaaatcattttcctccacttcctagtggattggttataatgataactttcttggcatgacatttatcatcttggtccaaaggcagtcgggggtatggggctgggaagagggcaggaatgtaatgcatagagtgatacgcctgttccttttgtggtagaaagatgctattttaatactgtttaatttttattatcacttataatattagtgtgcattttgctgtaactgcacctggtttcaaagcaggacaaaacccatggccatattaataaaggagggtgaagggaagagctgggttagtgccccttgtctggtgcttcagatggtaggagaggttgatcctgcaggccgactgatttaatgccctgatttccagcttaggtttcatatgccagtcataaagtgtaagaaataaatatcctaaaacaattatttttttaaaaaagtttggcttataagcaaaatatctaaaaacatttctaatttttatacagaagaggaaaaaataatcagataatcattgattttgttttttgtttttttttgggggaggtaagttatatatatggttgggaaattctaacagcacgaaag

SEQ ID NO: 108170 - DNA, 1436 bp, Homo sapiens
tgttttttctgagtgtctgtagctactggtgcatttttcagatgaactttaatattacttttaattgccaaaaaataatttttggtattataatttgaattgagttgaatatagatgtaatataaagagagtttacatcattataatatctaattttcctgagagcattgtctttctttccacttacttagagtttctgagtttttttcaaatagatcctgtacatttcttaagtttatatttaggcattttggttgctattattaatgtgatttttattttcgttataatttaaaatttttctttgtttagaatagctgttgattttaaaatataatcctgtaacccgccaccttcccaaaacagacttcggtattgtttttattgtcttttccgttgattctcttgagttttctaggtatataattatatcattggcaaacagtgacaatttccattcttccttttaaatgtttagaccttcaattttatttgcttatcttattacattgcttagtagttctagaacaatgttaaatggcaggcatcttttcgttgtttgtaattttttttttttttccctcaagacagggtctcactctgtcacccagactggaatgcaatggtgcgttcagggctcactgaagccttgacctcccaggctcagatgatcctcccacctcagcttctcaagtagctggggccacaggcgtgtaccaccacacctggctaatttttgtattttttgtagaaacaaggtttcaccatgttgcccaagctggtctcgaactcctgagctcaagtgacccacctggcttgacctccaaaagtgctggaattgcaggcatgagccaccatgccagcctgttgtttgtaattttaatgagaatgtggtgagtgttttatcattaagtaaggtgatggcttttcgatctcatttatcttttctctcatcataaggaaatactcatttatttttatttttttaaatcaaggattatttttaattttggaaaaatcttcatggcgtattttggagtgatttatggtttttgtcttttgaccttttactatgctgttatattaatatgttttctagtattgcattctggaaggtatcctacttagttgtattctggtctttcaataatatttatattattctttcagtaatatttatgtcataattgaaatgtctggttggcaatttttgtcatgtcaagtcttggtattagtatgctagcctcacaaaaaggatttggaaggttttctcctttattctttttaaacagttaaaatagttatctattccttagaagattgaagaaatttgtctctcaaaccatctgaatttgatactttttgggggtagcactttaataacttaaactgttttcctttgtattattagtcttttgtttcagtctctgccaggg

SEQ ID NO: 108171 - DNA, 1351 bp, Homo sapiens
aacaaagtcagtgtcacctatttgccagcatggctgcccatggcaagccattctggtcttgcctggagtgtcacagacagtatcccactcctcttcctgagtggccgtgtactaacaggtaacagatggcagatgtgtagacgagcagcggttgatgcctggcttcgccaccgagggagcacttgggccaggcacctgcgtgtacagcagctccttatcctcacatcacctgcaggagtaaggcggtttttaccccattgtaccatgaagactcagaggcccagagaggagaaatgacttgccggtgttcaagtcctggacagggtctgaatctaggttcagacagggtgcaacacatgaagtttctgcccttttggctcctcgggaattcttctcaaccatcagaaagagaaagcctggggattttcacacctgtcccacctggaacatgtttcatgttaagtgccattcctttccccactgtgtttttctgaggtcctgacccccctccaaccccttgtcccattttctgtggctcctgaccctcaaggcagaagtagcaggccagcgggcgggagccagcttaccctgcctgctgcctcaccaggggacagcaggcttcagaggctctcctgtaatctctctatccacacagccctcattttaatttgcaaaattgaagccagatcgagagcagtaaagccagaggatggtaaatattcatgcctcagtgagcgagggtggctccattaccgttctgagattgagagaattacctgggggattatgtatattcatgggccgatttttatttgcgatataacatgactcacgttggcctgtgtgttacaggttctaccctcaacagactttgcacaaagcgtatgcccttaagcttctgaaagtcatctcaagtggattgcccatcgccttctgcctcctaggagacaggtcagaataataagcacaccagtgaccaaccaggggtttccatgcactcctctctctgccttacaagctgtgggcactattcttacgtccaggtcacagaggaggagacgatctgaatgccacaccatgttctgtttatgtggctgtccctgcactgtgctgccatcctctcgactgcagggatggtgtctcattctgtcctgtgtgcccagaacataataggtgctcaggaaatggctgccaagggagtagcccctcttgcaggcctgctctgcagacacgctcagttctgccgctggcccctggcgtgtgtacagcacctgctgctggcagcacaggtttggccctgctgattggctgggtgtctggcttcaataggggcaggtcagtgttcctgttc

SEQ ID NO: 108172 - DNA, 1030 bp, Homo sapiens
gcccctgcacagctgcactggggtgcaggggatcatcagttgagtgtgacggacgttcctgagcatgctcctctgtgccagggacggagattagtgccacccagccccacccccccccacccccgctgatgctctcagtctggacaggaggcaggagctaaaggcatggctacatagcaagtatcggagataaagtgggggtcaagtggcgggggctgtgggggccaaggtgggcaggcagcatgacctgctctagctggagtaaggctggaaggacgaggaggggcctggcagtcaggaagccagctctgcccaggcacagggctgggaggcaccatcgggcctctaggccatgagttggacttggcccaagcttagggtgctgagggcagtgctgaggagtgctcaggagccagccagatggccacaggcctgtgtgcccatccagcagcctgccctgaggggcgggagctgtgggagccacacataggagggacatggccagtgctgggctttcataaacctggctgaaggacagggtagccttggaactgtggggatctttctgtccaccttggatccattcctttaagacccagacccacctgggctctttgctcaggcccagggcccacaggtgaggtactgttcactgctccatggcggtgatggcttttctggctcagccctgaaaacagagctggatcccttggcttacctcccaaggattccttaccccctaaaaagcccagggatgtcattaaaaacaaagtcccagttgtatagaaaacagaagaatccagcattgctgtaattcatttaaagttttatgggatggcaaatacttggggtggctgggaggaggagcgtaaagctccctggtgaagctccctggtaggccccttgtcacttttatggttttccattgttgcagtgactgggaggttaatcacgagggtttgtttgtaaggtcgccacagatggtcaggggcctttgctgggccacatggtagaaagccagatcattccc

SEQ ID NO: 108173 - DNA, 1064 bp, Homo sapiens
cgctctgtcacccaggcgggagtgcaatggcgcaatatcgggtcactgcaacctccacctcctgggttcaagtgattctcccaccccagcatcccaagtagctgggattacaggcacccgccataatgcccggctaatttttatacttttgtagagttggggtttcaccatgttggccaggctggtcttgaacaggtgacctgaggttccctctcgcagccccagaggtggtgctggggagctgggatctcaacctgcaggggcagcgctggcagtctccagggcccatactgctctgtcctcatgcacagccctaggtttgacttgttgtgtgtgagatgtgattaaatgcattaggcgggggaaaatgtcttatctgtacccagcctaggtcgaagaagagggagaaataagagcagccaaattgaaccttattaaacaaaattggttaggtctgatggagccaaacctagactgatctttaaaagcttatttcatttttcccctccagcctgaacctctttgaattgaagtaactgatcctgctgtaagcttattagtgtcaaaccttgtgtgtttcttttcctctccgatttacattttattaagtaatgatgaagttgcaaggtcccaaccctagcccttggcacaaccaggagcttccaggctcattagtggaacaaaatggataatagaggtccaatcttattatagctggtacattattacaaaatctctgcacattagaaaggctgctaagcacaagtctgttacctgcttcactcaagcatctgttgattctgtaaaatgctggagggaccccccaacactgctgttcctttaaagtttgttgtgatggtgtgggctgtccatttcttacctgacagaaggagtgcccatgttagtgatatcgctgtgctgaattgtgtttcatcttggacttctgtggtggagtgtgtttttctggtgtgatgtagtaagagaatatgtgctttaatgacaggcagattgcatgctttgaataaatgtcttaacctctgggggcttcaatttccttgtctgta

SEQ ID NO: 108174 - DNA, 1038 bp, Homo sapiens
aattcctcatgtattcagtggtgatctaattaacatctttcttctctagaagacagcagactttatagaacccaactgtctaaaactatctgttttgctcgtcctgctggcattccagagcctgggcctggtcctgagagaaggttgctacccacgtgttgagagaatgtgcgtgcgccacctcagctgcgccccgtggacattagcgaatgtttgaggagtgagttattcagtagatggagagaggccctcaaagttggctagaagataaatgactaaaaggaaagcctgtttttctcattcttaggttggtaaaattatctacttttctttatctctggtgttctaaatgggtcttctgttccgaagcgtccctcagtgagcgtgggctcactgaccaccccgtgtggcaatgctgtctgcatgcgcctgtgagaacccatgggagtgccatgctgccctgtccccatctttatctgctgcacaatttcctgtctaggcccttaaaatcttgatttgcacagttatttatctttgtgctcttcatggtgccctggtaaggcattctttatgatttcagtcctgagaacacaagccctgttgaaaagagaacatgctttgaataaagcctgcttgacgttcggcttgatggggaggaggagggggaaggggcatcagggcagcatgaggcccctggccgccctctctcacaggaaggctcataaacacaaggatctcgctcaagccccggcacgtctggaatctcagctcggtgctttgccaggtatgattttgccacaaggggcatttcttttccagaatctgatgcagtcactctcttcagagcggctgggcgtttatctggacctgtcacaaccaggtttctcagcagctcctgtgctgggcactgaggacgcagcatagggagagcacagtccttgtctcgggatttagaagggaagagatgcacatttgataggccaaaattaagaaatctagcagtgccaaatgttggagcagacgtgtatcaatggggtg

SEQ ID NO: 108175 - DNA, 1022 bp, Homo sapiens
cctgctgtctccctccccacccttgctgtagccctcctgcctcggtgtattcccagactcaccaagctactgccctcttagggcttgcacttatcagttgccccatttagagctgtctttctgtgggtcttcacacagctgtctgcttcttatgctaaggtcttagctcaaattcacttcttcgagacctttaccccacccaggccttctctatcacatcacctggccttgttttctttatagcatatgttgtctaatatagtcatataatattaatgtagattaatattatataattatattaatatatatttgcatgcatgtaatttatatattaattttatattgatatgaattgaattaatatatataatttttcctatataggtaattttgttgttgctgttgtttcaagatattaagctctttggaaacagaggtcactgtatttcttcccctagaacagtgcctggcacacaataggcactctgggaatatgtgttgaatgaatgaagagagatcctgccctaggctacccacaagccagcaggcagcagatacacaatagacagtgaccatgcagcaggctgtgggattcagaggggctgggttaccactaaggagtcagggtcaagttctgccactgggagttgggacaggctttccagagcagtggtgtttgtcccgggctttagagggcaaatgggcacagcttggccagctgagcagctggggaggccattcttgggggaggaggcaggcaaacctggacagagggctggaaaatgctagcatgattgatggaagggaggaacttggagggactggagcctggattggagcaggggtgaagggaactaaggtagtcagggatttggctgctatgacccctgcctttcccccagaagaacagtgagacttggagagtggggccctggccctgctttgctggcggccctcggccttgtgctttcagtgtggtacctgctctggtccagaagagtgtgcctgggccccagacc

SEQ ID NO: 108176 - DNA, 1089 bp, Homo sapiens
tgcccctgtacctagacctgccctcaagtgggggactgaggagcaaccccttcctctcccttcctcagacccagagcttggacccttagctccgggggggccgctggggcctgctcagggctccatcagccttaggccagccccaagatgctgattgaagatgaaggtgataaagtgtgtgtcactcgtttgtctagcctgatttattagcagtgtttggagtataattattctatagtaaaatatctatgagagagtaatatcccaattggtgtggctcctgggtctaattgctcccactcaggcctgtcaacagcggtgcagcagtcacttcctttgagaactgggagggagggtctgtgaggagcaagtaaacatatggcctcaatgactcatgcctccgaagggctgagggaggggccaggagacatgcctggcctatgtccttccaccaacctggggccaccagcattttcctgctcagtccagggaggctggaagtggaagcacaagaactgtaggcagtccacagaagctgagtccaaatcccatatagacaaccctgagcagagacaggcttcctccaaccagggacagcctcacagggtgactgtggatgtgtgcagaggtgagatcctatgagcccagggctttggtcgaggaagaaggccttcctgaggctccacaagggaggaaagggcatgggtgcccaggctaggagcagctcccccaactcgcaaccccctgaggctctagctgaatgggcacctgccttaatgctaggggctggctgtaggctggggcttctgtgccacatgctctcctctgggccccagggcaggaatgagcctgcctcctgcctccctccactctgtcaccactctactgattaagcatatactatgcgcctttactagctacatactttattttgaaaccgtttaataaccctgaggaagaggtcattatttttcctatgtacatttttccccaattaaatcaatcaaattatgtgcaaatatttaggaaaagtaatatatgcacatggtaaaaaatttcaaacaagacaataattattcagtgtaagga

SEQ ID NO: 108177 - DNA, 1041 bp, Homo sapiens
tttggctatagttttccaacccctaatataaatggttaatagggctcttgaaatagaatgagcaccctgcgaggaaaatgctaataattatctgcagctgaaagcattaaaccctctcagcagtccttaggaattgggctttttcttgggtgcccactgtctctgtgctaacactgggatgcatatactactttatgtgctgtgttttttattcttggatacatttgattttttcacataagtccacgtgtacttctataagagtgtgacttgtaataaagggttaatgaagaaaaaaaaaaaagaagaagagggagcttggattggtagagacatccagaggtctcacctgagtgggagaagaaaagaagtgaaagtgttctaaatggctaatctttctggggagagggtttaggaaagactactagagcatatggtgataagggaaatagttggtatcctgtttcaaagtaaaaatatagaaatatgtgcaagattttgagtacagagaaagggaaagaaactatatgaatgcagtgaaaatgtaatagcactttcacattctcagaggagaaactggaatgaatttgattaaaccaacaaaaataaggaaaaaagaacaatgttaataaataataataataacagaaggaacaacattaagtatcagtcattacactaaatgtgaatggccaaattctatttaaatgctaacgctgagagattgggttaaatactgacaaaggtaaagaaggacatcatgtaacgataaaaggctcggttataaacttgtacataccaaacataaaaataaaacagtagaaacctagggacagcttgataaaagatggaattataatgatagggtggcacttcagagtccatattttaaaatcaggcctactagacataaggacaacgaggcagaatatattcaataagcttgatttttagataaatgtaaactcttacactccttgaatagagtatacattttttttcctatggcttggaacatttacaaaactaaatattcagcag

SEQ ID NO: 108178 - DNA, 1059 bp, Homo sapiens
tctggagccccagatctgtacattcatgcgtcaatcacctctgcgtgccaaccctcagctcaggctaggactcagtggcaagagagacagctttgggcctgcttcctggagcttccacagaaggggtagttggtcaggcccaggagcataagcttctgtgcagctgcgtgccgtggaggaagagggcaggtctgacacggaaggggcatcttcgtggggcctgcaggaaatgcagggcacttctaaggaagcagcacccaggagacctggcccggggttcagagtctacagggtagcaggaagggcattctgggagggatctgcacaaagatgttcctttccctgaggtggaaaaggaaagagcagaagggcctgtggctggggcagcagggagcagggggaagaacagtggagcacaagtacgctgggccacgtgaggacgccatccactacctcgggacgggaggagacactagagataggcccgaatgtggttctgtgaagccacttcccaggtggccccaggcaaggccctctcctctctgagtctcctgctctctagaatgggggctatgacgcccagctcctggggttgtcaggaagaagaaagcactgcccatcatgacctctctgtaagcccctctgggctgcttgtggagagaaacccaaggcctcaaatcagaaatgcttccttcagactcctgggccttgaggcaagtgtcatgggaaattggatgccaaccaagcccagggcagacacgctgtgccaggattcagcagagcagggagcgtgcagggagaggcaaccctatgccctcgtctcagagcaggctgtgtgcgcccagcggacacggcaccagcaggagctgtgtgggctcggctccatgcaggtgcgcctacgtctatgtgtgtccatgtatgtgtgtgcgtgctcacgcttttgtgtgtgtggtgtgtttttgacaggggggaggtgagtgagaggccagcttcctgacagggcagttgtaaaacattcataaaacttttattggacttgccacccttccagataaatat

SEQ ID NO: 108179 - DNA, 1049 bp, Homo sapiens
gctttgtgcctggccctgtcctgggcattggggacccatttggtcacataggcctgagagctgaggtggacacacggccagtgggtgacacgtgtgcagcaggagtgcagccagcatcagaaagcgtgtgggcattccagtggggcggtggcgggggcggggggtgcggaggtcagcccatgggcatacctgcctcccctgggccttgcagccacaggccacctctgggatctgcctccgagggacagtgtgtgggcacatggccatcagcacagacacagggtgccaggccccagcccctgtacccacgctcaccctgggcctcagcccctgcaggtcagggagggatagactgttggagtctgcagctttcaaatcaggagtgtgggtggggaccagagatgccacgccacccctgcccttcccctgtcagcaagaggacagccagcaccgccgcctgcccacggcctctcgctctgctctgggaacagggctgatacagtaatcagggtgctacatatgggctctggaaaatgactgctccccgggcctttgttcgccttcattattctagacggtttttttcccccaccaagtcataaaaatgacatttttaatatgtggattttttttttaaagaaaagcaatatgaagaagacttttattgtcaataagctctaccttttaaaccagttatcttagtttctgctctaggtattttaattgaagattaactgctgttaaagagtatacacatttagggagtgagtgtttggagtattaaaattcggctcccttggtggggatggagctccacgggaggccaccaggaaccatgctcccccaatggccagccttggggggctgtctgaggaggagggccgcctgcaggaggggcccatccttgcctctggccacagccttttctttcattggaaggggcaggctggggtgagtcctagccccacaggggagcagaggacagcctgagagcatatggctgtgtggtcagaagggcatcctggcccggcctctgcacccttggttga

SEQ ID NO: 108180 - DNA, 1090 bp, Homo sapiens
taacggggttgagccattaattagcctgctcagccggcaccaggcttggctgctgggagttggggcggaggcagcagtgggtgctgggagtggggctcgcaaggctctacaggggctccattccctttgctgagcactggtgatgctcggggaggtgatgggggcgctatgaacaatgtggccggacctcgggcagccagggaggcctagaaggctgtctgctgggtgtgggaggccttggagccccacaagggcacaggcagggggatggggcatggtgtccagttggggtttcaagagacccctctggcctcctgaaggagccaatggcagggcctggaggtcagggctcccccacccccaacacaaacagggggcagaggccatatgggttggagaggacctgggaccagtggttggtgattggatgtggcagccgaggggaggggacagtccgagctgaggcctgggaggaagaggacgtttgggaaggctcggggattgaaaacagagaggtgaaacttgagaggagaggtacgtttgggaagaggccccaagttgagtgctcgaatatttatgaggcctcctgggtacaggccctgccactgtgctggggcaccagtgggggagacggagaccctgcccgcatcccagccttgtgctccctggggcaagcccagtgcagggacctcagagggcactgggagggacagcatggaccctagatcactacctcccacctggcagtgtggcctgcggccccctctgcaaaggaggctgtcgggccggccccgaacccctggcccacccaggccagcaggttgtaggtcacatggccacacccctggagccctgaatgaggtgttgctcagtccccacgtgctccccccacgttatcactggcccccatgagggagacagtgcagcagagagaaacggccacatcccacagccacaggtgaggcctctaggtcaaggcctggctgggagcccaggctgacctggccctggggcacggtgccaggcctcaccccccaaggtcattccatagactcggccccgagcctccagcatcccacatagccaccac

SEQ ID NO: 108181 - DNA, 1074 bp, Homo sapiens
tgctgttccccagggccagactaacacacagtaggtgctccataagtgtttcttgaaaggatgtttggagggatggatggatggatggatggatgggcaggaaattatagacgggggcaaactgccaaaggctacagtttagttggcagcaaaaaaatcgtttctgagaacgcatcccactgaatttagaataaaagccaaactcttagaacctatgtagtggcccttactgacctctcagacctgatttccttcttcctcactgcagccacaatgactctcttcttgttccagagtgttcccaccccagggcctttgagtctactgtcccctccaccccgaatgcattctgactccactcaagtgtcactctccaagagccaagttgctcccctgtcccctgctcttctctgtctatgcattcttttatagtgcttaacacagtctgaaatagtctcgcccctgtgtgtgtgttgtctgactccccctctagaataccaggatccttggaggtgagggagttcctgttttgcttgtggctacagctcagccactggaatcatatctgacaattggttggcatcagtcgcaactctgggaatgagggaatgaggactagagggggctggacgggcccagccacctgccttcatcattgtcatttctctttatcactacggtaactcctccttcccctcatgactttggaagtcattcagcagccactccagccccaccaacctgcccctatcccagaggggcctgggatggagggagagaaccactgaggcccctccacatccctgcacccgctgtgcccatgggggcggagaacacatctgacccggctctgagggagccgtggcctctctagggagggctggcctgctggtgagacttcactcataatacaagataattataccagagttgtcatgaggcggtggtgattaattgctgtgcgtggggcacggacggacagcgaggtatagagagtggagagaaggccgcagcccagctgggcttccaggtgggagctcagcctccccatctctgccgtggaagggactcaga

SEQ ID NO: 108182 - DNA, 1030 bp, Homo sapiens
ggtcttgaactcctgacctcaggtgatccacccacctcggcctcccaaagtgctgggattacaggcatgagccactgcatccggcctcattatgatttctaaaagtcagcaactccgagggtagacaggagtgttcaggaaagggcgctgccctgggagggacagggactggaagaccagagggagggctgcatgcgtattgttacaaataaatgcaatctgaatggctaaaaacaaacaaacaaactatacaaacacacaccaaagaaaaatccactttgtagtgggcactgttttgggcaccagcaatatgatagtgataaatgctatgaaggaaataaaatgggtgatatgataaatggatgtagtctggagggtcaggagggcatcccttagaggagactcctgagctgagacccaggacagctgagagctgggcagggtggtgtagcagggtgtgggctgggtggccataaatccttcagcctcttttctcttggcctcttcctcaccccatccaggcctctggtggctgcaggacctcctgcctgcaagtcaggtctcatgcatacctgccctctagagcgctccagcttctcagcttccagcttcctctcccctaggcttgggtcctggtgcctgcaatggccccagcactcatgccccctagactttgcgtcaaggagctgtcatactcatgccaagctcctgatgggtgtctgacccactcaagcctccgggctttctgtttctcttctctgagcctcacattgctcacctggagaatgaggaccataacgatatcaggactggaaggagctcagaggtatgctgcctgggaaagcccctggcgcagcaccggctcaaggagcaggagtctcttcctttgacagataccagggtgacaagtataatgctttgatttgaactaagagtagctgtttacaaagtgctttctttataaatgtccatttattcattggttcagactgcagatcgaggtctcagcagtctgaaccacctattgggt

SEQ ID NO: 108183 - DNA, 1615 bp, Homo sapiens
aaacatttgttgaatgttgaatgaatgtgactataccagtcctcaatgtgacgtacagtaggtgacaatgcctgtcacccccccttcccttgccattgatcttttgcctaattgaatccctggaactgatttgacaagctgcaaggagagaagtgatgttcatagaggagctgctatgtgccaggggcatgataggtgctgccaagtagtttcatactcagtcctcagagtcctagaatggagatgaggcccagggatggtgcagggcttgttcacaagggcgtaagaacggggcttgtgggtggtgaagttggcatttgaagccaggcctatcttcctccatagccagccctgctgccctgggacactgtgctgttggctgcatttgtggctgatacctgtggagctctggggtctgtaggcctgggagatggtggggcctgctgagtggggtgggaggacagctcacaagtcctgccctgctcttgcctcggccaggtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaaagaaaactttaaaaaaactcccattaaaaacaaaacatctttgtgttttgaacaaaggaattttcaatatttgattggtattctgttctgaagtctaagatatttttcagcctataaagccccctgttttatgcccttctaattctgatgtttgggtattgtgtgagtgcatgtgtttttttttttttttttaaagcgtgtgtgaacaaatggaaataaagcagggactgtgaacatttgtttttggtctgttgaagatctctcataatttaattcttaattttgggaatagtgcttttatcaagtgctttttattcattaaataatggatttgcttctcagcaggtttgcaaggcaagcatttacattttacatattagaacactgagttattctagtaccagagtgttgaaagtggtgccagagtgttgaaagagttgacgtggcttatgtcacagaatggagtagtggagtgaggcctccatttttgtagtttttgcatccttcctgtgagtcatgttttactcagcatcaaggaaacagtgatgagcaaagcagagatggttcctctcaagaggcaagggattgaaaggtcatgtggggaatcgacagtgccagtgagtgccaggctttctgcccctctttcctctctgcaggagttcgctccctgtctccacctaatgaattcctgctcagcctcaggatgtgttacttaaggttactgtgtcagg

SEQ ID NO: 108184 - DNA, 1117 bp, Homo sapiens
ctttttttttttttttttgagatggagtttcgctctgtcgcccaggctggagtgcagtggtgcgatctcggctcactgcaacctccgcctcctgggttcaggtgattctcctgcctcagcctcctgagtagctgagattacaggtgcctgccaccatgcccggctaatttttttttctatttttagtagagatgggatgtcaccatattggtcaggctggtcttgaactcctgacctcgtgatctgcccaccttggcctcccaaagtgctgggattacaggcgtgagccaccaggcccggctggtctgctcatctttatggccctagttttgcccattgctgaacctggtccagattaggtatcagtaggggtttgactttgactttccaagaaggtggcatttcatttttggatggctgctggtggcagatgttctttgggagataaggtcagagtggacccaagcctggatgttgtcacacatggtgcctctccttccttcaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtaagtgtcgggcgtcacagagttgcttggcttggggccctccatgcctcactgctttgtctagggcagacactgggcagctctcttgcttacctgcatgcttgtgggataagactgcatctggccataacttttcatgtggtgccagtccttgtggaggaaaaagggatttttggggtcctggtgtgagctgggtgtggaggaagctctgctagcctcgtcagcactgcgtgcccttgtggccagtattgagagtagctgcatcctctcctggaggccagactgttctaggtcccaggctgcttatgttgtggtaaaatgaacctagactttagaatcaataggtttgaatccaggctctgattc

SEQ ID NO: 108185 - DNA, 6019 bp, Homo sapiens
caagctctgcctcccgggttcatgctattctcctgcctcagcctcccgagtagctgggactacaggcgcccgccaccatgcccagctaattttttgtgtttttagtagagacggggtttcaccatgttagccaggatggtctcgatcttctgaccttgtgatccgcccgcctcggcctcccaaagtgctgggattacaggcgtgagccaccgtgcccggcctaaaccatattttttaagtgaaaatttgaatagaaaaaggaaaagcatattcatagtactgcgccacccaaacacagctgtcattttgatctatttctttgttcttttgtagtgtttttaaaaaacattttatcatattgcatatacagtttttaaatcttttttgtcccataaatgaaatcttataaacttttttttttacttatgtatgatagaaggggtcagtatgtgaacaaaggtattataccttcctcccatgatcaaaatacactgacagatttggaagatacaataaagtatatcaggtagaaaaaccctttctgtaaccctaccacctagtaatttgatgaaatttcttccgtcttctatctttacttttcttctctgcaaaataacttgcaagattatttttacctttgtattaagtcttcaatgttcacaaaggtatttgcatttcccttaattatttactgtttagaagaatttgggtagttagcacccttgattgagaagtcgacgcaaacctttgtggggaaagttagacttttttaggttgtttatgtttggggactattttaattaagtagtaccatgtgaggatcttggtgcaggaagtcttctgtgtttaggatcatttcctctcagctggttcctggagttttagaagggcatatccactctcttgcagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtcagtcttcaatagtaagggagaaactaaccttttctttaatttcgtgaatttttttctttcaattatcagtctttatagatggggtgtgttcatttgtcattctgaggaaggctggttttatcaggaacaactttttataagtgggtacgagttagtattgtaaaagtaatacatgcatttgatagtcaatccgaacagtatgtaaaagtcttcttcttacttgcagttctgtcatcagatggaaccgctgaaattcctttaaatagtttttgagttatttaaaaaatgaaaattcagagaataataaaaaacacttttatatgaacacccagaactaatgattgaaaacattttgtcatattttctttcaagtctttcttttttttgagacggaatctcactcttgccacccaggctggagtggaatggtgcgattttggctcactgcaacctccacctcctggttcaagcgattctcctgcctcagcctcctgagtagctgggattataggtgcccgccaccacgctcagctaattttttgtatttctagtagagatggggtttcaccatgttggccaggttggtcttgaactcctgacctcaggtgatccacaggcctcggcctcccaaagtgctaggattataggtgacagccaccatgcccggccaagtcttttttttaaacctttttactgaaaaataagatacagaaaaccatacaaaaaatgtatagctcagtgaattattatgaggaagaccttgtgccgctccccaccccctcctgtcaagaaatcaaaatttgctagctactcaaaaagtgttccatgtacctcttccttctcaaagtcattgccccgactttgagtaatcactttcttgaatatctttgtagttttatcacccaagtgtatatctctacatactataccttagttttgcccttttcaatctattcaatttgccttatctattaatctgcagttaatacctacatctgtttttcttggcttgatcttcactcactgcaacctctgcctcctaggttcaagcgattctcttgcctcagcctcccgagtagctgagactacaggcacccgccatcatgcctggttattttttgtatttttagtagagatggggtttaactacgttggtcaggcaggttttgaactcctgacctcaagtgatctgctcgccttggcctcctaaagtgctgggattataggtgtaagccactgtgccaggcctgttttttcatttaaaacttttctgggaggctgaggtgggaggattgcttgcactcaggagtttgagaccagccggggcaacatggtgaaaacgggtctctacaaaaaaatttttaaaaatgaaaaattatctggctcacacctgtagtctcagctactcgggaggctgaggcaggagtaacacttgagtccaggaagttgccctttagcctgggtgacagagcaagaccctgtctctaaaaaataattaaagttgcttttctttgcatttatgttaaagcattattatttgttgttattcactctaatccatcttaattagccttaattcctaaaatgcctcttttatttctaaatttttttcctgatttctatcatttttctgaatttttcttttttttttttctgtctcactttgttgcccaggctggagtgcagtggagcgatctcagttcactgtaacctcccaggctggagtgcattggcgcgatctcagctcattgcaacctccgcctcctgggttcaagagattctcctgcctcagcttctggagtagctgggactacaggcatgcaccactacgcccagctaattttttatttttagtagagatggggtttcactatgttggccaggctggtctcgaactcctgacctcaggtgatccacccacctcagccttccaaagtgctgggattacaggagtgagccaccgcgcccggcctgaatttttctaattattgtttacattgttcttgcatgacttacatgattttattaatacctttagcttgttttggaatagcaggagcagtctcctggttcgtttttatgggcgtcttgctggcatgttttcattttcttacaggggtgttcttgttttcatcccatttttcttatataacttaatcttttttttttttttttttgagatggagtcttgcactgtttcccaggctggagtacggtggcacaatctcagcttactgcaacctccacctcctgggttccagtgattttcttacctcagcttcccaagttgctgggattacaggcatgtgccaccacacctgactaatttttatagttttagtagagatggggtttcaccatgttggccaggctggtcttgaactcctgacctcaggtgatctgcctgcctctgcctcccaaagtactgggattacaggcatgagccactgtctgttgatcatttttaatgtgacctttccgaaggagggatggtttagagtggcttttgtaccttcccagatctctgctattttagtgcaaaaacatgtggcttgctttctgagctttcctctgtgcggtttttgagttccattgtccctatcatgttcatttttgattgtgttgagcagtttctcctcactgtagggcactgtcccagaaggggagttctgctctcagggactagactgctgcagactcgtagaccttctgcaggcccgtttcactcaccattaggcagggcacaactgctccgagtttcagccactcctcacactggcctgctgtgctctctagggaatcccggttgtgtgttttggggttctgctgttctcaagcccatcagttgccctgtttcttctctctgcgttctccttcacagacactgataacgtgaaggtcttgtggctgtcggtgttttgacccccatccctgtctctgtgttgtggggttcagtagagatactttgttgcctggttttgttgtaaacatggtccgtgggtttttggttttgctgtctacttgctctgtctttatgtgagcccctgtacttctttctctcctgcccatttgatccgttttccacatcattgcttatgcttgcttgatccttcaggtgaccagtatgcactgaagatgaggtttgtggaccatgtgtttgatgaacaagtgatagattctctgactgtgaagatcatcctgcctgaaggagccaagtgagtgtgactgttcctctcctttgcacccgatttctctggttgtacccttgtggtaccctaaggagagcctatgttctaggggcacagtctttgtgtcacttttctctagatttactttatcagggaacatctacttggcctctcttgagtcacatgtccactctgactgccagaatgagagaccccttgattttcttcctgtggagaatgttccatagtggaagagtagttcctcatgcaaatccaggctgtgctgtttaccaggagaagggacagtgggcctgggcagacaaaagcaggacatgtcccctgccccgtaagaagctcttattcatgtgaagagaaagaacattcagaacagctcgtgaggcatctgttcaagcctcccagggattcactgggtaggatgtacaggagagctgtgtcaactttgtgactccaaggagtggggccagtactggtgagaacttgggagtggaggattcagagggacagttgttgccccagcagacaagggctttaaaacaaagggctttctggcactggctcccctgtctcaagagagtgggtgttctccatagctgagaagggagcagagtggaggagtgtgaatttagtgatcttgaaaggctccttagccttggaattctctgatcctaaatctggtttattgatgtagttggttggaggctatattttattcccatcttcttccaggaacattgaaattgatagtccctatgaaatcagccgtgccccagatgagctgcactacacctatctggacacatttggccgccctgtgattgttgcctacaagaaaaatctggtagaacagcacattcaggacattgtggtgagtggctccactgtttgccttccatggcgtcttccccagacagtgggctctgggggccaagaactcaccttctgtccctccttgggctggagtcatttgagctcatggcgtcttctggtcttggggtggggcagcaggtcgagtgggccagcctgggtgagtctaggctcccatgtccctacagccccgatgaagcctgtcctcttgcttctcccaggtccactacacgttcaacaaggtgctcatgctgcaggagcccctgctggtggtggcggccttctacatcctgttcttcaccgttatcatctatgttcggctggacttctccatcaccaaggtaccgtctctgccttcttcctgcttgtcatttgtgtccttggtaatatttcaccagcttgagcactgatcctcacagtgagcccagggcaggacgccatggccaaaagacccctgcctgtgctcatccttgccggaagggtactttgtttttgttgcttgtggtcactagcacaggaggttaagtccctgcttctgtcttgctttggctctggagacagagtaacttggatgctcagttgaggtaggaaaaacatgaaaagattggtgcttatttagctgttttgcttcttgttattcagtggaacttggaggtggaagtcccctcttagtcccctctccctccccacctcccccttggtgattccttgttgggagcagaaaccactgacctggccctgtcagcaccgttctccccactcccactctctgctccctgacaggctccgtggctccttggtcctccccaggctgcactgctgttatcctcaggtcatcctc

SEQ ID NO: 108186 - DNA, 1292 bp, Homo sapiens
ggaggctgaggcaatagaatctcttgaacctgggaggtggaagttgcagtgagctgagatcatgccactgcactccagcctgggcgacagagcaacactctgtctcaaaaaaagaaaaaaataatttaagtcttctaagacagatatgtagctgtttctctcagggctgtttataaatagcaagagtgtaaaacagtgtaaatgttcaacaatggaacaaaagttaaaaacattctaataggtaatcccagctattcgggaggttgaggcaggagaatcgcttgaacccaagaggtggaggttgtggtgagccgagatcgcaccattgcactccagcctgagtgatagagtgagactccatctcaaaaaggaaaaggtgatctcttaaagataattgcttttgtctttggttcaaaattttgttgtgactttgaactgctactactgttttcagtatcctcagtctctcttacttctcttgccttgttcttcctttagtgggagattcttcacagtcaagctcccagttgctcttgatcctggggccaagatttcagtcattgtggaaacagtctacacccatgtgcttcatccgtatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggtaagctcaggtggagtccagcccatccctgtctgcttcagagaatgtcttgcagagtgactactggttgataggcttgggtggtgtggggtggatgaaatctgcagtcatttctaaggtcatcccaaaagtgtttaacctgcagtgaaatgactccatgggggtcttgtttctccttgggggatcacaggtagaggctaggggtagcatttggagaggtggaatgggtgttggagatggaagcaaggcattccacgcagaggcagtaagagggacaaaggctttgagatggtgtggctgggcagatactggggtagcaaagctgttggagtggttgagggccttccttgaatgttgggccttggttggaacttgaagagagagggagcaattaaggcttacaaagattttgttactatggcaaatcgcaaacatgccaaagtacaaagactagtataaactcccacacacgtcacttagattcagc

SEQ ID NO: 108187 - DNA, 1891 bp, Homo sapiens
cgggcgtggtggcgggcgcctgtagtcccagccacccgggaggctgaggcaggagaatggtgtgaacccgggaggcggagcttgcagtgagctgagatcgtgccactgcactccagcctgggcgacagagcgagactccgtctcaaaaaaaaaaaaaaaaaaaaaaaaaaaaaaaaaaaaaagtaagtacactcgcactacgaacagaaggatatcccgagcagctctgagagggctttagcaatcaggcgccgggtcggcttcccggttgccccggagacagggtccttccttgttcggcgccgccatcttgtgtcaccagcccttgcccaatgaacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtgagtgtgggcgacccctcgccgccgctcccgggacccttcccgcctcccttcctggcggtcccccgactccgcccgcgcccctctaggcctcaggaaatgcggagacccgggcggcgggcggggcacagggggtccgtgggattgcctcggggcccgcgaggagtcctgggtggccaggggccccggcgcctccgctgcccccggtgcgcgcccgccctcctgcctgggccacgtcagcaccggcctgcccccgcgcgggtcgctgctcacgtgggcagctgctgggatccgcggccgaccagcctcggagcttgcccctgtttgggccgttctcggcaccgctcgggagacctcgggccggtagaacgcacctcccttccgtaaggcgagcgcggcagcccctcggcccggtgccagcgggcgccagacttcatttctcacggcccgacgaggtggctcaagtagaggacaaataaatgaattaaagtgaatttcattctcttaattcagtatctggtccgttgtaggtgcttctttctagacatagagaaccatcagaaatgtaacaggtttcgcatttttaagttggtaatcacttgaaatccctatgaatgtgatgcattttaaggttcctagtgaacgctttctaaatgttaaaactctttttaaagttagttttaaaactcctgcacgtaatataagttctcttatgctgtacagaaaaggaaagtccaattttctcccttccccctgctgcttctcattcttacacctcggcaataaatggctgtgtttggcttaaatgtttccaggtatttcagtgatcaccaaagaaaatgttgggtttgggagtaaagggaatgtacatacacagaggtttggtttttattactattgttgttaaacaatttcattaaatgattacctaattatttgttgagagaatagtcattatagtgtcacatttcttctaagcacacttcgttctctgactgaatatggagctataaagatgggtttatagagattacgtttctgaaatgactcctattttctttcatgcgttgtccatgatgaaataaagttttactcaaaggcttgtggaaagatagatcaaaacttcatgtaaatttgccttgccatctttgaatgtcttgaatgttaaatcccgttctttatagaagccagttgtgatttaatgagcttgttacagtat

SEQ ID NO: 108188 - DNA, 1049 bp, Homo sapiens
cttttaacagatcattatgtttagttctttgaacaaccctctgaagtaccactgttgtgcccacttaacacagtgggaagttgaacagagaggctaagccatttggccaaggtcacacagctaataagttacgaagcagagatgcaagcccaggcagtcagactccagagcactgtattaaatttctaggttgtactgctttcacgtacccctgaagcttgctggtttatcttttgctacctggtatctgtacctcagtgcctcccaccacctcctttctttctattgatgtcatttgaaagtctttctggtagcatcagttctcccttaaagccataagaaatgccgtttgcgacttatcacacatattgtggtgtagtgtcaccgaattaggagctcttgaataccggcagggtacttaactgaggtttgaaaaattttgcaggtaggcctggcaaacctgcctagtgaacctttcttacaaccttagttgatggctgtccagccggctggttcttccctattcaaaatactgcatctttggtttcctaaagaacggactcttgtctctttcttgtgacttaagcagctgatgaagcacatgatttctcatccatggatgaataaagtctcctcttagtgtgtttctctcttcaaacttgggaaggtttgttcagatttgagtttaaggactggaaggtgagttaggagtacttcttctgaagaagggaccggctaagttaaagcttagcgttcacaatcctgttgtattcatatttgtcttttttttttttaactttgctacctagcctaaaatatttaagtgagtaataagtactgtggctttatataatgtttgagtttagagtaatgataggcacctttttattcattcattaagtattttgagtatccattgagtatcagcaatgtatcaggcattgtgggacattgactcagggagataggcgtggttcctgtcctcaaggaatttttaaaaggtgaatgatcttggccagaaattctgttgtggaataatttggcggtag

SEQ ID NO: 108189 - DNA, 1480 bp, Homo sapiens
caactgtgtctaagctcaccaaccctgtaatcagagaacaactctttatagtaaagtgtggctttgaatcagttttctgaccccactgccaagtgaagccaaaaaattttggttatttgattagcttttaatatgtcttcagctgggcacggtggctcacgcctgtaatcccagcactttgggaggccgaggcaggtggatcatgaggtcaggagatcgagaccatcctggctaacacagtgaaaccccatctctactaaaaatacaaaaaattagccgggcgtggtggcgggcgcctgtagtcccagctactcgtgaggctgaggcaggagaatggcgtgaacccaggaggcagggcttgcagtgagcagagatcatgccgctgcactccagcctgggcgacagagcgagacttcttctcaaaaaaaaaaaaaaaaaaagtcttcaaagggatcttcactaataacgtttttgctcttactttggcattagactttgtaaacaaagatgtagcaaacacagaccacgcaaatatgacagttgtcttatgcacattcctctctggcatttgacacaaatattttagtttttcctatgataaagtatttatctccccattcatttaattcaacaaatacagctgagatagatttgaccagatgttggacttggagctgtaggcaggcttttcctggggaggtaaggattagaagtcctcctgaataaggctaaacagaggttccccttggcattaaatgtcttcttctgaaggcgactgaaactcgagaaatgaactccccgcctccccccttattttttggctattggcttgctgttgatgattcttacctctcatgtaaggaaggctaccattgtattctcaggcatccattcctttgtgttaccacatgcttatctgttaatattatctaatagttctctatgcttctctgtctgcagtttgctgcagaaacatttttgcaatatgctgatcttttcagttatttgctcttaaatcttctattctgtttttccccacactccatatggcattaaagacagaaaaatagtttgtgttttaaaactttttttttttttttagacggaatcttgctttgtagcccaggctggagtgcagtggtgccatctcagctcactgcaagctccaccttccagattcatgccattctcctgcctcagcctcccgagtagctgggactacaggcacccaccaccacgcccggctaatttttgtatttttagtagagacggggtttcaccgtgttagccagattggtcttgatctcctgacctcgtgatccacccgcctcggcctcccaaagtgctggaattacaggcgtgagccaccatgcccagcctaaaacttatttttaaaacatttcttaatggtggtggtcactgcgatttgtgaatcagaggtaaaagtgatgtggcgagtgaaatcaaaacaagtttttta

SEQ ID NO: 108190 - DNA, 2478 bp, Homo sapiens
tgtgtctactgaaaatacaaaaaattagccaggcgtggtggtgggcacttgtaattccagctacttgggaggctgagacatgacaatcgctcgaacctgggaggtggatgttgcatgagaatcgcttgaacctgggaggtggagctgagatttcaccactgcactctagcctgggcgacagaatgagaccctacctcaaaaaaaaaaaaaaaaaaaaaaaggaaagaaaagaaagaaaggaaaacaccgcttcagtccagtgaatgagcagttagtcttccatagttgcccatagcttacttttatagtctggactccattcctggtggtggaattggcctgtgaaagagtaatctgtggggtgtagatctaaccatagtagatggtgctttcattccaactctcttttttggtcagacacttgagcccttagaatatcacattctatcgtacatatgctagaaataggtctgttttgcatattctgactgacccttcagatattagtgggcctttcaccaccagccttttggctgcgtgatcttcagctttgtgtatccattatagaccttagtttgattgaaataatattacatgactttgcctgtcttccaactctaagccacttgaggacaaggatgaatcattattctagaatggatcttgaaatattactaagcttttgtttaaattttttccagttctagcttttcagagtaagttaccgtttatagcatgtaagttatgcttctgggtcagtggttaatatatgtgggtttcctgaatgatgaactatgtgttctgtgttcatttaacaggtttttcttctctactataagaaaacactgttggcccctgtggagaattattcaggaataattgtaaatacagggcagatgagagttacttagtttagagttgttcaatgcctggggtggtgaggggcatgttgagtggatttttaaataaattggtaggcaggtgagagttgggaaaccattatagttggaaagaatggcataagtcaatgaatggatgtagggattgcagtagctctaatttgggaatgactgtatgtatggaaaccagatcctggtagggagggcaggcactgcaatcccttgttagaggatttaagttcaaccaagtggcacttcactctgtaatgctggaatagacacagcataatcctgtcacttgaacctcacaattaagtcagatagtaccccagttatgggtgaggaatggctttgatgttgtaatttgtctaaagaaaccatacattaagagcttagtgggctaggattgaaatactacaagagttgtgcttaaactttcagagagttgcttcttcagaagtggctttaatgaaaagttaaacatgggagctggttaggggaggtgggatagaggaagagagcagttagtttggttttcctctttagccagcccattgtgggctcctcttagcaatttatgggcagtctgttttactggttaaatgcctgagataatctagggttgatatcaaactatcgaagatagttcttatgtaactgttttactagctatctgctttccagtttgccttaccaaaaagaaaaaaaggcaggaatcatcctggtctctcgttagagactaaacttttggcttagtacctgggttcagaaagcttgatgacagtggtgcatcgtattgaagaatctattgatccaggagtgaagtcctcttcacaagaattgccttccaagacactcttctttgtgtaagttgcctttgccttttccctcccagcaggaatgcagtactcagagcaaagtacataaacaatgtctttacatttcatagaggttgttaccttgtttaaacttcacaatttaagcagcatttgatttgtctctttttttttttttagatgaggaaatggactaaaaggtcatgctcagtatcttggagccactgtgtgttagtgggactgggactagcatccagtattccaagttgacagataattctttaataatggcagaagaataatagcatcttctgcggaagaacagcctttgtacattttatcattcagttttatttaaatgtttttaaaagagggatttcagactagtctgtttcttttgaaacatagattttcaggtggtgaatcttcaagcactatcagacagaataagctaggttatgctgtagtaaccaataacctcaaagtggtcaaaaagagcatgggttttctagaggctctgcatcattcttactccaaccaaaggagcagccgtgataggagtattgatggctgtcttggcaaagggaaaaagaactgttggaggcagttaaattccagcacgtacagtttaaatccagcacatacagataaatttaaatactgttaaataaagttatttaacagtatttaaatttaaaaaaatttaaatacagttgaatacagttaaattccagcacaggaat

SEQ ID NO: 108191 - DNA, 1029 bp, Homo sapiens
ggcgacagagcgagactccatctcaaaaacaaaacccatggttgtgatcctaaaaccggaaggttggctttccattgtcttgttttggcaatttctagccatctttctttccccagtgttcagtataattagcagtcttcctgagaatttgggagcatttccttctggttacctacaatagggactgtgatctcaagttccttaagcatctttgaatgggacaaaatagaacctggcctgctaccttgcacatgactagctatggagccttagacaagttgtgtaaatctcgaattctcaggaagaaaatgccatttgagctctagctgaatggagaaacactgcacatgccagaaccgttctccctcatggtccatccaggctgatgcccgcatgggtggagatgcttgctgtcttcctccctgtgcccttttcccagcctcacaagcagcgtgtgaggtcacctttgatggtgccacataagctccatgggctggctctaagggacagcactgtgttcatggcacaaaggcctgctgtgaccagtagtaacagcaaaagtgactgtaccttctgatacttagccaccccttcttgtgacacacatcagcatgcctctgttgtccatagtaggctctagtaggatgcagggctgtcagcagaatttattgaaacctggaaatggcggggtggggggtgggggaagtgcccaggcattctttatgtcttgtataatctctctagattttgtttactctcttcaactatttattaccaaaggatcacaggtcaccaagcatgaggaagtactgtctatacgttttaagtaagagtccaggtaacacttattgttgttgctgcttcagagaattctccttggccagaattgtcagcccaccttttcttgcttagtggtatatatgaggtgtcataatgggcaagaggttcaaagtcttcatttgagtaagagagtgtcttgtgctaagcatctgcagccctcaggggaacctaaaagaaggcactctcaca

SEQ ID NO: 108192 - DNA, 1039 bp, Homo sapiens
ccaatccaatccatcactagatgccatccacctttactttctccccattctcttctgctttcacactggtctagtgcagtcctctcttgcctgaaggtggcgcagcatcctcactgtccaccgcagggtctcctaccctccccactgcaggcaggcagggcgctggctctgcaggatgaacactgctgcttagaaatctccacaagtcaggcttctcattactctgtggttttgggaccttagtacggcccactgtgtcctgcgtgatcaggcccaggcacctcattttcatatccccctccaagtaaggccttgcatgtgcgttctttaaggaaaactgtttgttcccttttcccccttcatatccaggttcagttcttcccagaggaatccttccctaattctcccaaccaaggtaattacccttaaagtaaacttaacacgtcttgatcacagtagtattttactttttgcatttggtatgatttctccttatagtctcgtatctacttttgcccttggtatatgtttgattaatatagtaagattaataacacaatgattagtagtcctggggcttaagagttctattcatggcatgattttttttttttttttttggagacagtctcgctctgtcgcccaggctggagtgcagtgatgcaatcccagctcactgaaacttctaccccccaggttctagtgagtctcctgcctcagcctccctggtagctgggattaccaaatattggagtagagcttcttaactctgtagaagagagaacagaattacatttttgcatctgggcacagtggtgcatacctatagtcccagccactcaggaggctgaggcaggaggtcacttgagccacaggagttctgggttttagggcattataccaattgggtgtctgcattaacttcggcatcagtagagtgacccctcagaagcaggtgaccaccaggttgcccagggagggtgaaccggcccaggttgcgaatagagcagatgaaacatctctcctatgctgatcagta

SEQ ID NO: 108193 - DNA, 1023 bp, Homo sapiens
agactagattaatatagtacataaaaatgtcaattagtggtaagtgctctgaaggaaaagcaagcagagtaacgggatagagagcaaatgaggggttatgctgctttaaataaagcggtcacttctttgagaaagtgatactgaagcagcgacctgaatgaagcaaggaccaagctgttgagtaagttggagcattagttcaaattgccaatccattcaattgatccaccacccaagtgagagaatacattctctccaacagcttgcaggggcaggatggccctgctgtgctgttctgcctcgctcttgggtccagagttttggtgagtgatactgttttttatcagtgccccctggtggaaggaagatacctagcaggaaggttcagggccctgcactgttggggctgctcagacatttgtgcaagggaggtgttttgttttggtgtttccatcacactcacagtgatttctccttttccccctttagtttgaaggatgacctctaggaagaaagtgttgctgaaggttatcatcctgggagattctgggtaagttactcatgaatttgagctaacagattggcttagagctaagcctctctgctgtggagcccacactgtccgtgctgccacttcttgctttcatagtgaggcttagggccttacatgtttccctccacggcagaaatttagatgatcccttgttatataaccttttgttctctagtttttagcatgattttttatggggaacggatggctatttgaactcaactaaggataggcattttcatggaatcccttttctccaagctggccaggctggggagtcttccttacgtagatgtattgccattggcatctggcgtagcagatgtgctttttttttttttttttggagacagagtctcgctctgtcgcccaggctggagtgcagtggcgcgatctcggctcactgcaagctccgcctcccggattcacgccattctcctgcctcagcctcccgaggagctgggactaca

SEQ ID NO: 108194 - DNA, 1088 bp, Homo sapiens
ttaaagcagcaaattgtctgagtggtgtgtgtctgctgaaagccaaggtcttcctcctggtgttacttcatcaagctaaatagcagccactaaatggagaaacatctaagatagcagggatactgttggaatagcagaacagtcttaatagtgaagcttcttttagaaagcagtatatttgctggcatccttctagaatggaaaaaataatactaggctctaccatttgacctggctgtgccaaaacatgtaagcagcttttccacatctgccccacatctgtaccctatatttttacccagagagaaaacacaaaacttcaaaagtgtaatgctcggaaggctactggcattgccctttgctgtgagggcagtttcttgtccttcaggtcaggcagattcttttaaatgcttcaagtaattcgtgtcagtttcaggaccctcctatttgacttatacttatggtttttctccaatttcagagtcgggaagacatcactcatgaaccagtatgtgaataagaaattcagcaatcagtacaaagccacaataggagctgactttctgaccaaggaggtgatggtggatgacaggctagtcacaatgcaggtaagcacatgtcttggctgtgctgaccaggccttgatagttcatttagtcttaatctttcctcatgcatagacattttccttccctgttcttcaaatcttattatcttatttgtagataattggctgatactcagttaaatttgaatttcagatcaatagtgaatacttttttagtatacttctagtgtatctcagatacgacttgctaagacacactaaaaaattcttcttaaaaaaaaactcagatttatcctttcttgttttttgttgtttttggttttgttgtttgctaaatttggcaacctgcaggtctctgtcttgtgcctctcttgacatccttgcccagtgctttaggtaaacatctttgtctcacctcagtagtgagacataaactttatttttctgacttcctatttcatacgtaacttcaagagttgtgtgtctattgagccaatcttttttttatgtatcagcttat

SEQ ID NO: 108195 - DNA, 7980 bp, Homo sapiens
aatgttttgtctctcacagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtaagtaccaacgatgatagatattgtcacagacacctgctccccaggggccttgtgaatttggagggttctctgctaagctcacatggctctaggaggtgctggtgggagtcttcattaccatatgccagcccttcaggccaactgcctttaaggaccgggacccaggtgacctgggttaagtccccatcctgcccccagctggctgtgactttgggccattgtcttggctgtctcagcttcacttccctttctgcactttgaaggagggaattcggttttgtcattctcagtagtgccctcccagtacctccaggccatgcctggatctccatgtgtgcagaatattgctttgggctttgagtaaaattgctgtactgtagtttcaaataccatttctgttggaaacatagactctttgattaattacaactaggtttatttctgaccacagatcttttcttaagtgacttagtccttatctcttggctgaaaatgggctaggggttggggaaggaatgagaatgtgtgagtggcataggtgacatcacactagcagtaatggtgaagggactataaaccttaagaccaagctgctgggcatttcctgtcctgggatctctgaggtcccagtaaacactcttcatttcttcccggactggcttcttactccattcacaaatggcttttaagtataactgagggtcagaaggtatgagctgtagaccgagacaggctttgagctctctagctgaatcctagctatcctgagcatagctagcaggacaagtttggacgggtctgcaggtctcctccaacaccctctttccccatgtctgtgtcctcacctgtactacctgtagacgaggggccatgacacttcctggggaggatggagtcagtgctggctgcttctgtcatgagcctatgtgcaccctgcttcttctttcaggtggccacaaagcgggcacaggcctggtgctacagcaaaaacaacattccctactttgagaccagtgccaaggaggccatcaacgtggagcaggcgttccagacgattgcacggaatgcacttaagcaggtgggtctcccacagctgaccagcccactctggtgatgcctgaccactgacccagtccctgcctggcctcctgcccttaatcttcttccctaacccactcttttctgtatagccagaataccctatgtgttcatctgggaaggttatgacatgttctgcttaagcttccagaaatcccactttggggggaataatataaaagatgcagaggctgtgaagtctgaggctgcccttcttttactaggcttgttcttattttctttgctgtgattaggagatcaggtcactgggagaccccgaacagattgctgcttctatttaaggaggaaataaacttgaatatgaatcccagctctgctgcgtaccaatcgttatatctagtttgggcttaaaaaaaaattatggccgggcactgtggctcatgcctgtaatcctagcactttgggaggccaaggcgggctgatcacttgaggtcaggagttcgagaccagcctggccaacatggtgaaaccccctctccactaaaaaatacaaaaaaattagccagacctggtggtggtcgccagtaatcccagctactcgggaggctgaggcaggagaattgcttgaacccaggcggcagaggttgcagtgagccaagatcgtgccactgtactccatcctgggtgacagagtgggactctgtctaaaaaaaattaaaaattaaaataaaaaaaattatatctgaacttctaccccctcacctgaaaaatgggaatacctgcttttgcagggtgattatgaagattaaatgagacagactcttccagctctcacatactgactggtaacttttttccttaggaacagttaagtaaacaacacaaagaaggaagaagatgtaggaaaactattcaaggaatataatacctagaatttcttatttactgtttctgtgattagatacaaccactcatgcgagttgaaagtctgttttgatgtacagctctgttaggggcagtggtgattaaggcaggtcacgaggcctcatcagacagtgtctgggggtggtcagaggtgtggcaggtttgggaggatgcatagaacacttgaagcacatggtggctgtgaagggcaaggcagattctgctgactccaggaagccggctgaatgaaggtaatggctttcagcaggacaaagagttgtttgtaatggttgctccaaggaccagggaaattctggcatgggtggggtctgcactaagtgttccagaatgaaagggacagatctactcaatgaggaaattgttccacccagaatgccaggagagccctcaagtggtaaggagcagaccaagatgcagacttggccacgcttacccccaaataataatgtttgtgtttttcttaatgttcatataagggaatggaaatccaaatatgtgtaggaaagtgtttcccacctgttccctgttgcctggcatcactgtctgagtttttctcttccatcactactgtccctgttgtctttatgcttttatttttagagctagcccttaagaagttagattgttaaatcggagggtgtatcttattgtaagtcagggtgccaggttgctttccccaaggggaataacatttcagcaatgtgggcttgctttcttctacctccttgccagcaagcaataggtgtcacctgtcactgctgacattgccgatctttgggtgtgtaaattgccaccatcgtgactactggtccctctgagttcccctccctggggcttagccatttggattttctctgctgcacacagccggcacacagcacatggttgggcctctctcagttctcatgagctgttggtgaattgaagttaactctacttgcatcttaagtgacttttccaactctgtggtctttttaagtcctttgaacatagggaaaaagtaattttttatttggttatgtcattttaagtttctatgtttcctgtgtctacctcagatttttctgtaattcagctggaatttgttttggcttatggcagaaaagagagacttgcctttcctctcaagagagctcagccagttgtttgaaatcattcagctatgttacacaagccgtttccctccctgaatagaccgtggcctgtgctaaatgctcgtatgtgctgggatctgtttctggtctctccagtctgttctggtgatgtccatgccatgttcccttatctggactgtgttgatttgactgcctgatgaggcaagtttcctcttgccacagtcttttttttttttttttttttttttttttttgagacggagtcttgctctgttccccaggctggaatgcaatggcgtgatctcggctcactgcaacctccgcctcccaggttcaagcggttctcctgcctcagcctcctgagtagctgggattacaggcatccgccaccatgcccagctaattttggtaattttttagtaaagatagggtttcaccatgttggccaggctggtctggaactcacattgtgaaccgcccgcctcagcctcccaaagtgctggggttacaggcatgagccaccgcacccggcctgccacatttcttttttaataattttgtttccaccattttcctctcttaccttccacaccccaaataaaactctgttgagattttgattggaatttttttcttcaagcccactgttttttcctcattgattgcagttttgttgtggctgttgcattagtctgctcaggctgcgttaacaaaaccccacagcctgggagggtccaacaacagacattttgttttctcacagttctggaggctggaagtccatgagcaaggtgctggcacatgtttctggtgagggtgcttttctgggctatcttctcactgtgtccctcccatgccctttctgctgtgtgcacagagagaggacacatgagcaaggtgtctctggtgtcacctcttcttataaggacacgaattctcagatcaggtccccatcctgcaacctcatttaaccttcattccttccttactccaaatacagccacctgaagggttagtgcttcaacacaggaattttggaggaacacaaacattctgcccagccgagtgcggtggctcatgcctgtaatcccagcacttcgggaggctgaggcgggtggatcaccttaggtcaggagttcaagaccagcctggccaacattgtgaaaccccatctctactaaaaatacaaaaaattagctggcgtggtggtgggcacctgtaatcccagctacttaggatgctgaggcaggagaattgcttgaacctgggaggtggaggttgcagtgagccgagattgcaccattgcactccagcctgggcaacaagagcgaaactccatctcaaaaaaaaaaacaaaacattccacccatgatactattttaggtcttgtttctgttccttcagtaagattgattgattctttttttttttagagacagggtcttgctctgtcagtcaggctgatacgcagtggtgcaatcatcactcgctataacctccaacttctgggctccagcagtcttcccaccatagcctcctaagtaggtaggactacaggcacacccatgctataattgatttataatatgatcctttgcctttcacagtaaacatattcctaggtactggtgggaatataaaatgtcactatttgtaatagccaaaaagtaagaacaactcaaatgtccatcaactggtaagtgaataaacagggcagcttatccatgcattctaatattattcagctataagaaggaatgaagtagtgacacatgctgccacatgggtgctaagtgaaggaagccagttgcaaaaagaccatatgttgtacgattccatttcagtgaaatgtccagcccggatgcagtggctcatgcctaaaatcacagcactttgggaggctgaggccggaggatcacttgaaaccaggagtttgagaccatcttgggcaacatagcaaggcctcatctctactaaaaattaaaaattagctaggtgtggtggcatgagcttatagttccagctacttgggaggctgagactggaggattgtgtgagcccaggagttagaggctgcagtgagctgtgatcatgccattgcactccagcctgggcgacagagcaagactctgcctcaaaaaaaaaaaaagaaagaaatcacagtccactagaagaaatggggaaaattaaaataaataaataatgtttaaaaattaagtgtccagaataataggcaactctattgagacagaaagtagatgagtggttgctgggtccaggatggtatagaatgggggtgggaaggaactactaatgggcatagggttttttggggggtgatgagagtattttaaacttaatgttgatggctgcccaactttctgaatatactaaaaaccattgaattgtacacttcatggcatgtgagttaaaacccagcaaagctattaggagtgcaatggcaccatcttggctcactgcaaccttgacctcccgggttcaagcaattctcctgcctcagcctcctgagtagctgggattataggtgcttgtcaccatgcctggctaatttctgtatttttagtagagacggggtttcaccatgttcgccaggctggtcttgaactcctgacttcaggtggtcgacctgcttcagcctcccaaagtgctgggattacaggcgtgagccaccatgctcagccaaagctgttatttttttaagtatgtattcctagatgttttatacttttatagttattgtgaatggaatgatttttttcctagataacttttaatgaatagaaacagttcctgctttatctccaaattctagaacagtcactggcacacaagtgctcagtgtttaagtgacattgttttcctgcacccaaaagtagaatgctgctcctcattggaagcatgttactttagcaaagtgccactaaaatgaccatagtccatgtgctctgatcacttgtcacagatggtgataaaattcattcacagcttcctttctaggcctgcagcatttgggagacaaaactctgctaaacctttggaagaaaaaagagaccagaggccattggtcccgaaaagtggatggaagatagggaggtagaaggaatgttacaggctgagagggcagctcacactcagctccagccacttcacctcgtgcacacactggctgagggttgccagatgtttgagaaaagctagaaatccagaccattgttaaccattggcaactatagggaacatacagaaagcatctgaactggatgtggtagagctcccagatcatgatctgattgagaatgtccatgaacttctgtcctgattgctcagtgcagactgctgcttcttctggcaagactcctctcttcacattgacctggagttgtcacaaaatctgtttttctcttgctactcccctgagcatggcaccttctgccagagcgctcccttaactgtgtgggcaggctctgcttcacagctccccgcccactctgcccaagcagaagtgagcccctcctgggcagaaagtgcccgcaatgagggctgaaatgtttctattccctgagtaaccaacctttctctgtttccttgtccaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaa

SEQ ID NO: 108196 - DNA, 1097 bp, Homo sapiens
ggttcttattcagctccttgaccgctaaacagtgaccagtgtttccaactagccaagttggaatttactaaggctgggtctcgtttcatctacagccatctgctgggtgaccttatttagtgtcctggctttaaatatcatcaatatcctgatgcctcaagtttctttcttcagttcagatttctccctgaactccagattccttttgctttttcagagttgggggctttctctgtcacctgtgctggagtgcagtggtgccatcatagctcactgcaaccttgaactcctaaggctcaatagatcctcccacttcagcatccccagtagctgggactacaggcacgccctgccacacccagccaagattctttttttaatctacctttgtactcaaaagctgtactaagaggtctaacaggcatttgagattaatagatcccaaactgagttcctggttcccacccaatcctgctccttccaccagccttctttatcatagataatggtggctctgttgttccacctgttcaaacagaacacctggagtcaccttgtactcttattctcctagtccacttctaattccacagaagatctggttttctctacttttaggttcttagaatctgaccacttttaggcccttctgctgctactttggatcaggccagtgtcatctctcacagccttactgggattagagcagaaacatgggacatgatgcttagaatctcagattgtgtaggccagtggttgtcaccctgccctaagctggacccaagctattcatggagtgtcctggaactgctgcagggatgggtgggaagttgagtgggtgggatttgggtgcctgttttccctatcagcagtctcagtcagagccgcctgcttctgtctgttttacatatttggtttctgcactagatttctttgaataacaggttccacttttttagataatttacaaactgtttattgcaattgaactctcctcccctaaggcattgacctgatttgataacatcaggatctttctcccacgcccctgcaatctctcctgtgtggcaggttttctgtggttgtacctgaaggcc

SEQ ID NO: 108197 - DNA, 1044 bp, Homo sapiens
actgatgaaaatcgggaagaacctatttgaacaggggagggagatggatgtgggtggtggagcctgcacatagtttctgtatctcaggaaccttgtgaggtttgctttccagttccttcagtacgtcatgtcccgctggccagggtggagtggagcacatgtttttccttcccttttaactgatatttccgtgatgggagtgtgctaaaaattaaattttttagaaaatatttactatttttagaaagaagttttcccatttccagaagttagccaagatgaacttaatgaaatcaatcagttcttgggacccgtggaaaaattcttcactgaagagggtatgtatggttttctttaccattgccgatttccattgtaagggctatttggttgatatttatattagaagtgacatacataggagaagtcttcttgagggagaaatggtttccactcataatattttgctttaggtttcatccctattgccatttaattaaaaaacatccagttaaatgcttctcattgtatttgtggttcaggagcactttaaacatttccatactgttccaggtcaacacttccataaagctataataaaaatgaataactaaaaaaattagatggcaaaaagccaaggccacacaccatacaagcccatggagcatgtgttggttgttgtggcagtgtacagttgctcttagtgtttctaaaggttgagtttcaatttctgtactttggtaattgtaaacaaagagtgatttgtggaccagccacagtttggcacctgcatggtgaggcagcatttgacctcaggtccctctctcagagctgttggccggtcctccagccagggccttggtggagagttcagtgatggtggatggacagcaggtcttccctaatagtaggatcctggagagcttttgtttatatgaattttatctatcaatatttgccatcttaggggttattttatttttattttactttatttttttgagaaagggcctagctctgttgctcagactggagtgtggtggt

SEQ ID NO: 108198 - DNA, 1030 bp, Homo sapiens
ctgaagaatgagaggtgtccctttaaaggtgccaggcctcacagccaacataagccagtgtttctcttctctgcccttcttcccctcatgctcccctccacccccaccctaggggcacagtaatccaaaatcactgctggaggccaagtacaggttgctagtagcattttgtctccttcacaggagacagctgctgggaagctggctgtgactccacccctcatgggggagcatatgtgtggctcccctgaggagactggctgctctctggcaggtggtgggtttgggggggttcaggctgtagccaggggcccagcatacccaggccagaggggggcacggagcttctgggtgccgaatgggccatgttgctggacagtgagcgccagcagcgaggcctccagtcacaggaccatggactttctgcagtgagcttaaacaggccaaagtgagcacagtcatggataccgttggccggaggcttcgggactccctgggccgaactgtggacctggggctgacaggcaaccatggagttgtgcaccccagtcttgcggtgagtgggcctaacaggcataccccctatttcaatgccctcctgccagatctccttgtggcagaaaagatctcactgtggggggtctgggcttctccaggggaagttggggaacaccagctagtccatgacaccctggattgcttcccccagatggggcatctctgcctggtacccgggctgtgagacaggacagggcactgtagggatgaggtgctgaactgagtcctgtcttggttaataggacagtgccaacaagtttgaggagaacacctactgcttcggccggaccgtggagacactgctgctccgctttggcaaggtaaccaggccctcccaggcctgggtcgcaagcggtcctccaatttggccagcattcatgagactactttttgtcaagcatcctttgggaccaggcctagaacagaaatgttgatcaccctggagggatggggtggtgaggtcaggctgact

SEQ ID NO: 108199 - DNA, 1089 bp, Homo sapiens
tgacggccgtgctgtcgcgggccagccgctccatccgcattgggctccgcaaccacgaccacgaggtgagcccagcccagcctcacacagggcctggctgctgccatctgtcctgctgcactttaatgaagttgattgttgaggagggtgtggtcgggtgtgggggaggctgtgcaggttcaccatgcggtggccgtgggagggtctgtgctgctcaggagatggggctgttccctttcttcttcctgactgagagaagagggggtgagtgacaggggttcctgatcccagtgcccctacccccagcaagggacagaccctgcacattgcccgctgtgctggagggaggcgggtgcagtctctgaggacccactgtataccaggatctctgcctgcactttccagagcacctgcagataccaggattgtgacatctgcctttcagaggaaacagggtcagagatgttgagtcacttgctgttggggaaaggctgttggatcagggctggaattagaacccaagacggggtgactcctgtgccaggccttgtgacccctgccatgctacccagtttggctgataggctgggtttttgaagctcagaggtctgattccaggaatttgggcatatcttttctgtcctcggttctggcaggttctcttggccaacaccttctgcgtggaagcttacttgcagaatctcttcagcctctctcagctggacaagtgtgagtggcatgtcttgggggagggaaggaagggcccacttctaggcccctattgatggtgagctgtttctggaccctgtcaagctcccagagcctgctagctactcacagacctctgccttgagcgagggcctgggtaggcctgggcttagctgcagcagtgcccaccaggcactgtaggtgcatacctgccccattcaccaaggcagttgtatgtatatatgtgtgtgtgtgtatgtatgtatgtatgtatttatttcgagatggagtttcgctcttgttgcccaagctggagtgtaatggcgcagtcttggctccctgcaaactccacctcttgggttcaagcgattcttctgcccc

SEQ ID NO: 108200 - DNA, 1013 bp, Homo sapiens
cttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaagccactgcgcccaggactggttctctgatctttgagcccagaggcggcccaggtggccacgtgcctcaactagtctccaggcccggggtggtagacaagctgccccctgccagtctgccacccagagcactgtgagaccttccctctgtccctaaacccttgggggacccccctgagcaagaagcagttggtgcctgaggggcagaggaagcttgggctgggtcccttctctgggacaccccaggttcctcccattgggtttgtgttggagagggctctttggtgattggcaggggcaccctcaccccgacctccccatgagggaagcgtcactctcctgagcacacaggcctggatgaggaatcccttgcccgggtcttgtagccacattgatcccacagtggcaggaacaacccaccccatggtcgaggttccccccacccctggatcctgggctgaagacatttcctacagagaagtgttctcacc

SEQ ID NO: 108201 - DNA, 1126 bp, Homo sapiens
gggcaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacagggtttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctagcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccact

SEQ ID NO: 108202 - DNA, 1095 bp, Homo sapiens
ggcttgcccagcccccatggcctcatgctgccccggctttcctccgcagggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagat

SEQ ID NO: 108203 - DNA, 1050 bp, Homo sapiens
acaagtcacttcattgacctgttgtcctatcagtaaagtgaagacaataaaggcaagagactggcccctgtggctatgctcgtactagaaatagagctatacagtgaccccaaactgatcagggattgtgggaagtagaggcacacaaggcctttaccaccttttgtctccatgctgtgactcaggatatccacatgtctgctttccttgctttcctcttgttcgttgtttagcccttgtaggtttctttaccttgcactggcctttgtgtagtgctcgggctgtgattggcctttgctgagacctcatgctaggcggttttcctgggtgctttgggtatgaggaattctcagagttcagtaataagaggagcaactctccctcaaatgtgcatgcgttttataagtttccatcgcttttctcatgagttgttgcatttgatcctcatagccaccctgtgggagactatccccatcttacagaagaggaaatgaaggcccatttgtggcaaagtctgaaccagagccaagcttttcagctcctagtctggtacttttctcctcattgctgtcttgtgccctctcctactaccgcaaacacacacaaacccacaaatgaaaaaagttgggactgatttaaaatctaggccatcttgtattgcttgcattttacacattgattagcagtgtcatgtcaacattttaatgcccagtacttattaaataaatgtttattaattcagatgaactgggggtagtgttcggaatggccagtgtgaatgacagaaaaatcccactttctagactggcctgtgaaatgctgttttattgttgatgtggcagcagaagctaaccaaatgctgttacataccagatctttcttttttttttctttcgagacggagtctcgctctgtcaccaggtggagtgcagtggcgcgaggcgtgatcccggctcactgcaacctccacctccctggttcaagcagttctcctgcctcagcctcccaagtagctgggactacaggcacacaccaccacgcctagctaat

SEQ ID NO: 108204 - DNA, 1993 bp, Homo sapiens
cagcttcaaattaactgtttttttctgtctgcccctatagaaggtaagctccttgaagacacagggatccagtgggccagtgtcaaacacatggtgtccaatatgtgcctgttaattggttcctttatagagagaaagctgaggccaaggtcacttacaactctgtggcaaaaccaagggtttggctggctcctaagcccagtcttcatttttacttgaccacccttctgatttgctctgagttcataaagatgaccgtgagattctgaaagtgaatggatctaataaaaatgcagttgtggccattgcattcactgagagaagaatgtggaatggggcattttagaaagattggggttgacagttaaagagttttagggtgtttggtttattattaaccaaaacgtgtagatatacccaaacggctcagagacactgctgtacgagtcagtaaggctttgtatatggtgatcatttccagtgttcttgtggatgcatttgactgtagctatgagaactggacttataaagtgaatctgagtgctgcttatcttgcatactgtggagtctctgacagagagcactggactaggagtctgaagttctgagtcttgcttcaaccctgccacagacttgggcaattcattttttttctccttggagcctcaggcttcctcatctgtgaaatgggactaatggtctttgctctgcctctttcttagggttgtcagaaaactttgaacatgcttaaaataaagtttccatgacttacttttgaatagataaaccattcacatggttcaaatttcaaaattttaaaaacttcaaagggtatatatagtgaaaagtctcccttccgtgtttgtcccgtaagccacccagtgtcctctaagaagaagccatcagtgttactcatttcttatttaaaaacaaggatttataaatatatatttttttattgctgcagttactgttttcctccctagatgagacagattaggtctgaatttgcccctcccccacccctccctcctccccacctcagtgtcctcaggaaatctcagctggctctaaatccttaaaacattctgaagctcctctactcactcttatctgggacaacacaaaggcctgttatgtaaactcgtttttgcagatcactaggcacaccggcctcaagtccagcgcagaggtcagccttatggaactgtacccctctattcagctctctctcaggctcactgtctgctcgctagggatgctgccagatctctccttcatagaggtaaagtctgtgcccttgggcctggacctccagatttcaggacctttggccttgactctcaagcttccccttgccctaggagtcaaatttgtttttgtagctgctcctggcacttcaaaaagagggggcagggcgggataagaggaaatggtttctggttaaagtttgcattcacagtccttccaatcaagagtctagttctgctcatctgttcttttcctatttggataaagtttgtttgactttttcagttttcattagaaatagcaaaaggactgttagataagaaagaagttctaggtcgtgctgattttctgaagaaatctgttcttgataccagggacagccatcctaattgcaaaataaaccttgcctctcgaggtttcttagaatcctgagacagcatgtctggtggagagatagtggaaagagggccagctttagaactgcacagcaccaggttaaatcttatcctcaatggatatgttctaagacccccagtggatgcctgaaacttcagatggtactgaacgctatatagactatgttttgtcttatacatacatgcccatgataaagtttaatttatgaattaggcacagtacgaaattaacaacaataattaataacaaaatagaacagttataacaatatgccagcatcgctattcctgcgctttggggccattattaagtaaaataaggattc

SEQ ID NO: 108205 - DNA, 1061 bp, Homo sapiens
agggaagcaccatcggcgtcgacttcaccatgaagacgctggagatccagggcaagcgggtcaaggtgggaggccggccagggcccctggaaggcgctccctcggagggtggggcgggggcagcggagcccctggccgcggcgagcgcaccccgcgtccatctgaagtttcctttggcttcccctttttccttcctcgggtcggagcaggcctgggccccggggtctgggccgggttcaagtcctcaaagcgccggccgtgggttgctggggggggggggggcgagggagtgtggaggaggcggccctgccctccggagctcacaccctaggaggggactgtgctccaaaataactttagccattggaaggcagggggttagactcccctgttccaggtactagcggagcgccttggagtgcggagatcagaccccccacctccatccaccgcgatggcagcccccagctcagcccaccggcggggcactcagccagagaactgcatccccaccccaggactaggagcgatcaggaagtagttgcttttaggaccagagggccaaaactttttgtcagaatttccggcctggccacgcctccctgcagtctctttgtggacctggtggtggaactttactcgactagggccagccccggttccctcccccagctggagtttgatagaaactgaaaacttcacagataccggaaggtgggggagagaaccaagctttggcaatggctccgaataaaaacagcaggatgtggttgccacaatgtcctggcagtggtttgataaatatttgtgatgaatgaaatcagagtttcttaacctaggtgttagtactccctaatcaaccaggagatcctgggctgaaggcactcagtaacttttctgaaccgcactgtacagaaatctttgcttgctttcatggtttcgagcccccatgatcttcaggacaccctcagggcacagggctgggacgatctctgccagggagatgggagtcactggagccttgctgctgctgggctctgcctctccgggtggctctaggc

SEQ ID NO: 108206 - DNA, 1016 bp, Homo sapiens
ctctaggccattctatcgttcaaatgtttccaatgggagggagttaggactcttggagactattctgcgtatttaaatcagactccttgatggacttctcccacggggacttcctcctggctgggtctggcaggggttgaggggctttgctgaggagtgagccctgcactcttaatttccacagattgaggaggcactggtgcgaaggaagaaaatggaactcctccagaagtatgcaagcgagaccctgcaggcccaaagtgaagaagccagaaggctcctggggtattaggacccagctggggctctccttggagttcttccatcccccagtggtacctcaggacccagggctgcagacacaggctggtgctgcaagggctcctgccccattctcagccttccttccctctccttgtctcatgttgaccggagggtaggggtctgtccctggtcttcctggtaggttttgtacacatattttgctactgtgtggatccatttatttttattgtggagtgtatacaacaggttgcgaactggctgcctgtgtcttattttgacttgcactgccattttgaggggagaagaatcaattagtggcaaacatttaaaaatgcaattttttgcagaccaaagtataattttaaaaaatgcaaattttctaaaagacacatctcttgaaaaatgagatgatgtggccaggcgcagtggctcacgcctgtaaccccagcactttgggaggccgaggcgggcgggtcacgaggtcaagagatggagaccatcctggccaacatggtgaaaccccatgtctactaaaaatacaaaaaaattagctgggcgtactggcatgcacctgtagtcccagctgcttgggaggctgaggcaggagaatcacttgaacccgagaggtggaggttgaagtgagccaagatcgtgccattgcactccagcctggcgacagagtgagactctgtcccaaaaaaaaaaaaaaaaaaagatgcacgcaacccaca

SEQ ID NO: 108207 - DNA, 3295 bp, Homo sapiens
cattgaccctaaccctgtaaattccatcacttttatcaaggtgtatattataataagtctataatacccaatcatgtagttgtgtgattattttatttttttgagacagagtctcaatgttgcccaggctggagtacagtggcaccatctcagctcactgtaagctccgcctcctgggttcacaccattctcctgcctcagcctcccaagtagctgggattacaggcgcctgccacttcaccgggctaattttttgtatttttcgtagagacggggtttcaccatgttagccaagatggtctcgatctcatgatccacccacctcggcctcccaaagtgatgggattactggcgtgagccaccatgcccagctatttttttaaccaatatattagctagcttttttccccagaataattttccaaaaatacatttaatagagaataaaagttaaaagaactttcagtggtttaatgctgttacttttaatatttcaaagatctgactgcagccatgagcagcaatgagtgcttcaagtgtggacgatctggccactgggcccgggaatgtcctactggtggaggccgtggtcgtggaatgagaagccgtggcagaggtggttttacctcggatagaggtattttgtcgaatagaaaaatttgaagtacttcagtatttgttagtatcaagactggtctgactagccgaattctttgtttttgctcaaaacaggtttccagtttgtttcctcgtctcttccagacatttgttatcgctgtggtgagtctggtcatcttgccaaggattgtgatcttcaggaggatggtaagtatttaacacttccttttcatacccctctagagcttggagaggtgagcacatgcaactgtgtatagcatttccacctttgaggttttgtattgtataatttaaaacgtaacactttgtaaaggttttatagtcttggcctgtttcttttccttattgttgaagcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtaaggtgtcagaatgttgttagaagaaaactcattgcagagattcttccagagatgaattagctataaatggaagggccttagtaaattcagtgaaacttagctgtgaccagataagaccaattttcagcatatgtaactggcagtctatctgtatataattctgtattctgccctgatatcctgtggcttatggtacctgggcagttttcacaactggacttttttaatatataaaagtaagagtgttataatttgaaacttccagagacttcatagaaagctctgtaatatacataaatcttttatcatgtaaccagaaatctttgcctgtttgtgacatgtaagtgtataatttgataaatgttgttgtgtacatatctgtgaaaccttaggggttaattgcatgaaaacaaagatcaggcgttttgttctgcatggtgactgttgctttggtagacagtttttttctgaggcccattgtgaaaacttttaatttcttttttaggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgtgccattctcctgcctcagcctcctgagtagctggggctacagg

SEQ ID NO: 108208 - DNA, 1076 bp, Homo sapiens
tgaaagttgtggatcctaaattcatctgggcagaatctcacctatgatttcagaaagctgagagtttcagagagtgactgtagtcagtccttagtgagtacaaaattgagaatacatcattactttaaattaatggtgcagtaactcttgtgactgatagcaataatttaggtgctttgttgttagtacttgattagattggattgggtcagttagtttcaccaaattgctaaagacacctgtccccctagaattaaaatactgagttacataatggctactaaaaggataactatatggggtgttcgatgattcaaaggtgaattacttggtctctaccttcaaggaatatgatacaaggcaatatggtactgccattagacagatattaacaaagtgtcttgggacttaatagggagggtagttccaggctgggagatgtagtcagattcttttatagagttggcatttgagttggcccgtgaaggttggaaaaagttgtgacaggtggaaaaggagcaggggagaccaggacagtgcagtgaaattccagccaggagcagtcacaggcaatgagacagactcatggagccatgattctcagctgtcttaccttaccttagttttcctaaggaatatcatggaattctgtaaagacctttaaactaaataatgttcatatgagatgagtgctaggatggggacctgctgcctaatataagtagtgtgagtctaaaacattgtggaaagtggttagtttaataatgttattaaagagacaagtctatcacaagggaccagttaccagtgaaactgtagaccacctgattcactgcgatagggttagccaaagggaggagagggcagattgcatacatagtacctaaggccactcaaagacctcttttaaaatcacgtgtcatgttgatgacatttggaggctattaatgtttttcttcccttttaagacttagtgttttctttattagcattaatttactctagtaaacaaaattatgtgtgactaaaaatggcaaaacaggctgggcgcagtggctcacgcctgtaatcctaac

SEQ ID NO: 108209 - DNA, 1977 bp, Homo sapiens
gatgaaggggggatggggtgggtatagtcgtgcaggccatgtgctggggtcgtgcgcctggcgggccatgtgccaagggttttgggggccttagaaaagggttcttaggccgggcgcggtggctcacgcctgtaatcccagcactttgagagtcccaggcgggcggatcacgaggtcaggagttcgagaccagcctgaccaatatggtgaaagttggtctgtactaaaaataaaaaattagccgggcatggtggcgggcgcatgtagtcccagcagctcgggaggctggacaggagaatcgcgtgaaccccggaggccgaggttgtggtgagccgagatcgcgccactacactccagcatgggcaacagagagagactccgtcttaaaaaaacaaacaaacaaacaaacaaacaacaacaaagggttcctgaagaagcctttgtgtttggagtggcgagactgctggaagacttgggagcttttagagtttatactccctatccttgatagttttccgattcttgaatttttatcgtcatttaaatactaagttgcttgtgttacattaccattccaaaaggggctgatggggctcacattccaagagttaacactatttaagttgctgggatcctttaaaagcgccattaccagaaaaaacacgaatttgtcaaacctccaaaaccacagcagcgggcggtagtctgcatcatttcttggattaatgaaacagatgtaattacaaacgagacacgaaattcaactagctcccctccatctagatttttccatatcgtgagaacctgttttagaatggcataatggtccacatttgggtttaggtgttgattttattatgggtaaggcttgtgcttgttcccacatgttaaccatatggcctcagccacagggcacttccaaaggaagtgactgtttctggtcttgggggtcttgtaaaaagagaacattgctcagtaatcgtctgtgattttagctagtgtgtttcaggcattattcagaaggactcaggtgagataagccaaaactgaatttgttttttgtctttctcaaagtgaaggaggtctaatgaatatccccatcttgcttttaaattacatttttaaaagtagatttttccccctttcctattgtttgacccaattttggagtgaaacgtaaccagttactatttccattcgaatttaaattagcaattttatgttatttgtttgttcaagcagtataactggagtgtagagctttgagggtttcaaaaagataagagatatagtacttatctcctgggcttccccctcccccctcctaaatagttttaaatgcttctaatgagttactctggttaaggataatcaaacacctgtaaactgccaggatcctaggtacatgctgtttttagtttgttgagcctgattcttgtctacaagagttctttgtgtattggaatataaaaggaataatttattacattcccaagggcagaattaaagacttaagtttttccgatttcatctcttgataagtttttctttaaaaaaataacagtttgtgtttttctgaggaaccaaaggtcctcttttttttcatattggtaacaggagaggtaatgtatttcagatggtgcagtctgtaaaatattttgaaccaaatcagtggaagaccaggggtttttctttttttttttctgagacggagtctcactctgtcgcccaagctggagtgcagtggcgcgatctcggctcactgcgacctccgcctcccggattaagcgattctcctgcctcagcctccgaagtagctgggattacaggcgcccgccgccacacccagctagtttttgtattttagtacagacggggtttcaccatgttggccaggctggtctcgaactcctgaccttgtgatccgactccctcggcctctcaaagtgctaggattacaggcaggagccaccgcgc

SEQ ID NO: 108210 - DNA, 1072 bp, Homo sapiens
agccagaaagtaaaaataaagtgttagatggcgattcgagctgaggaggaaatcaggcaggggaaagaatctgaaagcgaggagtgagtggctggcaaggctccttcggaaggtggcaataacagtcatagaccggtcacatcaattgggtgtttactgcgggccagtgtgtgccaccaacctcacacccgaaagccacaaagactcacgccacaacgcaacgaggcaggggctcctcctcctcccttggtatacggaaagaagcgtagggagcagagttgggatgctagtcagtacccccctgcacctagcccttgcccctccgtctggctttccccactcccgctccggcggagctaaggttaacattagacgaggctgtggctaccggaaagagcgcaggcgcagagcgcggaatgcgcctgcgcagagcgctgggcgacgtggccagtcggggcccggaagtggtccctgtagaaccactgtggcaccgctactccgtgccgcgcccgtcgagcattgcgttgctgcattgcgccccaccgactccactatgttgaagaaattcgacaagaaggatgaggagtcaggtgagggggccaggcctgggtctgagggaggccggacccccacccgccgagctttccttctggttctctgtcctgacccggaggctgaggcccagtgaggggcaggggcttgtgccagggtccacagctagtcagtggcaggcctcggagagcccgagcatgcgcggctgtctcactcttgtaagctcggactgcaattttctgggtgaccttgggcgcgacaaacacccccccccccaggcctcaatttacccatctgtcaaaggaggggaccatgccgaatgttctcttgttactttcttcgtccaacctcttgggattcgctggggctacgttggtgctggccaaactggggtgtaacctgcggagccagcgtcctgtgactgggaactctgaccccatcattcatttattcagcaaagtatattgagcagttactgtatgccaggtactgtacggtgtcctggatactgcaacagagc

SEQ ID NO: 108211 - DNA, 1051 bp, Homo sapiens
caagcgctgggtgaatgaggctcaggaggcagcatccagtgataacatcatggtccaggtgagatgtgagcaagggagtgatatttaaaacactcaggcaggtggtaaggcactggccagttggcatggacacttgccaccgagatccttgtgacccctggccatagcaggctttaatcctttcgtcattggatcatgggaggaattaggaggtcctgggttagagaatccagggtaccacttggggcgcttgggttacagactgcttaccagctggtgctgaaatattcaagtattttgataaccagctgagtattgttttggagcatatgatgtggcaaacttggccaaggcaggcagagggccgcctaaatttaggcctttgccagcctggctttgttatgatgtgtggaattatcttgatgaggctttcatccactttactcttcctcagtgacctaggacagccgttccttttatctctctggctcttggtttccttgtctgtaaaatacgaatgaaggttactgcctcacaaagcagcaaggacgagctgagatcatgcatgtaacatgtgacccatctgggtcatgagtgcctatcggcgctccctgtgtgtttatgtattccctttatctctcatctgtcttctcatcctttgcacgattcttgtcttcagggccagctgtggcccctcaaaacacttatgagggccagataagcttcccacatagaaggcttccacagctgccatatctttgcccccaaatgtcgctcctttaggaaacaaaagagagtatcgaggacaggaaataactatgagacctcacatctttagaaagggagtctctgggcttctggccctccaggcctagctttgtcagtaccagccaggagtctttgggcaagtcagcaaagattaaactgtctaccttcagggttgttgtgggtaatgcaagatttcatggctaaggtgtcccacacagtgacttacaaaacatgacaatgctcagggtctggctcccaccttctctctctcattgtctgattg

SEQ ID NO: 108212 - DNA, 1337 bp, Homo sapiens
tgccaagggggaagttctgttggatcctgtagacacagtaggagagaggagtggaatattacttcacagaggttaagggcttaggctgcaggtgcaggcagtcttggaatttaatcttggttctgccacttactggctgccaacctaaagtttgtttgctttcccctttgtgcctcagtctccttatctgtaaagtgggctagtggtggctgcaagctatagaagtgaggcatgtccactgtatagcacagcacctggcacacagcagatgcccagtgaataacagccctcactggaacccctgggtgctcacagacattatggcctctgtccatggctcaggtgcgcagggtgaggggagctctgtgtcttgggttgggatgggggtgtcagcagggaaatgagctgagcagagggtttgagtcagaacagtagcccccggttttcccagctgcccagcagtgaaggcaacctgacatgtggcatccatctccccacagtgctccagcttttctgcagctcacccaaggctgctctccgctatgctgctgttcgtaccctcaataaggtaagagtccagcttgggggttggaggaagctgtctgatccaactggaggtgtgtcctagcctctgacctggctgggaaggataatagccctggtcacagttagtttcttctagatggtgagatgatctcatccaaaggacttctgactgggccaaaccatcaaatgtagtgacagcattgggttcctgccctctctgtcactgtcctcccaaaacaggttgccatgaagcatccgtcagctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtacctgctacccccaggacacccacggcccccagaggaaggagctctgtccctgctctctgtggccacagccttcctgccaggactgacctgaggggctggtcagccttgaggactcagaggaggccagcagtttgctctgcagagacttggccttccgagaaatgtgcgtagtcctgcctccaggcctccatccatatcgtccccttgtactgaaagaacagtagtttccaggccagttaagggttcattgatttgttgtccaagtatttcttgagcacttgctgtctgctatgtagagtgacaaaaggggaacatagcagtgaacaaagcaggtgactgccctcctggagcttcctttc

SEQ ID NO: 108213 - DNA, 1016 bp, Homo sapiens
taagccgagatcgtgccactgcactccagacagagcgagactccgtctcaaaaaaaaaaaaaaaaaaaaagagtccttctggagcagagtggaggggtgactgggtaaagagactgttggagtaattcagaaggagaggatggtgcctgaaccggcgggagtaggagaggtgggacagtgcaagagctttttgagggataatgcctgttggcagggttggtgtgagggttgaggggtggatgtcaacagagatgatgccattttctactttgagctgacagtggtgctcttgactagtttgcaggggaggaaaagatggggtattggatgagggagggggaaggagatggagatgtttgtggttgcagacatgtggagtttgaagtgctgtgggcgccaggtggagttgtctgacaggcagttggaaaaggcaggtcttaagctcagacaggagataaatattgggagtcagtggcatataagaggcggttaaagccatgggaggggataagattgctgaagagactgtgagaagagaagcggccaaggacagaataccccagagacaggcttaaccaaaaaggagccagaggagatgatgggtgggaaccatcagtgggagccagtggtagggagagaagcaggacaggttgggtggaggggactcggagacttaagaagcctgagtagaagagcagagtttggggaacccagagtctgagagtctgacactggggctgttggcactgccttgggtgggctcagggattgtgcccttcaagcttcaagcgtggagttgagttcctctggtctccttgcccttgtgtcatgcccaaggcctggccttacctaaggaaggactcagtgggcactcagggaactgagtcaccccatcttggtggcagggcctgctgctcatgcacgtctatttcatttaggtggtggttgtccaggccatcagtgccctgtgtcagaaatatcctcgcaaacacgccgtccttatgaacttcctgttc

SEQ ID NO: 108214 - DNA, 1080 bp, Homo sapiens
tgggattacagacgtgagccactgcgcccggcctccatctgtcacccaggctggagtgtggtggtgtgatcacggctcactgcagcctcaacctcctgggatcaagcaatcgtctcacctcagacccccaagcagctggaattataggcatgcaccaccatgcccaactaatttttctattttttgtagtgatggggtctctccatgatgcccaggctgatttcgaattcctgagctcaagtggtccacccacctcagcctctcaaagtgctgggattataggtgtgagccactgcacctgaccagccttttgtttgacaggaaagagtgatagaggcccagagaaccaagtgccctgtctccaagttctgtgtttggacaactgtccttggtccagctcaggtcttcaactcttttctggagagagcaggctccttgcttagctcagcttctctctgcagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtaggtctgagccagggctgaacttggaaacttagcttacccttgaataaatgtcccagcaaagggacctgagcctccagtggggatttgtgcactcagtgttcttgctgcacaagctgtttttcataatattgtaggcaggaccttacatgtcatctagttgaacagttctttgttttttgttttgtttttttttttgagatggaatctcgctctgtcaccaggctggaatgcagtggcgcaatctcagctcactgcaacctccgcctcccgggttcaagcgattctcctgcctcagcctcccgagtaggtgggactacaggtgtgtgccatcatgcccagctaatttttgtatttttagtagagatgggattt

SEQ ID NO: 108215 - DNA, 1608 bp, Homo sapiens
ccgcggtcttgggcccctcttcaagtcctcgcctgagcccgtggccctcaccgagtcagagacggagtatgtcatccgctgcaccaaacacaccttcaccaaccacatggtttttcaggtgagcaaggtgggctgaggccctgctggggcatgcgcccagggagttgtcccaggtctggcaggtcctgtagggtcatgggtccccacactgcattggttgggagcccaacttgatgacagaatctgtccccaacaggtcggtctctcatatctcttgactcgggacatccatggctcccgattgtcagcatgaagacagggaacctggggcagggggactgggatgggaatcaccttggtcaataggaaagaggtgggacctcctggcttttcctctgcagcatggctcggacctagtgcaatgtttaagctcccctctctttcctgttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctggtgagcccctctccagataccaccctatcctcctgggagctcatggggtcaggaggaggtgggcggctgggcaccagctgtttgccttctattagagcttcagctccttgatttcagtcccaagaagaagaatagctgagtcccaagtgctcttctttaaaaatttttttttttaaagagacaggatctcactagaactcatgactttcctgtcctacaaggtggcaccctctgtccagctttgtgggattggatggcttgttgctgctactaataacatagcaggggcctagaaagcaggctgtgacccctgcctgcttgtcccctgcaggaggagcccatcccctgcaggctggggacatcctaactacccagcctctcttccccacagtggcctgcacattcagctgcatgatgaagttcactgtcaaggactgtgatcccaccactggggagactgatgacgaaggctatgaggatgagtatgtggtaagatcctggtgtcaggaagctcagttttgtgctgaggctgcaaagcaactcccttcaggaactgacagtgagactggagctgtttttggctttttagctctttaaaattttatttttttatttttattttttgagatgaagtttctcttttgttacccaggctggagtgcagtggcgcgatctcggctcactgcaacctctgtctccctggtccaagcgattctcttgcctcagcctcccaagtagctgggattacaggcgcccaccaccatgcctgccaaattttttgtatttttggtagagatagggtttcaccatgttggctaggctggtcgcgatctcctcacctcaggtgatccacctaccttggcctcccaaagtgttgggattacaggcgtgagccaccgcgcccggcctaaaataactttttaaacttatggaaatacatgttcatgtgtaaaaagaaaacttgggaaatacaaaaacaaaatt

SEQ ID NO: 108216 - DNA, 1065 bp, Homo sapiens
tgaggatactgaagtcctgagagacagtgactttcttttttttttttttttttgagacggagtctagctctgtcacccaggctggcatgcagtggcacaatctctgctcgctgcaacctccgcctcccgggttcaagcgattctcctgcttcagcctcccgagtagctgggattacaggcgtccaccaccatgcccagctaattttcgtatttttagtagagatggggtttcactgtgttggccaggctggtctcgaattcctgacctcatgatctgcccacctcagcctcccaaagtgctggaattacaagcgtgagccaccgcgcctggctgagagacagtgactttcacagtgaaatccctcactcagggatttcagcccagctctcctgcccgtttcactacaccagagctgccttcatgggttgctgcaaatgccatccttagcctgccctgtacagtcccttctgctgtatatatctgtacttctctcttcccttctaggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgactttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaatgattgctacttctgcagactcatgcttcagggctccaccttccccttcaaggcctcccctaaagaggcagaacacctgc

SEQ ID NO: 108217 - DNA, 1016 bp, Homo sapiens
gctagctgcgcttgccctgcttcgctggactgtgaagccccctccgctgcggctcttcctgcgctcaggcaggcatttgcagagctcctctcgggacttgcctcagtgccctgcacggagctgggcagtgggctcagggagcgaagcaaacgggcacatccttgtctttgtgggactttttggggaagactttagacggtggtcacggaggggcacggccctgtgggaacggaaagagaaggcggggactcaaggaataagacctaatatttgagatacgtaagccttttccttacgttttgtaatttaaaggttgcgaggggcggtgttgaagaatgtgtgggcgaacatcctgtcacttacctagagatgttctcacgagagcttgcgcctaccaggatcggcggggccagcagcggctcccggagtggagggaccctgataagtactgcccctcttacaacaagagtcctcaatccaacagcccagtgcttctgtctcgactgcactttgagaaggtaaccagcattgcactatgctagcccctcgcccagcctcgtgatggtcatctcctatttggtttggtgtgtgctcagcctcttgggatgacattaaaaaccagcctttactgatatattctgacttccagttgagaacctctcttggcctcatgaaagaagttttatcagtggcttctaacactgataaagacgtatttttcaggctcaatttaaatgcctttgctatacatggcatactagccttaatatatgccaaatttatatgagctttgtgttttaaaatagcagctttcactgatcatcagggtcattggagtatcttaaaaatataataaaaaaatttaaggccaggtgccatggctcatgcctgtaaccccagcactttgggaagccgaggtgggaggatcacttgagcctaggagttggagaccagcctgggcaacatagggagaccccatctctacaaaaaataaaaaaatgaggtgggaagatcac

SEQ ID NO: 108218 - DNA, 1021 bp, Homo sapiens
tctagtaaatatgattgctaaagaactcaagttacctacatcatgataagtcattaaattgtttttggctggttgtggtggctcacacccacaatcccaacactttgggaggctaaggtgggcaaatcacttgagcccaggagttcaagaccagcctgggcaacatagcgaaaccccatctctataaacaatacaaaaattagctgggtatgggggggcgtgtgtctatagtcccagctacttgggaggctgaggtgggaggatggcttgagccaggaggtagaggtggcattgagccaaaatagcgccactgcactccagcctggatgacagagccagaccttatctcaaaaaaaataaaaaaattgttttcaagtagattccctgtttaaaaataatcttgaattctttatatttcaatactcctaaataatgtaataaatacatatgttaaattaggttagaatttcattatgatctcctcactagatcttctctccgtggcaggatgcagactcatctgagcgtatcattgctcccatgcgctggggcttggtcccttcttggttcaaagaaagtgatccttccaagctgcagttcaatactaccaactgtcgtagtgataccgtaatggagaaacggtcatttaaggtaggtggctggtagctattagtgccccgtatacctcagaaataaggttccaaagggtgtttccatcctagcctacagaggacaaccaaaaataaataaataacacaaaaaagaatgttcccagttgttaatgtggaatgctattttgttactacataacaaaccacaccagacttagtagtgtgaaacaaaatgataaacattatctctcatattctctgggttgactgggctcatctgggcagttttcacttggaagttctcatgttgcagttagatggcagctgaggctggatgtccaagatgacttcttcacccacatctgacccttcagctgggatgactagaacaactagaaggctttccatat

SEQ ID NO: 108219 - DNA, 1103 bp, Homo sapiens
aacttctgtatcactgctagaaattctttagcgcattttcatctgtacttgtggcttctcccaatagcagaaagctttgaaaattgtcgccatgttcgaaaccagtaaactaaccactactagcactaaaaggagccacttgtggtatttaagattttatttatatataggccttatttatatattttttgtatgaaccttataggtgcttctttttttttttttttttttttgagacagagtctcactctgtcgcccaggctggagtgcagtggtgcgatctcggctcactgcaagctctgcctcctgggttcacaccattctcctgcctcagcctcccgagtagctgggactacaggcacacgccgccacgcctggctaacagggtttcgccatgttacccaggatggtctagatctcctgaccttgtgatccacctgcctcggcctcccaaagtgctgggattacaggtgtgagccaccgcgcctggctggagtacttcttgaagttgttccagccatggtcattttttttttgtagcatcatcactgatgtggactccttgatatcctttgctcaggaaataatcacatgttctcatttttcttccaggatcttttactatttcaagcttcttttcaatatttaaaatgtctccattcacatgcattgcctaccatgttttgagccaggaagcttagacatgtttgagatgttaaatgtgcatctttatatatatatatatatatatatatagaaaagttcagaaaggcaaaagaagagcaaaacacaattttgtaaaatagtatgcagtgagccaaagtagcagtcagtgtttgagatgggtgcattttgtggctcagttcatctgggtgcagttttctgtgttcaccttgtgtttctcacagatgaaactgtgcataagcaaacacaaaatttgcattgtgctccaattgctctctactgtatcagtggcattggaacagatttgcattttaaacataagcattggcagaactgactatacttgtattctacctttatactttctgccagagctgagtactccctgaagtgattttttggagttctcctgaaaagaa

SEQ ID NO: 108220 - DNA, 1108 bp, Homo sapiens
tccttttgttcacaattttcttactgtaagtctttcagaggtggtgaggcttgagattgctgttgatagacaagttttcaagatctattttcccttcattctaggctggggtgtcatagaaagtttaccaatttactagagtggacactggagtacactagaccagttagtactcttcactgtctttgccatgaaactttataacatggctctccaggtgttgaatctggtgccctgtcaccctgtgctcagggaacacatggcagcaatcagcatgtgaggcgcagagggagggcaagctccccttgtgatatttgaggtatcagctgactcaagtctctctcccttctctccttattctcatgctacctctcccaaccattgtcttaacttccctggccaggatgcctgccatattagatggagaggaggcagtttctaaatggcttgactttggtgaagtctcaactcaggaagctctgaaattaatccacccaacagagaacatcaccttccatgcagtctcttctgtggtgaacaactcgcgaaacaacactcctgagtgtctggctcctgtcgacttggtggtcaaaaaggtaggggcctgtgactggtacagtcctttttgagctttctgtcttctgtcagtgttctctttctttcaggatgtggccttttatgatcagccctttaatttggaccatcaaaagctctcatactccttgtacacagcaaggtagtgtagagcagcaattctcaaacctggctgtgactcagagtccccaggagaagaactctttcaaaatgtaaatgctagaccctatctagacatcctgaatcaacatttagagctaggcttggacttttgtataattaagaagcttcaggctgggcgcagtggctcacgcctgtaatcccagcactttgggaggccgaggcaagtggatcacgaggtcaacagatcgagaccatcctggccaatatggtgaaaccccgtctctactaaaaatacaaaaattagctgggtgtggtggcccgtcccaagtagtgatcccagctacttgggaggctgaggcaggagaatcacttgaacctgggaggtggaggt

SEQ ID NO: 108221 - DNA, 1232 bp, Homo sapiens
attttggactagacgctgcccatttctgccatggtctttttttttttcctttttcttttttagagacagggtcatgctctgttgcccaggttagactgcagtggcatgatcatagttcactgcagcctcgaactcctgggctcaaatgatcctcccacctcagcctcccaggtagctgggactacaagcgtacaccaccatgcctggctcatttttttaaattttttatagagatggggtcttcctatgtttcctaggctggtctcaaactcctgggctcaagcgatcttcccacctcagcctcccaaagtgctgggattacaggcatgcaccactgtacctagccctgccatggtgtttactccaaaagatgtcacattctggagaggtggcattgtgctaattcagaacctttcagttcaggattggggtgtgatgtaaaggaagcagaagggagtagtgacagtcaagaagaggttgtacagattgtctgcacaaagaggaaacaatttagccttatcacagtggctgttagaaattcttctgtatctctccagtctcgttttccaacactccccctgggtcatgctgaattacattcttttccctgagaatgcttcattctctgcacatttggaatgcctttcagctctcttctctggctggtcccacacaatcctctgtgaaaccttctctaagatctactttcctgccccttagagcacactcctctctttccactcttgactggtgggccccagctggcccttagtaacattttccaagcctgggtaagtacctaatgcctcttcccctgtttcttcccttggacttggccttttcccaaaagcttgagctgtatggtttgagctttttcctctttcttgtaggagctcagggcaagtggcagtagccagaggatgttgcagtggttggccacaaagtcacccaaaaaggaagactcaaaaacacctcaaaaggaagagtcagatgttccccagtggtccagtcagttcctgcagaagagtccactccccaccaagagaggcactgcaggactcctagagcaatggctgaagcgggagaaggaggaggaacctgtggccaagcgtccttacagccagtgacacaggactttcagagaccaaggccagggtctgctgcactgctgttctgataataggttcttaacattgtatgtatatgtgtttgctttgggaggaggtggcact

SEQ ID NO: 108222 - DNA, 1103 bp, Homo sapiens
cgcttctgcaggtgaagggcaccggcgccaacggttccttcaagctcaaccgcaagaagctggagggcggcggggagcggcgcggagccccggcggccgccaccgccccggcccccaccgcgcacaaagcgaagaaggcagccccgggcgcggccggctcccggcgcgcggacaagaagcccgccaggggccagaagccggagcagcgctcgcacaagaagggcgctggcgccaagaaggacaaaggcggcaaggccaagaagacggcggccgccgggggcaagaaggtgaagaaggcggccaagcccagcgtccccaaagtgcccaagggccgcaagtgagcgtgtcggccggtcagagcggccggcgtgggcttttcggtgtttttgtttttctaccccaagtgacgtagattttgtacggctcacgccggccggggccgcgaggcctggtctgagcctcagggaggggccccgggtcctctcagtctttcccctcccccaacgatgtagcgtttttcgttgtttgctttaggtttttgaaacagccccggcgacgcctctattggctctcggccttggcaacggccgtcgtcatggttactggcccctaggcgccgatggccgaggccgcgcctgcccaccgggcggggtcgctggttggccgggcccaggcgcgcggggacgcggaggccgcgcatcctttcccagctccccaccctccttgcctttgggtgcgcgacaaacaatcgctccgggctcagggctgcgcggctcttcccttcattccatgggcctttttttgggcacaataaagcgtttaaacctttcagcctctctcgtttaatctgagtggaatagggatgggcgccttcggcacgcggggttggatggcgggcccctcgggtccttataccccagatctgttggccagggtaggcctggagccaggggccttcagcaaggggtgggaattgctggcttgggacgaacttaaagtacctgggacagggagatagacaggatcggtcccttaggagggatggatctatctgcccccacagggggtccatcggccattgcggggagcgggatgggggaggg

SEQ ID NO: 108223 - DNA, 1020 bp, Homo sapiens
cccgcgtgccgaaggcgcccatccctattccactcagattaaacgagagaggctgaaaggtttaaacgctttattgtgcccaaaaaaaggcccatggaatgaagggaagagccgcgcagccctgagcccggagcgattgtttgtcgcgcacccaaaggcaaggagggtggggagctgggaaaggatgcgcggcctccgcgtccccgcgcgcctgggcccggccaaccagcgaccccgcccggtgggcaggcgcggcctcggccatcggcgcctaggggccagtaaccatgacgacggccgttgccaaggccgagagccaatagaggcgtcgccggggctgtttcaaaaacctaaagcaaacaacgaaaaacgctacatcgttgggggaggggaaagactgagaggacccggggcccctccctgaggctcagaccaggcctcgcggccccggccggcgtgagccgtacaaaatctacgtcacttggggtagaaaaacaaaaacaccgaaaagcccacgccggccgctctgaccggccgacacgctcacttgcggcccttgggcactttggggacgctgggcttggccgccttcttcaccttcttgcccccggcggccgccgtcttcttggccttgccgcctttgtccttcttggcgccagcgcccttcttgtgcgagcgctgctccggcttctggcccctggcgggcttcttgtccgcgcgccgggagccggccgcgcccggggctgccttcttcgctttgtgcgcggtgggggccggggcggtggcggccgccggggctccgcgccgctccccgccgccctccagcttcttgcggttgagcttgaaggaaccgttggcgccggtgcccttcacctgcagaagcgtgtcgttctgcaccagcgccttgatcgagtacttgaggtaggtgcgcccattctgctggtcgaaccacggaaccttcttggcctcggtgtagatcttggccagcgacgagccgttgcgctcgcccagcctacggat

SEQ ID NO: 108224 - DNA, 2256 bp, Homo sapiens
gttccagggaccagatggggtcagaagctaaactggattgtattgatgactgaatgagagagaggtgagaagggtgtgttaacaactccatggtgagatttttgggtgtgaggagaatggggagtttgaggagacccagagaagtggaatgtctgaggtcacacagctggcaagccgtagtgctggggctagaaccctgctgcatctgtggctattccacacctcatgaatcttgcttatcctgcaggctgtatgtagtgagatgggatgcggagcagggaagcacattactaatggcagcctgaatgatgcctgtcatgaaagaaaaggtcttgattgggtcaagtgggttcatcaactgggagggttcatgaaccacagagcctgccttcagtttccaaagacccaagagatttggaagcagtaacctgatggctcagtctttgtggggtacgggacatgctgccacctcacttcacagaggagagtacggggtacccacactgcttccctgtgggcactggggtcccaggacaagaggctggaggtggcctgcagtcatccctggaatagcccagggaacgtacctgtattcccccaggctcaaggtttccccactgggatcccgggacaagaggctggaggtggcctgcagtcatccctggaatagcccagggaatgtacctgtatttccccaggctcaaggtctccccccggtcacagctcctgagcaagaaatcacatcagctgggtcacaggtgaaatgagaaaaactccaacctgctttatgtagaaagggcagaggtcaggggagggaaatagtcaaaaactgcacgtcattccttggacacatctaccctctgagacactggacactttgagtccagagggaactggcccccggtccatccctctttgaaaggatttctttagtttgactctttgacactcctcttgtgtctgggctctgggccgctggctgcactggcccctggcccaggaaggctgggtccggcaacacctggctagctctagttgatgtagtacaccttggcggcatcataatgggcgtgggtcatgtagttcttgttcctaaggggccaccagtggtcagggtggtaggtggctgggtagacatggggctggtgttgaacacaactgaagagcgccaggctccggtctgtggccacagtgggcaggtagagctgcagcttatccagaagatgacccggccagaaggaattggggtgtgtttgctgcagaccactggacctcttcaccttcagcttcctggaaaacaagaagacacagggatggttgtcatggcagacaggccagagctgaggcttcatcgcagagcccaccaactgtgaccaaagtggagatttagcactgtgccaagcacttcagcacctcagtcctccccacagttccatatggtcagctctgttatcctgtcgacctcacctgtgaggacccagaggcctggggaggccgtcgcacactgagcaagtggccaagtgcaggcttcattccttgtccaatgcctctaaactcaaagtcttaagcgcgaaccatctgttatctggaggcattttaatgtggtgtttggagtacggcccctgcagccaccctagctgggttcagatccccactgcatcacttcgtagatgtgcgactctgagcatgatatttaccctgtctgtgcctcagtttcctcctgtgtaaaatgaatatgcttagtgtcacttcgtagggctgttgggaggatctgagtgagtgaacacatggaaagccccagagcaatgcctcctggccctctctgtgttgtgtcactgcctctcaggccagggcaccgagccccagctgttgtgccaggagtgcagagtcccagttgtctcaggcgaagctgcccctcctcccaccttccttccttgtggagttagatgattgccacagacctggtaaattcctcaaactccttaaagcgcattttcttgcttttctttggcgttttcctagtggagaagagagaggcattttgtgaggagagtggaaatccaggccaatggggctttagggagtaggtcagggccgcaggggtggacccgtttctaagtctcaaacgagagctctgaaagaaaaatgtcttccacctggggtggaccctgactctgtgcctccatgctccaggggaacacagtgggcttgggtcagctggacctaccctcagaatctggccaggtgacctgggca

SEQ ID NO: 108225 - DNA, 1049 bp, Homo sapiens
catactgtgaggacacttaagcagccctatggagaggtccatgtggggaggaactgaggcctcctgccaatagccacatgggtgagccagcttggaagcagatccttttgccccagtcaagccttcagatgactgtggcccaggccaacatcctgactgcaacctcatgagagactctgagccagagcgacccagcaaagctactccctgatttctgactctagaaacggtgtgtgatcataaatatttgttgctttcagtcatttgggggtgtttgttatgcagcaatagataactagacaactaatacacctccctctcaagacttctgtttgctcctctgtgaaatggtgtgaactatccctatccagcctaacccaagggaataaaataatgatgcatccctaaacccttggtgtcttcatctggcaaatggggctgctcaccctggtggtcctggtagttgcctgggaggcatttggctgggcactctgctcctcgtggatcatgtgtaagaccttggcctctgaaggcgtgatgctgggcttgttctccagccacctctttacatcaccaaaggactctagctcctgccgcagcttcgacctctggctcagccaggtcttcctgtcctctggctgctcttggatatctctagcttccagaactttgaagctggggatgggctttgggggagcctgaggttgggatgcaggattaaggggtgtctgatcctccttgcgaggcaccatgatgattcgccggcgggtctgaggcaggcggaagtccttctgctggaactgcttgaagcagtgggcaatgaccggttcaggatcaaagacgggagcattttcattgatgggagtcttagacgggcagagtccttggggtaagagagttaaaagatgagtttctctctggaagaggactgaaaggagccaggaaggaaaaacacttttgctccaggctgggcaacagggccctggatcccaggccaggctttatcattgtcttgctgtaatcgtaaggataatttcatctaatgttac

SEQ ID NO: 108226 - DNA, 1062 bp, Homo sapiens
catcctgactagtcctgtttttcacatcaaaaatattgtaaaatgagaagtgaaaaagatgctatacaaatgcaaggtattattaactgatattcaaattgcgagggtatggttaaggagtattacatgtgattttagaaatttgagaagtctgataacactggttcccaatagatagaggttctcaataggtagttgtctcaggtgttctagggttcaaattgtaggtttttctgcagattctgttttgtctgtatccctttttttggtaagcgtaaaagtaagtgttcactgcagaaattttggaaaatacagaaaagtaaagaaggaaagaaaaattagcacttggcaacaaccattatatcattttggcttatttcattcttaacttctgtattgttatttatatatgtttccccttttttataaaattgggatcatatgtagactcttgctttttcatttagaagttaataggaaaatattcacaatagtctaaaaaatactttaatgaccacattatacaaatgcatcgtaatttaaaatattccatactgcctttaatttttcaatactataaactctgaacataagtcataaagaactagtgtcacagagtggttaaaggtgaggactcaggagccagactgtctggatttgaattttagctgggacacttagtatctgtgtgatcttgagcaagttacttagcttctctgtgcctcaatgtccttatctgtaaagtggagataaaaatagtaccaagttcatgggtcattagttagattaattgggtatttatgtaaagggcttagaatagtgcctggcatgctttgtaatagtgttgatattattatttgcatccctcaatattgctttaagctaaaccatagactccataaagtgtttacttttccttttcagaagataccatcccacgaacacagatagaaagaaggaaaacaagcctgtatttttccagcaaatataacaaagaaggtatccctttcccaatcagaacagcaaattctaattccattttgggttttcaattctgatgca

SEQ ID NO: 108227 - DNA, 1036 bp, Homo sapiens
caactgctcaccaaccaggaaagacttcactggtgagaaaatatttcaaggtatccagtgctttcaagcactattaaacattatgtgatgagaaatttataatgctgcatcttgtattcgtgcccatacatggttaagatgtgaaaatagagccaagaaatagggccaaatatgagataccagttgatcctaatactttatcttaaactgatattcaagcagtttcctatggcagagagaaaatcggctgactgctgtcgtgatgccatggcaaaggagagtattactattaacagctgccatcgtctctccctggtgcagcagctgggactctcctcctcagcagtgctttcccttcttcccatcctctttccagccagtaatcttaaaacttgaaggaaaattaaaagccttcacttgtgaaaaatttagggaaggcttcttatatacataaatgagtggagaatagttggtgtcttcacacccctcctgatacttactactaagtgtgacttccaatttaattttgtatatatcatagtcatttttatcttctattttaatgtaatgcttctctaaaatgctttagagctctaaataattcaaaagtataatcacatagttcatctattatttgtaatatgctcttaatacagaattcagaacttagcagttttgtctttataatacctcagtgaataagagataaaagggagaccttttgagcagccctgtattagttattcattatgccattatggtataatgaataactcctttaaagaataataattttacttaaactcctgtggggaaacagcctggagaaatttgtgaagcaggagattaggtttgattcttgttcccagttctacccatgattttatgtcttttctgtgcctggagtttctctgcctttaacacaagatggccatatatacctaggaactgcataagaattcttcaagtctgtgtcctagacactgagcttcttgaagaaagctttgaggtttatgtagatttattgctagcaaaa

SEQ ID NO: 108228 - DNA, 1050 bp, Homo sapiens
ttttggatctgaacttcagtccttgtgggctagaaaatgatattaaaggaaacttactgctagtaaatagaagggacttttaaaagaactggaccacatttcagatttctaattaatttccaaatgttgccataggtatctgtcatttaaaaatgaaaaagagtgataaatggcacttttaaatggtttcctctatgacaatataaatttataaatataactaaaatgcaacctacccgttaaccattcacagaaggagggacaaaatgtatgtaattttccccaaatcacttgatgtaattaatagcaacattgaaagaatagaatctgcaatggttttatggtaaaaatataaagaagctaagattcctgctatgctcccactacctgcccagacaaaatcatttggctgtactatctttaccatcttatatgcttacctgataaagtacacatcaaatcttcctgctgtcttcccaaataacctttgcttcacaactctttcccatccacatgggacagacttacggcattctgttcctgcagtagcaccaaactgagcagaagcgatgggttcttgtagcaagggattacattcactgcttctttttatcatcatttgttcctcatcttctcccactctttccaattccatagcaacatcttctttgctggaaaaacaaagtctaagtgattaacttatttaaaatttatcttccactgcctactcagttttaatccatgacaatgcaggaaccacatagattatccatattaaaatgagggagattaaagtcagtgtggaccagtcttgtgctatgggagtattttcctgtcttccaaaagcttcccatatcctctagcacaggttaaaaggtgttggaaatctctgcacaacaaaaaagtcaagctagaaacttttcggattaatcactgagtagggctattataaagatttctgggggcacttaccataaatttgagaatatgaaccaatagctaagctcttaagcaccagaaaatgcttaaataaatcagtgagttacactg

SEQ ID NO: 108229 - DNA, 1039 bp, Homo sapiens
gccctcggcccaggcagcaagcccgctgcccccctcaaacacgctgcagcggctcgcgcactccccgcgaggactcgacctcctgctcttcgcgaaccgccccgctcctcaccagtgctcggctttatctctccacgtcaacacggccctcatcacggcttcccttacggctcgggctcctcctacccgcctcagcgtctgtctcagcaaccgcctcactaacggtcgccactccacaagccactttggctacctgcgttacccctggcaacgtacatgcgcggtaagctgagtgcgagggcgccttgctccgagcgcgcatgtccgaaagggaaagccagaaaagcagcaaaagcaatggtggcactggagcccctaaggcgccagcgcaaccagagcgcgagcgattggtcggggcgtgtgggggcggtgcgtcttcctcgagaatggatttgattggtggagcgtggaaatggcggctgtagccgagggggcggccggaaagcagcggcggcgtctggggcgctttcgcaacattcagacctcggttgcagcccggtgccgtgagctgaagaggtttcacatcttactccgccccacaccctgggcgttgcggcgctgggctcgttgctgcagccggaccctgctcgatgggcacgactgggctggagagtctgagtctgggggaccgcggagctgcccccaccgtcacctctagtgagcgcctagtcccagacccgccgaatgacctccggtaagttactgtccccttttgggcctcagtttcaccacctgtaaaatggtatcgggagagtggacagtgtgtgggcctttctaacctttgacagagggtcggcagaaacctcgaagcccacgggtttagttactagggtctggagcccaggtgctcttcctgtgcgatcagccctggggtgcgctcgacttcctcatctaagatgactagggagactgggggggagccgggaggttttgtgaaagaggtccccttggggttggaggatcctaggaagtcattaga

SEQ ID NO: 108230 - DNA, 1114 bp, Homo sapiens
tcaaatccctgaaaagttggctagaactttaccaatctattttatttttcttctgaaagaatgatagattcatagtaagttacaaagatggtaccaagaagtctatgtacttttcatccagtttcccccagtggatccatcttatgtaactattatacaatatcaagaccaggaaactgagactggcacaaagtgtgtatattatatagttctgttgttttatcgcatgtgtagattgccatcagcgtgacacagaactaagccatcaccatgcagttaccacttagtgtcatatctactcaccttacctccagttatctccaaaccctggtaaccacaaatctgttctccatttctataattttgtcattcaagaatgttatataaatggaatcgtacagtatatgaccttttgagattatgttttttcattcagcataaaatcctggagatccatctaagttgttgtatgtttcaattatttgttcctttttattgctgggtagtattccaaccaatccatcttcttttatattattgtgcattgaagggttgtggtctcctgaacagaagtctgtctccaaacacaaatcaagcagcaagatcatctgctgcaggtaagtgcagctctgacgataagatttatgttccttcatcttccacacagactctcaaaatccaattatttcatgcagcagagaaggtcttgtgttaggtagttggtttaggcccctgtatttccttttttcttctttcttcgtctcctcgatgggaaagacttgtgcctttgatcatgaagcaaaagagaactacaagttgccttcatgcagttacttagcaacaagcctcaacatccagctatactgagtggaggcttgttgaaaatgtgaggctgtcattgtccaggcagcatgtgtggggaagaaagctttccctcccacactttgatgctagacctgaattagaatccagaatctctcattgacaggccatgtgacctcaggaaagttactaaatctttctgagctggagctttacgttcctcatctgacagatagggataaaaatactgacttgacgagattgttgtgaaatgcacacaaactcatgagtg

SEQ ID NO: 108231 - DNA, 1032 bp, Homo sapiens
tcagcttctaggagtatatcccttccgttcagcatctgttgagcaccttctacaaagcaagcactgttctaggggttggaagacaccaagtctgttcttaaggtgctctttaagtgggaggggattgagatggagagtgggaagtggtggctggcccagagatgtaggcacaagctaagggctgtcatagaggtatgtacagagggctgggggagctcagaaaaaggcaccaaatggtgccttcacttctcactgtttattacagaactaaatagcattttaagtttgatcctctgactttatgtcaggaccggcaataatgaaaccatatcccagctgttgctgcctcatcagacttttatttcaaaccaaggcatcatcctcactagttttaccttctgtggggtgcttcccctatccccatgccttttgttggttgtgtacacagctggacaaatgatggtcagtacctggcgctggggatgttcaatgggatcatcagcatacggaacaaaaatggcgaggagaaagtaaagatcgagcggccggggggctccctctcgccaatatggtccatctgctggaacccttcaaggtactcttaaagttgtcctccttctagaacaaacaccatcatgaagaagggctttttgtcttcctgaggtctccctacattcaaaggcttctcacctcacttgaatggtctgttttagaacctgtcccatttgtatggattttttttttaatagtcccgctacctgagaatgtatggaatttattaagagcctcctcaaaagttgagtttaggaatgaatcctggacattttagcaaagcagatgagctatttaggacaggccaaagtgtgtgtgtggcgtgtgtgtctgcgcacatgtgcatgcacacatgtgtacgtgtacatgtatatgagtgtgtgtgtgtgtgtgtgtgtgtgtgtgtgtgtgtgtgtgtgtgtggtgtgtgagtgatgcagcaggaccatttccttatgaatcaatagtggagctctttgc

SEQ ID NO: 108232 - DNA, 1047 bp, Homo sapiens
caccttccctgtgcaccggcagaagctgcagggctttgtggtcggctacaatggctccaagatcttctgcctccatgtcttctccatttctgccgtggaggtgccgcaggtaactgggggtgcctgtccactcttagcactggcaaggctgacaagaccagggaagctgggccctttgctggtgctttggggagagagtagcaaggagagaagaatggcagctgtgaggtcgtgggaggcagtctgggcctggaacctgccgccctgtctccactccttgcaacctgtgtgactgggggcaaacagctcaacctccctgagtatcagtttcttccttgtcccctttctgtagggatgggaggggtatgcagtgttgtcagcagcgtgtgttttgcagagagcccagcgtggggccgaatggagtgagcagcaaagccgggagtccggcagggtgtgtgtgtgagtacgtgtgtgatggtggtgatgtgtgtgtgagagagaggggagagagagaatgagtgggtggggggtgtgggctgaggtctgtgagccaataagggagcatgggactctgcacaagctctctgaaccaggaggtggccagaacagaaatggggcactgaagggtggagccacagaatgggggagggcagaaccacagacaggcgcctgagattgacctcccgaatgcaggatggtctcccctccaccttctgcaccccaggcagatggtgctcactgtagaattgccataaaacagagacgtgcatagcgagaaactgtagccttcagcatcccatcctcaggacagaatcactcttaaacatgttgaaatacatctgcttagcgcttttctacgtgtatatataatatatgcataatatacaattaggagcatgtggttttataagaacatttttaaacaaaagtggaatcacactgcaaatacttttcatgacttttatgtgtatacgtattgctacctatagatggaacctcagatttactgtattccctgagcctggcctgtaaacaagacttctcatc

SEQ ID NO: 108233 - DNA, 1906 bp, Homo sapiens
aggctgaggcaggagaatggcgtgaacctgggaggcggagcgtgcagtgagccgagatggtgccactgcactccagcctgggccatagagcaagactctgacttaaaaaaaaaaaaaaaaaagaattcagaggagggaggaggcatctctatggagggagcttccctctcctgccccacccagaaatgccagcagggagggagacgacaaatccctagaatagaaaggattgtaaaaagccacaaggtttaatatgagtgtttactgatatttttataaatatatatatttttatatatttgtttaaatattgagacggggactcactgtgttgcccaggcaggtcttgaactcctgggctcaagcagtcttcttgcctcagcctcccaaagtgctgggattacaggtataaaccaccacacccagccagatttactatagttgaaaagtaagtgtatgtggtatatatctattgtgtacaacatgctgttttgaaaaagccacatgatattgaagataggctggatgttactatttcatctaaatcccgagtaccccacctctttactctgtgccaggcactcaggctcaccagcttggatatagtggttcctagagatggacagccatccccactagatggcagagaagagctgctgagctcccgccagaccctgagcagagctgcaggttcctccctattcccaggcttccctctgctgagctcattcaggggccttgtgactctgaccaggcaccctgacgctgcaaaatgtgtcaggttgaaggaactcggaaacagatttattaatgggcaaatcctagacactagcacagctgagctacagctagaaagacccttgagagggtgtcagtagcaggcccctttccacaaagaagatggttggagcccagaagcagagaagtaggctcagagcgaggactcagacctcgaatgctcctttccctcttggccactgtgctgggctttgcagggttgccctctcaaggcgctttaaggaaacccagatctagagggtgatgtgtaagacctacagcttgggacacaggtagtcttagccctgtgttccttggcccatgtgatgcccgcattgcccttttctacgaattcctcttcacaaacacttgtttgccaggttctgactctgatgcctcccttaacgctgcctcccacccctgctcatgctcagaccattcatccgtgttctccaggcatgtggttcgtagttggagagctcttagctctgggaggtgtcatgatctgtttaattgaccagctttccctgttagaatgtggacctctgaattgtggagggggacaggggccgagacatgtttctccctgggtcctcagtctcttgacaggaagcctggtcctgtgggatgaaaagataaagttgcattgtggtcacctgcaaggcaggccggggacttgctcatctcccgaggtcttttcaggagggaggatgccatgctgctgagcagaggctgcaagtggtcaggattgctctgcgtgttcagttcaaagggctctggagctgctgcctcctctaggcacaggtcagcccattttgaatggggcaataaatggtgacagcaaagccacctgaaagcagcctgacctggtggcttgtgctcctccaaaccctgggcagaatctgaaagcagcaaaactagcttagctaacaccagtctgcttgttcctcagaaacttctagaggtccatgagttaaagtctctggctttactgtgagttcaaggcaagggctgcaattttagggtttacataaagagtttgccttccacagacttggtgggattcattccctacccctccaccttcttccagaatctgtctttataccctctcagctttcccctcctc

SEQ ID NO: 108234 - DNA, 1036 bp, Homo sapiens
gactgtgttgttactgaatccagtcgcttgcatattgctgttaattgccttttgttttcgaagagctgatttgtttttgcatttctgtgggtagttttttgggggaggcactctccccctctgagttgtcaggctggcaaaatatgatgtccctaatggattcagccaagtacagtgttttcatgggggctgcaggggcagctttattaagacttcatttgctccttcccccaggcctttgctttgggtgagaagcatcctgagtttaaggatgacatctacatgccgtatgctcagtggctagcagagaacgatcgctttgaggaagcccagaaaggtaggcaacacagactgtcaccttctagaaggagcaggagaagttactgccaagacatacatttcaggaaggctaccaagcccttcccatctgtagatcccaagatagatgacttcatcctggggatgtgattgtttggtggtgaaagactgtggagcatggaaagaccattggccttggagtcacaccctcctgggccacactcacttgccacaggcccttaagaggtgctgcctcctctccaagcctctgtggttactgagcaaagtgctgtgcactgcagtgtatcttcccgtttaatcctcgcaacagccctatggtatagctaccatcattatgattcccattttgcagatgagaaaactgaagggtaaagaggtgaagaaatttgcctgaagtttcatagctaggaagtggcagggaggtaatgtgagccagggtaccatgaggacaataagggaggattgccacacagtgtgaggcatggtctctactgagaatagaaactcagcttctatttctggctcagataaacgggtgacttctgctcctcaagaattctgttggtaaaatgggctgcacacagcgtacaacagcatctgaaataggagttaaagcaagtatagaactttcgctgatgttattaatcatattttttaaagttgacttccctctctgtgtcaggccctggctgagcac

SEQ ID NO: 108235 - DNA, 1043 bp, Homo sapiens
tttggcctggaaaatactctcaccctggggctaggaagacctcggtttgtacaaacttcctcaaatgcagagcctgagggctctccccacctcctcaccaaccctctgcgtggcatagccctagcctcagcgggcagtggatgctggggctgggcatgcagggagaggctgggtggtgtcatctggtaacgcagccaccaaacaatgaagcgacactgattccacaaggtgcatctgcatccccatctgatccattccatcctgtcacccagccatgcagacgtttatgatccccttttccagggagggaatgtgaagccccagaaagggccagcgctcggcagccaccttggctgttcccaagtccctcacaggcagggtctccctacctgcctgtcctcaggtacatccccgagggcctgcagtgctcgtgtggaatcgactactacacgctcaagccggaggtcaacaacgagtcttttgtcatctacatgttcgtggtccacttcaccatccccatgattatcatctttttctgctatgggcagctcgtcttcaccgtcaaggaggtacgggccggggggtgggcggcctcacggctctgagggtccagcccccagcatgcatctgcggctcctgctccctggaggagccatggtctggacccgggtcccgtgtcctgcaggccgctgcccagcagcaggagtcagccaccacacagaaggcagagaaggaggtcacccgcatggtcatcatcatggtcatcgctttcctgatctgctgggtgccctacgccagcgtggcattctacatcttcacccaccagggctccaacttcggtcccatcttcatgaccatcccagcgttctttgccaagagcgccgccatctacaaccctgtcatctatatcatgatgaacaagcaggtgcctactgcgggtgggagggccccagtgccccaggccacaggcgctgcctgccaaggacaagctacttcccagggcaggggagggggctccatcagggttactggcagcagtcttg

SEQ ID NO: 108236 - DNA, 1482 bp, Homo sapiens
ctgtgtcgccgccaacggcattgacccagccttcctctgcagggccttgctgcctgggcactgacatagtgatggcagcaactcactgacctttctctcccactctccccctgcagaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttggtgggtgggaatgggggcagagaccccgtgtcaggcgcttcagccggggctggcccctgccttgacgggaaacactcctttcacctggcatgggtgcatgaatgtggggacactgagaggatccaatgaggccccctcagcaagaagctcttactctgtaggagacaagtcctgcagtgtgagtgaactacggacaacagcaaaaagccttcaggaaaggcttcctaattcctaaaggagggatgctggagtagggttggtttgtttgtttgtttttgagacgggatctcattctgtcacccaggctggagtgcagtggcgcaatctcagctcactgcagcctcgacctcctgggctcaagtgatcccctcatttcagcctcctgagtagctgggactacaggagtgcaccaccacatccagctaattttactttttgtaaagatagtgtcatgctgtgctgcccaggctggtcttgaactcctgggctcaagcgatcctcctgcctcatcctcccaaagtgctgggattacaggtgtgagccaccgcgcggggcctggagtgggttttataggagtcttggttaggccaagggtttcatcagcaattgtaacatgaacagccttgcagacaaggccatttccagagctcctcctctgtgccctccaccctggcaccttctctttgtaccctcacactctcccccagctctttcctgccctccccattttacagatgggaaaatggaggctcagagagaggtatggcttgcctcagtttacatggagagagcgagaggcctctccctatgtggctgggccggtacctacccctcaggcccagctccctgcccggaccctgatggcctgtcccttgtcccccagagtggttcgcctccagcacacagagctacatccttcgggacctggacgacacctcagtggtggaagacggccgcaagaagcttaacacgctggcccattacaaggtgcagccctgccccccgcccccatttccccaccctcatgcccccaccccaacctccggcctctgacctcggcctctcccctcccatcagatccctgaaggtgcctccctggccatgagtctcatagacaagaaggacaacacactgggccgaggtagtgcgggtgcacgtgggaagggagcccaggctgcgtgtggacaggggcttccatcccatgcccca

SEQ ID NO: 108237 - DNA, 1048 bp, Homo sapiens
atcttaaaacagtcctttaatatgaaccaacaatctggagcacaccgaagggcaatctaaattgtggcttgaaggactgcactaaaacccactaaaaagatgcgaaaacctgatgagggcaaaccagttaaacctaacaccctgccttgtctgggctcatcacctctccctatcccagactaactttactgtgaaatcctaccacattccatgtctgaatttttggattcggggtggattttcgttgtccgtggaagaacacatggatctctctggctttctcacccaagttggccacttacgctaatcctggaagtatgatcacttttgaacctgccccttaaccttgacgaggatacaaaagtgaaagcatcatcccccaaaggatcactgcacagtcctactacagtatttttaagtagccctctaaatacttaattttaagcaaaatcccttggccgcacttttaaggtttttttatatgtgtatagttaccaacctaaaaataaaaaatccgaacagcatacttgaagaatgtaatactcaaactctcagtgcttccttatggtttctaataggattttttattattgttattattattattgggtttttttggacagggttgggagggtcttttatttttcctttgaaataaagaagtgatgtttttaaatgaagaaatgtgtggatatttaagtgtgctgctccctcttgtcttgaaacagtttgagtaagaaagtcttgctgtaaatgctgccctctgccgcctttgttttgagatgcagtttaaactccctctggctgctgctgctgctttttggtgtcccgacatacctacgcccccgttttatgggtttggcttagttgaagaggaaagggttgtgcaaggagagcaggaggctgtttccaaaaaccagtgtagtaggatagggattttttttttttttttttgccccaagaaaacgttcacccagtgatcttgggctggggttgtctttaggaaaagttgagactataagagtcataaataagtccttgtgtttcc

SEQ ID NO: 108238 - DNA, 1060 bp, Homo sapiens
cattttaagcattttggggaaatttctctgccttcttttacaaagtacactgaatctaacttaatggaaagagcttagatatggtagtattcagcttagagtgatactctcaggttagtgaagctgtccatttatgtgcctctacagtaaatggccctaggcttttttcagtttgtctgctttttttatagttttttctcctttccatttcttctccacactgttagtgagctacccgcagcagcctctctttactaattctacttctactctgttgtaggctttgctttttgtgtaggaagaaagtaggctgtggatggacttcacagatccttctgtgaccaagaaccagttaatgcatgcgtggatgctcaggatacattttttttctacgctttagtttattttactagtatctgagttgatgagagggaggccatgcacagtgttgctgtttgttatttgatgatgatggtgacaaggccactaccacgaacagtgttaaactcctgtgatgtgcctagtgctagatgttttacgtacatttgccaatcctcacagtaggccctacaggtaaattgtattattcccattttaaagatgaggaaattgaagctcagtggggttttaaaagttgccagaggtcactcagtaagtggtaaagccaggattcaaaacccagttttgtctgacttcaaattcagtgttattttcataccaggatgatttttttcaaagctcaatcccgaaatctatatggttgaaagcctagctctctgaagcattagatgcattggcagtgggtattaggcctatcccaagttgaagtaaatgtttactaaaagttgagtcactgtttttaacatattttataaaaatgctatgaatatgcaagctctggaaagtttcctaggccagtacagcagtgtaaataaataggtgaaaccttcttaaggaaatccctacttcggtcattatttccccttctcagaatcccttctcaataatgtccttcgcttaatgtgtttccattgctgtctacccaagtgagtagctccaa

SEQ ID NO: 108239 - DNA, 1068 bp, Homo sapiens
gccacagctcctctgcagtttggaagctggaacaaatggaaagagcttatagccaagagaggttgtgatttttttttttttaccatccaagctttctctggcagtgcacaaatgaaggatgagctttgtggcaagcaaaatcagcagactgcctgacagggggttttggtaagataaatgtgttgtgatttttttcttattttttgacttttctatatcagctgtatggaattgcttcttagcaataactaaaacattttgcaaaatcatgtttgatggaaaaggatgaccaagggaaccagaaggagaaacataacttgtggtcattcagttgtgaccttcagagataatccaagttttctcatgtgtctctcaacagacagaagccagaaatttccagagcaaagaatgcagactaacaaacctcttttcttttctttgaatagtcataattatgcttttttttccctgctttttctatagtctgaagcgggagaaggaaaaataaagccttcctcctgttatagagttgttgccactggaacagtaataggctgagaacataagtatggaggtggaggaaggcaggataaggagtctgctattttcatagctgtgcgttggtgggtatttgtcttgggttcattgtcattgctgtttgatatcaagtggttgtgaatgctgtatctctttgcctctactatgactgaatctcttttatgttctcttttgtatattttctttgccagactcaattctattgatatgaagcctttttctgttactgtttatacatattagccgttattagagaaaaaatagttgtagagagtagccctccaatatttatggacctcaaaaaagataaggatgttgtttttctctttaaaatgtatgttttacttttagcagattttggagtcttgcttctggattctttaataagtgttttattacaaattagagaaatgagttgcattagatttgcaaaatcctaccagaatcaccttgctttaagttggatcttatttcttatgttttttttctaaacattaaagtttacttttc

SEQ ID NO: 108240 - DNA, 1403 bp, Homo sapiens
accggttttgtggaagacaatttttccacagatggggtcggggtgtctgtgggcaaggttggagtgggatggtttggggatgaaactgttcacctcaggtcatcaggcattagttagattatcataaggagcatgcaacctagatccctcgcaagcgcagttcataatagggtttgtgctcctatgagaagctgatgccaccactgatctgacaggaggtggagctcaggtggtaatactcgcttgctgctcacctcctactgtgtggcctggttcctaacaggccactgacctgtactggtctgcggcccaggggttggggatccctggattaaactatttccttgcttccctacctttgtctctctcttacctgaactatttattgattggtaaactaaaatattctcattgaaacaatgattaaaatgttcacaaatgaggtacttgcccctagtatctaaaacttttaatataacaatctagatacataaaactgctatagatagggtttcatatatgacctccttgcatgagattgcacacgctttgtgttttttgtttgtttgtttttgagacggagtctcgctctgtcgcccaggctggagtgcagtggcgccatctcggctcactgcaagctctgcctcctgggttcacgcgattctcctgcctcagcctcacgagtagctgggactacaggtgcctgccaccacgcccagctaattttttttttttttttttttttgtatttttagtagagttggggtttcacggtgttagccaggatagtcccaatctcctgacctcgtgatctgcctgcctcggcctcccaaagtgctgggattatagacatgagccactacacccggcctgcacatgctttgtgaagagttcattccaaattacagaatgaacattttgaaggcaggatttgagaagaaaaaatgtagctgactctgtggtcccagctacttggaaggctgaaatgggaggatcacttgaatcccggggcagggtagggcagtggaggttgcagtgagctaaattaccactgcgctccagcctgggtgacagagcaagatcctttctcaaaataaataaatacaataaagcagggtaagaggaattggaagtgctggacattgagggtagactgccatttttaatagaacagtaagcataagcttcatttaaaacaagacatttgaaggaaggcttgaaagaggagagcaggttagccgttcagctgaggaatgagcattccaggcaggggtacagccagaataactgcaggagttttcacagtgtttacaaggaattaaaaagaggttagttggtatgattagagcaataattaagagagggaagagtggcaggaattgggagtgtgagagatttaatac

SEQ ID NO: 108241 - DNA, 1714 bp, Homo sapiens
tgcccaggaacagatcagatcagaatcagtatgttgtttatgatacagatcaaattaactaatgattcttccagttttcttcttcctgattatttcctccagacacaaaatagggtcaaggagaaaagttcttttctaccattaaacttttgagctgcctgtgtttgggattcaaagtattttgggtgcttattgcttaactgggctgaagattatctcatgtgacaccatagatctcttgttttggaattgccattactttctagaacaggcattctgtacagctgccaacatgccctgaatcctcttgcttcatattacagtgatactgctttgtcagggtagaattcagcctcacagggctggagtaagtctctgctgacctcatgccacagtacaacatgttcaaatctgggagaaacctgagggttattcggcatattcctcctcctcctctctcacaagcatggagccctcactctcctcggaaaccgtatgttgtatatgtgtgtgtatctgtcttttaaaaaaaaaaaaaaaaaaatctcatcctgaatcctatagttagttagtcctgcagctttaagtgggggctggttgaatagacagacaaaggaaatagcctgagctgctgaaacttagcgtttttcagcagtagatctcagccaggggcatttgctattttaggactgacttgtgtaaggttgtaataatggagaagcataatatgtgtttcctagttgttcattttacccaaagctatttggacagaatgtagagggtgctctgtagctgtatggacatgctcagatcatcctggagtgtcccgtctcttgtgtgtaatgggctgcttcattgcagagtaagtgtcatcctcactttctcaagcgaaatagttactggaaaatcagtgtttctttcaatgaacaagagtttcatttgccttggactgcttgggaaaaacatgggttaaattcgaagatgccaggcatgcataacaaataggaatttgatttagagccacctggaatacttattaaattaaaaaaaaaaaattcttgatggatctaggtggccaaaaaaaaaaaaaaaaaaagaaaaagatttcttagtgctcagctacttattttcaaagtatttttcccaaggacttggaaattttctgaattgtaaagcaatatacacatatctcagtgtgaaacttgtatctccagatcagcagaacaaatctctgagataaaactggattggaggatgatccagctttattcaacacaaccaccattttcacatttcatccatagtcctgagtacaaacttagcctatagtttgattttaccattttttttagttgaccttgccattttttagttgatcttataaatgatacatattttctaagagataaatactaaagcaaaggagattctttatagttttgcctgattctgaagttaatgtacattcatattgtttgctattgagcagttggatttaagatccaaacagatttttcactgtgaagtttgatattgaattaccctcttatgccttatggttgataatttaaatgccaactttttaagcagatttgtgcctctggtctgtaccctctttttctgttgtttgctatatatcttggattcaaaacccctgacacatctctgtttgttctgaggttataaaaggtcagtttacttatctattttatta

SEQ ID NO: 108242 - DNA, 1022 bp, Homo sapiens
tggctcatgtctgtaatcccagcactttgggaggctgaggcgggaggatcacttaaggccaggtgtttgagaccagcgtgggcaacaaagaaagaccccatctggctttttttctttccttttttttttttagggagagtctcactgtgttgcccaggctggagtgcagtggcacaatctcggctcccgagtagctgggattatatgcaggtgccaccacactcagctaatttttttatatttttagtagagacggggttttaccatgttggccaggctggtctcgaactcctgacttcaggtgatccacccgcctcggcctcccaaagtgctgggatttacaggtgtgagccaccatgcctggtcccatcttacttttttaaaatgagaaaagattcagctgtgtctatttaaaggcttctctctctctctcctttgggaaggacatgctttgtgcagctaaaatggagaaagagtggctaagatccttaggatccagaatgtctggcaacaagccctagtggctgcaatcacaactataaacatacagcatttcccatcagggcatttgctctgaagaggaggattcttgtggaaacaagtaggcttagagaaatgcaaaactactcttggcacaggctgagctgcggagtgaagcgctcagtttagcactgtggctgagaagctgttggtgttattctctgtgctcacaagagaaggtgtacagttggtgtaggatatgacaacaaaatgttttataatctcatcatacaagcccaagagaagagtgaatttcaagaagtgtgagtgcatgtttaaaattgtaacgaagtttttttctctttgtttttgtacttttgaataaaaatcttcctagtagatagcagtgcctccagaaatggtagctgataccttgaaatctagtttaatttcatttagcacatgacagtgcagtgcatgtcttacaagaaatttttattctctccattattactcaatatgtctacatctccccttgaaat

SEQ ID NO: 108243 - DNA, 1504 bp, Homo sapiens
atcctggctattatgtttaatttctttttcttttttttcgagacagggtcttgccctgtcacccaggttggagtgcagtggcatgatcatagctcactgcagccttgaactcttgggctcagacagtcctcccacctcaggctcctcccaagtagctgaaactgcaggcatgtaccaccacacctggctaattaaaacatttttgttgttgtggttaagatgtggtggtggggttgtcatgctttgttgcccaggcaggtctcgaacttgcgggctcaagtgatcctcctgcctcagcctcccaaagtgctggaattacaaatgtgagccaccacacccagccttcaatttcttatctgcatacacccccaccaagccagcaaatgtcattgattctactttctaaatattctcgagtagcaggtattgttcagtgagtactcttgtctctgtccccagcatagtacctggatccctgcagcagtcttctagtggtctccttgccttctatattatcccccctgtctaattcattctggatgctgcagacaggtttaattatggcatttttctgctgaaaattcttcattacctcccttaggataaagttcaaacttcctaacatgatctgtagagattctttatgacctggcctctgctcttcagcctcacattttaccattcacacccttgctccccacagccacacaaaactactatttatttcttagtagtctagctgttttacactcgttcccttttcctggtcttcccattgcctattctcacttccatttccccacaaaacaagcacacattaaaaaagaaactcctaaggtcccttgggtcttagcctaggtgtcatttctccaaagaggtttctgatctgccagctctaggttagttgcccctcttttgtattctcttagtaccctgtattagttccaaccatgatactgtctcactgttttgaattgtgtctgttttccactagactgaaagcttcatgagggcagggacagtatcttccatgttcaccattttatttccagcttctagattcttaacatacatttattgaaggtgagctgtgggaagaaaggtagtatattaatagaatattcatagcatttttttaggtatgataatttatacagcctattgatacttttctagaaagaatattaaacatatttagttcataaggaaactgatacctctgtactatataataaactggtcagtgccctaaatattattctcagaagtggcccataagtcttttccacatgacccagcagtgtatatgtaatcacaaaagccaagaaacaaaggtgtttcagcttgatatctttcctcctccagacctagaattggctacatttctccaaggagccctggtttctttcagtggaaaataatatttagagaccatttaaagcatgaggtatgctcattactgttatgttgtgccaatatgacaactgaaaacagttaatttttt

SEQ ID NO: 108244 - DNA, 1004 bp, Homo sapiens
aggccaaggtaggcagattatttgagcccaggagttcgagaacagcctgggcaacaaggcaaaaccctatctctacaaaaatacaaaacaatagccaggcgtggtggcctgtgcccacaatctcagctacttgggaggctgaagtgggaggatttcctgagcccaggaggttgaggctgcagagaactgagattgtatcactgtactccaacctgggtgacagagcaacaccctgtctccaaaataaataaataaataaataaataaaaaggtgactttcgatattaaggcttagtcttcttaattttaatatggtgaaggaaacctggcttaaggtatataactccagcctggtttttagcatgtcttatatttaaatattactttgaaccatgtgaaattgccaatactggagcagtttttggctcacaaaagtggtgattttatatgatgcaccataatgaagtaccataacagcttagttaaaagattcttctgtccaatataggaattcattccgtagcattcttggaaacattctggtaggagaaaaggatgaggtaaaatggggatttttcatatcaagtaagggggagagttgaggtccccattgagtacaactagtaggtcctagagctgcattagggttcctgtggtgtgctataagctctatgctactgaggctgaaggctgtaaattcattgatgtgacaattagatataccgtgcccacaaatctgaatactaccacatactctccaaatacctggctgacaagctatggacctgtataggatttcagcaaatttcaatttagccaaaatagtattacttaatttagtttactctgtgtataattttcctatgtgtttccttaggttagtagttgaacttcaaaatgataataaaactgtcctggggtttaaaacattgtaaaaataaaatatgcaacaacaatagccaaaggggtcaggggaggcctaatggaggtaaaaggccttgtat

SEQ ID NO: 108245 - DNA, 1081 bp, Homo sapiens
ccagcctgatttttgctcatagttctgtatcagtatcttttgttgccttagggtgcagagatgtgtggattagtacagaaattcaagacaagtttgactttcacatgttgttttcattgttatgaggatttgtagctctaatgtttttctacataaaatcagtaaaactaaataaaatcagggtccttatttagatgagtaacttgctttgtcacatcaagattaaatgtactgttttagtgggatttacctaaaaagaggtaaaaaaagaattggctactactgaaaccgggaaaattgtttgcaaaatgcattaatgttcagtatggaaaataccaaaagctattcttttttgcaggatttcagtactttaactaaatgtttttctataaatactgtctttacctctctctctcttcttttgcaccctggagattttttttttcttcctgtcagtttgtatctcttatcatttactgtctgtggcttcacaatactgtattgttacagtaccatttaaaaaattacagctggaagctctgaaatgcatcctgacaaaggaaggctgaattgtgtggctttaggccaacagtaagctacaggaacaaatgaaattaagaagttaatattatttcagatatgtgtttgtgtccttagtcttacagagaattattaaaaccaggaatttaaaagtcatatctgctttccaacactaggagtatgaaacattttacttgcttgtgaatcttctattttaaatgttattttttgtgaacaactttctgtagatttatttaatataatcttccagaatttttttttttttttttttttgagatggaatcttggtctgtcgcctaggctggagtgcagtggcgcgatctcagctcactgcaagctccacctcctgggttcacaccactctcctgcctcagcctcccaagtagctgggactacaggtgcctgccaccacacccagctaactttttgtatttttagtagagatgcggtttcactgtgttagccaggatggttagccaggtcaggatctcctgacctcgtgatctgggattacaggtgt

SEQ ID NO: 108246 - DNA, 1054 bp, Homo sapiens
ggagcttctaaagggaaagtttggaagttatggattcaggttctctattaaggttaatatcacttcagagctcactatatcatcttcttatttatagccagatttaggaaaagcagtgtatattaggctgcaatgagggaagctttttggattacttataggcagaaggaaagggaaatttttgtaatgcctggctgtacctggaagatagagaaaagtggaagaagtttgagggagatgtatgtgttcaaataaaaagatttctaagtttgaattagttgaactgtaagcaaaactagtaatgcaggtgtactgttctcccagtggggaagaaatgaagcggggaaaaggataattcattttgttgaccaccaggtggtgccctaggtgaggattggtaggtggaagtgaggggatggatgcctgacaggacattgattaaccccggggtgataatttaattagtacaggaagtcattaggatgtgggctagcttgagcacagtgactattaaatagtgatagtgctcttataaatattgagctgaattgataactgtggaagtggaatggacaatagaagaacaggtaggatttgataacaatgttagaataaaaaattttaaaatctgaagtttgcttgggagaatcagaaaatattttccatttccactaaacagttgaaaaattgtattttttaaggaaaaccatttagtttcagttgggtggctgacacctactatgaagagaatgtcttataggcctttaataatacggaactggaacagtgggcataagttagaaatgaagatgtattttggctttctcattgttctcccttaaagatactttacgtagcaaaacttgattgccaaagcaagtaacttacaggtttattgaccctacctctgaaagccagaatgtttatggctatgtcctttcccccaatactgagtttcctttaatataaatatgtattcattggccccaaagatattttgattatccttaatgatctcatgtgggcatcaaatatagttcttgtaagagtagaa

SEQ ID NO: 108247 - DNA, 1059 bp, Homo sapiens
gtttggccagtagcatgtttttctttgttttaacactggagtttctgcatggatttataatataaggttttttttttgtttttttgtttttttgtttttaacattagataggcatgaagccttcgtctcacagctgcatgcgtagtcactgttgaagcaaatgcctacctaatttgacactcttggtgtgtttaaaaaatttttttgagtttgcaaataagcatattaagtctactgatggagccttcgggcagtgaacagttatttgaggaccctgatcctggaggcaaatcccaagatgcagaggccagaaagcagacagaatcagaacaaaaattgtctaaaatgacccacaatgctttggagaacattaacgtgattggccaaggcttgaagcatctcttccagcaccagcgcaggaggtcatcagtgtctccacatgatgtgcagcaaattcaggcagatccagaacctgaaatggatctggaaagccagaacgcatgtgctgagattgatggtgtccccacccaccccacagctctgaatcgtgtcctgcagcagattcgagtgccacccaagatgaagagagggacaagcttgcatagtaggcggggcaagccagaggccccaaagggaagtccccaaatcaacaggaagtctggtcaggagatgacagctgttatgcagtcaggccgacccaggtcttcatccacaactgatgcacctaccagctctgctatgatggaaatagcttgtgctgctgctgctgctgctgctgcatgtctaccaggagaggagggaactgcggagcgggtaagtttgtaagattttgtttttctgttaacttactgtttttcatacctaggactctccagactttcctttggtaactaaaaagatatctcagcaaataccttaaagttgtggtaaaagaatttttccccttttcaaatgggtaaataataattatagctaatgaatgaatgcttagaattatattcctatttccttcctaacatagtgctatattttattttatcctttcgttaaaaccttaag

SEQ ID NO: 108248 - DNA, 1183 bp, Homo sapiens
ttctgtaatcttgttctctcttcttttttggatttgagtattttaattctttctcctttctatttagtgtgtttgttttccctctggagtaacattagttaccagttacctgtccaccattccagaatgaaatagtctgtgcatatgcagtatgtactcactcctttaaaagtagtagcatgatatatacatggttctgcactttggattttttaaataaatacactttttaaaaacatattgcagattgcttgccgcttttacactcttggacagtacaagaaccttggaaccctgtgactcccaagtatatgctcttgattatgtatttttgttctttatagaaacctcatcacacgttattattgctttaataattaaatgttgtttgatatatctctctttctggattctaaaacagagtatctgtctccttggtgatgggttgctaggtggggctggttcagctagataattaggaaaaactaagcatatgctaacagatgggaaaagcctgtcattaaaatatatatatatatatatgaaagagtgagagaaaccgtgactgaattttttttatgtttggaaaagaaaaacttattcacagcatgaaaacacagccatgaataggaaacagtggtcataataagatcttcactaaggaccttaggaaaaaggatttcaagaggatcaaaggaaagagggagaagctttcttgggtagttaaaacgtttccattttattgtggcataaatgaggtgcaaaagaaaggaaaactgaaatttcatagttgtaacatcttcggccagggtggtgagagagtagagaaatatttaagcaggtctaaaggaataagagacatcttaccaaggctggatgcaaggaaatagctctcacaaccgtctagagggagcccataggatttgctaaaaggcaatcaatttctttggggctaaatgaagtatggatgacatttaattgttgaaataagatgcaggaggatgaattggatgattgtactcgtaatacgtttccagctgagaactataaatactcattttatcagatgcttttttagcatctgtcgcaatggtatgaggaattcctgttgactcttcagtactttgtgcgctcattcctttccattaacttttttattccattcccagccatactaatgggc

SEQ ID NO: 108249 - DNA, 1900 bp, Homo sapiens
ccagccgatatagagatacttacaaataaatgcactagtctaatccttattaaatcttgctctgttaaatttatgatcatgatgtggtacatgtttaatagtagtagtagcagtaagaaaaagttatagtagctcttagtattcttttgtgccaggctgtatattaagtgttttccatgtgcatattgtgtcatttattctttacaataagactgtagaatgggcaatatttttatctccattttggaaatcaagtaatttgctcaaggaccaacaattagtagaggagcgagccatagtagcagaatgtttcaatgatgtaggaagtcaggtcataagaggaatgaaggtgggggagggagtattagatttgaagagttaagtgtgaaatagtccttcatgagaatatgggagtgaatagactagagaaacatagtcagattacagaatagaatcaaatgctcatttgaggttagtggacatgaatttaaagtttcattggttggcacggatttgtgtattttcttgtactttcaactgcacagtgtactttcaactataagggttcaggtatggaatcagagttagattggcaggattggggttttgccagttgtttgaggaaaggaggccaaggaagctaagggtgtgcaagggaatgtttataatgatggctcatataatctaagctaggggacttattataggagaaggggttaaatagaatggaagtggagttatttttatcctgtgtatattcactcttttcaacagatggtcctagaacaattggagattcatacgcacacaaagaacctcaacccttacctcacaccagacacaaaagctaccttcaaataaatcataggcctaacttgaagagctaaaaccatgcaactccagaaagtttttgtcagaaagaaaatacaggagaaaatcttagtgaccttggggtaggcaaagatttcttaagacacaaaaagcatgaagtataaaggggaaaaaatcgctaaattggatttcatccaagttaaaaacttttaatctttgaaagatacctttaagaaaatgaaaaagtacgccttgggctgggagaaaatatttgcagaacgtgtgtctgacagaggatgtgtatctagaagatataaagaattgtaactcaagaattgaaagacaaccccataagaaaagggggaaacaatttgaataaagttcatcaaagaatataaatggcaaataagcacatgaaaagatgcccaaagtcgtaagtcattagggaaatataaatttaaaccataatgagataccactgcatactccctagaatggctgtaatgaataggattagtcacatggtgacaagaatggaggatcatctggaactctcatacactgacgataggaatgtgaaatggatcaactactttggaagacaattgggcagtttctttcaaagtaaatgtgaagatgccatacgattcatccattccatttctaattattcaagagaaatgaaactgtatatccacaaaaaagacttgtacacaaacattcacagcagctattatttattggtaatagctaaaaactgtaaacagctcccatatccatcaagtgtatggataaacaaatttggtgtatttatacaatggaatactactcggcaataaaaagaacagttgatactctcaacaacctagatggacctcaaaataattcggtttaatgaatgaagccaaacttaagaagagtacattgtatgtacttggagaactaacttcttgcaatagatttttaagcactattaggagcatatgacttaaacagtttttaaaagtcagggagtaagtatgcttaaataaaatacaatctgtgaaacaaatctctgaattattatcac

SEQ ID NO: 108250 - DNA, 1315 bp, Homo sapiens
ctgaggcaggagaattgcttgaacccgggaggcagaggttgcggtgagctgagatcgagccattgcactccagcctgggcaacaagagcgaaactctgtctcaaaaaaaaaaaaaaaacatatatatatataaaatatatattatgtatatataatatatattatgtatatatgtatatataatatatgtatatattatatattatgtatatatgtatatatattatatatgtataatatatattatatatatgtatgtatgtatatagctgtgggtctttgtacaccattaggaaacaaatgagagatgaagtctctaaagcataatgtgtatttatttcataatcgtaagtttagaaatcagtaggataaaggtcagattgggtgtcagggcatccagaatagtgggtgtattccattttgatctgcatatcttattctgttgttgattaagagcagtgagagtccataaactatggtatatgatagctgtgatctctgatacaagcttcatgtagatgacactcaaatctgcacattcagcttgcacttccctactgcctgctggacatctgcattttgagatcccgctggttcctgaaacctagtgtgtcttctaccaaagtcattggcattttgcagtgatatttttttgcattcccataaacctatacctcctctagttttacttatcttgattaatggcccatcattcatttagccaaccagtctacaaaacttggggttttctttaatttctttcttttttacttctgaaacatgtcttccctgttgaaccttaagagtgttcatttattcactcattcactcgtttattctgacatttattaagcatctattatgtgccagacattatgcaaggaattaaggatatagtggaaaataagatcaattttctgctcttacagaccttatagttcaagctttcatcattttctccctatcctctttgggctattttgatagccatccatattttttctggttataaacataatacatccttattttaagaagtgcaaggatgccaggagtggtggctcacgcctgtaatcccagcactttgggagtctgaggcaggtgggtcacttgagcccacgagtttgaaacaagcctgggcaacatggcaaaaccccgtctctataaaaaaaaaaaaaaatgatgtggtgtcatgtacctgtacttccagtgggagctgaggtgggaagatctcttgagcctgggaggtggaggttgcagtgagcccggattgcgccttgcaccactacagggaaaaaaaaatgaatgagaagcc

SEQ ID NO: 108251 - DNA, 1049 bp, Homo sapiens
tagcaattatcaaaagaatgaaggtataactttaaggaccaatgatattttaaactttttttttttttttttgagatgaaatcttgctcttgttccccaggctggagtgcagtggtgtgatctcggctcactgcaaccccgtctcccaggttcaagcaattctcctgcctcagcctcccaggtagctgggattacaggcatgtgccatcacacccagctagttttttgtatttttaatagagacggggtttctccgtgttggtcaggctggttttaaactcccaatctcaggtgatccgcccgccttggcctcccaaagtgctgggattacgggcgtgagccacggcaccggccctattttattattctttggtaaaagtatccagtctatgtagcatactcagccagatgagcttatgtaaataaccaaagtgggtgggtgtggttagacataacttattcttggcttttatggaagacctctttttcttcatttgtttattaaaaaaaatatgtattgcttactttcatatttgttggccctgttgtaggtgttggagatacagtggataaaagtttctaccctaatggagtttatgttttagtggaaatgaaataacagattggggccaagacttgttagtggtctcacactggtatgagtaatcttttttgggtgtgtttgtgttgttttttttttttttttttttttttttgagatggagtcctcctctgtcccctaggctgaagtgcagtggtgcgatcttggctgactgcaacctctgcctccagggttcaagcgattctcctgcctcagctgccaagtagctgggattacaggcgccggctacctcacccagctaattctttttcgtatttttagtagagacagggtttcgccatgttggccaggctggtttcgaactcctgaccttaggtgatcacctgcctcagcctcccacagtgctgggattacaggtgtgagccaccgcacctggccattttttttttttttaaatagcaatggaatcttgctgtattgctcaggc

SEQ ID NO: 108252 - DNA, 2287 bp, Homo sapiens
ctccgctcccacttgccccccattctctctctctctctctttctctctctctctctcttgctctactctcgcccgtctgcgttctacattggttctgcggccgtgtccctttcgtgtgtgtctgccctgtgtttctccgtcgtctccgtgtggatctcggtctttgtctcgccctctagctctctcgtgcgcctgtgtttaatcgtgcgcttctctcaatctctctgtccctccctttgccccctacacgcgtgttctcgtcaacagatctccagaggtggtgcagaaacgaccccgcgccggcgccccatcctgcggccagtgcctccgcgccccggctccggtccccaccgtccccgccccagatttccggaggagcaggcgggcggggtcccgcggggccggctgccgtcagcgccccttcccggcggccgcgacccctccccgctgacctcactcgagccgccgcctggcgcagatataagcggcggcccatctgaagagggctcggcaggcgcccggggtcctcagcgctgcagactcctgacctgccgactgcggatcccgagtccccggatcccggacccatcctgtggagcccactcctggcaggtaaccgccccaacccctctccttccgcagacggtgtccgggagcactggaaagggagccctctcggcccgccctcaccttcggttctctgagagcttcctggagaacagggccggtgcacaggcgggcgctgtgctcgcacccccgggtcctccccgagcgcaggccggggacccgacgggaggcacggcgcgggcacatcggaggctctcgctgctgggcactcaggtcgccagagtccgcagcgcggggtgggagctccgcggcaccccctgcctgggtgccgccggacagagctgggtattcagggcgtcggcctgagaacctgggagttcgaatcccaatctcaacgctagaaatagaattttagcgttgaagttaggattttagcgttagaatcagattcctggcttagtcatgaaagcttagcattagaaatagaatcttagctttgcaaatagactttgagctttagaacctgaatcttagcgatagaaatgggatcttcgcgttggaatgaggacgtcggccacggagcttggagttagaacgtggcgatggggacctttgggggagtcttggcggggacgcaaccgttagcgtcgcggctgtgcctggcgctgcaatctcaatggttgcactcccggcgaggcagtcccagcgttggcttccccagttccgcgtcacattgaagggtggcggtggcgctggcgatggggttcctacggcctcctgccttgcgcaagcagaactgggcgcaggcactacaggcacccgtgggggcgaggacgcctagaggtgacaggtgtggacgcagagccggggcgaacccgccgctgctcccgcccctgcacgaggggcagtggtcctgcttctgggagggcggttgaactgtgcgtggtttgtttctggcgggcgtcgggggagatggagcgggatgtgctgtgattcggtgcgctcaggctccctctgtcccctaacccagacgccgcgatgcccggcccttggttgctgctcgctctggctttgaccctgaacctgaccggtgtccccggcggccgtgctcagccagaggcggcccagcaggaggcagtgacggccgcggagcatccgggcctggatgacttcctgcgccaggtggagcgcctcctcttcctccgggaaaacatccagcggctgcaaggggaccagggtgagcactccggtgagtggatggggctgttgggggctgtggggctaggctattgggagagccgtggaaacctgccggcaaaggggaggggaggcttggtcagctagccttctgcctttcggaagctcagaaaccctccctggctgcgcctaggcgggatctggagttgaccattcctcggggtcagattcctcccctgtctcaatgctgggaatatttcacagagagcaggccctgggtggggaagcttctgtgtgctagggagagagtttctttgtgtgtgacagtttgaattactactgtctaggcacttctgtgccagacactattccaagcacttcaaacaccttatcacactgtttgatcttcctaacaacctcttagttaggtactgttattacgattttacacagaagaaaactgaggctcccagagatcaattgagtcgcttatggtcagacaactagggagcgccagagctgg

SEQ ID NO: 108253 - DNA, 1605 bp, Homo sapiens
ctgtgggaccccacaaacggcagcaccctggccgacgagaagatgaggcttcatggtcagtcgatgtaacccagcacaagcggcagcatcctggccggcgctccccctggcttgcatatgctgtcccgaagcggcagcacccaggcagaaggctggcagatcccaaggctcaaaggagctgggaagaagaggaggaggaggaagagagagaggaagacctgatgcctgaaaaacgccagcatccgggcaagagggccctgggaggcccctgtgggccccagggagcctatggtcaagcgggccttctgctggggctcctggatgacctgagtaggagccagggagctgaggaaaagcggcagcaccctggtcggcgggcagcctgggtcagagagcccctggaggagtgaacccagttttccctgaagtcgagtttgtggtctaaggatgtcttgagccctgtgtgccccaccattcatgacctctgtattctctagttagatccctgaccataagcctgagcccctccctcccagccccatattcacacacatcccagcccctggccttgccctcttcctttaggcatgtgagaaaatcagcctagcagtttaaaccccactttcctccacttagcaccataggcaagggggcagatcccagagcccctctcaccccccccaccacaggcctgctccttccttagccttggctaagatggtccttctgtgtcttgcaaagactccccaagtgggacagggagcccctgggagggcagccagtgagggtggggtgggactgaagcgttgtgtgcaaatccagcttccatcccctccccaacctggcaggattctccatgtgtaaacttcacccccaggacccaggatcttctcctttctgggcatccctttgtgggtgggcagagccctgacccacagctgtgttactgcttggagaagcatatgtaggggcataccctgtggtgttgtgctgtgtctggctgtgggataaatgtgtgtgggaatattgaaacatcgcctaggaattgtggtttgtatataaccctctaagcccctatcccttgtcgatgacagtcatcctaatgataataaaacctgcatccagataatcacggagctctgtggttgctgttctgtcgcagctggcatgggattcttctttcgcattgagagggatatttaaaaggggatgggactagagttctcagctctgctgcagagggaatcagggaccctgggaggatgacaagtcctctctactgtccccatttcagaacacacttgggaggtggatggggttctggagcccatttgactcctggggagactaaggcctggagagaaggaagggcttgcccaaagacacacagctggctgaggtggagccatgggtctgagaggccagctcagggatttgccttgagtttgcctgatttgggaggcgggggtggtggtgagaggggaggtttgaggggaggactagtctggctcaggtctgtaatcttcatggttctgttgacagcttgtgtcaccaaacagcctgttaatgaacaggaacaaggagggcagaggaccaggctgcagt

SEQ ID NO: 108254 - DNA, 1082 bp, Homo sapiens
cccgcaagcattaggagggtcaccttctgcaagaggggcttcagagctgagtgcaaggacaaaagctagctccagatgttgtcagattctccccaaactcacggccacatctgcagaaactgcaaccaagttggaggaagggacttgcttagaatgcctaatgatttcacaagtttgactttattgggggggggtgactaaaatgtattgttctctctttcttcccagggttctcaaggtctgaaaggcagcagaggacacaggggagaggatggaaaccctgtaagtttttattactccccctcaccccctgttgcacacacactgtacacacacacacacacacacaaacacacacttattttctttttcataaaaaaagcttattttcatacaaaaggggtagatggggttttgtttatatgtttatttttatatgttgatatgtttattttgtttatatgtttatttttgtgcttttttgtgggaagaagggttgcctttcttttcacttttccttgtctgaatgatgaggcagttactaagtctaagtttggggtaaggagggaacaggcttacacgtgtagcctggcatgtttttatcagtggcagatacctgggcaccctcctctctacccccaagcagggcacagcaggttatctgccagggagctctttttagacctaaaacccagtgcttagtacatggctttgggccaaggctggagtatacacccttccatggaaagggaagtcggcaaagcatccctcaagatgagaggcatggcttcacggtcaaatgctacacagaggtttgcgaatctctgtgtttgaaaccagaactctcactttctcatcaatcaaattgtgagaaagaatttgaagaaactgaaaccacttaggtggctctgttagggatggaaaaatttcagaaagcatccagactggatttctatcaccttagatcaagtccagttcctcatctgggcaggaagttttaaggattgaaagcaaagactctagagtcaggctgccaagagttggcctagatatgggtccttgaacaagatacctaacttctt

SEQ ID NO: 108255 - DNA, 1077 bp, Homo sapiens
agcagggtaagtatttctgtggacatttatttcccctccttgccacttgaagatgacagaggcattcagaatatttgttgtgcacagttggctgattcagggctgaaatatttttcagggcttctccatcttgacactactgaaatttggggccaataattatttcttgtgaatggctatgctatgcattgccagatgttttgcagcatccctggtctctacccactagtatcagtagcaccacccctccccactgcccacttgtgacattcacaagcgtctctaaatattgtcagatgtctgtggtggatgtagtagtggtgagtttgagaggcaaaatcacccctggttgaaacgactgtaacatagttggcctttccctttccaccttccaggtgttttgggatgtctttgaagagagccaatgattttgacacaaaagctctcctttggtagcttacataagaatactatgaactaggtaaatatactttcgctttacatgttgccaatgagaaagaggactcacaaacaaattcttcctaaatgggccaaagcactggcaattagggtcaagtggcaaccttgaggtgctggcataactttacagcatcccacgttatatcaagcctatcacagcaaaaaatggggatattggacttccatatctttttaaaaggagcaaccaagaaatcgcctttccttctgtagactactgaagctggaagtgatatttataatgtattaaaaactcctctctcatgcgctcagcatggacatcattagaagagaataatggacaaagtcctagatttggctctgagttttgttcaagaaggaattgaaaatgcttggatttcttttctagtacaaatttggaatcttattattttgaaggctgtggctgattgcccttctctctgggatagatggtgaagaaatgtgtttttataccacttgcctttgtttatcttgaaccacaattcttaaaggaaaagagctggagttggaaggggttaggctttccagtgcttctggtaaaattctttgggactttgccctcttcttcacacaaga

SEQ ID NO: 108256 - DNA, 1034 bp, Homo sapiens
aaactgctactcgacttgcttaaagctaactctacaggggtatcagtatttctgaaatatgactgatagggctttctgtgagccatttgcatctttcatggtcatatcattagtcatgtgagcaccggaagtcagagcatcattgtcttacttccctctgtgacagaaggggaagctgtggtcattctggagagtagcttcgtagcacatggttgtttagtcatcttatgaagcccactttacatgaagcccaccttaagcctggactcgtatggaagggcctgtgtagctgtgcctattctaaggtcttcccaggaattcattattttctagaaaattcaggtattaggaccaaactggaatttgggattctcttgagtggttctggggtccctgaaccaagctatgagctagcagtttctctagattgggtagggatgggaccagcctagatccattcccaggctttggggtggatgtgggggtggcaatgacagttacttcagatacctcagacacccgtgggtccctttgacactgagacagtgaatcaaggctcacctgatggctcctgggcagcccagggccagttcacagctggtacttcaataggaagaaacgttactgccacctctagtttttgcttctgtgtgagataaccgcatgagaaccacgtgtttgatggcaaatatggcagaaaaatagactttgattcttctgatagaggtctgctgctaagacgcccttttgtgctaacttgaaacaactttactctctactttacacattaataagggctttggctcaggtaacccgtccctttaaaggaattcatctgactgttgtttgtgtcttacttcctttgcttataggtttcatttcccgctttggcctatttttatttcctctgtagaagagggatgaaggtcttatatccaggccgggaattccttaaagagatctggaccactgagtccactgggcctgtcctcaatgactcttaatacatgcttaatctcagggttaaaaggctg

SEQ ID NO: 108257 - DNA, 1162 bp, Homo sapiens
gaggagctgggactacaggtgcacgccaccacaccctgctaatttttgtatttttagtagagacggggtttcaccatgttggccaggatggtcttgatctcctgaccttgtgatccacccgccttggcctcccaaagtgctgggattataggcgtgacccaccgcgcctggcctatacatcttttaattatattctatcccttttttcttttgatgttggcaaaagttaatatgcacagaatattgacctaagataagttttccatagttataagtggctactcatgaaatccaatgactaggaccctagaatgtcattttggctcctctactccttttgctcaatgtattcgtgaaagcatgactacaaaaggtgttaacttaaatacaacaacagtatctcagaagcaggactactgacgagaggaaaaatgtggtacagacttttaacctctggcttgctcccttttaatcaccaaacaggaaattcagaataagcagaaagtaggaccaagtgatgacacccctcgaaggggcccagagtccctgcccgtgggacatcatgacatcatcactgatgtcgccacattccagaccacacagggcttcatcgtaactgcttctagagatgggattgtgaaggtgtggaaataaaacctactgatttgtataaattttaatagttataaatataatactataactcgagaaaaggcatttctagagaacagattcatttgcttaattttcaaaattatgtctccatattactgtttcatgactgactgactaaatgacacccaaaatggttaagatgtacttgactagtttacttatgcatctctttgcaagaatcagccagccaacaatgtctgggatttttattgtatatgttatagaggtgagaaatgtaaaatatgaaaatgaatatgtttattttgtattgaaaaagatggttgaaaagatggttgtaagctattatagtataaacacatttttgctattaaaaatgctattcaaagcagttaaactgtattcatgcatcctaagagtttgtggttttggtggtatttttaaatggtaaatttaagcagaggaataatccctccattaagcagaggaataatctctccagcagcatttgttctaaggtgaagaaatg

SEQ ID NO: 108258 - DNA, 1071 bp, Homo sapiens
gttaagtagcttgaccaacatcatataagtagttggtagtagaagtccgtgattccaaagccaatgcttttccttctgtgccaagctgtgtgatagaataactgaagggtataagagtgagggtttaagatattccaggagttgaagaagataggatcaggaccacaagtatgggagttctcattagaaaagagttcaaaaccagcctgggcaacatggcgaaaccccatctctacaaaaaattagccaggcatggtgatgcacgcctgtagtcacagctgccagggtagctgaggtgggaggatcacttgagcccaggaggtcgaggctgcagtaagctgtgatcgcaccactggccactacactccagcctggcaacagagtgagaccctgtctcagaaaaaaaaaaaaaaaaaaagaggagaaggaggggtagtctatgatagagagaagtgtgtgcagatggccatttgaaaatatcggaagaaaaggcaatttttgtaacagttcttttgagaggaaattcttgtttttgtcctgagatcagggagattaaatggaccccaaagtaataattttgcttgctaatggccatgtggatatttaacattagcagtgacattggttcataaatgaattttatttttctttcattcagatctattcttacatacagccgaattggaggacgagtcaagacgctcacattctgccaaggctcccactatttagccatagcatctgataatggtgctgtccagcttcttggaattgaggcttctaagctgcccaagtctcctaaaatccatcctctacaaagcaggtatcttatcttttgtctttcttaaacattgtatttagtgcactacagtaccttaagtctcctttctaccctgcaatgtagttgggatcaactaagggcctcttacattgcacttctttttttaagcccataaaataaataaataaataaataaaattttaaaaatgtgcttccagctcaaaactgtcaaatgtggttagtctcagaagatggtatctatgtatcttatcttctgcaaacttgtcaag

SEQ ID NO: 108259 - DNA, 1060 bp, Homo sapiens
tggagtttgttgttgcccaggctagaatgcaatggtgtgatctcggctcaccacaacctccgcctcccggtttcaagcgattcttctgtctcagccccctgagtagctggtattaccggcatgcaccaccaggcctggctacttttgtatttttagtagagacggggtttctccatgttggtcaggctggtcatgaactcccaacctcaggtgatccgcccgccttggcctcccaaagtgctgagattacaagcgtgagccacctcgcccggcgagtccttgtttctaatgtcagggctacagagcgaaggaccatatttttagcttctgcaagcaggcaatatgaacacttctacataattttttttttttagcttagagttcttcagtgctcttctatacgggactgtacttgagacacatcatgggtaaagtaggcctttctagaccagcgtagcattgtttctatgggaaaatatgttagtagttccagttaatagacttaacatacacttttggaacgttacccatatgggagttggaatctgtactccagattttcagtagaacttaaatcaggagatgactcatggaagggctgttttcattagatccatctacaatagctccctgttttatttgtatccatttaatcaggtgctaataaataatacaaaatgatttcactcctttaaaaaatgagttacatttttaatgattttttatttttgcactttttgacagattagtataaatacaggtttaaaattcaaaagctataagaagatatataatgcaatgttaagattttatctaatccctgccctccggccagggagtttctttctctgtggattgtgaattttatgttgggtgttgaattgctttgcagtgttggacttgttctgctgtgcagttacttggaatcagtttcatccttttaagctttgcttttaagctttgttaagataggtttaggataggtccagaccaacccttaattggtcactttagtcccactactaagaactcagaacatgatgctttgtgtatattaaga

SEQ ID NO: 108260 - DNA, 1058 bp, Homo sapiens
attgaatttgaaaataactgtacatgttatatttttggctgatcctttttatttttccaatatagattgaaagaaaacttgttctgctcagtgttttaaaggaaccagtaagtcgttctatatttgattatgctttgaggtctaaagatattactagcttgttcagacatcttcacatgcgtcagaagaaacgaaatggttctcttcccgactgccctccgccagaggatcctgccatagcacagcttctgaagaagttgctctcacaggttgtatcacccttccaaagtcttacatttaaatgcgaatttcataaaaatattgaagtgtccatttagttttttaaaatgtttttgattgattagattacatcataaaaatgagtaagtaaatctggcaaacatcttaggcatttgcttttgattcctaaacaaagataataataagatgatgataaggtatcaggttaagctaaataaggaatcatgggagacctcttaagtttcttttgtaattactggctaaataaatgagggaaagacagtagaaacaaccttagatttaattagtagtcttgattcagttctatgttttaccaaaaatgtaatgaaatttagctggaagaaacattgcaaaacacagatgcaatatagaaaaatcctggttcatttcgatccaaatttgtaattaatacttgtaaacagctgaaataacttgtatttagaatgcatcttaggtttaatagaccagcagtttactggtatatcttaaaagcctatgaatttgaatcaattaacaaaatcttactacacttggcattggtaatgcctctttagaaatatgaattgtattcatgacaaaaaggccaaaagcaattgcaacaaaggccagaattgacaaatggatctaattaaagaggtctgcacagcaaaagaaaccatcatcagagtgaacaggcagcctacagaatgggagaaaatttttgaaatctacccatctgacaaagatctaatatccagaatttacaaggaacttaaacatatttacaagaaaaaaaa

SEQ ID NO: 108261 - DNA, 1036 bp, Homo sapiens
cagggccatctgtaatatatttgtatataattttttactgctttctaggatgatggagtcacaaatcacttagcagtcaggttctgaaagatcctttaaatcgtatgtaaattgcctttgtagctttcatctggtttacttttctattctcaaatctattttaattccttttcttcccttggtataggtaactcagatgattcaccgtgagccagataaacgtttagaggcagaagattacttaaaacagcagcgtggcaatgcctttcctgaaatattttacacttttcttcagccctacatggcccagtttgccaaggaaacgtttctttctgcagatgagcgtattctggttatacggaaggatttgggcaacattattcacaatctctgtggacatgatctgccagaaaaagccgaaggagagcctaaggaaaatgggctggttatcttggtatctgttataacatcctgcctacagacccttaaatactgtgattccaaactagctgctttggaactgattcttcatttggctccaagattaagtgttgaaatccttttggatcgtattactccatatcttttgcatttcagcaatgactctgttcctagggtgagggctgaagccttgaggacgttgaccaaagttcttgctctcgtcaaagaggttcctcgtaatgatatcaatatttatccggaatacattctgccaggcatagcccacttagcccaagatgatgctactatcgttagactagcctatgctggtaagagtttattgtccaaatattagccacttagatattttttaagttaatgactataatactgcttgtttttctgatttgtttgagaattgcaagtatgaactttgctctttgaactatttgtgtacattttgataatatttctagttactctgttcctgggaatcaacgtttgtgtgttctctcacttttgaaatgatcagaattatcaagtgatggaattttgtggttttcttaggaatactacattcgacttggaataagac

SEQ ID NO: 108262 - DNA, 1034 bp, Homo sapiens
gctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttgggtgggtaccagtattacctcctgcccccatttctagaaacttccaggttctgaaggaaggggaggttcgggtatcccctggatgggggggcatctctagggcgccgccccgctggcgtgagctggggacgttgcgggcacacgacggggcgggtgcgggatcttggggaggggggctcccgagatagtggctgggcggggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggtaaaggcccctggccgaccggttgcaacgcggagttgagggtgtggtggtttgcttttaagttgtctttgtttttccacctttttattttcgtgagcttatttatttactgtgtatgtgaagtgtccaaggatttgcttacttagggtatccagcttttattttggtaacatggggcatttgagagattgaggttctgtgggtgactgagcttgattcagctttcttgaggaattcctgctctcttcagcttagggaatgagagggaagttttcatttcagatagcgtctgtgcatgtttaaatagctatttgaaaggaattactcgaggggaagtggaaatgggggacaaggggatggggctgcatctctgtatattggcgtttcaagcctcgatgtggtgtgtggcaggattcatttataagaaagcaagccatgttttattatgt

SEQ ID NO: 108263 - DNA, 1145 bp, Homo sapiens
atccatgtgttggttccttcagcaatggtggtattttctttggcacttcggtttagattcttctggacttttttcctagggcccatttaaactttctcagcaaagcttgaccaatttttagctgtagactccaggatgtttcatgaacactttctgcttgtcactaggaacgtttaaaatgttaatttcctggaatttttggactacttaacattcagtcgtgagttaggattttatccagatcctttggaatttgtttttacatgtttatcacaaatctaaacagatcccgcttaggcatcttgagatgcacaagtaaacagctcttacctgatttttaaaagttaattgcatgtttaaagtgatagcttactagaaaagatatgtctagctggagaagcttgcacataggttttcctttctagtaatggatttattttttggaataaatttggcctttcccatagaaaattcagtgtgactttaatacacatgaaactttaatatagccttaaatgtttgactagtggatagaaatgtaatagtcttcaggatttcaggacatggttaatttaagattatagacagagctaataggtgtagagaacaatgccccaatcttttttgtttgaaaatggttgtatttacactttacttttaaaagcagtttcttaattcaatttcaaattgttaatcagctaggaatgtctcaagaaaaaattgcattactatagttggagaagctatagggaaaaagggatgagaagccaccttaattttattcctttaactgaaaataggaaaccaggttataaaaatatatctttgggtgtgggaaatatagtttatgttgtttgcagttttgtccataaaatgatagtcttaattagtactctgaaaaagagttgaaactaaaagagattatatatatgacattttgtaaactgtagtaatttaagccagaggatgctgtagagagtacttgtatgcaataaccttctgacagttggattccaaatacttgatttgtcttcatatttttgtcattcatttaaagtcagcagaattcaggtctgttaacgcaaagcattatgaaacaaaatagtttcctagggaacacacccctaggggcccaggactgattt

SEQ ID NO: 108264 - DNA, 1711 bp, Homo sapiens
gtcttttttcctgttcagcccttttctctttctttgttacttccttctccaaaggtgagaaactgttctcaaccacagtatattgacttacttgtttcatccgagtacacacaaacaaaagtagttttagaattagtgacctattcattccctggtgagaaacacagttttaaactagagtacaatatttgtctttaactttatggtatacaggcaaattctgttttcagaagttacttgggttcttttcatccctgcctaagggttatgttagtcacttgtaataaaattaggttcacttgttattgtttgtatgctgttttaagttcctcctacatcctgtttcatcatagcacagtatccctctcccatttatttatgataaagatgtgttcttaaaaggactggatttgcttaaggttgggtacagctgtaattgctttgccagacagcagttaaaggacatgtgctttggcaatcattctcttgggcttgcttgcctggttccttagtttcagctctcatttctacatcgtttacacttgggaattgatatcagctgtggccccataactgtcagtgcttgaaatcatgcccatcgactaaatcttatttgttctgtatgcacagttttagacccggagccacctacagtatgaatactaattctctcatagctgtggtaaatcatgaagtattttgtagaccctgtcctttactgggtttttctttttcaagatagaatcacttaccacaaaatttgtcattttaaagtgtataattcagtggtttttagtatagtcacaaaattgtatattgatataattctagaacatttttatcaccccagaaagaaaccccttacccattagcagtcacttcccattctcccctttcgctagcccctggtaaccactaatctactttgtctttatggatttgcctgttctgggtatttcatataaattgaatcatacaatatgtgaccttttatgtctggcttctagcacgtgttagtacttcatttctttttgcgatgaaataatattccattgtatggatatacacattttgtttattcatcagtttctactttttgtcaaaaaataacactattgtgagcattcatgtatgggtttttgtgtaaacatgttttcagttttttcaggtgtatacttaggagtagaagtgctgggtcatggtaattctatctttaatttattgagtaactgccatagtggttgaaccattttttcattcccactagcagtgtatgaggctttcttttaattaatttctccacatcctctccaacattttgctgttttttttttttttttccattgcatcctagggggtatgaagtggtttcacattgtagttttgatttgcgtttcccaaatgactaatgatgtgtcaaggatcttttgcatggattcttcatgcaaaagaatgaaggtggactcttatctcacagcatatgcaaaaatcatttctgcactctgacttctaatctgttggtttataagtctttgcagatccaagtaccacaatgttttggttactgtagattttgcgataagttagttttgcaactaggaagtgtgatgtgcttattggttatttgtatatctttggagaaatgtctattcaaatcttttgaccattttgtaatttggttatttacttttttgttgagttgtaagagttc

SEQ ID NO: 108265 - DNA, 1020 bp, Homo sapiens
agatgtttacctaagagtgttcactgcagcaatgtttataagataattatcagagatatggtttgtaaatatttctcccattctgtggattacctgttcactttctgaatggtatcctctacatcagaaacttttaaaattgtgatgaagtccaatttatatatgtgtttcttttattgtttgtgctttatatatctaggaaaccattgcctgattcaatgtgatgaagattataagaattttatagtttaactctcacgcttgatccattttgagttcatttttgcatatgatgtgacataagggcccaccttcattcttttgcatagaatatccagttatcccaatactgtttgttaaaaagactattctttttccattgaatgtcttggcacccttgtcaaaaatcaattgaccagaaattatgggtttatttctagactctgaattctattctgttggtttatatgtctttgctgatgtaagtaccataatgttttgattactgtaggttttgtagtaagttaattttgaaactggaagtgtgagacctttaacagtgtctgcctttcttttttttttttttcagattgttttgtctattctggatcccttgcatttccatatgaattttagaatcagtttgtccatttctgttaaaaaggcagttggaattttcataagcattgccttgaattgtcctttactttgagaatataatattcttacttaggtacaaacataagactttttgagtactatgtttgggtgtgaccttattctaggtaacaagcatttcacagaaatagaaggccaaaaggtacatgaaaagatgttcaacctcagtcatgaagaaatgcaaattaaaaacaaaattataatttttcacttgtcagattggcaaagattagagtgtagtgatgactagtcttggctagactgtggggaaaatagaagcttctgagtttgaagtttttgacacagtccctttggagatcagtagcagtagctatcagaata

SEQ ID NO: 108266 - DNA, 1024 bp, Homo sapiens
ttcccaccccatatagaaatggcaccaacatctctcctagaaacttcctggtgattggaaactttttatctgttgatgctggttctgtctttagggagaatgtcatgtttcatgtaacatatcttaaaatatttgaagatacctgtcatatcctttatttagaaatctttattgaaatccaattaatggtcaggtactgcccttcatacttctctaggccgaatattcctaattccttccactgatcatcttaagacctcatttccagaaatgtcaccatagtatgccatgcttggtagcaggctctaatgatgccctaaactgaatatagacttctcaaggtatggttggattgttgtgaaatagtctaggctcattgactcgcttggactaaaaagctatctttctcataatgcagtttaggataatgtttacctttttagcaacaggtttacactgagaatgcttttacagctctttaaatgatgtatgaggtcaacttaacccatgtgtttgtctgaattattattgtagagccttagcatctggtatgttagtagttggtttttcggtatagtagtaggttttatatatatatttatatttatatttatttattgtcaatagagttagggtctcactatgttgcccaggttggtcttgaactcctgggtgcaagtgatcctgctgccttggcctcttaaagtgctgcgattacgggcatgagccacggcacccagctagtagtaggtttttacatttatttctcataagtatacgtgtatgcttttgtaaatgttgaggtggtggtatattgcctcttctcgttgattctgcctgataatcagcttgttagaattttgttttggtttgtagttctccttgaagaggtccttcacatcccttgtaagctggattcctaggtattttattctctttgaagcaattgtgaatgggagttcactcatgatttggctctctgtttgtctgttcttggtgtataagaatgcttgtgatttttgta

SEQ ID NO: 108267 - DNA, 1024 bp, Homo sapiens
caatgttgctgtatattcaaattgtaaaaatcatctagcttatcatgaaacaagctgcatttatcatcagagactgtcaggtcatcatctccacctgcagacagagcttaagcagcatctcacctatctcaaagatgacagactcttgtcactgttgtcaaaggggttgctgttctgtttcctcagtgagctcccagagttggttccttccttgggccctgtatctgtttatgttcccattttctgtctctggctccttttaccaccatcagggtaggcagacttggaacaattctctccaaatgggcagcttccatgttcttcgttaaaatacctacatgccttatcactcttcatctccttgtattcctgaaatgagtttctgctaccttctactccacgcagtactcatgtggaatgacaaagttaaatatggcctggcattctgggatggactttaccatcttgcttttctgttgcttagtactcctccacttgtgaacacacttgaggtgcaggtgtggttgcagctggagagcatctcaaagcagccctttatatatttagagagtatcatgcccctttagtgttttattgtttattatatgaaataataccgtttcctactctggagatttacagctactttgagcccatggaatacccccaaagggttttatgtaaagtgtgttcaaatgtagaccctatctatataccaactaccaaaggattagttgagaaacattttatgagtaaggctgtcatattgcatgctgggtactagagttagcaatttccaatatattattgatagaaaagtaaacattaataggaaattatcatgaactgactttactcaccttgtttagtctgtattgaccttgttggaagaaaagtattaatagctgtcatttgagctcttactagtggtaagtcaaatgctgtgttagtgtatttaatcctcaaacatctctgtttagccatattatccccaggttatatatatgaagaagatgaggtttgg

SEQ ID NO: 108268 - DNA, 1017 bp, Homo sapiens
tcaaacagacccaggtgattcaaaaggttgcttcaatttgcacattttacatttgaacaaataatttgtttttcaagttattttctgtcatcttggcatcttaagtgtttagaaacagtctttttcttggttcttatatttgccttttcctcagacaagcctactggaaataattttttaagacaagttgcatgaattttttttttttaaccatggttgtttctatttcgtgttacagtgtgcgtgaaggaaaattggagcatacacttgcccgagacttggttccaggtgatacagtttgcctttctgttggggatagagttcctgctgacttacgcttgtttgaggtaaatttgggatctgattgtaataagtgaaaatacgtggatgtagattaaaggataaacattactagttttaaggaattaacacatagttgatttgaaccatttggtattctactttaaaatgtgacatatataaacttttttttttccttaaaatgtatctgtctctactgtaacatcttttgaggtgtttgtttagtgaatcagcagatctttatagaaacctgcatattagggactgtgggagatacaaagatgatatgacagaatacttgtgactagggaacatactatgtgtacacaaattactcaccataaaatagaactcagtaattgagtaagagaagttcaaagaataggatatagacatttaaagaagggagaggttccacctgatttgaatgagatcagaatatgcctcagaccacatggctttggcagtgataattgaagagtagtactggacaaagatggggaagacaatgaagcaacaccattcaaatcactatgaacattccagtgtatgaaactctgttgggacatggtaagggtagaaaacgtgtgatggaatcagatttcagaggccttggatactaggcttaacttcagatttttttggttaggagttaccttttgaggctcctgtgcagttgctaaataatgttatcct

SEQ ID NO: 108269 - DNA, 1018 bp, Homo sapiens
taggagtgtgtatgttagacatcttcactgtaggtaagactttgaaagttgttggatgtgtgtgtgtatgtgttttggtttacatttcatctggatgtaaatgtattttcctgtttttccccttagggtgttgtcattggaacaggagaaaattctgaatttggggaggtttttaaaatgatgcaagcagaagaggtgagtacttaatatgttaatgatgtatttgttccaaatctgaaattcttcattgtaagtagagaatgttggattattttatatactattgagagcaatattttattcagaatggaaatcagttgtctctgtttagaaacataattggaaagcctgtaattgaaaaggtctaaattgatgttgttagtattctaaaggattttgagctttactcattgtttatagcagaaaaaggcttatagccacttatttgtagatcttattattttcagaaattagtgttgtggtaattttaaggattagtaattagtatatttgtaccttggaatatgtcttctatcaaattttttcaacttcacataattccaagtaagggtggcagggaaaagattgccaagtaaaataacctacaagatattctcggctaaaagtattaaagatgagttcattttaaatactttcttattataaaaagaagcttcattctgcaaatgtcgtgttctccccaaatcctctggatttctcaggtaacctgccaaaactccagtatgcgatgcaaagtgggaactcattccaagaggcgtggcagtgaagggatgaatagagaagagggttagcagttgagggaggattaaaagacctgggttactagcatgtttgtggataccaaaagggaaaaattggaaaagcaagtgagagagcagctgatggtaatgaagtcctgcagtggttggtaggagggagaacagatttttcctcaaaaggaagcatagagagaacggaccttttcaaataataaacaggtttttaaaaatagagaatt

SEQ ID NO: 108270 - DNA, 1050 bp, Homo sapiens
ttgagccaagtcgtaagtgtccctttgtgtgtagtatggatttgctgagaagtgtctggatattgtgttatggaaaataaagttttagggtttaattttgcatatttgatattaaatagaagacctatatgtttgctgccaccttctttttttcattgtatgaacatactggtaatttttaaaaaaataataaaatattactgctttaagggatggtaggagcagtgtcaaccaaaagtaaaactgtgtgtgtgtgtgcatgtgtggtgtgtgtgtgcacacatgtacgtatgtgagtatgcacagcattcacattaagcagtgttaactttaacctcccctgtttaatggatttttataaaatcttctaattgtgatctgatatgctttcccttttttgtcaagggacgttttagattccttcagcttgttctgttccttctaggtgattgtatgtaaaagggaaaaataactatttaattatctttcaggaatcatcatgttggttggctggttactgggaaaagatatcctggaaatgtttactattagtgtaaggtaagtctcaatactttataattggagtctcttttgcctcttttatttctctaatggacatagcttacgttttattatggagatcagtattacatggagcccataagagtataacatcgctacataaatagttcagaagtcatatattaaaattatccttagaaaaatgaaaatgtatgtatatggtaatgaagaaaacccatactagatgtctggaattactaatgcattattgcctttttatatataaatatacaattaaggattgtcaaattgaaaactagcaacatgaaagagaaagttcacaatatagaaattgaataatcaatttcagaggaaaacgaaacattgaagaaatgatgacaaatttaaaaaccaagtgtttgtattttcagagacttgtgaagaaactgcatccatgagataaattgttgtagaaaaggatcagagaacaaaaagagtttttagaaattaagattatgattgttgaaa

SEQ ID NO: 108271 - DNA, 2086 bp, Homo sapiens
taaatttacagtagttatattgctgtaacaaaactttatgtgcaatatgctttgaaactccaaaaatgtactgaatttaatttctagtttgtattttaatatcttctccatatatgagaagctgaaataccttgaaaaatcctgattgaagaaattatacgggtttatatttagaaactctccaaactttctagaaaagatgttatataagatcattacataaagctaatgtgaagtagctttgtagaaactaactgtatataaataagaacatgtcatcatctaatttttatttttaatttcagaaactgtaccttatgctgaaacaagcataatgagagaagttaatctaaaattaacaatgagtttgatttctataaaattcagagaagtaggacaggattctagtctttgatttgttttttaagtgaacctatatttctccttgattcttttggtgacttgtaatgatttaattctttaggctgctgtaatgtgatttgttcagataaaactggaacactgacgaagaatgaaatgactgttactcacatatttacttcagatggtctgcatgctgaggtactctataggtttttaaaaacaaacaaaaacagtatccctttaagaaacttggtgtttaacattcctaacagttccagtgtcttaccttcaaaagggctgtaaattagtagtggagttattttctctctctgtgattttaccaagtctttgtctcattccacttgtacacttgttcaatccaaaaactttgattcctccttgacatctctctttcagtcaccccttcatctatccataatcaaatcctaccaattttgacttcctaaagaattttcccagccatctactttatagccagcttctttaagttaccgccatttctcacctgccattctgataaagctttttgactggtctttttccattcttgatgccctcactccataagcagtttgagggatctttttagaaccaaattttaagcatgtcactccataaattaaggtactccaatggttttccattgtgatcaggatcctgaactgtggcgtctcaaagccgtacatgttctgtcccttattttctcctctacccttatatgctaccctttgctttctgtgcaccaagtatactggctttatagttctttcgatgtgacacaattattcctactttaagaactttgctgcctttgtcactgtttaggatagtctaatgcctcttcatcctttgcaccttaattccaacccacttcttcagaacacccagaagtggccctatgttatatgttgtcttagcatttcatacctcttagtccttatcttaggtaaaattttctgtcccttttccccattataagagagcaggagctatattgcctagcacacagcctgcttcatagtaataaatactcgataaatgaatgaatgaatgaatcactttattttaacaattatatattgatacattgtctcttaagtgcacatcactgtgcagtagttcttcctgaaggtgcttatggacaggtctaatcctactcagtctatgcaggatttctgactggaatgctcttaacactacttatgttgggtacagtgatttaaaatgtatttatagctaattcattgagaaaaataagcagtaggcaaattgacagaagttgtacttgggtttatttacgtccattttacataggttttgaaaagagactcttgatatttacggtgttagatctggtcaaagatcccccatgctgtgttggtgaatgtgccctttctggatgattcagaagggtcattgggattacatgtgcttatatgatccaggtatggaaggtagaatattagtttttcttttgttttaaggtcatgctatatgtaatgcattaactatttgttaattgttttatctctcaattaatgtcattaaacattttttatttatttttatttttaatagagatggatcttgctttgttgcccaggctggtcttgaactcctgggctaaagtgattctcctgtcccagcctcccaagtgttaggattacagatgtgagccacc

SEQ ID NO: 108272 - DNA, 1248 bp, Homo sapiens
tgatttttaaaattggtgtgtaatatgctgtgttaaagtgatttgtaagtgctagcatatatctcaatgtctccaggcctgcatgtttgcaaaaagaatactgcttttgtctaagtcacagctttgtgttgtatgttacatatggtaatgcatttgagttctttgcaaactgtagtatgctatataagtgtaatgtcatataagtttaagcttacttatgtatattttcatagcttattcttttaacagtatattgtaattagaaaacaatgtctttttagattaataattgtgatgagaattagaatctatatttctttactaaatgtcctttttaaagacaaattttaatgcttttctaggtgaacacttttaacagtgtcattataaataaaatgaacagaactcattatagtttttgggttttataggtcttgtcaccaccaagtgtttgtagtgtttgtattattgatcccactttgtgatctttaggttactggagttggctataatcaatttggggaagtgattgttgatggtgatgttgttcatggattctataacccagctgttagcagaattgttgaggtaaatatttttttttccaagatggtgactttcttcataataacttaagacacagtgataggttcatagtttatgtgtatttttcttaggcgggctgtgtgtgcaatgatgctgtaattagaaacaatactctaatggggaagccaacagaaggggccttaattgctcttgcaatgaaggtacgtacctaaatttctcttctttgacatttgagacactgccctcacaacagaatgcagtgtcatcaatttcagtattactggtttttaggtattgagtgaaaaaaactcatactatttcattgtttttactatcttttaggtatcagttttattcctataaatgtaaagtatagacttttttcagtataactttattgttcacatgcaagttacaaactaatgagcagtcattgatttcttgtgaagaaatgttcctgtcttccacaatgttgagatctacatgtgaaatactttataaatgtgtgtaattgctgataaatactaacttttgaatgaataaaaggcaacattctttagtatttctatgtaaagataataacacagtcatgagaaaatagctttgttttcccagtctttcctttctctcctttgttaatttctcaaaatgattgtgaagttataatttgttttggggaga

SEQ ID NO: 108273 - DNA, 1031 bp, Homo sapiens
agcaggcctagaaatcagccaattagaaatggaaagaagactgaaggagggtggtctccagtaataatatagaggtaatagcttatctgcttctttgttgttgtgaaaaaataccatgagaagggttttatattacattgaagagtttaggaagaatgaatgataggtatacagaaaacaaattaaagaggtggttattaactttataaaagacaaaacttgaacaggaaaagaagtatcctatttgagctatcaatcaggataggccatgaaaacaacatcatgctctcctgctgcctccctgtccccaaatatctgctcattgtagttacttgggaatgcaggcagatggaagctccattttaatgtgagcacacactgtcacagcaggggtagaagaataggaaattgtgcactggcacctacatttccatttggaagtgacacaagtactcatgtttattggccaaagcaagtcatacctgaccgttgtggagtgaggacggcaatagggaaatacattcctgcctcccaggagaactgggatatttgtgaactgctatagtcattaccacacttggcttagcagcaaagagtcttgttgtaaacaaaatactggcagattttgctttagctatatcataaagatggggagggggggaatagatagtggaaatggggaaattaacatctgtcacaatagacagtgtataaaattgataactgatggagtagcagtataaacatgttaaaaacatgagggtaaatatcagagaaaacagctaagagagttaaaattattttgcttccatggagtaggactagtggtgagaagcgttgaacaggaaactgcagtatttcattataagcttttgaagattatttaccatgacaaaaaataaaagaaaaagtgcgataatacccataaatacagtgtgattgggagaattaaatggtgttttaggtagatagatatagacgtatatagtagctaatagagaacttgaaccattgtgagctgttatttctct

SEQ ID NO: 108274 - DNA, 1712 bp, Homo sapiens
ggttttaaagtggcatggatttagaggacttaaagaggtcttgaaggtctaatatatgctccctctttttgttagtttctggaacaaagttttcctacctcattatattgactaattcttttcatatgaaggattgtggaggtttgtgtatgtgtgttttgtactgtaacattatgaagtagaccagagttggtagaggggaaagtttttgttgcacagagttttgggaaacattctgctcatttgtctcttgcttcatgtcttttcttctttatctacccttgtgctccacttccatcctccccctgagattaccgtaatgaagaacagaaagattttaaacctcagttgatatgtacttacattacatcttatgaaacaagtttcttaaaatactgtggttcttaattttgatattagagtatattttgttttatgtcaggggctctccacatgaaaaaagtttacctatccttgactcagagagtagcagcagattttcactggtgctaaagaagcaaataaatacaggatactaacctctagactagtgccacccctccattaggagtgcgcagagctgatctttccgtcttaggatttgctgacatatatttttgtcactgtccccttctgttaccatcagcctctatcctaacaccaggaactgtgaagtggctcattctctcaagggtgaaagcctttggagcccacatctacataaataattaggtatatgactcttactttggaaaaatagaattacttgcttttaaccttgattttttttgagcatatgtaatctttcataccttctgcttgacgaagaatggatagtttctttggtctctctggggcttttcagtctcctcttgacttatttatgtttagtttgtatgtgcatgttacaagttgttcagtctaatatctcagatgcaggcacatccctttggttaataaaagtagtttccggagttccataattctgagagcaagctaaatgatatttgggaaatgaaaagtactttgtactatatcttacatgcccaaggatgatgacagggaaataagtagaaataataatatgatggcgttatttacatactcttagagaaccaacgttacaaataagaaatgtctgttcatgttatggaaggagtaaaagaatccaaactattgttggtattaatggttttacaaccactttccaaattagctttaccttccaggagttttcatgtacaaagttgttacaggctgtgtataattaactaatacagccttctcttcagagtgtttaatttttctggagatcttggaaatggaaagatgaagatccgttagaagccaccttcaaaggtgtttgcctgtttaaaattgactttaaagcctaacaaacccatagtttctctaaataattaattctattttttaaagaggtagagttcctgttgaaagtagctgcatgtgattactatgtgaaaatattgttcattttctgtctcttgcctactctgcccttcagttctttagtttgattctttttaattaaaacagcttaaagggaccccttatccagaaccattaaactataatgttttggtctgtaatcattttgattttacaaatgacattatagtcttaagtgatttatttaagaagtgttactgtctccaatttctatcaactaaattctgatgttttcatgactc

SEQ ID NO: 108275 - DNA, 1121 bp, Homo sapiens
ttattcttaaatttaaacaaaaatgaaagtcaaacataaaactccagacttaatactgattcagataggtttgtattactggtaggtaacaaaagagaacagataacaaatcatactaaatgagcattacgttgactagcctgtcaagcaaaaacaatttggtttattacattttctctctcatttgctttagccagtcgtctgggattgtattccaaaacttcccagtcagtctcaggagaagaaatagatgcaatggatgttcagcagctttcacaaatagtaccaaaggtaggcctaaactaaagccttttggactgaaaggccttattctaagtgttaccatttctactactatcttaatgaaactgtttaattgtgaacatcagggatttaaataaccaccagatttgttggttcaaatcctgaaatgaagtcttatcattgaattagtcttatcattgattatttatgatatgatgtttatgaatatcagtgcaaaattattaattttagcaagaaccagatttcctctgagaaaagtactgtggaaattaatagtgcttgtatttatgaattagaggatggagagagatcattgatttatacttcttactcttttgttcaattttaattttagcatgagtatgtgattttttttaggtacaatttacatatagtaaaattcgcccattttagtgtatagttctgaacattgagtgatgcatgcagtcttgtgaccaccaccacaatcaagatatagaacagttccatcatccccccagattatcttaggcctttttgtggtaccttctccccctacttccaggacttggcagccactaattctttttttgtctctgccactttaccttttctagaatgcactaaaaattgaatcataccatatgaatgaggcttttgaatctgcttctttcacttagcataatgcatttgacatttatctatgttggttgtgtgtattagtagtttgttgttgttttttaaagtaatattctattataggtgtaccttacctattcaccagttaaaggacatttagattgtttccactttttgatgattatgaataaagatgctgtcaacatttgtgtacaggc

SEQ ID NO: 108276 - DNA, 1207 bp, Homo sapiens
agctctgctccaaaaatcctccccgttcctatatcaaaattttttccttgctgctgcactttaccatcagtatacaaacatgtttcctcttccatttaaaaaaaataaagaaaaaaaagggaaagggtggcagctgaaatgggaagggaagagaagtggtttttctttctttttttatatggaagggacaacatgtttttgtatactgacggtaaagatatagcagtgaggaaaacattttggcacaggagggaggagaatttctggagtaatggtcttaataggtaagaaggtagaatctttgacctgcagtagatgcatattgagttcatctgtagtaaaaccagaggttagttcctggatacagatactgagttgggggaattgtggaaattctcttctgattctgatttctccaaagtaggaagcaaggtggtcggctgagaaggaggctagagaaaggggatagattgcaggtacgaggagagaaaactaatatgaactaatcctctaggagaataggaaagagaatggtgtattatgtatattgaaatcaccataacttgtaaatattgttggagagagtgacatggtagtgaggcagaagttaaaatcattgtgaaatgaggggctgtgaactccggagcagtgaatgcttacagttagtgagttacagtctcatctgacattcagaactgaggttttatgaagggagaatagcggataccgtgttccacctgtaggctcccccagtggtactatttgaggaggttatagggatggtagtgttttgtggaaacactaggttagagcaaagtactatttgaggaggttatagggatggtagtgttttgtggaaacactaggttagagcaaagtgaaaaagagtaaaaaatagaggagatttgttggaacacagtgaaacgattttagatcaggagatggggtcagaaaaaaggattaaatatttattttggagagataaaaatcatataagcaatttagaagtacagtggaagagaggctaatgagttaacctgagtaaaagggaatgagcagacacttgacactgtaaaaaatggctctacagacactgagaagcagctgttctttattgctcctgaagacagaacaaagggaaaaggctattttagttgtatgcgagtgtcataggaaacagacgcaagagaatttttcctttttttgt

SEQ ID NO: 108277 - DNA, 1036 bp, Homo sapiens
acacacaattaggtccattctccaagaaaggattttagattatctaccttagtgaatgtatagaaatgatttagcaaaatacaaataaagtttcttgatgtttgggatgttaaaaggtttcttttctttctatggtctaaattatatagtgtcactttttaagcaagccttttcttgataaataaaataaaagctactttaatatttacttttattccatctgaattattccaaaacagtagtaaaatttaagatatttcatagaattgacattgcacaattcagtgataaagtgacactgcttgttaaaaattagaagtgaatataataaagaagttatttctgtgaccaaggagtaataaatgaactctctgctctgccaacagaccaagtctgtgtttgagattggactctgcagtaatagaatgttttgctatgcagttcttggatccatcatgggacaattactagttatttactttcctccgcttcagaaggtttttcagactgagagcctaagcatactgggtaaagaaaacgttatctttatcatttatgtattttagataaatcatattttctaatgtgtttgttttaattttaaaattcttttaaaatagcaaaataagtaactcacttgatttgaaaaaggagtctattttttcacttggggaagctcaggggaattactctcctaactccagggttttggtttttgctcttttataggttatcaattgttataaaaatcataatacgtgattctcaaatatagcaaatcaaaacctgctctagagtatagtttataactttttatgtactatgccatcttgtatgaagagaaaactagacttaatctccctgaaaaccaagttgctctcttctttaaagttagaattttcagtaaactaataatttcattattctttcttgtttgtacattctaatttcacaaaatgtcagtctgaccaaatagcagaatgttttataaagactatttggaaattacacatttttcttacattaccatttatta

SEQ ID NO: 108278 - DNA, 1452 bp, Homo sapiens
taagtcacttaatatctttttttcttttcttatttttaactgagggtgattgtgcctgccttatggaatagttgtgaaacaatgtgtttgaaagctgtggtggccaggcgccatgcctcacgccagtaatcccaatacttcgggaggctgaggcaggcagatcacttgaggtcaggagttcaagaccagcctgtccaaaatggtgaaaccccctctctactaaaaatacgaacattagccaggtatgatggcacatgcctgtaatcccagccacttgggaggctgaggcaggcaaatggcttgaacccaggaggcggaggttgcagtgagctgagatcatgccactgcattccagcctgggtgacagagcaagacttcatctcagaaaaaaaaaaaaaaaaaaaaaaagttgtgttaaaatgctagaaaaatgtaagctattaagctttgcaactgtaagtttcaaagaaatgtaaaacccaacttattttctcttgcagatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaac

SEQ ID NO: 108279 - DNA, 1205 bp, Homo sapiens
aatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaatgacatcccagtggggactattagcattaaaattatccatatggatgctgaagatacagaaattaaaattatccatatggatgctggagaatgcatagtacacagaatctatgatttaaaaagaagttgaatgtacagtacagatccagattgcaattttccataatatattaatccaagttgacatggatgagttaaatgggctagtatctaaattttaaatttttaccctatttcctaatcctaggacttgctagagtccctaacaatactaacttacttgatgtttttc

SEQ ID NO: 108280 - DNA, 1034 bp, Homo sapiens
gaatattgtacatcccatattccctttccaaaatctagtttcctatgtttgcaatcaagtgattaggtcctgctctttctaattcagttctaacaaatgaaatctcatcttaggctttggaaactgtcttcaattagcagttcaagtaacaaaaggaactctgggcagctaagatgaataaattttagagagaaagctgcagagacaggaaaacttttactataacctaatcatgttctgtatttagtggtgataaaattatactggaagtctattttttaaaagcactttttgagacacctggaccttgaaagtttaatatgcatcctgtaaatataatcacaggtctttcatgccatttgatcatggggaaagaattcaaattaaccttttgacatctgaatttgaatttcagaagataaagaccatagctaaaaagcccttagaattatctttttctcctttgtgcacaaaaggaaataaatcaatgactatgcctcagttgccctacttgcaaaataaggattataacagtccaaattattgtgtaaaagatacaataacaagtatatttaagttacttagcacagtgcctgatactaaaagtgtgttataagtgatagccattgttatatccgcacatgaaaagccagggcaaagcaaggaatgtgggaagaagtgagtgagtgttaagcagtacaaagattaagacaacgtgagaccagagttgccacaggtttaagagcagaattttgcagaggcaaaggagatcaacactatcaaatatggtgaagaagaaagatgggcaggaatgtgagaatattatagcaactccagccgtagccacactggaaagggtagaaaactaccaagacaatttcaatgggcagccaagctcaaacttagaaaataatgaaaaaagaccagaaggaattatccccatgtgagtacctgtcccccttgagccctttttcctatgttcagagagttttctgtagtgtttttaaagcccaatttgaaagagcccttggcat

SEQ ID NO: 108281 - DNA, 1362 bp, Homo sapiens
aaactgcctactccacggtcatgaaaatgtttttttgctgttcacatttagatctataatgtatctagaattggttttttgtgggtgcgtatggtgtgaaatagggatcaggataccttttccccccacatggaaatccaactgaatccatgagtatagcaggctgcttatattccttgctaagtagagatgacttaagtgttctcatcatttacctggattcaaaatagagtgaaattttagttcattctctgcgctctgctatcacccagctttctcttggcataaacttatcaattctgaatttagctcagtgctaatggttctaattagcccctgaaaattataaatgtaccaggtgctcatgtgattccaaacacaaatgcaagtacaagtatagaaaccttgtgatagtacctattcattttgttttttagatcttgtaatacattatctgctttggccagctgttgttaataaaaactttatagtctctcatttaattcccacaataaccacatgggatagggtttcattttggttatgttagttgcaatggacagagcaccattcaagttaaccaatgggaggttaatcataaggagacacaaaagtggatcattcttaaggagtaaggcagccaagaccagtctctctctgggcatctctgcctctcggggcagctgcttctgcaggcttgtgctttcgctccccctggggaagagggaaagtagttgtcacatgggataaaacctaactaacgttaagggctgtgagttgagtacttccccttttggaagggactgtggactggtgggtttgatgaaacatcttatacaagtcattataatgaccattttacagataagtcagacagactgtagaaaaggtcagaaacctttcgaccaaagccatagggttagtgcagagcggaacatctctgaagtcaaagcccagactgctttgtttatgaaaagttgtaacttggctctataattcagtaatttaaatatatatcagaaaagagttggtgtattttcttagctctacttagtgcattttaaaaaccagtttaagagtttagtttccactttacttaaaatttaagtagttaaaactacttccagtaggggtaattggttatactataaagttctttgcatatttctaattttaaaatttgtatcacaatattattaaaagcagtatttagaaataatcgtactatttaaagttttcatgcattaatgataaaactattttgtcatttatgatgtgttttgtttcaggttaatatctttagtctcagctgtcaaccactctttctactaactagatgttacatgctgagaaatgttatta

SEQ ID NO: 108282 - DNA, 1047 bp, Homo sapiens
ccaaccctaccgaagcactagataatgttctgaaatacctcccaaaaaaggatcgagaaaatgttaaggaacttctctgctgttccatggaagaataccaacagtcccaggtgaagctacaggacttcttccagtgtggtacttatgtctgtccagatgccttgaatcttggtttaccagaatgggtattagtggctttagctaaaggccagctatctcctttcatcagtgatgctttggtcctaagacggaccattcttcccacacaggtggaaaacatgcagcaaccaaatgcccacagaatatctcagcccatcaggcaaatcatctatgggcttcttttaaatgcctcaccacatctggacaagacatcctggaatgcattgcctcctcagcctctagctttcagtgaagtggaaaggattaataaaaatatcagaacctcaatcattgatgcagtagaactggccaaggatcattctgacttaagcagattgactgaggtaagtatttgtaatactaatgaaatttttgtaaagtactttacaggatacaaagtgctgtcttctatattagttcacttactataacaaactgatgaggttgagtgctatcttgccctcatgtcgtagctaagaaatctagaacttgagtgaactaggtaatgtcttagccagaaagtgtcagtgctaggactcaaacctagctcttttagctctaaatctaccatttccactgtacttcagtagtctgtgttatcgtcacagttattactactatattgttattactaccaggttaatactagctatcaatagaatgggttacgtggctgaaaaaaaaaggaaaaaaattcacaactgcaaaaaaagtgtatagacactaatcataggcacaacatctcagactacatcggatttcagataaggttagtactgatgctaaggtctaattttttaacttttattaatgaataccttttttaaaataggtttttgtgtcattatggttatttgcctagtttgatacagaaaacatgactcttag

SEQ ID NO: 108283 - DNA, 1036 bp, Homo sapiens
tacaaatctgcttttcaactttcctcaaggggtagaatataaggatgacctttacagctaatttccaaaggtaaatttgcagatgggacctgaccatgtttcaggacatatggagaaatgtgtatagaactatggcctgtttttctagtgtaaagagtattagaatacagtcaaacacacggaagctgagttcgtacttagggttcctcatatgcagaatgaattccgttagtctgtaggattacttgccttacatccagtagcttattttgttgtactaatcaaaaaacccctctttgagaaagagtgtgtcagagtgaagtctctcctgattccagcaaaattgaacctacgccctaaatcgttgcccaaagagagactgttggctgtgtcacagtgaaaacccatgatgggaggaaagagcagtgttcagattgctgactctgaacctgttatttggacctctgggatgaatacctttaaatgttggtgttattcctcatttttgtcagagtagaaacacagtgtgggcttcctgtggcactgagtcttgcaaacttgtcttctagcctggagtgtgatgtgcttctactagctacattatttttctatggctgattcttttcccttggtaggatgtgtgtgattctaaaaatgccttttactgcctgttttgcctgaaggtcaccacttgggaagttttccccacttttgcaggaactatggcaagaagaatgttatgtttctattatggtacttatcatgttactgcttatcatgcttttatgaacagttttataatggagcactttcgtgatgaggtagggcatgttgctgataacttactgaactgctgaaccaagagagtgaagacaggcagacagaagcaactcactatgctatgaggccaccttgggcaaacatcttcaatagctttataatcatgtgttacttcatggctacctgttttctctatgggaagaagttcttcacatgagagtttattttagtagtgatagataaagcttctactctc

SEQ ID NO: 108284 - DNA, 1038 bp, Homo sapiens
tttgtcaggtcattatatttgaaaatgaatccatataaatgaaattcaagtagtaattttagaatgtgatttcatcctgtgggcaatcctagagattcttacaagttaagatacaaagtaacaattggtgattttatccttatagcttcttgagtttctgttactggattagtcaaattttttagaattaaaggaaagcattgactgagttctttttactctatttatgtaacagttgtgttattcacattagaaaatgtagtagcgagtatttctttgattatgaataatagctgaaaagtctacctttaaagaacttaattggtttcactaagatttttgccttctctcaggtcaaagattctaaactgcctgcatataaggatctcggtaaaaatctaccattccctacatattttcctgatggagatgaagaggaactgccagaagatttgtatgatgaaaacgtgtgtcagcccggtgcgccttctattacatttgcctaacatctttggacgtggcagaaccttacatattctgtgagcttcgatgagccagagtgatatcataaccaccagaaatcatactctcctttcttagtcacaacaaaatcacacatgtcatctttgtcaagggcataaatatatcattcatacccccattaaattttgttagaaaaattaccacattaaatatatgagttaagtagattggatttgctgaaattggtgttgggcatattagcaaaatattcttaatttgtggactcgattcttttttactacatatttcccaagttatcttaagatgtctgtaaatttaacttttattaaagttttgtcaatctttgtgaaatagtggttgtggaacagtagaaaaccatatggggactatagtgcaacctatttgggtaaagaaaccatttgctaaaatggagaaagtaaatagatttttatttaaattacagaaacatgttaaaggccggacaaaggaaagacaataaaatcataaattatcggtcctgtttacatttttgtt

SEQ ID NO: 108285 - DNA, 1148 bp, Homo sapiens
agacaaaaatggttgagatgtcatttacgtttcagatccatgaattataatacttagattttacaaacagtgattccgtcgtctaaaatatttctcaggtataatagttctataaaagtgtgaaagcaactgagagttatctctttgggtcattgatgactaaatttttatttctcaaattagcacagaaagttttgttgtgattggttttattgttttttttgcttgggttttattttcaatcctaaatactgagcaagtttaaattggtaagaatatgactttttcccttcttaaagttcaacctaagattaatggattggggggacaaaactaaacaagtttactttcttctgggtaatttactgataatttcttgaaacaattttaataagagggattaaagtagatctgtttttctgtactaagctgttcctagcagctgtgtactttatttcaaccaaattattcatttcttattgctaaagtaattatgcctcattttactcgtgtatataattacatgtaatttttttaaaaactttacttatgaatgaaggctgtagaatgagtcagaagttctgaagaatccaataatgttttccaaaaataaaactcaacattttagatcacatcagtacctatattaaaattcttcagtctgtgaattcacagatataattagaatttttgagaatatatagagttaacagagctcttataaagacccataggtctgttattgtttttgctaaatattattctgtctttaacttatcaataagaatgtatgctctgacatacattgtgctgcatttgttgtatatgaagataggattggttcttgttgctcacacctataagcagaaaaatgcactaaggccatggaagtattcagtgctaaatcaagaatgatataaaatagtctcaacttaaaggcccttacccaaatttgaaaatgctgaagaattaactttaaattttccgtcaatacaggacttttttttttttttgaccatgtgacatagaaatacaatcttgtttgttttatttgttggagaaatgactcttttggtaggggaagaaaaatgtaagctgatttccttaataagaggtgatatttttgattatgtgctcttagagttaag

SEQ ID NO: 108286 - DNA, 1074 bp, Homo sapiens
ccaaatattttattttctcagtaccattttttgaccaatcattctctcccatttatgtacgttttttctccacatgaagattttttgaggaccatctactcagcccacttactttagaaattagaatcagtgaggttgtggcttctccagcctctagttacagcaagctagtattaactaaaaataaaataaaattgaatttccacttgttattgttaatggtgccaacagagtcctttgaaatatccaaatagtcttgatcattcagtcacatctctatttaaaatgagagttttctactacttccataagatatatttgctatggtcttctattacaagtcatccataggacttgaagtttttcagttcttattcaacattctgaagtactggtaataatcttttattactttacaagcaacttacatcctcagcttttagtaacattgttttaatacaagtatatcctaaaatttttggttttatttcatgctttaggtgtggagaataaacacaaagcacaacataatctatgtaaatggctctgtacctggacataaaaattgcttagtaaaggtaagtataagtgtcttctttttttttccttttttttttttgtttcttactcgcaagctaacaaattactatctttattttctattgtttatatatgtggatatttgccataaagtctcctttttctcatatatgtggcttataaataaatggctgtttttccacatgttctctcctgaatctttctgctttttagtagcacctgagtgaaaaaaatgcacaagataacctgtattctatttctttcaaaccaagaacctgtaaaaagggtaaggctgtgtattagtccatcctaatagaatggatggactcctataaagaaatacctaagattgggtaatttataaataaaagaggtttaattggctcgtggttccacaggctgttcaggaagcatggctagggaggcctcaggaaacttacaatcatggcaaaaggggaaggagagatggacatgtcttacatggctggagcaggaggaagagagggaaggggg

SEQ ID NO: 108287 - DNA, 1025 bp, Homo sapiens
aaggaaagtaacatctaaagcaaggagcagtaggaccattccagcaccagtggtatggatgaagtccattaagtcagttaatacagaagatgagttcaaaacaggcctggcagtccattttttttctttgaatgatggtgtcggtgtgtctgtatgcccttgtccttttttaattcttagccagtattaggtccgttgttgctgagtttttctcctaaatctgcttcttagtctgtatttattttatcattctagtctcattagaaaggaaatcctctaggagtaaatatgcctaaatccatatttagttccttacttgggacctagcagaataggggaaaaataaaacattttaataatttatatttttagtttacattgtggtttgatcagtgctgtttaaaattgatagtacttaaaagtgttaactttagttttctcatttaggatattggcagagtctggcctggaactaaaatgcctggaaaaatgggaaacatatacaggacagaatatggactgaaagtaagtgttacaagtggttctttttaggaacagctaaattgtctaaatgcaaaggcagcagaatatgtatttaatctgtgtctgtaccattgttctaagaggctttaaaattattgaggaaaagaggatacatgaattgtgtgtgtgtgtgtgtgtgtgtgtacactctagttgtagtaatggtggtagtaatgatagggtatatttcaggccatgaaaagtgcagtcattaaagagacaaaattagtagtccactcttggacctggaagatttttacaagatattgttgcatgaaaaaagtaagattcagagcattcagtataatactctttattgagtaaaagatttaacaaaagctctctacgtgtgtatgttgctgtgccatcatataatcacagaagagtggaagggtatataccaggttcttggattatatatcaaatgtgtgtgtgtgtgtgtgcgtgtgtgtgtgtaagtgtaaggaggagagtgggaggca

SEQ ID NO: 108288 - DNA, 1162 bp, Homo sapiens
agctggagacatccttgcagcatgtctctccataggacagtttacactagctgtggaagttggcttccttcagagcctggcaagcaagagagtaccaagatggaagctacagtctctttgtaaccaaatctcagaagtgacatctcatcactcttgccatattttatttattagaagcaagggactaggttcacccagactcaaggggagggaattaaacaggagcatgagtaccaggaggtggtgatctttgggttccatcttaatggctgcttgccatatctgctataagtactttgaaacttctagagcttttccatttttactgtgtcatcttcacagaattaggatgataaaactcctgttcagataaaattccctgtgcttagcttgctggtgtctcacaatcttgaattaatcattttatatagaattagactccaggaaggggtgcagaccaagacagagataaaggaatatttatttgcagttttagttgtatagccttttctagttatttaaataagaagctttgttaaaactctaacaagaatgtgtacagttggtactagaaagtgtacaattgggaatggtctatgctcttttcattatgtaaattctaacgtttgttttgttcagtattggtaaaggttttcaaggtgtcatgaaaagatggggatttaaaggccagcctgctacgcatggtcaaacgaaaacccacaggagacctggagctgttgcaactggtgtgagtataactagtgaagctctttttaatgctaaatattcaacttctgcacatgtagtcctcagtccgtccttgatatgaagtcacataattttagtctgacacaaggggactccatgtacttgtcacccttttatggatccttgcccctcactcatttcccagagccagactagaattagttatattccacaaggttagctgagcatctgtagtttggctgtatataccctgagtctaaatttaaaatgtactttgtgcaaatgttgaattcagtttgtcttttgaattagtatcagttaacaattctgaaataattttctgtgaattgtaggattgagtagataagtaaatgtattgataatggagctaggtttctcactgttggaaaagggcgttaaagtatgaaaatgg

SEQ ID NO: 108289 - DNA, 1058 bp, Homo sapiens
tttttaaattgccaagcactgtactttccaattaggttctaaaattcaatgttaagtggaaacatttgttaaatttctaaagcataaaatatttgattattctcttcttagatgttagtttacataattaatagtgggtttttatttaatatgtgttatgttttagctctttgatcaggtatacacattatcttgagttttcacatccaaaaaattatatacacactgttcacaggcttaatgtgaagaatgtgatgtaagctatgtttaaattattcttataaaagtgacttttgacctatgatttgatagtattcagctgttaagtcatacatgtaatgtatcatttttgtttttaagtttgaggtctcactatgttggccaggctggcctcccctgacctcaagcagccctcccacctcaacttcccaaagtgctgggattacaggcatgtgccaccagacccagccttatccttatttttagagtggatttttgatgtattgaaaacaaactgtattattcacataggctttcttcaatccattgctaattgtttgctgaatgcatagcaaagtccttgtggaaataagtttgtttttataatctttttctttttgtcctctttgtaaatggcctgaacagtacactatataataatagctaacgttggtggggttagggaacactctgttaaaaatatgttgatgtattatctagtaaaaggtgagaaaaatcttcattttaagagtaaaaatatgtcacatgcctggcatggtggctcacacctgtaatcccaacactttgggaggcccaggtgggaggatcactcaaggctagaagttcgagaccagcctaagcaacaaagcaagatccctctctctaccaaaaaaaattaaaaattagctgagtgtggtggcatgcacctgtagtctgtagtcctagctactcatgaggttgagacaggaggattgcttgagcccaggagtttaagactgcagtgagttatcactgtaccactgcactccagcgtggttggcagagtaagaccctgtctc

SEQ ID NO: 108290 - DNA, 1035 bp, Homo sapiens
ggttggtacatctgtagaatgggatcatggcaaaattcttgccagagtgcaagattatggaactccagcttattactaataacttcaggggtctaaaaactttttctcaaagaatgggaagtaaatatcttaggtttgcagacattatgttctctcttgcccatgagagaactaacttattctgccattacagctctaaattggagataggcaatatgtaaattagtgtgcatgactctatcccaataaaactttatttacaaaaacatacggccagcacaggccagtttgccaacccctcttttaaaccttagtgagaagagaatcagaggcagcaagaggaaagagatttctcaaagaacattagggaagcaggaaaatagggaggaaatgatgacaatggaaaggagcgggacgttaaggggtagaggaaaaccctgtggagagattctattttaaaagatcctatagaaatctaaacaccgatgttaagaaattactaaattttttaggttgtgataatggtattgtggttttgttcttcaaaagtattcttatcttttagagatctctactgaaatatttgtgaatgaaatgatagggtatctggagtttgcctcacaataatctattggagttgtcagaggagaggaacagatgaaaaaaataaataggccttgagttgattattgttcaacactggatgatggatacatagggatttattgagttaatctctctgctcctgaatattccgtaaaacttccataataaaaaactgttttagtaaaagacttggatttgggatttggggattaacctcagagtgaaatccaaagagtaattggagaggaagatggattgcagagagtggatggttgatgagagaaggagaagcagtttgtgttccagtgaaagacgaggagggatatgaagggaaaagaaggtaggagaatccagtggcttctcaagggagatactcaggggatgggaattttagaggaagttctcagaggacacagaatggatgggttt

SEQ ID NO: 108291 - DNA, 1610 bp, Homo sapiens
taggtcattgcaaaagctgctggctgctttaataaccttcatttcgctatttagaaatgaaatgtgggatagattggtaataagatgagtcttctttttaaagagattgtaaacctgtcccccttttttttttcctgcttcctgattatcgtgaacttgttcctagttacaagaacccctgaaatcactggttccttggtaactctgttttgcattcctttggcagaactcaaaatattggagcttaaaagctttgatttggttagttggggaaatatgtgtgttgtaaatcagattattttacttgttaatttttgaattattgcatataaaatgccacatagtaattttgttaatttacacacagttaatgttgtgtgaattccattatgtattttatacaatatgggatattctaagaaaccacgcaaagtcagaggcctttgttaacatttgccttgtggctggacttgtgactaacttggattagagtctagcttttcaaatgcctatcttcagtgaatgctttcatctcatatgcttctgtttggtttccttggcttctttaaagtgatttttaaaacttcagctgccttcttgtaagcataaagtaaaagaggaaaacttttgttttttggttttttgtaagatcattttcatagaaaacaagattatgtaaagccatgcaccagcttcaggattaaatagctggtaagagttgggggaacaaccagccctggaatttaaagtagtgatagtcaactctggagaagtgaggacctccatttgagaagatcaccactgttatatgggctacaatacaatattctgtttaacttttactgtattaacagtggggcagggttttcctcgcatgtgtgtgtgcatatcttcatgaggtatttattacttacatgagaatgaattggactttatttgaccttttgctaaatgttaccaataactatagctcttgtagctgacatcttattattgctgtaaggtgcttttaattttaaatgcttgtaaatttataggattcgttgtccttctcatctggaactgttttgaatttcctgagtgcagcattgtattcccagctgcatacagccctagttgccactgcctcttctctctgccactgacttcccacgtctgtacatgtacacatacatgtgcatacctttgtttaactttttttttcttttttaaactcctctctctactttccttaatgcattttggaacttttcggctctatcttctggatattaatcctgttggaagggtgaacactaggggaacaatatgtgcagtgccatggttaagggagtgatgaaaggacatggatttataggctggagcagtgggtctcatgcttgagtaggctttataatctcttggaggtttagttgagcacaaattgatggaccccacccacggaacttctgattctgtaggtctggggttaatacctgagaatttgcatttctaccaagtttccaggtgatatagatgctgctggtccggaaacacacattgagaaccactgggctggaaaatagaagctcatcagttaaaccacttttcctcctcactcctctacctag

SEQ ID NO: 108292 - DNA, 1003 bp, Homo sapiens
tactgttaatatattagtgctggtatagacaatttggtaaaagcatggagaagttctcttaattcttttatttgatcaactcaaagggaggaagaggaaacagtgctgaagattttagaaaaggatgtgacttagttttcttatagagtgtgaaaatgatttaaccagagatatgtaggtatctctagatataagcaggccacatttgagattctgaagtttgtggtcataacatttaaatgtaacataccgtgttttcttccagtttagaataagtgcagaataggcagagttgatttttcggggtttgggttcttaattcagacagtctccagtcagaatttaaatatgagcacaactctctattttcctgcagaacagaggtctttcccagtgtgctatatttgaacactatgtacatgattggaatctaaatagtaagattattcagagatgtaataaaatatagctataaatctcacctcccttaaataaggggaattgggtgccctttgttcattaaggaataaggtatgctttgatttattttctggggtgttaataacttggtttagatctccatgcatttaattccacttttaatattcaatgtattacttatatgtgctgcttttcctctagaaagctacatccatattggaattttaccgggaacttggattgccgccgaaacagacagttaaaatctttaatataacagataatgctgcaattaaaccaggtaatttgaggttggggagaggagggaggtaaaaatacccaaatatgcaatttgtttaatgtcagccctttcaataaagctacatctaaaatgcaaagtctcaaacacttacttttaaatacaaaactgtatctcattttgtttttttttttttttagtggaaaaacctgtagataactctttgctttctgtgagagagggaggaacacttttgtttttaatgtagagagagtttaatatttgaaaaagccacctcaaaga

SEQ ID NO: 108293 - DNA, 1072 bp, Homo sapiens
ggcatacatcatttctatgggtgtagtctattgataacacatgccaaccctgtttcagtgccaactctgctcctctgccagatgtgttgttttggaccagcacctaaattctgagtcagtttcctcatttataatagaaaaataaatacttcctttcaggaccgttttttatgattaacaaatataggattatgaagcgctgcttagcataatgcattgcctcacaacgggcactatttagaagtgtcttcattttccttagcgtcctcaggaagtctgtccttattcttctaaagtttaaactctgaacatcccttttattttacccctggagaggcgagtcagtcccttcccacccctacctactccaactcacatccaaagtaggacaacggtggaagcagaactatagtttccggggagcgactcgagtgcccggagttcattgtaaaacgcaccggaagtgggtccggcggctttctttccgtcgcagagagcatcggccggcgaccgttccggcggccattgcgaaaacttccccacggctactgcgtccacgtggcggtggcgtggggactccctgaaagcagagcggcagggcgcccggaagtcgtgagtcgagtcttcccgggctaatccatgccgggttggaggctgctgacgcaggtcggcgcccaggtgctgggtcgactcggggacggcctgggtgctgccctgggcccggggaacaggtaggaaggtgtgagggtgtcctacctgcacagttgcgtcctgaagcagtggaatggcctggtgcagttgggcctcccctgggtggaggaggaaggggctctgttgagacgtgggacacagaagaataagggccgttaacctaaggaagcacgttctaaggggattgaagtggtgatttttaaaaaacgcttatgagccagccactagcagcgaacgctattaacagcaatcatatcttacaattagtgagcgtttgccaggtactaagcgctctgctaagtgtattaggtgccttatgtagcctcacgggagcaaactgctatcataaggtttacagata

SEQ ID NO: 108294 - DNA, 1032 bp, Homo sapiens
cagctttgaggaaaatgggctttggatgattattttatgttttagggacccccaacctcaggcaattcctacctcttcacctgaccctgcccccacttgccataaaacttagctaagttttgttttgtttttcagcgttaatgtaaaggggcagcagtgccaaaatataatcagagataaagcttaggtcaaagttcatagagttcccatgaactatatgactggccacacaggatcttttgtatttaaggattctgagattttgcttgagcaggattagataaggctgttctttaaatgtctgaaatggaacagatttcaaaaaaaaaccccacaatctaggatgggaacaaggaaggaaagatgtgaataggctgatgggcaaaaaaccaatttacccatcagttccagccttctctcaaggagaggcaaagaaaggagatacagtggagacatctggaaagttttctccactggaaaactgctactatctgtttttatatttctgttaaaatatatgaggctacagaactaaaaattaaaacctctttgtgtcccttggtcctggaacatttatgttccttttaaagaaacaaaaatcaaactttacagaaagatttgatgtatgtaatacatatagcagctcttgaagtatatatatcatagcaaataagtcatctgatgagaacaagctatttgggcacaacacatcaggaaagagagcaccacgtgatggagtttctctagaagctccagtgataagagatgttgactctaaagttgatttaaggccaggcatggtggtttacgcctataatcccagcattttgggagtccgaggtgggcagatcacttgagctcaggaggtcaagatcagcctgggcaacatggtgaaacctggtctctacataaaatacaaaaacttagatgggcatggtggtgtgtgcctatagtcccactacttgtggggctaaggcaggaggatcacttgagccccggaggtcgaggctacagtgagccaagagtgcacta

SEQ ID NO: 108295 - DNA, 1046 bp, Homo sapiens
agtgaaactctgagaggcagagggaggaggcggagggggcggggaggcagcgccgcggcggcaccaggaacccgcggcagcggagctgcagggccccggcgggggaaaggggaagtggtgagggtgaggaggccggagggcgcctcatcccactctggaagctgagccggcggcgggaggagctagggctggagcctctccagcctcccgcgaaggtaaagccgactccgggcactgggctctggggctctgccttactcccttcccacgccgtggggactttgtggggctcagggcagggaaaacggggtggtcttggctgctgcagcctgcagctgctaaggaagcagattacccttcccccaggctgctggtctggttcctttcgttggacgcccccccggctttgagtgacattagctcagggcgctgccctgtccagccccaccccttttttttgcttgttttatacctagtacgctcctccactcgccttaacatatccttaccccacaggctcttcattcccttgtgggttccgccctcgggattcccttccagtctcctagtctgagcacccttcctgctggatgccggcaactcttgtttccttgggtcagcgaccctccttccgaacaagtcctgcagactgactttctttgctttgtttcgttttgttaggaaatgagcatccgcgtcgtctgttctccagtactttttctaaaatcattttctcccctaaggcttttccttcctgcaaggcagcttattcacgtggcctttcctccgctgctgtgattttatctttgaatgtggcctttggagtgggtaaagtaggacttagacgctcagtgaagtggctgttaatcacttgatacttaactatgtttaagagtgccttcccttaaattttctccttttgtagcgtgttccgttaaccacgtttgtcttaagattgtttcctgtgtccgttgcttagaggggggaaaaaagtaaagatttcaccctaatgtggcggtggtctcccaaagtaattatttctcatt

SEQ ID NO: 108296 - DNA, 1446 bp, Homo sapiens
ttgctttatcacagatctgtccatctttccatcaatccatcttattttttatgcatttcaaaacaaattcacatttttagttattgagggcagagctaatgaaagtaagttccgttcttgcattttacagactcaaaatgggaaaatcagtagcttacctgttctctgcaagttgtcatatttgtgtaaaaattacttccagttgatgatgctaaatacgtgctttaaacaggtgactagcctgattaatgccaatccttctttcactagtgtatttttttctaagtgtattcattcatccctagttaaatgagtgttctgcttgtgtttttgcttaacacaagccatgtgtatatacttaattttgctgtgtgtgtaaatttttttgcttatagcttgaccgtaattggcttgagtgtctgtggtgttgagtcccttcatcttgcttttgttcttagtgtcaacttgatgtaggcttcttctcactggactcccaaatcctgtggttttctgtcaaaattatgtgtcttctaaaagatcattctcattttaaccataaatgatcttaaatggtttgccagtattactgccagtaataaattagagaatgcaagaatattgtgttgttcgaaagcatgatgcagtagtattcattgagagaggtgaatctagccaaaatgcctgtgttgccctgaatttgactttttaacccataggacagttctataaaaagaacaaacagaagtttctttggtggtgtaatttaggatatagcatgaaaacaagtgaagctgactcgcaaaaattggagatgctttcaatgcaatttaattacaaaaggcatgtaaatttgatttttcctcatcagaaagaatcatgggtctttgagaatttgaaatatggaacacaattgcaggaatgaaggagatgaaatttaagtgacgttagtttgagcagataaattcctgctatttcgaatagcctctaaacaactggcagaatggcaaatgctagtgatacagctgctaccaagatctcattcaagatcccatttaactgtttacattttttagttggacagtttgtggttgttgatagcatgtgcttatatttgactgttactgatattacctgcttgatacttgagcttctgatactagaaattttacagatttttttcatcataaatagtggaaatcaatggttgcttaagagtttttgcctataagtgatgatttttttgaatcacttttagagcttattaatgtacagaggaaatattgactgcagattaaatttattttgtgaagttttttttttcttgaaagtttctcaagccatagttaatttgtagccatcaaacataaatttaaaaatattaggttggatacatgtaaggaaacagttctaacaactgaaatttcaaatacctaagtggggaatatt

SEQ ID NO: 108297 - DNA, 3036 bp, Homo sapiens
atcttgaataatactgcacaactcaggctatacagcccttctcttctgaaaaacgtgcatattataaatgtaaatgctacatgtatttttttttcttttgacatttccagttttcagtatctttcttgggaaggagtttggtaagaattaaaagtgacagttaaaaggaaagtaaaccagttaatccacgctcttgtatgctatcaattaatgatgaggttatatagtagtagcagagtgttaaccctacatctttgttacccagtgactaacctgtctgtagccaacattttcatatccgtttgactgtcggagaaaatatgccattctagtgaagtctaacctttttttaggcctgtaatgaaatttaaaaattgggtttaatatattttctttgggagggagtgatggcattttttagtagcttcctagtcagaccaaaatgtaagtgcttctgtttcctgtctgtaagatggttggtaattcctacccttcagatttttgtaaggattaaatgaagtgatatggcatgtatgaaagttttaaaattatgcctcaaatatattgagtattcagtgaatggcatctgttgaccattacaaaagtttagtctctggtccctttgatcagtaataagtaaaatgagtgtgtcacacttttacaaatcagtgaccacattattctgaatcgtgccacaaggtaaaatgtgacacatgcacaaagccagtaagtgtttcttctctcaacttttcattttttagtcactggagtggtaacttcttaggatgtggtatacatctgagctgtctagtatttctggtttgcattagcaaactgcctataattttggaagatttgaatatttgattttgttgtctaatagctcaattgtatgaactcctaaattagaatagttgttaccctttagaatacttgtctctcattttttttccccctagttagtttcaatgagtgaagttagggagaaaagtggcatatccagggtagtatgagtcattttagttctttgaatcaaccttagaaaagtatatctttaaataatccttattttttcctcaagtggtagattactttggtcatcataatatgacttccgtttttaatatgattataacatactgatacattctaaagaacaaacttactgcaatgcttttcgatttgtgagcttgtaagtaactgtgatcatcaaaatttttggtaatgttcttagagtagtgactaagacttaactatcctcttttttcctcgtaataattcagagtacaactgtttgtgtgctcttagcgtaattcttttaggccttgagacttggttttgtttttataacagctttaaggcataacttatataccataaaattcacccttctaaagtatacaattcagcggattttagtgtattcataaagttgtaaaccatcatcactgttttgagaacactttcatcacctcgccttccctgcaaaaaacttcctctaaacactgcgttacaaatcagcagttaactccctttttccccctcttttggcaggcgttaatctacttcctgtctctggatttgtctatttggaacatcttatataaatagaatgatacaaaatgctgtattttctgactgacttcttccattaagcataatgttttcaaggtcgtctatattatagcatgtcagtacttcatttcattaatgtcatataatctgttgtatggatatactacattttgtttatccattcatcaactgacagacatttgtgttgttcttactcttttactattatgaataatgccactgtgaatgtttccatatttccagttgttttgtgtatatacctaagagtggaattggtgggttatgtggtaactctgtttaactttttgatgaacagccaaactgttttccaaagtagctgcagcattttacatttccaccttcaatgtctgagtcccaaatgctccatatccttatcaacacttattgtcttttttattttagccatcctagtgtaggtacgaagtagcttctcattgtagttttgatttcatttccctagtgattcatgatgttgggtatcttttcttgtgtttgtaggtcatttgtgtatcttctttgatgaaataatctattgaaatcatttattcactgtaactaaaaaaattttttttattttacttttttttttttttctttttgagacagagtctcactctgttgcccaggctggagtgctgatctcggctcactgcaacctctgcctcatgggttcaagcaattctcctgcctcagtctcccgagtagctgggattacaggcacatgccaccatgcctagctaatttttgtatttttagtagagacagggtttcaccatgttggccaggctggtctcaaactcctgacctcaagtaatccgcccgcctcagcctcccaaagtacagggattgcaggtgtgagccactgcgctcagccaagtcatttattcacttttaaattaggttgtcttattactgaattgtgagagttctttatatattctgaataaaagttccgtgtatatgatttgcaaatattttctccaattcttcagatttttttactttcttgatggtattgtttggagcacaaagcttttaatttgatgaaatccaatttatcaattgtttcttttgccatttgtgcttttggtaatctaaaaagccattacctaacccaagctaacaaagatttacttctttgttttcttctaagagctgtatagctttaattgcgttaatttttgtatttggtgtgaagtagggttctaaattcattcctttgcatgtgaatatccagttgtgccagcatcatttgttgaaaaaactgttctttccacttgaattgtttcgacacccttgtcaaaaatcagtttaccatgactgtttagttttttcctggactcataattctgttctgttgatcctgtatgcctaaccttatgccagtaccatattgtcttgattattatagctttgtgc

SEQ ID NO: 108298 - DNA, 1027 bp, Homo sapiens
tgtcatctcaaagttcttttgacagtatgatctagatgacagaattatatgagaaagatattagaagaggcttaggtgtggtggtgaagattggtgtaggattgaaaaggatattttcttagccagtcttctaagactgtacatggcaccagcagttacatttggaacatttcaggcattctttcactttttgctcacagaataaaataaacaaattctgtagttttatttcaggattgtaaggagtttcatgtttgactttcagggtgattttgaaaaatagtttgtgaattcacatctcttatcacacatttgatttcactgtgcagcttttaagtcaaagactgagcaaaatcttatttctttgttttagttcctattaattgattaagcctttgaagttttgaaacttttaagctctttagatagcttgtttacttcaccagtcccctaaccctcactccactttaaaaagaagcaaatgactgcttttttgttagagggaagtgctataattctttagtttctcactccactttagacatgtagagttaggaaaaaaaacacaatgtagcaatacttttgtatatggatatgtggtaaagattaataaaatcttatcatttcctttttacctaaatggaaatactttctcatttttataatatactgattttaaaaaatagacaagagaaaaatgaaaatgtgaaagatctctcttgatcttaatgggaatacttttattgtattacctttgagtctgatcatggctgtttgtttaagttattaatgcctttttagcatactaatagttcaaaggaagaaaacatgattctctccgtagatgtcaaaaagacatttgatttaacttaagcatttttgataattaaaaaaatctcgtattaaaatacaactagatatttcaataaatataacaaattatgttaatagatttttctaatattgaagtgtttacctaattggtcacggtgtattactattttaaaatgcgacttgattgttactg

SEQ ID NO: 108299 - DNA, 1255 bp, Homo sapiens
aatttaagcacttgttttcctttgtaggtataagcgtgtcttttcagttggaactcatgcgattactacatataatcccaataccttagaagtaacaaatcaggtaatcctgttagaagctgttaggtgtttgtatgaactccctttgaattttaaaagccaggctgtgaccattaccctcccttaaatcagtacttgaagatagaaatgtcaaatcagaaagagattgatgtgcttacataatactctgatttggggaccaaaaataaataataaataaacaggagggggagaatatgcttatttctagggctctcaagggtataacttgatgttactattagttgtggccacctcctttatgtaaaattagtaatttagttctctataatttataaaggcttatactttttactgtaacaaaagcatatataagtcatgagtccagttagtgtaaaatactcgtcatgggagtaggattatgggtttataaaggcaagagtaacctgaacatttataagtaaacatattcaaagatattctggcctattttaattccaaattaggcatgtttcacaaactttttaacaaatttttaagtagtcataaaatttcacttcccagttcttatcactttttaattttaatttctttggattaatgtcatcattaaaataggaatacatattggatttttctgactaaaaacctttaaaagaattttttacagaattactgtaagacacaatttctagactctattttataaaattttgctgatttaatcagtgattatgaaattaaagtgacaaaaataagcattacattttactgtattatagtagcaccagtcaaaatttttttttttttaagtggccttatggagacatttgcagcatcagccctgttggaaaaggacaaggaacggagttcaacctcacatttcgtaaaggcagtggaaaaaagtcagaaactttaaaattttctacagagcacagaacagaacttcttacagaagcattggtaagaagattccatgttcataaataaaatttctttcttctctttttaaaatgaagtagttacatagaagtagagaaattaatgttctctgcccctgtacccactatgattatttttttcttactgacctttaacttgaccctgtgaaacgttcacttttctctaacaggctggaaaatcttttatatttgcaagtttattagttttttttaattgcatatgcaggagaaag

SEQ ID NO: 108300 - DNA, 1245 bp, Homo sapiens
cagttgtgtgattagaaaagcctaaggtcaaatacaggcctcagctttttttttttgtatgtggaaataaaatatacattaatatactgaggcggttcaggttgtttaaattgaatattacaacttccctgaaatgtgacttagctcttttcattattgaacttggattaaaagaatccatcaaagaaagtagatcttttttccagtaaaactctttcagaatacatttctatgtaggatttcctcttttttctttttataaatttacatagagtggcttaaaatagcttcataaaatattgtaacccaaaccctttgctaattaaaaaagaatgtactgtcttcagttagtgtgaacattcttaaacacctccaaatagttaaaattaatcatagttttaacaatttggatagtagctctaaatatttacgatgacagttagatttttggtcgtttcaatagtgactgtgatacattaaattttattttatatgattttattttatgaacctaaaagtaatactgattctgtctttagagatacaactgctataagcatcactggagtgactcaagaaaacctgtaattttggaagtaactccaggaggctttgaccaaattaatcctgcaaccaacagagtactctgttcctatgactatagaaatattgaaggatttgtagatctctcagattatcaaggaggattttgtatactttatggaggatttagtagattggtaagtactattttaaaaaaaaaaaacactttaaaagggtcatgaccatttgaaggaaagcaaagctttttatacttcattttgaaatttcacgtgagtcctctggaaggaagtataatagtccaggttttggtatcaaagatacctgagcttgaatcccagtttgctgctttccaaaatgaggagagtgaggatctggtgagataatttatgtaaaatgctttacacacaatggatggcttagtacggtaaacagtgactacagttgttattttcattggtattactgtcttaccaaaaagtttctaagctttctttgaaaaagtaatttaagcctggcatggcagctcacacctataatcccagcacttagggaggcagagttaggaggatagcttgagcccaggagtttgagacctgcctggcaacatagtgagaccttgttctgcacaaaaaggaaaaaaaaatgaaaaaagtaatttaaaatcacttactttttgagaat

SEQ ID NO: 108301 - DNA, 1315 bp, Homo sapiens
tggtttgtaacatcggtaggccaatgacttgtaaacatttaaacattcttcagcatcatcttgcaaagaagcctactgtgtaaaacagattaaatcagagctgcgttgtttgaaactgggaatcctgcccacacagtacccatcacccccagtggcttggctggggttccttggaggcccttcttggaagacccagcatgctgttttgcacaaggtgatgagaaccagaacctgagaaattttgagataattgccgttcagtgagttagttgcaaagctctgtatcccagactttattattttaatttagtaatagtcttttcattgaaacaactgcttatttgcctctaatacctacctcttttttctctagaattgctactttaatacctttcctatgagttgattagctacagacacatttcagttgtttcaactctgactttttaaatttctaaatttgtgcagcatttatttgcgtcagagcaaagagaagagattattaaaagtgcaatagaccatgctggtaactacataggtatttcattgcggatcaggaaagagcctttagaattcgagcaatatttgaatcttcgctttggaaaatacagcactgatgaatccatcacatctttagcagagtttgtagtccaaaaaatatcacctagacattcggtaagacccatatgttaaaaatgaaaatttgttcacctgattttgacgttttaaaaaataacttcttaatatgtctcaattttattttttgaaggagcctgttaaaagagttctagcacttacagaaacatgtttagtagaacgtgatccggcaacctataatattgcaacattgaagcctttaggagaagtaagtttcagcattgttagcttaaatgagatttctttctattgataaattaggataattttctttctattttaatgtttactcatggctaaagaatatggaatggacagaatctgtatttaactcttaacatatttatattaattgatcatagaacaatgattattacaaaagttattttccaagtatataaagaatggaacttattactcaactgaaaatttgagattttaaagttttaaactcttatattgtaaacaagtcacatcttaaaatactgacttttgtaagctaagtgatgcattttataatgaaatactataaaactataaacttttttttgttgaagctattttttgttttttcattaggtatttgcgttggtctgtgactcagaaaatccacaactttttaccattgaatttataaaagggcaagtacggaaatatt

SEQ ID NO: 108302 - DNA, 2296 bp, Homo sapiens
acacctcactggaaaaatatgaatgttaatacatgaaaagatcatgaatctttaggaaatgaaaatgcaaactactacatattcactaacatgactaacatcaaaaagactgccagtggcaggtgttggcgaggatatggagaaaagaactctcatacattgctggtaagaaggtaaaatgataaaaccagtttgaaaaacagtttgataatttcttaaaagattaaacacatacttatatggtctagcagttccacttttaggtatctatccaagagagatgaaaagatgcccacagagagacttgcacatgaatgttcgtaatatcattactcatagccaaaaacagaagcaatccatatctagatcagccagtgaataaacagacaaaatgttgcctgttcatacaatggaatactactcagcaataaaaaaggactgacctaatacatgcaacaacttggatgaatctcaaaagcctatgtatgataagtaaaataagcaagacacctaagactacatattctataattctgtttttatgaagtttctttaaaaagcaaaactatagagatagatcagtggtttcctggggctggggagtgttcttttgcaaatgggcacaaggaaattttttggagtgatgaaaatatatcagaactgatgatgattatacagttgtataaatttattaaaaattatcaaactgtacgttttaattggatgacttgtgatttgtcaattagaaccgagtaaagctgttaaaaataattttaaagggagagaaagagaaattaaaattagtgtttaagtaacttgtacaaggtcatgtagcagcacggtgaagagctagtattagagctcttcctaaagccccactgtttgtgtttcccattgtaactgtagtgtgtccctgagcagattacctgctaaagggcctatgcttcatgctagatcaaaattccccttaatcatcaatgctaaaacctttttttacttttaatcttacttagagattccttattagcaagtttgctggatggagtaagagcctctggtaatagagatgtttgtgtaaaaatgacaccaacccataaaggtcagcgatgggggttactcagcatgcctgttgatgaggaagtagagagccttcacctcaggttcttagctacgcctccaagtaagtattgatttaaatgtaattacatttccactcatctacttaatttaagaattaggaattcgtatcttctttttgaacctcttaatctctttacagatggcaactttgcagatgctgtattcaggttcaatgctaatatttcatacagtggagtcctacatgcagtaacacaagatgtaagctaagttttatcataattgttcattgttactaacttttggtatggaaacttttttgaaatactctttcttcacctagggtctcttctcagaaaacaaagaaaaactgatcaataatgccataacagcattactgtcccaagaaggggatgtcgttgcttcaaatgcggaacttgagagtcagttccaggctgtgaggaggcttgtggcatccaaagctggtttcctggctttcactcagcttccaaagtaagttgtcttctgaaacttaacttctcttagagaatttgaactactcaaaatggcaaataatgaacgattcacctccttttccttgactaaaccagataccttttatagggtgatatggtactttattcatgagaaatgaaaaaggaaggtgagggcagcagaagcggaatattggtcccatactcaccagtaatataactgactcttgaatttgaatgggaaattacatgccttttagttttagttaaccctaaaaaatattttccctctcaaagaaaaaactattatgaagactgataaatttcagaggtggaatttaaaatacgtcattgttccagtagtgcaatggaaagttaatatgatctatttcaataatataacaatttaaaatgttctggtattgctagtatatgcttgttttttgttccaaaaggtttcgcgagcgtctaggggtgaaggtagtaaaagcactcaaaagaagcaacaacggaataatccatgcagcagttgatatgctttgtgcccttatgtgtgtaagtagtagttttcttaaggaaactggtttttcttaagttgactggtggttttgatttccacagtcccagattttcattgtaccaataagttcttgtttctgtttcataaattgttctcatagttactcaaacctttgtttagcata

SEQ ID NO: 108303 - DNA, 2274 bp, Homo sapiens
tagtgaaagaagtcagtcacaaaaggataaatattgtatgattttaattatatgaggtcaaattcacagaaagtagaatggtggttgccaggggcttgggaggaaggcagaatggggaattattgtttaatgattacagagtttcagtttgggaaaatgaaaaaagttctagcgatgggtggtggtgatggttgcccaacaatgtgaatgcttaatgccactgaacagtgtaatttaaaatggttaagatggtaacttttgttatatgtagtttaccacaataaaaaaaagtaagaaacaatgctatgaaacaaacattgagccctcattacatattaggtgttggctttgtatcttacatgaattatctcatctaagcatcatagtaatgttacataaatactattactcctactttacagctgaggaaaatgaaacttagagacttatgtaaagtaacttaccttgcgtaacgtctcccagttattgtcagtagtaaaattaggattggagctctactcctaaccatcacgctggaatgttttatacactcaaaagaaaatcaccctgagacaagtatttgttgttaattttagtacatttaaatgctaagttttatttcaaattttagttataaaattctgggtgggcaaatgtttgccttttaataagatctgtgacttttgagagagtaccttttgtatatgttgagttaattgttgggcaaattatctgtgaagtctgatcaaaatcatggtaaatcgtcacttctgcctgcttatcacgagtttcctttttgccttacactttaaaggcaatggtttttaattctttcaatgtgtaatgaatactgtttataaatgacttttgcgtgatgctagcacatgggactgcttatgaattatcactgttttttttttttcatcaatagcccatgcatgatgactatgacttaagacaagaacagttgaacaaagcttctcttctctcgtcaaagaagtttctggaaaacttactggagaaatttaattcccatgtggtaagttataattaaatttgtcttcatggtagataccataccattattgaaagatattctagaagtgccacgtggatgattttttttttttttattgtagcccccagctttggtcagtattggtcacagttcagcttggtcactgataataaaatattttgtcttaggactatatccattcacctgggaaggatagatgtcaaagcctttagattttcacagggatactccaaatttttgttttttctttctttaaaaatatcattaggaaataaactgctctaaaaaaaattaagccaaatctttgttcctcagtccctgataacaattttggagatgggcattctatagcatcttgaaggaacataagcagattgccagagttttgcaaatattgtcaaatattattttttgcaaatattaacctttgttatacacatttgagaagtcttggttatactcttgaaatttgaattttaattgttccttttgaggtatgatggataatggattcactatatgagcaaaagcaagtactaaagagtcatccaactttgaacctcatgttgagaaattaaagtcaatgttgatgtctgacatatagaataacagaaaggaacacattattgttaaaatttaactgaaggtccccatctcttaagtctttaagagaatctgttgcattgtttcaggatcatgggactggtgccctagttattagttcgctcttggacttccttacctttgccctctgtgctccatatagtgagacaactgaagggcagcagtttgatatgctcttggagatggtagcatccaatggaagaaccctttttaaactttttcaggtgagagcttgtatttttcttgtcagataacagtgaatttaagggaaccgcttttaggatcactgtttctaagataacatttgcatacttctatagcagaggtgtccagtcgtttggctttcctgggccacactgaaagaagagttgtcttgggccacacataaaatacactaacactaacaatatctgatgacctaaaagaaaaaaaaattgcaaaaatgtttttaagaaagtttaagatttgtgttgggctacactcaaagccatcctgggttagctttgaataaatataagcatccatgtaggctgcgggttggacaagcttgatctataatattgacgaataaatgcacctagtacattatcatattggtacattttgagtgt

SEQ ID NO: 108304 - DNA, 1867 bp, Homo sapiens
ataaatctgttactgcattatttgtttattttacttacttaaaagttagcattctatctgttgctcttttttggaaggataatgttgacagtgttgaagtcttgagatactgagcttgtatagaaatctattgatggagttagttcataccaaaatgataccaagtaagaaaggcaacaaaaagttcttgataaagcatatttgtaattgagctctagagattggagcatgatcttgtcgaagatactgcttctttaagatagttgctttatgcttctatattttttaaaaggttgtagctatgaatgtctgttgcatactatgatgattacaatgacatcagtctaaatggcttttgaattcttgtattttgttgtcatagaagcaatttgaatacaattgaagaaagtctccttttaccaaaaaattcatttattgtgcataagtatagcacacaattaatcacagaattagtatgcccttaagtagctgtaaatatatataggcattgaactgaatggaacatcaaagtttatttgcatttttagtgtgcatatacagccaaaggctaattttctccctttagctaatgggttctttgctcaatgttagcttccaaagtgcccatcttttacagagcttgcgatagccaagcctctcctttttgttggcagctatacacagagggagtgaacctagttttaatattaagtttagcaaagcatagtttatgaggtaaatttgtctggaaacatctcaaccttattccaaaggtttaaaaattacctgtgctactactcacctatttttttttgggtgattagaagatgcattttaaaaacttctattacatactgaatgtttttttcatttaaatatgtaaaattagttttttaaagtttggatagcttgtcctggattgccaccttagggatcatcttaccctttttccaaaggaaggtgataaagaaattgctacaaaaatgcaggagcttgccctaagtgaaggtgccttacctcgacacttgcatactgcgatgtttacaataagctcagatcaaaggatgcttacaaataggtaggtgatttaattcaatttgctgcaatttaacttcctgtctagagaattgattcagatgttacataaaactaaatgtgtttgtattacacaaataatacattttcttttgatccacctagttcttttcctttccttacagaaggattttgcccaagtgatcactgtccctgcctatggaaaacctggagggaaacactgtttactttttttccccgacctattatcaggccctgacaccatagtcatgggaccaatatggaaaagggtacttaaaagcttatggaactagaaccacatgctcaggtcttttctccttatatccctgtgaccatcttgcatgcacatgaccccatgggaaaacctcacatagttgatttttaaatatctttggtcaaatactctactttaaaaaccacagaaaaccttacatatccagcctaagctagacttaacctaaatctcttgtaattaaatgattccctttttcctgatagtcattcaaatataaacacataaatttattcacttattccacactacatgaattccagccctttttaaccctctttgtggtttctaacatgtgaccctttcagctatcttaagcatactatattatgactcatattagtaaaaacagtatcataaatagttttaattttattttttgactttttaaataatagcataagttgctgagttaaacgtttagtttgttacaatactgtacattttctttgtcatctatgtgcagttattatacatcatggtatgctgccttgccag

SEQ ID NO: 108305 - DNA, 1064 bp, Homo sapiens
ttaattgaacaagttatctgtactgttaaaaggggatggtttgttttttattgaaaagttatttatcataggagttaccgtaaagttttaccctcaatagctaagccacagtattaatttatttgggtttttaaggctaaattttctttttcacattgttttgaaaatggattttgtgtttttagccgccaggcttgctggcatacttggaaagctcagatctcgtacctgagaaggatgctgatcggatgcatgttagagacaatgtgaaaatagcaatggtaaatatgactgtcccaagtgtgccttttttaggagtaagggtactgttatatatatgtctttttttgaaacacgttaaaaattttagaaacaaagaattcattgcattgaatagtatacttaactattgatatctttattgaggtaaaatttacatcccataatattcatctttttaaggtatacaattaaataatttgtggtatatttacagagttgtgcagctatcaccacaaattaatgttatgaatagtggtcattttattctgtgttttgtttctctaattcaacttattggtacgttctggagtaccagtaagtgtgtaaatatggtattttgcacatatgagattgataaatgttgttggtaaaaacggccaaccatgaaaaaagttataggtagggtttttttccttacaagatctatgttaattataaggttgggccatccatggaaaaattaaacatctttatgatacactactataataatttcttacgtgtattctttttctgtcatcactccttctctgtctgcacccagctcccacttgcatcttgccacccctcataaaagaatcatcttgaaacctaagtagaaaagttagtttcttggataaaaagtataattgtagaagttttcagtttgtttcttcactgaaccataacatccagcattaaccttataaaatagatagaatgactcagctttacatagagttttaaaataaatttgcaaacaggcatgtaatggattccaacattattttacaggatcagta

SEQ ID NO: 108306 - DNA, 1160 bp, Homo sapiens
agtaagggatatttatagattttttaaaatgcttagtgcatcctgctatttcctcattatatgtatgtctaggtttggtcaagaccatgccaggtcaaaccttatttggaatttcaaaacacgagaagaactgaaagatactcttgaatctgaaatgagagcatttaatattgacagagaacttggaagtgcaaatgtgatctcctggaaccaccatgagtttgaggtaaagtttgatttttccagtatattaatcttaaaaaataaagcatgtactatttggggagtgattttttttaaaaaaatttgtaattacatatctggtctttacctttccccctttaatgttatgtaggaaatactggaaaactttaatctgtgtgtcagacaaaaataaaaaaattttgtttagtaacttagctttgtacctgagaatcatgtaagaattttaataaatttgattctgtgcattccaaatctattctttccttttttctttttttttccatttctgggacctttgagttcttttttcattgaaacataccctgtttgccttgttccttgtaacttgtttgatttttttttgtgttaattgattctgaatgtgaccatattttgctgttctattaaaatattgatgtgaagagcaggagaaacaagaaagatggtggtagtaggtaattttatacgtgtgggtgtatatatagttgaagtatattataaacatatacaatttaaactattatagctttaaatttgaacatgtgagtgatcctgcgggctttgatctttaacccagttgcatttccatattccatttggatatgctcattcttttcttagcaaaatgaaaaacttgtctttactttgttttgggagtccgtattctgctagattttctcctttttcactgtctaccacttctcaagtcatctttactcattttgcttcatctcgctgaccactaaatgttggctggctccaaagtttcagttctttgacctcgttcatttttattcattgcctcaatgaaatcattaagtttcatggctttaaatatttttattttattttattttttatttttctgagacacgaccttgctttattgcataggctagactgcagtggtgccatctttgctcactgcagcctct

SEQ ID NO: 108307 - DNA, 2186 bp, Homo sapiens
gatgacagagcaagaccttgtctcaaaaaaaatttttttattttaagaatttgtcatttaacatttgaacatggtggaggggacaaattaatcaattcatcatgcagctcatttgattgctgcctgtttgttgcagtgtatatgttttatactttcttttgtgtttacatccttttacttcaagtatcatttggaccaattatttcacttacattatttcacttacttcaatttttacttatctccttaaagctatatattaatctgatgactttaaaatgtctgcctttctagggagattagacaagttatataaagaatgtaattttcaggattcattaaggaattgcaataattgacagatttctatgatttttctccttaatgtttataaaatggcattacttcttatgggctgttggtttattttgtctagtaatagtaataccttaatttttatttctattcacttctgaccagattctcatttatttcaatagtgcacagataaacttgaacgagataggttgattctcttccttaacaagttgatccttaataaggtacagtagtttcgcatacatacattgttatttccaagtcatataagtatgtaagataaactcacagtttgagttgattatccagggagtgttcttttctgtcttctcctttttagacagaaagttctgtgtgctctaatctcctggagggagaggtttttgtcagtattccctgtatagtctgtcttaatattgtgggtgcagaatgaattaatgataataaaattctgaatgacgaataatggatgacttttaatacattaaaatgatttttaataataaaaattagcttatttttctttagggactctttagggttaaattttaagtaaaatatatgcttgacataaaatggaaagtctttatcagtgtacattttgttgataaaaagtaattggaagttataagattagtcattttactctgtattttctttttaaagacattttaataggttcatgctcatttcaaacaagaggaattcacagttgtaatatataacattaattcacaatttatgttgaagtgtaagcggattttcatttcttaaaactttgatactaataccaatttgcatagttttattcttaagtaatgcaaatgttttaaactgaagtgtaattataagtacaaagaaattttaattgaaattatagtctcttaacttctaagaaattaccagttaagtttatgaaaacaaactggaacattaaaagattttttaatatagcagactttatttctgatatagaataatctgtttattaaaaagaccttgacagaataattgtaaaaccagaggttgttttttcctcagaatatatttaagtaaaaattcttaagtgatctctttgtaatatagttttgcccttttaatcaattggaattcaggttccttgaacacaaaatgctgaaaagaccaagtaataccagtcgtatcacttatttccaaggactccaaacattcttttcttcgaggaccttgtaggtggtagtacctattgggaaaggtactattgggataggttttaggttatgaaaaatgtttagattacgaaaaaaatgttttcctcttccagaaaaatgttaaggatctcatggattcaaatggaataagaatccttgtggacttgcttacccttgcacatctccatgtaagccgagctacagtaccactgcaagtacgtatccttgtttacgttttacaaatttaacgttctttgagtataattttagaggcaaaagaatcatagaaatctgaaaagatgtggtcacacacttatttttccagtaattacagtagtactagttctgagatttcacacagaagatgtgaaaccactgtaagaacgatccaaaatggacagtaacgattgagttttattttgtcaattaaagtaactgtatctctaatatggcttatcttgaggcaatgtgacttttaggatataaattgaattcattagatatgtaaatagtacttttaacattggcaagcagtaagaatatgctttgccttaaaggagtctggacaccttcttgataccagccaagaggactgatacttaacttatagaagaatctatccttagctcatttgatgtttttggtgttttaatttcc

SEQ ID NO: 108308 - DNA, 1524 bp, Homo sapiens
agctccaagggccctgcaactcagtttccacatgaaaaatggagaaccaaacatacatataaaattatgccttcaaaccttgtttaaaagctgttgttatggagatagcactcaggtttttagtgatttttatgtaataatttctggctgggtgtagtggcttacacctgtaattccggcactgtgggaggatcgcttgaagccaggagttcaagaccagcctgggcaacatagcaagagactatctttgttaaaataaaaaataattagctaagcatggtggtgcatgcctatagtgtcagctacttgagaggctgaggtgggaggatcgcttgagtccaggaggttgagactgcagtaagccatgatcacaccactgcaatccagcctgggcaatgaatagcgagaccctatctccaaaaaagaaaaaaaaaaagctatcttagtacttacgtcaaactataatgtttctatatggtatgaataagtaagttttaatatgcagtctaaaattcattgaaaattattcagtccaagagctaaggacagttttcctctttatcttgatacttgatcctgcctctgatcttcagcctcccaggctcatttcgaattgggcaaagatagttttatggaggaccaaccattctgctctagtataatttgattatttagcaccccacctgtcatttttactctttccagtattctttatgctctgcaggctggccaggtggtgggttttttggtttttttttgtattaaccaaatttgggttcctaaaggcctgtcaacaaaacttattttttctgaaatagtgtacttacatgtttgtttcataatttagtatgtatttactataaagtagaaaacactagtgaggtttttcattttattttgtctgtttgtaataatgccttccatccattagatgcaagaattgtggaccaaaggaatgttaaatgcaaaaaccagatgctgggctcaaggcatggatggatggcgaccacttcagtccataccccagcttaagtggtgtctcttagccagtggacaggctgtcctgaatgaaactgaccttgctacccttatattgaacatgttgatcacaatgtgtggatattttccaagcaggtaaaatgtaattgaatgtttccatggttaattgatatgcttccttagtaacagcatagaatcggtctggtgttttaaaacaaagatgtcctatttatggccttggaggaatgctgttttgacctttggaattttttgaaacagatataaagaatttgcaaattatattaataaagttgctaaaaaagcaactttttctgggagatttcaaataatgttacaaaactgagacttacaatagtaacaattttataatttatgtgaattggtgttaatgttttgaattacatactgcagtccatagacagtggtgaatgccagctgttgatctgacacgctagctatttctgctatagaaggcaagtgtaggcccacgtcttgccccacttg

SEQ ID NO: 108309 - DNA, 2841 bp, Homo sapiens
agattttgactattcttagttatgttttcattgataccaatgattcaaagcattgagttggtattaatctaggatacaccaaaatatctttttcttttgcattattctgcttttttggaattaagctatttaaacttcagattaacattaaacccaaataagtcaggtcctagacatttcaggcaaatgtttctattaagttgtatgccagtgacttgtgccatttgtacctttcagttgtacattggtctgcagtgggaaagaagagttaactcagtttatatatttttacattcacttatttactacctaaatgcttatgtaagtcattgatgctgaaaaagacttctaaatacagtaatgccctatcctttttttttttttttttttttttttttgccaatttctgttatttaagcatactcacattttaacatttctttgcttttcttttgtggacatttccattcgtatccttcagtgaaaaagcactgcaattattgagggctctaaactattaccacatcccctttcctgtggggccatgtggctgcatatgtgaggtgatgcaaagagaggaattttttctccctgatagaccctctcaacatgtggataaaacaccacacccaaaagatcaaccgctcccatttttctaagtcttacgaaactgaaaggaaaaagtaaatacaaatggcattaaatttcagtctaggaagggatgattaaaaaacttttaagaaatgtgctcagcataacatgaagcttgggggagggaggctttcttttaattaaccaaaaattttcagtaatatctgaacaaagtgattaaagatacttatattgataaatctagcttcgaacagtgtgtgactcctatttttttatattgagttcaaaaattatttttaagaagttatttttgtttttcttttaattttttctattctgggagacctgaatcatgccaaagcacagttaggtggctatagtagtttctgggaatgttatcttcatcggttggaaagggatatctgtacttcatttgactttaagagcagtcatcatttttaccatctgatagagcttcagaatttttagagtaatccaaaatacagtgagtaaacgttctaggttttctagtatagtgatagtttgaaatactctaggtgtgtgtctgtgtgtgtgctgaataaatgttataggttttctagtatagtgacaaattgaaatacggtgggtagttgggtgtgtgtgcgtgcttgtgtgggtgtttgccactaatttccgtaatgtcaagtcttgaactactgccattaacactagggaaaattctatatgactgtatgtttcctttttaaaatatgtaatagtatgaaacgcttaatctaaattccttgtggaatagataagacaccaaagcatagagaaatttaagttatttacttaaaagacccatagctgtttagtctcacatatgagtatagaactttggcctcctaatctgagctacttactctctttattgtaaattaattaattaattttatttatttattttttgagatggagttttactctgtcgcccaggttggagtgcagtggctcaatctctgctcactgcaacctccgcctcccgggtttaagcaattctcctgcctcagcctcccgagtagctgggattacaggcacctgccaccatgcccggctaattttttgtacttttagtagagacggggtttcaccatgttggccaggctggtcttgaactcctgaccttgtgatccgcccacctcaggcccccaaagtgctgggattacaggcgtgagccaccatgcctggctgtaattttttttttttttttttttactgggagcatttgaccccgaattgaggattcattggaagcaagtgttttatagaaaattggaacgacacctttattaagcttcgtagataaaacttattaaatgtttatcaaaagtttattcatagcaattctgtatggtttttaattagcccagatttattagagtaattccagaaattcccttcagtatttctagctcaaatttctagaggccacatcttttggtacttcctggtagcagatgtactacctgatacttgtttaccctcttgcctgttacctgcacttctggatctaccttttaggctgttttattgatcattattttctgctctgctccttgagttctcaagaagccttcaggggattcttgtgtcagctcagctgagttgaaacaaaccgagaagtctttttaggaagattcttgcacaagaagcaatgttacctgtaacattatgacaaaactagcttcaggcatgtttgggcttttctgaatacattttgatcaattctcaattgatgttctgcattaaatgttgtagaatgaatcatttttcaaatctgttgtgggtctggtagatgagcttactgactcccatgggtttttattttataatttacataaggagctataacctcagcatatgaaataaaaaacctaaagtgatgatgcaggttttttacaacccaataaaaacattttaattttttttcagctactgctgacctttgaccctatccttgttgagaaggttgctattttgttataccatatcatgcaagataacccacagttaccccgcctttatctgagtggagtatttttctttatcatgatgtacacaggttccaatgtgcttcctgttgctcggtaagaactttaagggtaatctatttaaaagtattatttgaattttatatggactgatttaattgaattatttgtgagtaccttattgcttttattaaaa

SEQ ID NO: 108310 - DNA, 1036 bp, Homo sapiens
cacaccacaatatactgcttgctttcttactacagtgtatcatctaattttgacgtttttcatggtttctggacactttaaaaattaaaacttttaggttttatctttcacccgtaaagataacatgtaaaaaaaaataaatcttaattcttcctgggtttaatttgaagcctaatacataacacagattggcagaggatttaaaaaattttttaaatagaggaatattgccttgtaacaaataccttgctctgcccaactatacagcagtgctcaggtgattttggttatttgtatttcagaaagctgttaattggacagctaaaagtatccatttaaataaatacagcacaataattctataacttaaaaattatactctgaaatagttttactttgatataaattttaatcttttgtctttaaggttaagcttctaaaagatacccttgatgcctggaagaaagaagtagaaaagaagccacctatgatgtcaatagatgatgcttatgaagtgcttaatctgcctcaaggacagggaccgtgagttgttttcagtacaatagcaaatgtctgtcccaccttaaagtaccagtatcaaagactaagttatatttaaatcaatcattttaaaatcttttgcctatactttgatatatacaccttgggaataaccatatggaactatatctgtgtgactttcatttattgcaaacttattagccaaattgtatcctcctcttcttgctggtacattcatttctctattaattggaaaaatgtatgcagagtatctggcaccatatctgacacatggtagccattcacatgttcatttttcctcttccttttgtaatttgtattatgcatgtggaagagatttgatagcaatatgcctaggacaccaaatgacagattatgaaagaatgcagatttatcttgtttatcagtgaagttttatagtagactatgttatggaaaaatggtttgaaaacttaagtatagactaaaactgtatattttggcaagactgata

SEQ ID NO: 108311 - DNA, 1040 bp, Homo sapiens
acgtgttaaatgagacagaatggaatctggaatttaaagatcatttcatgttttcttaaatggcatatgaaagcctatcataactttaaaagcctctgaaggttaaaaacaccaagagcattcagattttttaaaagcagtagaaacttttcaaatgatgatatacttctcatacgttctatttcctattgtagctctcaggaccctctagtcctgtgggacagtttgaagaacactggtatagatgaaataggtgtaatttcagattacaggattatccagtgtttgtggggccatttgcagtagccctaacagtagcagtcagaaagccaggagtatgttcaaaacatccccctttgttggggatgaggggttaggttcaatatggcagatgcccaatggcttgggaactgaacttgacttacagcacaaagtgggagagccatttgctatggtatgttgggagagaaggaagaggactttcaggatttgagataagcatggagagtgttgggtaactaaagacaagagatggtgttgcagtttaagtattggaggggacaacctgaggatctagcagttggattattaaagagagcagtgattagttgatttacttttacatgagtttaacagaatacgtttataatacattttagatatatggcttttactaatcagaatgagtttggaaacctttttcaaaacccttggttgtcttttaatgctgataactaaattattagccacaagatacagttatggcccatcctggtttctctgttatcaaggtcatctttaacttttcccaagaggggtttatacccaagaagctctgaggtggaggtcctgatctgacaggacttagttattcactgttctttcttattacgtatgtgtcactttttttttttttaaaggaaaattaggacctgttccagggggccttttttttaaaagccagtttagaaatgagttttaaggcagattattggtcagcctcaaaagtcaaaaagatttatgctgatttcaattggaat

SEQ ID NO: 108312 - DNA, 3045 bp, Homo sapiens
catatctgagaatcaactggagggctcattaaactgtaggttgctgagctccaccccaccccaagtttctgattcagtgagtctggggtggtggcctgagagtatgtttttataacaagtttccaagtgtcattgatgctgctggtctgtgtatcacactgtaagaaactgtactaaagcacttgtgatctgttggcttacgttttctttcttagagaatagtttattgaacccatatgtttccattacccagcttaatgccattcttgtttcacatatcttccatccctcactctcctatctctagtattttaattggcttaacatttaaggttgtaagataggaaattcatcaggagttcattaagagctttgtagagcgtgtctttctatttgaccttttgcttatgccagcaaaattcagaatataaaacgagtactggctgttgagttccatcctctattttgaagtccgttgtgtaaacagaattgtgatattctgctatgttaataaactatacaaaattaccttaatccagaggccagcaaacttctaaaataaaggtccagggagtaaatatatgagtctttcaggcttcatacagtctctgttacattttcttttgtgacttttttacagccctttaaaaatctaaaaaccattcttagctctttggcagtacaaagaccatggtcagtttggcccatgggttgtagtagctgtggtttgccaactaccccagcatttataggaaatcttaatgagaaagactagtgatctagtaaagacattctgtttaattttggaacattgtatataccattaagcattattcacaaatttctgctggtttgatttctatgtgttaaataaggaatgcctatgtgactctactggtttttttgctctgttgtgttgtctgcaggtgtgtggatacataagtaaatgctacagtgtggctgctcagtttgaggaatgccgagagaagatcacggaaatgcctagcatcatcaaggatctctgtcgggtactatattttggcaaggtagggttaatctttaatgctttctagatacagacagcaaagtgtctttttgtcaactagccagttcctaatgtataagcacattgttttcccaaagttatttgtaagtaaaattatttggatttctaaaagcatttttcacagaagccttgctgtaaatggaggctttgcttctaggctggcctacaaagaaaaagactaaagtgatacatctaaagggaagtgggttccatctgaacattagaatgagtggcagggagaaaagagaagcctgtaataaataagtcttttaaaagcaaaaggccagcccggtgtggtggctcacgtctgtaatcctagcactttggcaagccgaggttggcagatcacttgaggtcaggagttcaagaccagcctggccaacactgcagaaccctgtctacaaaaaaatacaaaaattagctgggtatgatggcatgcgcctgtaatcctaggtattcgggaggctgagtatttggctgaagaacaagcaactccagaaaattcaaccataaggaaaagtttagctggcatgctgacaccctatgtttctgtggctagtgtgactgagatatatgcttcagaggtagcctgtgccactacactccagactgggcaagagagtgagactctgtctcaaaaaaaaaaaagaaaaaaaaacagggccatgtaaaacctgaaaactagagagttcggcactgcttggtgggaaaggctttagagatctgagaacttactatttcctcccaatccagacctgctgaggaaggttgactgtgggtagatgagatagatgactgggagggagagagaaatgtcttaaataactgggcagagtgagaattgtcttgaataaaacaggatcgagatgctgatctagtactaaagtatcaagaagtgagggaattgatgaaaatatctcctctactatatctacttaatgtccttagaagtatttgattacagaataaaaaactgacataaataaatcttttaacaactgcacaaaatatgtcgttacatttaagatcactagcgtgtaagttgctattgatgccatgtcactatttttaaaaattaaaaatacaagaagtgaaacaggaaactattcccaagtcttctgacattagccttaaaggtagtaattctggtatctcgtcatgaggtcacttttaattttaggctttaaaggatgtaggattcagatttaaattggaattgaaaatgtaagaagaggtaaacattttacaaaataacgtggttggcttgacatacatgcacaaccagttcctcttgggagcttttttttttttttttaactctgtaacaactaatgctctcatttttattctctcagagtattccccgcgtagctgctcttggggtagaatgtgtcagttcttttgctgtggatttctggctacagacacacctatttcaggctggaattttgtggtatctccttggttttctgtttaattatgactacacactagaagagagtggcattcagaaaagtgaagaaacaaaccagcaggtaactttaacattgctttaatattgaatttgaacccaaaccttaggttggtgttaaactaatccaaaccaaagctgctatccagagtccccagagataaattgtttttcaggaaaattaggttttttgctttttaaacctaatcacttacttacaaaacttttagttgtaattgcttatgcttaaaggattccaggcaagggaatttgcaatagcatatactggacataatttaataatttcttaattactcagagtcaactttatgatggcaaaattatggttgtgtaacacaggacaatataatgttaccatcaggcagttgaggctagctcccctaaacacttgagtacttgtctgatttttatagatatttttctgtctcttctatgtgctctcatttattgctcatattgtaaatgtgtgcttctagcaggcagggct

SEQ ID NO: 108313 - DNA, 1017 bp, Homo sapiens
tcagaccaccagacacaaggcttcctctggccaatattaggagaaaatataggttgaaaataaagatttttttagaagatgactggagtcacatcagatcatcttttgtgatgattcctcatcacttccagaagcagctgaggagcttcttctgagtgcttggggatcatatagggagtttttgctttcattttttgttttttctatttaaagacgggtctcactgtcttgcccaggctggtctcaaactcctggcctcaagcagtcctcctgtctcagcctcccaagtaactgggattacaggttcaagccactgcccctggcttgtaggaggtggcaaagaggatttggtggttgatttgtttgtaaaaaggaaagaagtgaggctttgttttagagtttactcttagaggaaaaatgtactatgccataatgtatatcacgtatcacagagtaatatatatgtaaatagctattaagcagaatgagttaagtgacttgtgacgtccctttgaaaattgtcctttgaatttctaaattttatataacttaattataaaaatataaccaaattttagaagttctgtatcatactatctgttacttcgattgataaagggaggaggtattctaatctcagaattgttacactaagatactaatgggagtatatcagatctctggaagttgagaaatactttataatgtttcctgccctctacatcccccctatagtgcataggtgtattcatgtgtatgtataatttaatcatgttttattcactttcatagcttaaagttctttcttttgctatggagttatttcttagggcacccatgttgtttaaatacttgtctgcattgattaggttccaaaagcatttgctgcaagtctcttggattatataggctcgcaggcccaatacttgcacacattcatggccatcacacacgcggcaaaagtggagtcagagcaacatggagatcgcttaccgagagtagaaatggctttggagg

SEQ ID NO: 108314 - DNA, 1050 bp, Homo sapiens
cttattagctgtgagaccttgggccggttaaactgggcatcagcttcctcactcataacatggccatgaaaatacctgtctcactggttattatgaggattaaatatgacatcctgtgtagaacatctagttaagtgcctggcacagagctggtgccaagtaaatataagctaacctgatgatgcattccttgaaatgtcttttactctgcaggtcgtcagcttgttctggaaactctttatgctttgacatcgagtacaaaaataatcaaagaagcaatggcaaagggtaatgtatagagtgctttcttagctagtcatgtgcaatataatgaagcttattttgagctgcattttacagcctgataaactagaagaatgctttggaatgtttacagtttttaaaaactacattcagttgaaatatggttgaaaatgaattctgattagaaaagtcaaattctttataagcactaattatctttttccttcataggtgctttgatctatttactggatatgttctgcaattcaacacatccacaggttcgagcccaaacagcagaactttttgccaaaatgacagcagataaactgataggtccaaaggtaggcacaaaataagttcttgaaaggaaattaattattaaagcattgttactttgatactgatttcaagaagtttactgaaatctgagatggtgaggataaggaaatgaggtgatgtgaaagttggaaaattcacattccgggaattgttcctatgtattactgtttgagaaaactagagtcagggcaggctgtactggaattgaaaagtcttaagagaatgtttggattaagatacactgttcatctccctcgaagagggaacaaaaagtatatcaagactatgacagaagataggttagactttcacactacaaggattggcctgtggaaataactagtgaaggagatggtggtttgtgtattttacattccacacctgaattattaaggacatgccaccctcagcagtgaattcatataggggcatgagtgtaacaac

SEQ ID NO: 108315 - DNA, 2104 bp, Homo sapiens
aaggtggtatttcctaaatgttttgtcacacagaaatgtctttcatcttagtttagtgcatattcccacacatgtattatttatactcatatatgtgtatgtatttcaagtatatacaagtcctcattttacttctgatactctgatgctttctatattgaccaattttgttttttcaacaacactcctgattgtttcataaacctctttaggtcacagctcataatttgaaacactgctttaagttttagctcaatttggctgtaccttctccccaaactccttcctcaggaatagctcatcagcccatacactgtcagccatctgttactgtcacaagaaaatactctgcataggtatcttcctccttgaattacatataagtcggtaattgtaggttcaaataatagagtccagcttcagagggacgactgacttgaggacttctttgggtctgccttaatgagatgtgtctggcatagtgcctgctatggagtgtttgatgaatgctagttcttgctccatatttgggtctttcctcactggccttcttccttgttgctttggaagttggtttttctttttgtcttccaacatccagtccttgattttatgttcaaagggcttgttttactttcctaggtgaatgaaatcctgtgccgttcttcagtctggagtgccttcaaagatcagaaacatgatttgttcatttctgagtcacaaacagcaggatacctcacaggtaagccatacctaattggttattgtaagacacctggcagaagccacttggaccttccttttgccctaaatagacttaaaattgtgttcagagtgtttcttaggctaccagctgacctttcttggaggtgctatgagcatgtagtagacatatggtcttagctttatatagcatgcaaactgttgttgtgttgaatgggtactgactaaagcatgtattttgttcagttttgatccagttaattgggtcatagaatatatttggagcatgtctgtattaaagtatttatcttgtaaagagaaggaataaatatctgctgaggaatatcagtgtcagaaacatgattcatcattccatatctgtcagaataacagattaaaactccaaatatgtataattgtatgtaaaagatattcttggctgggcgcggtggctcacgcctataatcccagcactttgggaagctgaggcgggtgaatcacgaggtcaggagatcgagaccatcctgtctaacacagtgaaaccccatctctactaaaaatacaaaaaattagccaggcgtggtggcgggcacctgtagtcccatctactcgggaggctgaggcaggagaatggtgggaacccgggaggcagagcatgcagtgagccaagattgcgccactgcactccagcctgggcgacagagcaagactctgcctcaaaaaaaaaaaaaagatattctcctaagtttccagtgatttgtttatggttttgctaaatatttagggtgtgtcgttttatgggggtggaatacataggtatcatgaatgaaaggatgttttactgctttggtttcaaaagatactatgtttaaaactcagaacatttgacacactaattgcataattttagaatagtcattttcatataggcttcaacataagtcagactcttgctgaatgctaaagaggcaatatctagtctgctataaaagttcttaatttgaaattaaccttaggaatatgaggcggttcttgctgtctgcctgaaattgtagtatataaaaagatgtcagccctgcattctctcctaaccaaagatgataaactaagagaaaaaattatcacccagggtttctaagccattgtaattgttttaatcttgattgctagtatagaagtttataagatcatgaagactttatcttgaatattcaaaattagaggctttggaggaaattttacctggttttaattttaaacttggtgtgacacttttttttcttcaccataaccactttaatattgacactcctaaagttggagcagagtcctaaaatttataaacatgcagtgctttggctgcaggtcatgtcctgttcag

SEQ ID NO: 108316 - DNA, 2301 bp, Homo sapiens
cctttttcctgagcagactgtgaaaggcctggcatcctgattggctcaaggcaggagttgatagatgcaggctcccacagtaccttaaaaaggagaaatattttttgtaagttctacaagtacaaggtttttataagtacagcgttccaagtacctgggcactctggttggcttcagttacagctcacacaggctgagtcatctctgcctatgtatctatacaagccatttcacatccatagtaccaatacttttaaggtcaaaaacaagatgaatctgaatggtggcctttttgtcctccaccaatccctgtttctaccttcatcaaactactctgctgtttgcacttcctcacaacttcccttgctgcttatatttcttttttcccctcaggtgtctctccttcccttctaactggcagcagcccccttcacctcaggagcgggctttagatccgctctgccaggcagcttgctaacttctgtgtagctctctgaagcaggtagagaaatgttttgctaaatgcatgccgctcccactgcctttctagtcctaaccctcaatgttccttagttgtttgccttgtttcctacaatttcagctaaaactattgctcagtatgcagtattatgctacagtgtcccttgcaagtacttgttagtttgtgcagtgcttctgagatgtaattaaatgtttatgcaatgtttaaaataaactctagagggctaaagccattaatatgcccataggacacatctcgataaatgctggcatatatggcattttcatgcaatagaaactgttagaatcaagggagaaatataagactaaaatatcagtaccctttcacatagcattcttgttttaacctatgacagatggatgtccagagccttttctttttcagagtccttggtttagcaacccttgttcgtttggtgttacttgttataatagcatttctttgcaccaaatgaaaataggttagtttgagtgttgacagaagtgtttatgttgaattttgtcacatatgacttttggatgagctgagtgtagagtttcttttgtctgtctgtttccattttttccattcgacatagttcttttcagtgctcggaattttttgaaagattgaatttcccaaatgtaagaaagaaaattttatccatatttccacaccagtgttactgtccagcatacattttgaaatgatttctagtctatagtgtaggcaaacatgaaaatagtactatgtagctgtttattaaggtatagatgtaatttaggtaattgaaatagatgattagttttgtgtgatggagtgcctgagcaggttctgacatttttataaaggtcaatgttttcacttgactgctttctagaggtgtgtgtttacctttctctcttgcaggacctggagttgctggctaccttaccgcaggtacatctacatcagtcatgtctaacctgccacctcctgtagaccatgaggcaggcgaccttggctatcagacttgaaatattcacgagagacaataaacgctgaaaggccagtgccaagtccacattcctccagctgatacgttgaagcaaactcttactgcctttctcctggtttcatgacagtgttattcctttttctataaatatatttttaggaaaaaaagtcagtgatcctaattgtatcacattataagaaagcactctgtggatcaacataagtgggtacacaagaattttttttttcttggtgtatgtaagcacatttgttcctttatatctgtttacaaaactgtgaatcaaaaagacaaaactttcttcctagtttttgtaattttttttttgaactagcatgactgtagggttgagctacagtcaacaaaaattgggctaagtcacttttccccaggaaagaatatttccctctcctgcatcaagtctgcgtggccatcctccccccaccatccaagactattaggttttgtccctgcacccttcactggcatcctcaatcattaaccttctgaaagctcacagtacacattagtatgtataactggctttaccaaattgaatgaaaaggagcttgtgcaaaaaaatttaaaaatggatgtcaagatgttatgtaaaagatgagtgtaattgtgaaatgttctatacactatcaaatatataaagctttctatattgaatgtacattatacagatcattcatatgtgtacataaaattttaaaaataaagggaattgactgctttgttaatgagatatatttgttctagtttaatctttccgtttgaa

SEQ ID NO: 108317 - DNA, 1103 bp, Homo sapiens
gataagcttgcacagaattcgtaagttttggaatgtataaaataatgactttcagtgtttttattatagtgctgaattttgttttcctttttcttatcctttctattttccttgggttctttttgtcctctgaagtatctcaaatattcttatagaatcaataatgaaaatattatttttaaaacagtgtgccaacttatagtacattttcaaaagaaatgttcttatgtttgctaactttttttgaatgaatatagcaaagaaaagaaggctctgaagaaagacaccacatagaagaattgctttcattatgtaaaaaccgggtgccaacttttttaaatgactctttttatcattaaagttacttaaaaagttccaatctggaagactactctggtcttcatgttcttatgcattaattattaacacagtatgaaccttgttcttcctttctctttcatcagaaaatcttgaacctgatgataagaaataatatggccaaatattataatatattaaggaagggaatttttaagtaagaattaatcttactaaaaatgtgagtaaaaaagagtagaaatggaattatttgcagaaatgatccttccggcagatatatagacacgcttttaagtgtctttataattaccatgagaataaaaaaaaaatcagtacttgtaaaagaaagtgaaaaaaagtggtataataaaacctattttctccttaacaaagttttaccgacaagtaatggcatttaaaatcgtattttcttcttgctatattaagattttcatttaaggttaaactgtacagctattttcaagtaacccttttttttttttttacaagtaagcatttaaacttttatgcatcaagactccatctatataagtaaatatacaagatctttgggcttaaaaaaatattcaagtcagaataagaaaagaaataaagtaccaacctgttgtagtcggcagagaggagcagtcttgagtacagagtataaaatcaaatgacctaactccagctacttttgttttcactttacaccccgcctttatcttgtatccaagaaggctttcctgaaatttaaccttgtgagc

SEQ ID NO: 108318 - DNA, 1103 bp, Homo sapiens; identical to SEQ ID NO: 108317

SEQ ID NO: 108319 - DNA, 1051 bp, Homo sapiens
gcactttgggaggccgaggtgggtggatcacctgaggtcaggagttcgagaccagcctggccaacatggtgaaaccccgtatctactaaaaataaaaaattagccaggtgtggcggcatgtgggcctgtagtcccagctactcaggaggctgaggcaggagaattgcttgaacctgggaggtggaggttgcactgagctgagatcatgccactgcactccagcctgggcgacagagtgaggctccatctcaaaaaaataatgtacaacataaactatatatactgtacatgtagtagctttggagatggtcataaacattccaatctaattggaaatataaaattgaatatgatggaagaactattacagtgttttatttattacagtgttttattatataaggaattatataaagaagacacagtgatgtttgtttttagggaagaggaaggagtttattatgttgaaagtacagaaatggagaattatcaaagaaacactgattagcattcaactaacactgtttgaaagagacagttttacctgcattagggacccaaaaatgagataaaatgttcttagagatcgtctcattgtcttccttttgattttatagttttttaaatcttatttttgtttctttagattttcccccattatgaaggagggtagtgatctttagaggtgaaataacttgcagacttggtatctttggtaactgctgagatcatttgcaagtttgatttgattataaattagaattatgttaggatgagagtatgtgaactgtatgatatgagtatgactctttagaagggtgtaattacccctgcatgtacattaatatcgtcgatagtctgttttacgtcttcataccctgtgagtataatgtcacatataactgagaaactggaaagattgattggattgttgaaggacggttttcaatgaattttaattgttctatgtttatttatagggagtatatagcagatatcttctgggaaataattcatctgaggatagctttttatttgccaatattgtgca

SEQ ID NO: 108320 - DNA, 1023 bp, Homo sapiens
atcttggctgcaaatcagaatacatagcttttaaaaaccaatcttgtttcatatgctacacttgggagagtttttttaaacggtgcctgggtaatttagtttcatctggtaaaaaccagcctgtaagcatcctcctctttgaaacgattagtaatgattatattttggtgtttattttctgtgatgatgtatgtctatttgtattactaatacctaaaagactgtaagctttaaaacatatttttctttgttttaagccgcttgatggcattgaaacgaatgggaattgtaagcgactatgaggtatgataaaccctttccaagtttttgtaagattaattcagtaaattaaaataacttctggtgacatatttgatgaagagctattaaccaacatatactattttatatttcacagaaaatccgtacctttgccgtagcaatagtaggtgttggtggagtaggtagtgtgactgctgaaatgctgacaagatgtggcattggtaaggtaaaaacatttctctttgcctgtcatatagggaactactcactcctggagtaaatcaggtacaagttaggattttttttctttaccagtggcttattgacttgcagtgtattaatctagattgttctttctactcgggttgagacatatccccacccaaacaaaaggtgatattagacaaagattgtctaattgtgtttagaaacgtttttgtttgaagtaatatgcaaacaatttggacttaggtgttttagatatagaaacttaggaaacaaggctgttaatttgataaagtgtgtgaaacactgaaacatctaacaaatattttattaaacatataccaggcagaatagaaaacatgtacctttcctactcttgattttgaactagagaatgctctggatggatttttaaaaattggtactcttttacttttttctaaaattcatttagattatgggttagaaagaagtaactttcttgtaccagaattcagtctaccaatcttagattta

SEQ ID NO: 108321 - DNA, 1055 bp, Homo sapiens
tgctaatgcagctagaccacgccattttgagtagcaaagaggtagaacagtagttatatattgctgtagttagaatcacctgggaagttttaaaaaattctggtgtccagactgcaccccataataagtgtctctggggatgaggcacaaacatctgtatttttaaaaattctccaagtgattccagtgtgccctcaagtttgtaaactgagaatctacacaggtaagtttcaggaagtctttctttaatttgtaaaacagataaatacgaagtgaattaatgaggttaaataggaaagtagaagatgttaggaaacccagagtccatttcttatccctgaaagcctttggatctctttaaagtatctggggtgccttggatcaccagatctatattcgctgctttattttagagatgaagatacaggcctaaaaagtgaaagtgatttacccacaatcagagctaattagtggcagagttacagctcagaccttctgttcccaagtttaatgtttcccgcaacttatgtataaacaagctatgaggcagaaactcatttaatacttggcctgacctaataaatattgatgagcttaaagaaactatgttttggagactcttacgtaggattagaaaattttggagagtgtgagatcttttctagtattaagggctatctaggtgttatgggttaggttaattttttttctttttagttttttattgaaaagaaaatcccatttttgtttttattgtttagtgtgctgagaattgtattaaagagtcacagaatttcatatgaagaagggacaggaagtccttggctctagcctgttcttactgataagaaatgtgatctaatggccattttagtgtgtgtgtgtgtgtgtgtgtgtgtgtgtgtgtgtgtgacaaatgctttttgaaacaggcttaagtgtatagcaggaaacaacaattaactggtttgtaattctatttggaataatgttttagccatgtcactggtatatattttgtcatatacacaaaaggagtcaggttatactatatt

SEQ ID NO: 108322 - DNA, 1684 bp, Homo sapiens
gagtggcctttggacaagtgttgtagttgcctcattttaaaaataaggataatagtacctacatgcctcacatgagcattcaatgaattaatatatggcacctagtgttgtagagttagctaatattattatcaaactgctaaactaattaaatgtaaagctctctaatttattttttgatatgtttagttttttggtatgtttttcatcagaataccactattttcattttagttgctactctttgattatgacaaggtggaactagccaatatgaatagacttttcttccaacctcatcaagcaggattaagtaaagttcaagcagcagaacatactctgaggtaaatggaatagcaatcaagtaccatattcagtgaaatcttactttatgtatttgatatgagttaatataaatgaatcttaatttttctctataaaatgcagttttcacttgtacaaagaattctcttacctgttggacatgggttggcaaactttttatgtataggttagataataaatattttagtctttgagggccagatattctgttggaactgttagttgcagtttgatagcagctgtaggcaaaacaaacatgaatgagcatgtctgtgctccaagaaaattctatttttggactctgaaatttgaatttcatacaatttttaatttttttaattaaaaaataaaatttttttgagacagtctcactctgtcacccagattggagtgtagtgacacaatctcggctcactgcacctccgcctcccgggctcaagctatcttcgcatctcagcctcctgagtagctaggactacaggcacgtgccaccatgcctggctaatgttttgcatttttagcagagatggggttttgccacattgcccaggctggtctcaaactcttgggactcaagccatctgcccacctagccctcccaaagtgctagcattgcaggcatgagtcactgttcctggctgataaaatttttatagtcataaatgttcttttgatttcttttcccaaccacttaaaaatgaaaaaaaattcttagtctgaaggctgcacaaaaacaggtggtgggccagatttggcccatgggccacagttcaccaatccctgctttaggaatttcctttgtggccccaaatttgttaactgagtaaggaagtgaggctgagttgtaggtagttactggacatggttaagtcttaattcccaacacttagattgattggggtgggaacagttttgtaatctttatgacaaaaatgaacctagtccttgaagtgtgagataaaagagacagaaaaggactttgggttttctttgaatagcttgaattcgcttctctaaggtatgttaaatgccctttagctctttcatctcttttcctcacagttttttcttactacagctactagtagtagtctttttaaaaacatttttttagagacagggtctcactctgtcccccaggttggggtgcagtgggtgcgatgatagctcgctgtagccttgaactcctggactcaagtaatcctcccaccacagcctcttgaaatgctaggattacaggcttataatcattccctttttccttcttaggaacattaatcctgatgttctttttgaagtacacaactataatataaccacagtggaaaactttcaacat

SEQ ID NO: 108323 - DNA, 1083 bp, Homo sapiens
cagtggatggagacttaaacacacttgtttctactatcttgatttaagtcttaccaaaaataaaccaatgtgactaaacagtaattattgttaatgtaattaaacattagtgttactgtaaattttacatttacataaaatgttaacatttatattagtgttaatataaaacacattaacagtacttaaaaaagattcttgaaatctgcttttagatacctctgctatccaaaaacaaatatccagcaactgtactatctaaactgtagctaaaaagaaggaaaaagatttctttgctgctgaaatttatgtcacagtttatgaatcaactcatactttattaaaagcagagcccctttaggtgttctctaattcaggctatttattttccctcattttacaactttaataagcttagttgtattccctaagcctccaatataataagaacaaactgcaacaagacacaaggaggtaccaatcaataagaagtgtcagttgcgagcaaagaaattgaaaaaagcatacatataaactctcaaagtaatggtctagggctatttcatataagagcaaatagcctgtttagacagtagtaggccctgtctaaacaaaacattttatagtatgatacaaaaaaggagaaaagaatcatggctaacaaagtattcccttaaggatgtgtcctatttagctagcccctctattgatggtcatttaggctacttaattcttttcttttttattaacaatgctataggctacatcttgtatatatctttgaatactagattgatcactcttctttttgtttttttggagacaaggtctcactgtgttgcccaagctgaagttcagtggctcagtcatggctcactgcagcctcaacctcctgagctcaagtgatcctcccacctcagccttccaagtagttggaagtacgagtgtatgccacaatgcctggctaatttttgtattttttgtagagacaaggtttcaccatgttgctcaggctgttcttgaactcctgagctcaagtaatctgcccacctcagcctcccaaagtgttgggattacaggcgt

SEQ ID NO: 108324 - DNA, 1083 bp, Homo sapiens
ttttattgagctatacatttaagattgtgcattttatagtaagttacatacaaaatgttaaaattaagtagctttcttaattatctcagggatttaaaaaatacacttctcccacattttagcttctctgaaatcagcatgcttcttgaagttgttgacgtgtaattgtttagctgccagcattttatctttattagaggttcaaaaaaatagtgtgttctacagttgatgaaatggagtaatcttttctttccttcattcaataaacactgaagtatctactatgagccaggcactgtaaataagataaaatttctgttttctggatgcagatttctgttttctggttaaaaaaaatatataattacctatttcaacgttatttttaaaaaatttaggtgttctagtatttttcatgttttaaatttctttatttaagtctattttgatttttctaggtttctgttaaattttggtactgttagtttttaccttggatacaatgcaatgcaggatttttttcctactatgtccatgaagccaaatcctcagtgtgatgacagaaattgcaggaagcagcaggaggaatataaggtatatgacaatctgttagaatgcatgagggatcatattgaataggacaatacataaacagatttggaatacaagataaatggttaatttattcaccatacttcaaaaatgaatgttctttcttgcttttggtaagataaaaagcctgtctgaattcttgattaatgctttagagaactgagaatgagtaagaacactttgatgctgtttgatttctacagaaaaaggtagcagcactgcctaaacaagaggttatacaagaagaggaagagataatccatgaagataatgaatggggtaggtattcttttataaattgaaatggcagtataaaacaaaaccttttatggtagcaaatctaataagattatacaaattgaataattattgcttattaaattccttaaaaactgacataggatcaaatttacaggtattgagctggtatctgaggtttcagaagaggaactgaaaaatttttcaggtcca

SEQ ID NO: 108325 - DNA, 1007 bp, Homo sapiens
ctgggggatgctgcctgtcctctagctccactgcccccatagccagcagttccagccctttacactctgacttcaatttcctattcatttttggcagttggaggatttccctttatttatctaaaaactgtgcttttagaaatgtgtctgatattcatacgtgtttataataggagggctattttcttccactgtcttcctggaattggaattctgccattaattataataatacattttatgcagttttaattttcactgtacttttttctgtaagagtgttatctttggtgtgctagattttatatatacactatcttaatcttcattaatgtcttttggacagtgtgttttaataaatctgtttcttgatttattaaatcatttgaattataagttttggtaaaaagaaatagccttaaaagaattatggaacttttaatggccgttagttacttatacaggtgctttatgattactgttaatttgtttttctacctagatcctctgccttgtcaatgttagtcacaatggtgtgagtgaatcagaactgatggaactctatcctgagatgtcctggactttcttgacctcccttattcacagtttatacaaaatgtgtttgttgacttatggatgtggcttgcttaggtttcaacatctgcaggtaatgttattttaggcatctttttatttatttatttaagaaacagggtcttctctgtcacccaggctggagtgcagtggcaagattatttctgccaaaggaataaattctaaagatctgctatacaacattgtccctatagttaacaatactgtagtacacttaaaaatttattaagagggtagatctcacgttaagtggtcttaccacaatacaatttttaaaattaaaaaataagtcagacacaaaagatcaaaaaaagtttcttaaaggtagtttatttcttgaagagaaaaaaagtctttttcaattatgtttcattgaattgcggtattattat

SEQ ID NO: 108326 - DNA, 1044 bp, Homo sapiens
cattgtgaattctttttttattgacagtcaaggaactttatcggttttataaaagttctgtctttttctttcaggattcaattacaacagaagaattcccccaacacactgattctttcccattttgtgggaaggcccatgtcaaccagctcagagtcctccttgattattaaacgactaactctaaaggtatagtatcccatcttttggaattacagaattttatttagattcagaaattgttgggactaataagtacctactggtaaaccaattttcagtattatccacctgttttggttttatataaggttaaaaataatattcgatacaatcgggtcctcttggtgacttgattttggtttataaaaaagtaagaatagaaatatttcccccagctctgtaactacttcagtaactacgtgtaactacttcagtttgtgtgtgttcttatcttgtagttgatgcagcactcttggtcagtctctgctctgacactggatcctgctaagcttctggaagaatttccacgttggctggaaaaactctctgctcgtcatcaaggcagcatcatcatcgttattgattctatagatcaagttcaggtaccgttttccatttgttacctattgatatgctcagaaagagatgtaaattcagtaatagctagagcaggcatttatatgtttgtgagaagaaaatatgatgttattttttatatttctgctttatttctagggaggtaacatggattaaaaaaatatatcgtatgcccacagacactaatatcttattaagaaagaccaactgaatttacacaattaacaaagactattcgttctgacatatttttagggccttgacatttcctgacgtgtccagagttcagattggtgataataatgttttgctacttgttcttttaaaattctaaaataaatcaccccaaaataagatttttatccttaataagataaacttaatgagaatttcattttatttggggagctattattggattgttttgaaatattttgattaata

SEQ ID NO: 108327 - DNA, 1076 bp, Homo sapiens
tttttatatattaggaaagtctctctcaggttttccccccatgttatccctaacagaagagggggatgaaagcatgcctccaggggggtgagaacatggaccagggaggggccttgagctggaagtctctatgaagtttcatgtgctatcttgaaaatttatgtgagttatatattctgcctgatattatgtctatgtttgtgtttaatataaaaaaattttaaattatatattagaaaaaaatagtaatagtgattatttattattcccctctccctcaaacagaatgggcgcagtgggaagatgtaccatgtttagcctgtggttgcccacaccttctgacacctcccccagccaaccaaaaaccctatttgagaagtaggaagcttgaagatttattattagagaaaaagagtgagccccaaaatgatatgacctctggcaacacattttgtatggtgctctctagtataaagattgtctttatcaaatttgagcttcacaatcttgcaaattttaggaccaagataaattaattgagcagaatgaatggcagcaagtgaaagtgaatgtacttaccatcattagtgcttgaaggataacatattttcagtaacctaatataaaaactgaatatgaccacagagatacttgagatcaagaaatcacatcttagtaattcaattcttatagcatatttcctagccattagtactttataactattcaccagccagatacaaccaaaatgttgtgtaacatttttcagaaaacaaattccatgggattcaaatattcctttaattttatttttataaaaagaggtattcatttctattattttaatatttttatttctttgtttttaaattagtgatttttttgtagttatcagtttattcttgtaggtattatacaaaggctgtatgtttgaacttgccctcccaaaagtaggtgaagcccactttgggcctgggtgaccccgctgtaagatctttattttcttcattcatttttgtgtggttgttctttgtgtttaggacatactgggttttgagaacacagacttggagact

SEQ ID NO: 108328 - DNA, 1039 bp, Homo sapiens
tttaagtggcatggagtagaggggagaaaagaatgctgagggtgaggtaggtggcatagtatacacttttattttcagaggagagaaattaatctttgttccataaaccgcaaagggtatgcattgtttgtttggcctgcggaagggaggcagggattttgaaaaggttgggaaacactgattaggttatgcaagggacaacaaaaagattaacaagcttagtccatctagcaacgtacttcagtgacctataggacaaggttttattctctgattcaataaaagcccactagtgttgctttcaaagcagcaacaaaatcatttcctttctgtcgtttctgtcccctgggtcagggacggggaacatagagagtgaatgagagagattagagtccgacctgcatgcctaagcagtagtgtcctctgaggaggatctgtgtcacattgtgtaagtataagagccttcatattgagagggatctgagtaccttccttaggacacatgctgtaagatacagctggataacagagccacaggtgggggcactgggtgagatcatctgatagggaagcattggggaaagaggagagccaggaaatgtttaattcagtggggctctgctggctgcttttggatccttgaggaggcatttcaaggcagagctgcctcattggctagcctggctggctttatgtggcttccagaggacctgccattcacaagatgaaagctcctgtggtagttacacgtctcaggttgtaagcatcagttatgcttgtaatgtgcttgagaaaagaagggctcacagagacctaaatctaggctgccgttccttcacttggctcatgtcaccccccagggctcccagaaaacaagttgtaccctccttaccagtagatggcactgctgcccctgggaattcctggaggagctgaactatggagctggcaaaccagcagtgtgtagcctctagtcagaagattttgaaaggctatgtcagccctcaaacgaaatctcaaagaaaatagttctgaaagc

SEQ ID NO: 108329 - DNA, 1068 bp, Homo sapiens
gagctattatacatgtttgggtaagcacttagtctactctcatattcacttcagcagtgacttgggacttgaagttcctttggcctaatgcattttttcattttcatctttgccagttggtgatagattggtggtcatccaacatgcagaaatgaatgagcagtgaaaagcagcagagccgatgggtcatgaggatgtaagtgcgtttgaaggcttccacaccctctactccagggtaaggcaaaggcattctctgccattgtttttcttgcttttccaattcatagaggctattgtctcacctgtctcttggagtcagtgcaatatgatgccctgtctgtgaaaggctcctaaaagcctttattgattcaactcatagataccatgcaaatcagcagttatgaagagaaaaccatgaccgaggtgatgggatggaatctatgcatggaaatatttcaaaacaggagtttttagtgagttcgtttagggtgtgatttatatgggaggggctgttgagccctcttgaggtgcactgtaaagatgggaacagggcctgattatcatttccttatagccatgtcatatgttagctctggtagctcctgtttccctcacctaccaccttctttcttctttgattactctgcttaacttttgcttcattaatcacttttttagtgaaggaaataacttctcaaagtgttgaaaattccagatttggtgtataatagcactagcaaagtacatggttttgcctgttccattttattttatccagcatcactggaagtcacatgcccattcatgcctcatctatttgcagcccctagtacaatgcatgtgggcactggcaatgttataaccaaaactggttttgaattttcacttgtgctgcagatttttgagaccagaaggagaaattaactgtttggtgtggaaaggacatcacatcctttctgagctctccaatttctagagcttaaactaaaaccagcctccttgaagggaaaattatgattcatataaatataagaaaagctgaggatggttaagaatgagggataggag

SEQ ID NO: 108330 - DNA, 1109 bp, Homo sapiens
ttgagaaacactgctgaagggatatagtgattcaatcttgctctgaatttctctggtatcgtattttaatcatttaacttcattttgtttcactttccctatctgtaaaatatacacacataaatagctaaatagtctaatgaagtaatgtacatagtactgtgtgactccttgggggctctgtcatttctaagaagcgatattcgtcttcccaaatttctaggacccaagggtaattcttaattcttgtgatggcactaactgaggaacagtggagtttgaagaagggcgaaggtctgtggtatgggaaataatgaagaatgctggactcttgagtttattcaagggcttcatgttctggttcattgtgataatatattctggatgaaaactttcctttgcaaagttaaaaaaaagggaagagtggatgaggcagaaagaaggctgttcaaaagagcagtcaaggaaattgcatttgacaaggtgatctgctaatgttaaagtgactcatgtataattagaccaaaggacataaagaaatagcctccaaaggaaaactatcgtcccaaatgactgctagtccagatcagtttttgcagacaatacagtaaagaccagagaatgtttggagatcagtgtttattctagaaacttttacatttctatttcttctcttctttaggaatatggaaagggattatctttaatatatgccctttgaattataaatgtaaatgttttaatatgacatgttcttttgacagttttctagtactatgtgttggaatggtcaaagaggccataactctgacctagacctgaagtgtaacctgcattattttaattaaaaggctcagtttaactctaaaacaaggccagtgcagggattagatgtaaactgtcctggcaggtttgcattcccccttgctgtgtttctggtccctgtgattattagacttgcttacaaagtttccaacaaatgcactgtattttggatctactatgtagagaagccatcatgtatagccttgtttatttgcattcttcatacatttttagccctaggtgttaagcaaaacttataagaatgtttaagaaggattccatgt

SEQ ID NO: 108331 - DNA, 1029 bp, Homo sapiens
ctgcctttctttctttctctctttaaaaatagtttattcactcatttgtttatttgaacagttttaagttcaagcaaaattgagaggaagatacagatttcccatatacctcctactcctcctactccctatacatgcatggcctcccccaatgtcagcatcacccaccagaatggcacatttgttagaactgatgaacctacattgacacatcataatcacccaaagtttatagttcacattagggtatattcttggtgttgtacattctttggttttagaccaatgtataatcacatgtatccatcattatagtctataggtattttcactgccctaaaaatccttcatgctctgccttttcatatctcccacccctttgcccttcactaaaccccagaaaccactgatttttttttttttactatctccatagttttgccttctctagaatatcatgtaatatgtagccttttcagattggcttattttactcaataatcaacatgtaagtttcctctatgtctttcatggtttgatagctcatttccttttagcactgaataatattccattatctgggtataccacagtttgtccattcacctactgaaggacatcttggttgcttccatgttttggcaatcatgaataaagctgatataaaaatctgtgtgcgagttttttttttttttgtggacataaatttttaactcctttgggaacattccaaggaccatgattgctgcctcatatggtgagagtatgttttatttagtaagaaactgccaaactgtctttcaaaatgactaacattttgcattctcaccagcaatgaatgagagttcttgttgcaccacatccttgcaagcatttggtattgtcagcgtttcagattttggccattctaataaatgtgtaatgatagctcagtgttgtgttgttttaatttgcatttccctgataacaaatgatgtagaacatcttttgatatgcatacttgccatctgtatgtcttctttgatgaga

SEQ ID NO: 108332 - DNA, 1010 bp, Homo sapiens
tacaaatgttgacatttggtggattactacctcacatagtgtgttttgttcactttctccctgaacttggagcattagtttcatttgagccagtgattgagtgtgactttataagggaatgcattctaatactgcagaaggctctgtctttatttatgactctgtgtcagggtaagaatgatggtcctggctctatttggacctgcacagctgtgagtggagtgacccatggcagcacaaacagcccgtcatttcaatgaattatttaaggctcttacacttcccttcaagtagctggatcatggtggcaccacatacagagaacaagttagtgtttccttagagaaatgcagcttttgttgaaagagagtctgaagagaagagattcagcagggcttcttcaactgctggttgaggaaagaatgtagtttgttactgaagggtgatggagattgggatcaactttctcaacccagctgctgactgctgaggtgaaaacagcagagataaaacatttgctccagtttctcttcagactctgtgaagatccccatcccctgtattgaatttttaaaaataaaaagcaaaaaatatagaattgtatctaattggtcttaacatatatccatgtttcttctgaacaggaagatttgtatgtagataaccacacgttgccagaagattaaaatcttcaattttaactttaaagaagcattaatcttacagtataagtgaaagattaactcaaatttgtgcatatataatttttctacaaaaacaaaacaaaattatgtttgttctcatagaatcaggaattaatttgaagcccttgttgaagattctttagcaacaataaagacatctgctctctccagggtatagagagattctgaaagatggccaagagccagggatcctgaatcctttattcccatcctgccataggctactccccatgaggttcctgcaggataaatgtgcacggggggtggtggaggcaggactttgga

SEQ ID NO: 108333 - DNA, 1037 bp, Homo sapiens
aacagtatttaccaggcattaaatgttagacattatttagagactctcaacttagaaaatcatatttttactttgagagagcaaaatcccatattaatacagtcctggattttaacttttggtttcctctggtgtttctccacatacccctccattttttccttccattaaccctgttaccttaagttctttagtctctttgcctcaattcttatatctttattttatttccagagttctatggttcccacctggctgcaggacaaggtgctttataagttggcataaagacacaggctgattccaacttctctttctgaatttctttctactctttctatgcgcaaacatcttttacccaaactggtccttggtcccgttctctcctccctgtgtacagtgctcctgtttcttttcagtgaccgcttggtagcattgatagactttgagtcctgtggccagatagatctgcatttctatcctgtccctatcattttttagaaatgtgactttgggcagaatatttcatttcagcctcaatgtttttatttttagaatgggaatcataactaccttatgggatgcttatgggcatggtacttagggaactgtcctgcccaggttctattttctgccttttcatcccaacagtatgcatacgtgcttgctgatgaagttattgaacatcagaattccagagctggtctacatcacagttcgtggttagccattctctacctgccactttcacaccttccctaaccacatcttcctttgataggacctaatcctatcagtgagcatctaaagatacattttcctccttctacctatgatcgtgaaaactatgttcatggacattcagaatgtcctggtatatctgcccatatcagaaattgacagcaatttcatggccactgtctgcaaccttgagcactaattcattttctcagcatttgtttcctttcatgtaaagtgagatttatcgtgaacgtcgaatgctctgattgcaaagaatacctctttaaaacgaagtt

SEQ ID NO: 108334 - DNA, 2528 bp, Homo sapiens
gcctttgaaatctgaagtaaatctcatataaaatgtatttacacataattaaatttgttttagtctaaaatctggtgatgttacttaatgtcagttcatttccacaaagatttatcaagcttctgtggattcaagtgagaatggaaggagaaggtttggagacaacacttctgaggacttttgccaatcacctaagcaatgtgaggttccatattgtggctttcgagtgagatcattcaaaggtgttatgtgtttttctccctctgggccttcatgtgtatgagtggagtgttgaagtgaacgaggccatgtttttgccgagtgagcaggtccacactagagtggggatagagttcagcatgtatggaagggagtggttatgacaattgactgtggaatttaaattggctaaggaggtgaatttggacatgaggagggtgagggacagtgaaaagctgtagtatccaatgggttggaggtctccctggggtcagagacttgctgaagttgtggtatcagagatgggaaactgacaggagatgttggtggtgggagagcaacatggaggaatttcagctaagaagtggtgtgtgaccttggagttagggcagagaacagggactgaaaagccagggtattggaatgatcatctctgtggctactgaattcacttagagtcatggccacaggagtgatgaagagtgacagggaaccaggaacccagatcttcccagaatgagggagagtgggcaatatagtctgattttgtgtgaatcaaaggtcaggattttacagaagaaaggagggacagtggtatagatgtgataaagataacccactctacctctaagccttgaagttcagggaatgtggggagaaaatagtcaccacataggggggctagaggtggagtgagcagtgggatcttgctaatgactataagttccagacagcacagggaaagggtttcaagcattgggaatggtgggtgatagggtcaggaagaggaatggaaagagccatatggtggtaaaagtgtaaggttgagaaatgacttgtgagtccttgagggcttctccttgtattcttaacagggataaaagatatgattaagttagtcctgatattcccaaggctattgatttatagactggaatgggagaaaggacagcacccagggttttgggtctcccgctggactcctgcttgagggggtggtcttatacagagcacatagggcccccatttaaccccagccagaggaggggctgccttgagaccaagcattcattacccctgtccagggaagtataatgaacagtagaggtcatggaacattctcatgttttattcaactttgtggatcacttcacgtatttcaccacatagacagcattcccttgtgccatatttctgattactttgtgcccagtgaggatccttcattcatttattgcttctttccttcccagttacttgtgtttcttttgtctggacagaagaaagcggtaatgtctgccagtctgaggacagagcgtgtgtgatggtgccctgtaagactctattgaattgagatactgtctgcaggaaggccatttagtctaaaaccagttatcacttctcctgagctaaaaagcattcagttctatcttctggtcactccagaagagattccatagtacaagccaaaagaaattaaatacatgaagtgacctttaatctatattagggaaattaatatacgtttaactctttggaagcactagatttgaaattcaaaatgaactccttaataaatccttactgtctccttgtggacagatgcgtgggtctttaatatctttattctttatgtcacagtctgttgagccctaaacatatttgtataaataaagagattcaggaaagatttgccaaaaggacttaattttatttctaattcccctttctggaatcctgcttcctttacaaggatattgtacagaaatgtgattttatgaaatacttgaattgttttaatacttcacttttaaagttccactttgtatgtaagaggacttctcagatttgagtcacaattttcaaaacatagtgaaggaccaaatgggaatataaaggttggttagagaaataaaccttttttttttttttaatggacagttaagcacgtgatagaggttccaaaggtagattgaagtaggggaagataatgctgatgaaataatggtttcactggtgtcccttcattctttacaaataaatctatcctagagatcacttatgcagtatgtaaataataaacacagccaaagttggtttactggtcttttttccaaccagaactttacactgatacttcctctcctctgtgatagagtcatgatcatcagtcctttggaagatctggaaagtcctgagatagcagggtgaaatcagaccccttccagcctgtaaacttttacaaggcacaaccaggccttttatgtcttacatggtgaagttggggaaactatctcaccatttgggaa

SEQ ID NO: 108335 - DNA, 1009 bp, Homo sapiens
tagagcccaagaagcagatagatccaaggcaaagagacaaggacttgggagggcaaggctccagttgtttctcattctttgtctggctgagccagtcaaagactcagacaaagggcaagagaagtaagcaagtgggtacctggccgtttggggctgtgctggcggtgagcagaggaggcagccgatgttttataaattgttgcaaacaatactcctaaagtcttgggctttatttttgcagagaggaaaaagggcccatttaattgtgctttgttattctcctactcatatttttttctcttttattgtagtgatggcagtggtgttcagccaggagcaagttatatgaggtagggttctgcccaggggaggtgccaggggcaggcggtgagatagggcgtccaggctacctgggtgtctgcagagcaccctggaacacccatttcagtgagttgtctgacccaggaaggtcagcactctgctctccccactttgttcttggggtgaaggatggatcttgtgaaatcctgagcaagaacaaaggctgactttatccctaggagggatatttgggtcacttttcctctctgaagactacttccacagttctcaaagtgagaaggcagaaatgaaagcactttcccttttctgtttgtgcccctaaattcccctgcaccttcagtcttcctttggccaggtaacttccttttgagttggctagcttcctctgcctgctgcttagggatacaggagagatggtccattcgagaaaggactctaatctttgtcttttgtgtatagagtaaataggtacttggccaggattccctgagctcttgctcccaggctgactcgtttgcctgtgttctgaggaaacaggcagagtgtgtcttcccaggacagcccgggggcattcagagtgatcaccccagatgctgccaggtttttgtgtgtcttccaaactaagacttttatacaaactaaaattagcctttgaggatagagaact

SEQ ID NO: 108336 - DNA, 1050 bp, Homo sapiens
gagcaaaggtcctctctggagtccctcttacaagggcactcatcccattcttgagagttcatgatctaatcatgtctgaaaggccctatgtccaggtaccatcacattaggattaggttcagcatgtgaattttgggaggacacaaacattctgtttatggcagcaggtaaggaactgcaggtcagaagggccccagcaaagtatcattctgaaatgaatgacagatgggacaggcacgaagcttgaaagcgaggaataagggtgtgtcttgcttgactgtgaccgtcttgcttacctgctgaggcagaggtgctaggtatgccttctcttcaaggcagggcctcatcatgtaaaggagcttctgggtggaggctgagtgctttctctatatagccagaggcctcactccaatgcttggggtgtgagatctaagttttgcacagatgtcttcttgctacaggccaaggccacaattagggggaatggactctttccacatacttacttgtcatctcgtccaaggtagatgcttgataaaatagtgctgtatgctaaagtgagctgcctaagcttccctacacatgaaaaagaagcctagaggagagcacagatgggggaccgttcaactgcattcccaagagcattatccctaacagggataatggcaggatgtccactgtctgcggccccttcttttgccattcttttacattcattgctgtagagggtataaataggaataaggaactgatggctatgtgaaggtgaatttcaaactctttgagttgtgattaacttccagaggcctcaaaataactgatttacataaagtatgatgcagaaactaagccactcatttacatcttcaccatattttttgcatgtaaggacatatgttggttacctttggtcttgacaataacttcaaggaaggaatgctttgtctaatccttgttccttcttcaaggcccaactcaaacactttctcccctggaatccttcccagagctctttagtcagaattaatgatcctatatacctttccatag

SEQ ID NO: 108337 - DNA, 1052 bp, Homo sapiens
tatggtcacttgtttgccaagcgctattttaacctttttatttattattattattgttgttttgagacagggtctcaccctgtctgccaggctggagtacagtggtgtaatcatagctcactgcagcctcaacctcctggacttaagggatcctttggcctcagcttcccaagtagctaggactacaggcaggcaccactgtgcttggctaatttttaaaattgttttatagaaacaaggtctccctctatcgtccaggctggtcttgaactcctgggttcaagcaatcctcttacctcggcctccaaaagtgctgggattacaggcgtgagccaccatacttggcctgtaaactttttgtacaaaatactcatttaatgcccactatacgtctaaaacagtaactttttcaaaaagttgcaattttacagtacaagaagttaaacaacccactaaaagtcactgagccagtggtgctgggatttgagcccagcaagtctgttcctgagcctgtgctttcaactaccaagctgtttcgcctctcaagagacattacttggaaagcccccccccaccccccgccgccccactcctcagcctggcttgactgtttcccatgtgatccatctgtatcctgtacatgcctctgttacagcacattgtgatggcactggaaactgtccctcactcctcatccccctcccagcacctcacacatactgagtgctcagtcaatctgttgaataaatggattgagacagatgagagagttgcccatacatggcacatggactgttaagctggaacaggacgttgggtaagttgttttctcctttttagatgtttttgcccttgtccaaccttcagaagtttacttcctctctggtttaatactgttcttagacatactgaattataaggactgtggactgaaaaggggcagctttgaaagaagtgtatctcatatagttctttgttgtgtctaattcattttgtggtgtcacattcattgggcaatttatatttcttttcatgtccctgaagtaatgttt

SEQ ID NO: 108338 - DNA, 1361 bp, Homo sapiens
catctgtacaatgcataccccagtatcataaatgataagattttattttcaaccattctttttcttgaattaaaaaaaaaaacagtgattaggaaattttcaactagaggaaaccaaagaacagcatcataaaccatgtgtattcagcttcaacatttacccacattcttttaatcctactaccagacttgcctatctgaatcatgaatgttaggccctctggtcaactagattttcttcaatgcttgatttttcccttcaaacagacttctgttactgtcactagaacaatcagtattagacttattccagccactcttcccttctctctcccactctagagaagaaatggcctcaaatttagtttggagtagggtgctgtgcacatatctcattaggaaatggtgtagatattcaggttctatctaaagatagttcataggagaaaaggggaggcaaagagaggtgattcatgtgctggaatgatgaaggtaccagcgctgctccttgaaggattattagcttttggatgggtgatggaattaaaaattattaattgtaatggcaacaatagctaatatttgacgtgtttactatggtccaggcactgttccaagcacttcacatatattacgtcattactatatgcaaaggtgaggaacaagaactattaacatcccatttgcaaatgagatggaacctgaggtacaaggaagttaattccttcaagggcacacagcacagggagatagaagttcaaatattcgtgagatcatagagtgggagtgaatgtcatcaagaccagctcttttattaaggaaaccatagtgcaaagggggaaggggtttctccaggacacgcagtgagtgggtggtgggtttgagactcttttccaggaacctagatttgagtgtggtgtgtttcagttataccagacagtcgtcttcactaacagaagcacctcgcgaggcctcatgatgtcagttccctacctttcagcttttgttaggattgactcttcttttactatttctttcttcgaggaatagttcttgctttttatatttttaaatctcatctctgcaaattattgaacttagctaacatttagagaatacagcctgttcaaagcatagtccaaagacaatgtaaagttaggggaagagtctcttgcctctttatctgaaattccaaatataaaatgaatgttttcatttttttaccccatttcctctgccttatagtctcaaaaaactgatggatgtctgaaggataatttctttctctgccaccaaaggccttgcccactatggtgcttattcactttattttacttttataatggaaaaagtttatataca

SEQ ID NO: 108339 - DNA, 1707 bp, Homo sapiens
caaaaattgagcactgaaacagatcactgattctcaatcagaggctacagcaagagatgggaaataattgtgtataaggatttcccctttcacttttaattttttaatgcacgttactgtgtactcaggggttttcatctattcagtatgttacaatcaattatagtcattattatttggaccaaatttggccaccagaagcctcttcagtctgattcctttgtccttttggcataaacccattaatctttgaatcctttcttgtattcagtgataataagatgtcccattaaggtgtcatgttgtactttcttgctagacttcttcttttttgtaataattacttttatttttttttctttcatagaagaatggtggtttagattgtatggattttagaaactcttgaaaaaaattgaaagccattagtaagatcaatgtaccatttgagatttttaaaaaagtatttcagccttcaagagcaatatttttagagtgagacttattttggaaatggaatctataaggtttctaaatcaggggtttctatttttcactaatttcatcttttctcttgttcaactcttctaatttctgtctttgactgctgagccacattaaaaaaagaaagcaccattattgcttactaaggagatatcatatggaaagaattctcagatcctgaccttgtccaaggagtggtgaaagggatggcatcccaaatgttagctgtcctttgtggccttttctgcttctggagtccagaggttctccctctgtaccttgtgacctatccatcattgaaatcagcttattcgtttcagtgccagatgtgtctggagtccaccttagttcccttcttacttaatctctcgagcatttgagcttttttttttcttttgccatctgtaaagtgaagcaaaacttgtaagtttgaggtaagcattaaatgaacaatgtttacactataaataagggacttgaggcatagtgagggttttgtacctgttgaattccttcttccttgtgttatatttacttacacatgcaggatatgtgtctgcttcatttctataaatatttttattgttaagtataagacaaatacaaaaacctcctaaaataattgtacagtttaatgaactattacgagatgagcattttttaaaacgttatccatgtgaaacaggccctctctttattagatgaggtacactctgtggtgaacaagatagggtcctgctttcacagagctgatgattctgtagcatctggtactgccagagatcatacataggaatgagagaagacatttaatttggctaaattaacattggctcaaatccagcaaaagaccttgttagcagaaggtagagctctttgtccactatggtgtagtttgggcattacatggatgtgtgcggttggccatacaaccatgagataacatgagattccatgtctcacttccatggttacagaaggatcagcatgctttatagttttacatcacaaaatgattcagaaaaatgcagatgtttacaaatcctatacttgtcccagaaaccttaaactcccacttgaaaaggaaattcaaaatgtcaggaatccctggggaggaacattcaactttaggatcttggctctgcttgactctcactcaggggtagccaccagcagttgggtgcagccctgatagagattaat

SEQ ID NO: 108340 - DNA, 1031 bp, Homo sapiens
aattaatatgacttactgggtggaagaaacttaattctgatggggacggagatggacagaaggctccaacatttaatgttgctttaaaacatttttatgcctttcttgatatttcatttttactgttaggtcagtatatctttctgaattagaaatctagctataagtagagatggttttcattcattgaaagcacaaatgatgtctttgtggatggctgcaacttttctgcttattcaacccccggccacctaggaacctgccacttgcatttataacatcagtcatgacagttaggtgtgttgacatgtgaagcagacacctgggtagattaacaaggcctgaggaacttgagttgttacagttaataggtcagctgttgtatagatagtaatattatagccaaagtttccggtttagtccttgtttccaaaggaaattcctctcatggtgtgaagatatgcaggtctgtttcttaaccctctcagtacctgtgtcccttctgatgaacctcaatgtgagtcattctttctttctccccttcccacctcccaccccaccccccaccccccccacacacacgagatgctgctgaccaggttgataacccttgatacaaatggaaggaatactagattcattcatttcagggctactcaactgtagtttcagatcaaccccttaccagccccgtggccttggataagttagcaaatccctctgttttctcttctaaaaaatgaggacttaggtcacagaatcttcaagaatcacaaaattatactttcagaagagtaagacctgacgcataaataaatacatgcctggccccaggcataccgataaaacaagacatgctgtttgtttgtggaactttcttgtctcttgtccctttctgcacacctcatcatttgttctcgctccctccatatcgccagcatatggcacccagtagacttcttctgctgccactgctggcctggccccttgcagggatagttagcagtttctcagccaccttttccacttgt

SEQ ID NO: 108341 - DNA, 2037 bp, Homo sapiens
tcaacatagtgagaccccgttctccacaaaaagaaaaaaaaaattgaggtactgtgtatctctggggagagttcagagtgataagctaactctgtttctaaagagaatagggcaaacgttacaaccagagatattccttggaaactttatgcactgttattagacacaaatacccattcattagttttccaaggtttttgtgtaagatgagtgttcctttgtaactgtaagaaatatttaatttctaagactcataaaggtatggaaaacatgagaaaggctgtcattgcatgcgttgacagtgagtaagtaagcaaatctgtgccatattgttcagtgtgttttatattgtttaatagctgcagttttagtcaattatgatttgtagcatattcttaacgttatgcagggggtgcagcctcctgcctaataatcagtgtgaccttagttttggtgcaacattagtatataatacggtacttaggaattgtgatttgtagctatgacagattttctttttaggattggtaagtacagacagggcccccttctggaacccttacaggataactgaaatccaccagttaatcagaaatcctctattttagcttccactgtaattgcatctcttcttcaccaagcctgttttgcctgtttttttctcttccctcagaggatcagtgaaaatgcaatcagatgaacaagcagacaagtaaaaaggaggaaaatcaaggagcctatatgttctctgagagagctacataaacttaaactctgttgcttctggagttgatttgagtgtgggggagggggaggaagagaaggtcaccaggtacagcagcttgtcttgtttgagcattcagccacagcttccaacactgaacagacagaaataaaaagttggtgctggctatgtgcgtcaggtagctctacatcagtcctgccactgtggaccatgtttacaccagtaggttattttctacactcctttcattctaagaggattacatcctccattgctttctgtccaggaatccttcaattccatctgaaaggcatgttcgtgacatttctagttggatcaggaattgactttgacctgtagtggtctgaggaagtgtcgagttgctgggtgacctgcatcttgttgtcacatagccagagagtattgtgaatccattgctgatctgtgttatatcacagggccagagggatactgagatttcttgaactaaatcagacattttctaaactctgatttgaaacagatacaaactcctgaacccactgaagcgagactgtctcctaaggctgtggttctcaaaattatgtgagcatcagaatctcctataggctttgttaaagtccatttgttgtgtcctcactcccagaatttctgattcagtaagtgtgcagtaggggcaaatattttgcatttctaccaagttcccaggtgatgctaatgctgctggtccagggaccacttttgacagccattgtcctaaggggcttctcaacatggaaagatttgaagtcaggccatagtccttttgaggtttctcaatcctttcactctgttgacccagcttgtctctgacctactgccccttgggtatgggggccatagatgtgtgctcatatcctgtctttcagttccatagtgcccagacaaccaagattgtgtctgaactatggtagccatctagtctgaatttttgaatgtagtgtaaaagccagagatttagggcagaatttatgtctcctattgccttaggaacattaatcttgaaaaaacagtcttaggtggggaggattctcatttttatctatgaggaattgaaactcagagtttaaattatttgcccaggaagtaaatggcagagttgatatttgaacccaggactctggcttcagtgatgattttccttcacctaagcttctctttctcttgggttccttttgaactgaagattttcttcaccctttcttctcatcatgagtctctttaattagagtgtgaattttgactttaatata

SEQ ID NO: 108342 - DNA, 1896 bp, Homo sapiens
ctgggcaacagagcgagactccatctcaaaaaaaaaaaaaaaaaaattggtcaacattttaagatgctataaggtggaaataaaagttttccttcctattgtctcaatcctaaatatcattccttaaaggtaaccactgttaagtctctgcaaattctaccagaaatgacctaatgttctatttgtatacaagcacacatacacgtatacataaatacctatatacatgtaacacacatctatgcttacatgtgtatgtacggatacatatatggattccattgtggatatgttagcatataccttagacatctgttcacatcagtatgtataaatccatttcatttttaatggctatattgtattccattgcattggtttgccataatttagcttaccttctgtttatcaacatttacgtttttccagttttatcttgttgcaaacaatactgcaataaatatttttgtatatatctttttgcatttttgtaagtatatttgtaggatacattcaaggcaagggaattactggtaaaagagggtgtccgtttttagcatcactaaatattggcaaattgtcctccaaaatggctgccctaatttatacttccatcaacagtgtagaagaatgtcgtgtttctccacacccttgtcaacactaaatatgacaaaaatttcagtttgtaaatacaataagtgaaaatagtatcttattttgacattctgttgctgctgtatttgaggttcatttaagcaaatgcttactgagcactcactgtgtgtcatcactgaaataggaaatggcaataaaaaaatgtccttgttcttgaggagccatggaagtgaataagaagcctctttttagaagaaattcaaaggttgcaaaactagaaaagtgggtcttttgcaccctaccagcaggaaatgttgtctataaaagatagtgtccacccatgtcaactttcagttctgttgtcggcctaaattggcaactctctgcttctgcaatagtggccttgctttcattttggaagaaagttggctgcaggtaggagtagaaatgcctatctagtagctttggtttttctccaggacctgacttgattatctcactggttgcttttaggagaaagcacccactgttggcttctgttctgaaagggcaccaggcaagcatggaatcctatcagcagagcaagccaagagctcaataaactgtttattcattgttcaagcttctccacctatatggattattagaagaagtatttcatcttagggtacccagattagattatagatacttcaagtattctttagaattcactgaggggaaaaaaatatggaaagcagcatcagtcatttgggaccgtgttgtttcctgataccaaaataaccgaaatgaagaaactacaatctgtaagttaaaacagctggtttccagcctgttaaataaaaaccaaaaggtgtgacgtacatggcaaaatgggataaacctggttttctgagtggaggcagctattgataattttacttttcttatagctgaagatgaaggagatttgaggttctctgagaattaaaattcggctggagttagcctagggtgagaccctcagagctgtctgttcatgccattgcctcaagcctgtggacgttttttcaccctggggcaagaagaggctccagtttgcccaactgctgtgtgtgttccaggccagtgtccagtgaggctgacttggcagctgccctttccacagccagccagccagcccctgagtgtgttttaaaagataagcgacaaaaagccaaccccttttagaggggctggaacaggctagtagttgctaggcaagttaaagtaattcagcgtccttgccaaacgtctgccagg

SEQ ID NO: 108343 - DNA, 1036 bp, Homo sapiens
tgtttagaacaaatgttttcttttagatcacaatcttaaggaaacctttctttaacggataaagttttacttgtgcatatgaagtgtatatataaatttatcatttgccatatatttgattcatgttcagagggtatttaaaatagtatcttcttcagaatgtatatgttgggattatatattgctgtttccttcttatgtggtttctttttgtggtcatgtaaaagaagactaaagggatgtgatatttagtctcaaatatttgaattatagtcactgttttatttcagggctgtttccttctatcagttcctttgatctggaacaccaatgtcatttttactttacagttgaccgtatgctggctgactgacatcaattaactaatctgaggcaaatttgtaagccaaatgccaaattgtaatttactgggagagtataatctaataagaaagactatccttgggcttttcacatggtgaaccctagtgtgattttgacaaagaagcccaagtatatactactataatcttttttttaaaaaagtgatgttctgaccaggtgcggtggctcacgcctgtaatcccagcactttgggaggctaaagtgggtggaccatgaggtcaggagttcgagaccagcctgaccaatatggttaaaccccatctctactaaaaaaatacaaaaattagccaggcatggtggcgagcacctgtagtaccagctactcgggaggctgaggcaggagaatcatttgaacttgggaggcagaggttgcagtaagccgagatagcgccactgcactccagcctgggcaacagagtgagactttgtccccgccccccccagaaaaaaaaaaaaagaaagtggtggtcttatctagaccctccagagtctagactagcattgtccaataaaaatgtaatataaacctcaagtatgagctttatatataattttaaattttctagtggccacattaaaaaataaaaggaaacatgaaattaattttaacagtatattttatgttgcttaa

SEQ ID NO: 108344 - DNA, 1050 bp, Homo sapiens
tgttaatatctttgctaccgtttttaacttcagttttccaaaaaagatgttggcctcaacccagtcatgtctttttctcttcttttctgttaagtatttaaggtatctacagaccaggactagaactgggcttttctgtctacttctatttttcaaaagtttaattggagggaaaagttactggtcaagacaaagtttctatgtagatcataacaatatttggaagagtggttgaatataattaaagacaagctacctttatgtgtgtacacatacacacacatatatatttaacaagtctgtagttattaccacaaaattaaacctgagtcttataagtttgggaaaagtaaactcttgctcagattttaagttctcactctccttgacacccttttctcacttagagaaaattggacccattttagaacatgtggccataaactggtgcttgagacccatggaaggaatggtattctgcttaagagtacttttaacaagttaaggatagcaagttctcttggagggtgcctaaaacagagctactttatattaaactcttatctgcattaaagaatatagtaagcattcagtgtaatagtcactctgatgatccaagccatcagttataatgaggatttacgtgtatcctgttgaatatagctctctcagggtgtgtgtaagccaggggaatgagctcccccggttctggataacaattagctgagtgtgactctgttgaaaggctggttagtgctagcactgcagactacaacatggccttttgagtgcttagtctctttagactgaacagattaacccttctttttggagtaaagcctgcattgccatatgccaggtactagacaagtgggttatctcctttaagcctcttaacaatcctgtgagtccttttaactcctttttatataacagattcagacaacaacaaacaaaaaaacagagttgggttctgccctccatatttatctctgtggtgtctcatgtatcttagaaactggttagatgggctaggtgtggtggctcaca

SEQ ID NO: 108345 - DNA, 1057 bp, Homo sapiens
tgtatctccaatgcctagaatagtgcctggaacatagtagataggtgttcaattaatagctattgaatgaataaatgatatatggtaagtgctcaataaatgttaactattattattttgttagataaaaacaaaaatgtgaaaatataactggggttccattgagtcctgattctttccagtgatatgttcaaagaaacaactgtgtggcagaaaaatatgattaaaaataacttttactcattccctcaaaaaaaaaaaaagcccaaagtgagagggtgtatttttcacctataacagaacttgttgaaatcttgtctcgccatttctgatactcacagcattcaacacacatggcagctctgccaactgtgtctttctgtctgtttgccaacccccaaccaaagagctcctcgaaaacctggctaagtgtcttcaggtgctgttgttacctcgtttttggccccagtttctaaatcagcattcagaaaaggtcaggagccacacaggcacattgaaacctagagtgaagttgggggtggtggaaatgaggttgggaatactcaagttgatagttttttaacctgctagacatatagcaaaaatagggaactgattaaagatatgagtgtattctaaactgaagagtacttaagactatcctaaatagctgtacttgtggagcattgaatcctagacttttttttttttcatatatacaaaaggttgatctctttaatcttggtatcccactacaaagctttgaacccagaatagaaggagatctctactatcacaaagcttgtgcattaaaaccatttgtttactctataggtcctcctttggaaccttattgacttgctttattattttgtttgcaactactttaggttagaaactggacctaaaagggaaggggaactattagagacaaggaaaagaacatgatactagtcagcctgagtgagcagaccaagatgaaaaatgctctcattacacagtggtaacagtgaccctgattcctaaagtgggagtcagattaaagacaggagtgtgt

SEQ ID NO: 108346 - DNA, 1051 bp, Homo sapiens
ttcctacattccttcagggagtctgatttccttaatctgggatgtagcatggcataagcattgctgtgttcctccattgttctagtgttcagtcattgttctagtgttcactcagcattaagaactgctagattaggtttttggattccaagacttgctgatcataatagccatattgggagccttttaaaatttctccatcccataacctgggagtcagaatttctaagggaaagacctagggatatatgtttgaagtagattctggccatcagctagtttgggaaattaccaatcttggtactttcagatatttcttctagccttccagtcatcaaagcaaggtagaattatcaacataatgatataaagctattgtattattttatgcatgcttcctggagcaagacataaagataaaactcattcaaaatgttcggaatatcatgaacttcactgtgggactaagcattcctgcacaagtccaaacagtgaacttaattcatactcttcagatgatagctgtgtctgtttaatattggcccaacctactcttgctcacgtattttccatttcactgtaatttttattccagctgtatattcaacagactgcctgccaaccctgtggaaccacttgacataaatgatgtattttgaaagattaaaccagaaacacgtattaaaaccatctttatactagcttaagacttaaagaagtttttatgtggattcaagtggaatgagaggaactaagaacggggaatgaggccccagaaaagcaaatttgaggttaaaggtaaaaattaaaattaactaatttttaatcaacatgccacttggtagcaaaaaattaaaatttattaatgactataatattatgaataatttcacatgctgaagtgtattgcctcttcaaagcatgcctcttgggtttaaatgttcttttcacatgtaaaacgttctggtaagaactgtgcctactttctatgaccttacctccctttctactgtaaaaacatcagcacatctttcaggaaaattgactgctg

SEQ ID NO: 108347 - DNA, 1062 bp, Homo sapiens
caatacttctacctcagcctctcaagaagctgggaccataggcacacatcaccatgcccagctaatttttaaattttttttgtagaaatggggtcttgccttgttgcccaggctggttatacaattatttgaattctttgttaggcagtttataagtctctgtttctttagggttggtcactggtgcataattttattctttggtggtgtcatgtttctttgattgttcctcatccttgttgccatgtgttggtgtctgtgcgtttgaagaaatagggacttattccagtatttgcagacttgctttgtttgggaaagccctttttcagtcaacctgtccagagattctgagcaggtcgtctgatgttgtccattagcaggcatgctgttggagtcttcgggcagcctggcttcatatctcggtcagcaggtggtcagcctggtacccgagtgtatggaattgaacctggagcttaaaactactgtagtagacctgttattgggtctataggcatgggcctggagcatgggttgcaagggtgggttgtttttcctttatgcagtgcttttggatgtaactctgtactttcttaggatttcatcccccaaattgttatcctcgtaaattattctctgagggaccagactgatgtgattaatattttctattatatggttgaaagaggcttctgatggaatctaactgtggcttgccatctatccaaagcagcgcaattgacccaagagattcagctgagaaaccatcattagaatagtaagttagttcagtaaggtcacaaaattaatgtcagtcatttttatatagaggcaattaggaaatataatggaaacagaaattctatcactgtgaaaaaataaatataaaatgtctaaaagctataaaacttgacaggactgtagaacttaaagaaaaacactgaagctctacaagaagacctaattaagattaatttttaataaatagccaaatggtgcttctagttgggatagccctgtgtaacccagttgatcccaaatctcctagatttataggctcagttg

SEQ ID NO: 108348 - DNA, 1029 bp, Homo sapiens
gagcatatagtccaaaatgcagtgcacaggtgcagacatctctggaagcacagctcagggcttaaaaaacacagaaacaatcacataaagcagaggacctgactccacaacaaccctgcccaggtggccacagctgagtaagccacatctcatgcactcactccactgaggcaccgagagtttatctgtataggaaggtttgttgtctcagatcctctgcaaggccctgaactgaggagcagcatacttcacaagagtgttttgaggtcctcaccccttacagagacctctgcatgccatctcatcttagatattatgttagcagattctaccagcaactccaaaggaaattgtttcatggtgtgtgcatcccttgggagaagaacaagggttgttatattctgaaacatcagatgtcacaggcttctgtcatggctctaacttaattaccaagtgacagttcctctctgctatggacattagcagaccaactctaattaagatgtccagggctcagatgcccagatagccagggtgcctaacaagtaaacagaagctgaagtttctcctggggaaaactgtctcaaataaaaccttcaatcacaataatttgcaggtagtgctattttccaaatgaacaaactgtcaagaatgggatccttagaagacagccctcctttaaatccctctctgcttagttcatcgttattttttactttataacatggttgaagaaaagtttatatcaagaataatagaagtgtcagcctgccttttgcttgttgttcacttgtgcttccattattagcattgccttcaatccagtgtttatttcagatgtctttttaagctacctgcccatgttttaggagctaacatttcaaagtagataacagaataggcaaatcccctcacttggatacaagtaaactgcaaggcttcctagtgtcctgagtgttaaggaaatagggtaggccccacttctgagccttcccagatggggagcttcccctctttcattaagatgcc

SEQ ID NO: 108349 - DNA, 1025 bp, Homo sapiens
aggcttagactaggtgatctccattcttgcatacagtgttcaaagaaacataaaacaccatatgtattttccatctgcagttgattgaatgtgcagatgtggaatctgtggatatggagggctgactgtactacccaattttatataaaagacttgagcattcataaattttgatatccaaggggaatcctggaaccaatcccttctaggtacagaaggccaactgtattatgtgttataagtaatcaagaaactatttgaagtatacaagaggatgtgtgtaggttacatgcaaatacaatggcattttattgcaaggaacttgagcatctgtggattttgttttcttcaggggtcctgggaccagtccctcaagtataccaagggttgactgtacagagaaacctattacagttgttgttttactcaagaaataccatataagacaagaagagtggtttggtggcagaaacatttgtctgagattcagaaaagatagattctaatactggctctcctaccaacttgttgatcatttcacctttctggacctcagtttacccatttataagaagtctcagtttactcacctatataaagtgcatcaagtgatctgtaaggttgtttcaactcttcctagtctctgattctagaattcttaaatggatgtatgtttttgccctaaaaaaacaacaaaaattagcccagaatgtcatcagatctgcacactggaatcatataacatgggaaaagcccaccaaaggccaaagaagaaacataaattatgacagtatgtggtctcttcaagttagtccatcccagttgttactgcttactaaatttatcaaattctttaactctttaggtattattagatttgtacagaaaacagaaacacataccaccctttctgatagggtttttgaattctaaatccataggaagatttcgtgttgccagtggttaatttaattttacctgctttcattgtttaccaggtttcccttggttggctgacagccatc

SEQ ID NO: 108350 - DNA, 1112 bp, Homo sapiens
ctgcttctctaaccctattttcttagatttgcaactagtttatacccacatttgagtattctctatttttccgcttccaacagttgaatcccgtgctcttctttgctgtaaaaacaggcagggagcttggacaagtaggaggctcaggtccctcaaagacctgccttggtgctactagaattgaggctgtggctggctggcaagatggtttttggtattcttaataactcacctgctccagacatttttatatagtgaggtttagggctaatgagcagatcacttataaagaatatggattaaaattcttcccaaaccttacttataaaaccttttaaaaaaaggatcaaggttgagtatatctatgggtatgagtgacctcagttaatgattctattaacccagtaaaaactgggtttaaacaaagcaccatggattagtcaagtatctaatgcagtatatcatgcgtatctactccctgaacaagctactgacaaatgtgattttattgaatcccaaccctctcttctgtaggttgtcctggaggttaatagagttacttctagccagttcattctgtttgccaaaaaatgtttttgcttgctcctttgtatgggattgtcagttgtctctgggaggtgctagatagaaattacaatataatgatggtagatgataaaatgaacactgagagaagatatgttgataagatttcaaaacatcttctaagatatacttatcacctaaaacaaatagatgtttgctatagatggtttaattttaaaatttgctcttaaactaaataaaaccaaaaaagtttttagttagggcctcttttagattggttaccaaacactctcaaaataaaaatatatagatcaataatttgtttaactttgttgaacacagataatcacttaggttcaagagcaagcaaattcagaagcactgaatggagaattttgctgctgtagcataaaaatcaaagatatactttatgttcccaacgtcatcccttgctcactgggagccttaggctgggttcagcatgatggacctggagatcccaaaagagggacaatttcagttgcattttaatcaagccccaggat

SEQ ID NO: 108351 - DNA, 1059 bp, Homo sapiens
tgttcccaagcctaacacagagcctggcacatagtaagcccttgacaagtgttggcttactatgtgccaggttctatgttaggcttgggaattaaattgttggctattaaatgaatgaggtttggacactgtccagtattgaattagatgcactcaagaccaaagattaataataaaatacacattcctggattcgagtggatcttaaggattcatctcaccaacttcctgccttatgccagtgccaactttcaagcataactaggaccctttatttttagttccttcctaagacggatgttgagtggttttgctggctaactcgtcaagcatgagcattctttgtgcagcttaagtccattttctttttctccacttacatgaaattgaagtagaacatgcctacatcttgtgtgtgagggtttttttttaacatattgaagattcctcttatctcacagtgtcttgtctagttcagattggaagcagagaccatcacctcaattagagtataacagaagagttaagaggttgtcaacttgaattttaaaattgcatccagtggcagctggcaacatagaaatcagcttccgtacaccaaggggagatgttgcaaactggaacactgccatcctttgccaaagatagaccaggctactgtgcagaaagtctcagatttgttatgactgaatattaatgtaccactctctgtaagtgtttggtcctctttgccttatttgatgtgatttgaatgaatttaatttactagaagtgcttttctgggtaataagcatttatatttttcatccttataaaaaatgcacggcatcttcaggcagaaaataagtgatagtgttaaatataaggaagaaagctttattgtacagtagaaatcttccaaccttagggttattttgagctgatagcaacatggcactaaaattctcagaacttctcagaagaattaggtaataaaaagtgaagccaccatttttgtgttatttactttttaaaaaatgcaatttagggttgagaagctaaagaaaactatgagaatac

SEQ ID NO: 108352 - DNA, 1046 bp, Homo sapiens
gctcccccggttacttgcaaaatgaatttaatttactgggttgttaaaagaacaccaaatatgtcatacagagccctggaatagagatagaaaaaaaacaagacagaagaaaagtcaagagaccaacaatagagaatcagttctccaaagatgtgaatcattgcttttgaatggcagagccccctggggagatgggtagagcagaacaataaatgaaagtagtcgagagcatagactctgcagccaagctgcctaggaacaaattgcagcttgccattccccagctatatgaccatgggcaagttcctgtacctctctgtgcttcttttcctcaattgcaacagggagctaataatactacctgcttcatgaggttgctgtgagaattaaatatgtcagtacaggcttagccctttgagcagtgtatagtacatattagccatttctcttttcatcaattcccttgttgcctttgccagatgcaaatgtcatgcccaatatggactgcaggcagccaaccaaataaacagaaggaggaggacctttccttcccttgggtcctgagctcatgtatgcattggaattttcagtaggaggagaccttcttgtgatgtctggacacccatcaatatgtagattccaccccacaacaattgtccatattcagacacgttttaaaaatcggttccacatttcaagcatgtgaagctaggttttagctttagtctctactacatatttggaattaaagcctctagagtccattatgcaaatccatgcaaataatatgcaaagaggcagtagcctcagattgtggggagggggagtgtgtagtccagcacaaagggccttgaatgaaaatttgcatgtgttagggaagccctgggttgaaggcctcagatgtttattgtgacagtgtgcatagcattcagttgttaaccttttgtgccaaagaagagaggtaaatgcttgtctgatttccatattgaaggtgacagtagaggttggaggtggtatttggctagcacaacattgtagggattttt

SEQ ID NO: 108353 - DNA, 1010 bp, Homo sapiens
actagaaccagcagggaacagaggcagcctgttctgggctatgggcatagacagaatggcactactctgaagttttctggttgagagtgtaaattatttttccatttttttccccaatggttaggaccctgggtttaagtgaggtgaccaggtggctggtgatgccaacttggagttactgtactagtagctattatagcaattttatatgataattaataatagatggcatttattgactgctcactaactgccaggcactgtgctaagggcttgacatacattatcaaattaatcatctcaatgacgttatgaggtaaattctattacgatcctaaagtggctcacacttgcattggcagctacaacaattatctccactccacaatcgctttctcaatgtgaccttgccattgtctcatcaagaagttgaatttatttctctccctgttgaatctaggatagtcttgtgactgctttgaccactagaatgtggtataagtgatgtccagagactttcgagcccaggtgttaagaggcctggtagcttctgtgctcactcaggtgctatatcagaagtttgactatgtcaggctgtcatgatatgaggaggtctaagctagctacacggagtggtcacagggagagagaaaaagagatgcacaattgagtcaccagagaagctaaatgaagaagccatttttgggtgttccagccccagcagaggccacatgatacagagaagagttatccctgctgaattctgcctaaatcacagaatgagagaacaagtgattcactgttgtcttaagctactaagacagtaactagatatgatagccaaaatagatcctcactttacaagtgagaaaatgaaagctgttcattcacatagctagtgagtgaggagagcacccaccacgaagtctacctcctgactcccacagcaggggtgctctctcccatctgcccctccctcacatttgtatcagctcctccaccgaagccac

SEQ ID NO: 108354 - DNA, 1094 bp, Homo sapiens
gcaggcagagcaaaatacgcaggcgcaggcgcttcctctctcttctagcggcccgccctccctcctccctctccctcccctccccactcccttcccctcctctccaggcctgcgcgcgcgcctcttcctccggcacgcgccgctgctagccgagcactctcgccagaacctctggctcgcgcgtgccttttcccctcaggttgtggggagagcggaatcctgctccgccgtcgcagcagcagcggcagccccggcagcctcgggcgacagcggcggcgcgcgagcccccgggcggaccgtaccaccgctcgccagcacgcagggggagccgcccgtctcgccgcgcacgcctcggcgaccccgcggggctgaggcgtcgccgcgcccggcagcgtgagcgcagagccggcctcgaccccgagctcggagccccgcgggccgcgcccgccgccggccccacccatccgggtcgaggaggccgaggccatggctgagacggaggagcggagcctggacaacttctttgccaagagggacaagaagaagaagaaggagcggagcaaccgggcggcgagtgccgcgggcgcagcgggcagcgccggcggaagcagtggagccgcgggtgcggcgggcggcggggcgggcgcggggacccggccgggtgacggcgggaccgccagcgcgggggctgcgggcccaggggccgccaccaaggctgtgacgaaggtgaggggccgggaggccggcactcggggcccgggccgcgcgccggcgccccatgtgcccgcccccgcctgccggggaagcgtccgggaggggccgcggaggccgggcggacgggcgcgggccgccacgtgacgcaggctctccacctcgggctgggctcgccagggccgggaccccttccgatatccgcggtggagccgcccttcccaccccgcgtcgctcggcgttagccaaggcccgggcggcgccaccctccgggggcactaggtctggggccgcagtgcccagcacagagcagcgtttatcgggtgacgtctaggctgagtaattccgtgtgctgacctcagcccagtagtttgagctgaatt

SEQ ID NO: 108355 - DNA, 1458 bp, Homo sapiens
agcaccaggtcaagaaactgagtattactgatacagaacaaggttcccctcctaacacatactcactgcattcaccttcaacataaccactattctaacaccataattttttctaaaacttcataggaatggaattatatttgtaaacatgttattttttaaagttcaaaaaaatagtaatttttaaaaattgggtagtttagaagatttgaaattaacattttgtcaagtccagtctatggcagtcaactttaaggttgatgttaagtaagtgctatattttggagggttcataaagtaggaaaaaacaaatgaagatatggttctgctgtaagatgaaaaaatcctttgctcccggtttaaagaaataaaggatcttgataaactgtctccagtttgaaggttgcattttataggcaatgccagtgagtgcgaggcacagtggaggaaatactttccttaactgaaaactgtcttttgacttctctggatgttagtatctatagctttagataacttactcaaaaagcagggttaatattattgacatttgttgaacacctaccacagctaggcattaatgtcctactgtgaaaacatcattttgtgagcttaaccaaagtgaaacccccagattgataatgggaaactttcaggaacgatggcttctccactcttgagatttctttgtagtggtgttgagtagaagtgattagacttgagtttgattcccaaccacttgttggcttccttaatgtgtctttctcttttctgtctcctggggcttgacctgtaaataatggggaggagggaatgtgaggttcttaccatttggtgttgtggaactgcctgtgtgtgtggctccggttctgttgtaaagtttggctcttcttaagtcttttctttcctaagtgactgcaggttcttgaaaacgtgagtgactggaagaatagtgtttggccatgttgaacttggcaaaatagcacttttctgaagataaaattttggtttcaagttcactgaggattagaaattgattttgttaaactatggagattatttaaacagaacctgtgtttttctgttactgactataaattacatgttcatcttcagggttattttgatcttgatctattttggttacttttgagatagtgaaaagtgtcttaaataacttacatacttcacccttgccagggatataagtaagtatcagctagtacaagcatttaagttctgttcaacctgaaggtagactagctttttttttttttttttttttttgagacgaagtttccctcttgttgcccaggctggagtgcagtggcaaaatctcggctcactgcaacctccgccttctggtttcaagcgattcttctgcctcagcctcccgagtagctgggattacaggcgcccgccaccacacctggctaattcttgtatttttagtagaga

SEQ ID NO: 108356 - DNA, 4493 bp, Homo sapiens
caatgttttcacttttcttttttcttttttgagagccggagtctccttctgttgcccaggctggagtgcagtggctcaatatcggctcactgcaacctctgcctcctaggttcaagccattctcctgcctcagccccctgagtagctgggattacaggtgcctgccatcatgcccagctaagttttgtatttttagtagagacagggtttcatcatgttggcccagctggtcttgaactcctgaccccaggtgatccacccacctcggcctcccaaagtgctgggattacaggcgtgagccaccacgcccagcctgttttcactttcagacattttctgaaatgaattcccttctgtggtctgacccagagaccctggtattgttttttctataattgttaaatgattgggaatgcaagaatagcttattaaaatgctgagcatttaaatagtttatctaaaaattgttataaaatattagttacagaaaccccagaaccagcgatgactagtggtgtgtataggcctcctggggccaggttaaccacaacaaggaaaacaccacaaggaccaccagaaatctacagtgatacacagttcccatccctgcagtcaactgccaagcatgtagaaagccggaagtaagtactataattaattgcattttgtttgggacttctgttcctaggccagggagtgggatataggggatgtgcatacccacccaagggagagactactccttaactaataaagcctgagcttcagctgacaggcaggtgagaatcagggtgggacttcatatgtccagaagggaggaaagggggagggcaaagagcattggagacactttgtcttctgtctgcaaaagtttatcttagccctggtttatgttgttttatagcaatgacaagttttaatgtagttaaaattcttttataattaagtggcttttgctccttataatatggaaactagaaatataaaagcgctgtttaattgtattcccagttaatgtgactatagacagaagatgttggcatttataaatctaatattaaaataatcttatttcagcaggtacttaaaatgaatgctacctggaattaaatgactacatatggcacatctacatcttactttagggacatgaattttttaaaataaataaaatgggaagaaatgtaaatgacatcagatggaaatgtgttttttggggtggcttttagaataaatcccagccttttcaccactttgagagcacagctggcttgaatttaaacctccacgtggacttgctcctctgctctgtcttaaaaaatgtgtaagggaccttgggagggcagtgattcaccacactcgagtttctttacctgatctaatcagatccactcccacaaaatcgatgtgaggagaaatcattgactaatgagtagaatttacttgaatgagaaaattgttacccttgtgcataaagagagagatgtattatctattacttgctaaaagtaagagtcttaggaggaatgtcattacacagcttttaacagttttcttcaagtttgtcctgaaatagggtcacagttaatactgttcagtagaagataggaccctagagcttcaatacagcgttctgtgttttctgtttgaattgaagccttaaaatggtttgataaggattttctatatgcctccactcctacccctccccaggattcttctaaggggtggcttttttttaaattcaaggacgaatattttcaaaaaccctagtgaagaagaaatatttactgattacatttcttttcccttagggataaagaaatggagaagagctttgaagtagtaagacacaaaaatagaggtagggatgaggtttcaaaaaaccaggcccttaaacttcagctagacaaccaatatgctgtgcttgaaaatcagaaaagcagccactcacaatacaattaaggaatgggctttgctaacccttctgaggtaactagactgcagctaaccaccaccaacagccattcatcatctgatctctgctggatctacagacaccgatgcagaccactcgatttcatgaccggccctattgcactatggaagttaaagtgtcacgactgctctatgcatattggatttaggggaattttcattgttacataaatgtgtgaactagtttcaacagtgttctttcatatttactctgcaaatacaaaaaaccaaaacctgcagccagtggtcatttcaaaatctttttatgttcagatactgagccttcataagggttgactacctcagatttgctgcactcattgtggacttcatgtggatcacaacttctggataagaagattacaactattaagtgtcgatgtgaaccttgcaaccagctctactggattcttatcagaaatcctgcataaaaagtcagccatctgggttctgatctgctgtaaaagatgaagatttaagtgaccttaattaacctgtcctgtgccctacccttaaggaatactctctgtagtaggctgttgttatattagacttcctggaacacactgctgaaaagaactgatgtgttcagatcatctgtgtagggctgtgatttgtaatttaaactaattgtattctgaggtaaccacaaaataaattcaaccaaactggggtccaccaagtgggggaaggggaagggagagaataatcttgggggttttttttttttggtaatttttttatttggatagtgcttttttgttttgtttttgttctgcattaaggccttttttgctttgacttgaaataagttctttgacagagcatattgcttggttaattaagtaacctaaagtatgcattaggattgtgaaatgtctcgtgagtatgccaatcctgagggtggaaccaaatagcctttgatgaaaagggcagtggattctggaggctctacttcaggtgctgctataatgcctcatctaatcaggactaaattgtgtaggaaactgcagtgggaagaatatgctttctgctcaggctaagagggtcactgatctgtccttagaaattcagagtaacatgagcaaaacctcagctaaaacccatttaagtggcatggattgtgcatgatctttgataagaattcctcatgtacttgtgcctagtttttcaaggtattggctgttctatagatgcagtgattgtcccagctagctctgttaccagccttttggtgtgtctttatgttcatttggagagtcagggcgaaagacaggtgatgtagcacttctgtttttaataattattgcttaaaatacctattaatagttttgggtcatttaaagggacttgaggaagctacccaggattacagaagagtgtccacctaacaagatggtctggcagtttcctagttttgtatctggttcaatagaaatatgtgaaagtggtaatgtcatcatttgatgcagagtccgggtttctctataataaatccctttgccaaatgcatgagttgcagacttgctactggcaagagtgaagcaagtgggtgagtaaaactattttgacgtgggagcgttttcagataggagtttagtcttgacgaaagtgtccgtgcaggaattggactccgaggagggttacagtatctcctgacgggacctgccactcgcatctgggcaatgttgacatttgaggtggcaggcaggatgcctgccttctaatatatttgggtgagtaactgagccagccaagggaaggttgaatgattaaatcagaaatgggattcttggtaaactgaagacttttatttgggaatgaaaaaccttaaaaaaatctcttcatcgttgaactgtgcattttccctgcattttttcccaacaaaattttgttgggggttatgttactgaagaatgaacagatgagtaagtggaggtgttatgtaaaggcatattgtactcgaaatctgaagacctgcagcagatttaaattacaactcttgttataactttttaaaagattgtgaaaatatcaaaatataaatgaatcaagttttaatatactgtatgatgggtggatgaggctgtccattgtaccatttgtttgaattctcaggcatggtttggcagtgcaagaattctgtaacattaacaaattcaataaaaagtaaatatatggattttggactgtaatggttattttaaagccttattctgtctttgaaaatggtgagttgaggtcacacctctcttgctgtgggaaggtgaagatgctctaaactcaggggtgtacttttttttttttttgagacagttgctctgtcgcccaggctggagtgcagtgatgtgatcttggctcactgcaacctccgcctccctggttcaagcgattctcctgcctcagcctcctgaatagctgggattacaggcgtgcaccaccacacccagctaacttttgtatttttagtagagacggggtttcaccatgttggc

SEQ ID NO: 108357 - DNA, 1031 bp, Homo sapiens
tacatcacctgtctttcgccctgactctccaaatgaacataaagacacaccaaaaggctggtaacagagctagctgggacaatcactgcatctatagaacagccaataccttgaaaaactaggcacaagtacatgaggaattcttatcaaagatcatgcacaatccatgccacttaaatgggttttagctgaggttttgctcatgttactctgaatttctaaggacagatcagtgaccctcttagcctgagcagaaagcatattcttcccactgcagtttcctacacaatttagtcctgattagatgaggcattatagcagcacctgaagtagagcctccagaatccactgcccttttcatcaaaggctatttggttccaccctcaggattggcatactcacgagacatttcacaatcctaatgcatactttaggttacttaattaaccaagcaatatgctctgtcaaagaacttatttcaagtcaaagcaaaaaaggccttaatgcagaacaaaaacaaaacaaaaaagcactatccaaataaaaaaattaccaaaaaaaaaaaacccccaagattattctctcccttccccttcccccacttggtggaccccagtttggttgaatttattttgtggttacctcagaatacaattagtttaaattacaaatcacagccctacacagatgatctgaacacatcagttcttttcagcagtgtgttccaggaagtctaatataacaacagcctactacagagagtattccttaagggtagggcacaggacaggttaattaaggtcacttaaatcttcatcttttacagcagatcagaacccagatggctgactttttatgcaggatttctgataagaatccagtagagctggttgcaaggttcacatcgacacttaatagttgtaatcttcttatccagaagttgtgatccacatgaagtccacaatgagtgcagcaaatctgaggtagtcaacccttatgaaggctcagtatctgaacataaaaagattttg

SEQ ID NO: 108358 - DNA, 1371 bp, Homo sapiens
gactttgtcccacagggtccattttgtttaatttgctggaacctaggaatgaatatgcgttttcctttaagtttgtcagattcatccctgagaggtctgagatttaaagaaaaaatctattaccagatcacgtaaatgtttgaaatcattttaaaaaatcacttatttttccttttataggaatcacctcctcatgtagaaaattactgtctaccagaagctatttcatttattcagaataataaggaacttgggactggattatcacaaaagaggaaagctcctacagaaaaaaataaaatcaaacgacctagagtacactaatcgcatctaccctttagttaccaaacattaaatgtttttaaaaattgaaagcctgaatgtgactgtgatagatttgggtagtaatttaaagatgagtacctgaagaattctgcttcagagtataatgatgacccttcttgagttttgaacacctgaaattgtaatcactgaaatattaactgtttcttaataaaaagttacctgaaataacaacaaaatacaactcctcagctagcttgctgttaaaccacattgaagtctgttaaaagatatttatttttcttgtaaatatctgaagctgtagcttagtggaaattttagcaaggtaatggattttgctttaaaatgtctgccttacaaattcataacaacaagatttgtcagtcagcatttattcatgttttccctgatttttatcttctcaccattttacctcttttaacaggagcctgagcacaaggtttaatgaggaagctggggctataaatatgtgtgtatatatgtatatgtatgtttgtacaaatctccatgatgtttgccaagtttgaatgcgcaaaacttggaaaatgtgacaataaagaataaaagtagtaactcaaattagtattaagatgtgtttacatagataaattttttaaaagagcaccctggcatctgttcttctgttgaagcaacaaaacatttatgtaacgtaaaaaatgaattgcaggggcctgggtgcggtggctcgtgcctgtaatcccagcactttgggaggctgaggcaggcggatcgtctgaggtcgggagtttgagaccagcctgaccaacatggagaaacctcatctgtactaaaaatacaaaaaattagcccagtgtggtggcacatgcctgtaatcccagctactcaggaggctgaggcaggagaatcgcttgaacccgggaggcggaggttgcggtgagctgagatcgcgccattgcactccagcctgggcaacaagagcgaaactccatctcaaaaaaaaaaaaaaaaagaattgcaggccaggcacggtggctcatgcttgta

SEQ ID NO: 108359 - DNA, 1065 bp, Homo sapiens
tggcctactatgtgccagataccatggattcacgtttcagtgttctggccagagataattatactgtggcaaaagtaaagtttataagatttattgacaaaactaagtctacagataaaatcatgcattatctgtattattttgttattttccaaatgatttcaccactgattgttttttatttgtagggagcatttagtgggtggaaggttattttacatgtggatcagtctcgagaagcaggcttcaaacgccttcttcagtcaggaggagcaaaggtttgtatcaaattaatttactgacctttttacatgaataatcatctaaccaagattgctatgatgagttcttcattttctctactttttgaaatggtaatccttaagtacacattatacagctgaactactttggaatactggtagattgtgatactaccttgttttttcattaggtgctacctggtcattctgtacctttatttaaagaggccacacatcttttttctgacttgaataaactgaaaccagatgactcaggagttaatatagcagaagctgctgcccagaacgtgtactgcttgagaacagaatacattgctgattatctcatgcaggtttgtgagattctatccttgacctcctcattaccagagatacgtttatgtgcatagataagtaactgcacaacaaaaccttcagctcatgattagtagaagattagtctcctgttattctcttctattccagccctttcagttttattctatttgtgttttttattataatgaacatattatgtaaacatttagcttggaagttaaatatgagaagagtataaaaatctaggtacctctaaaggctttaaaaataccctttaaaatgttggaatataaagcagaaatcgattccaggagtccaaggagaaacatttatccaaaggtcctttagttttcttgactgtttgctttcatgtacattaaatacctatgttagacactgtggtaaatttaagcatttgctatatggtgggcttactactctcatattcagaattggcctgtgt

SEQ ID NO: 108360 - DNA, 1085 bp, Homo sapiens
ctgtctctaaaggaagaaacagacaaatttatttatttacttaaaaaagtaaatctcagatttcatcacatttgctgactgctcataaaattgaaataaccaaatatggccagttagagtataccagctttttcaataacaaagccaaacaacgaaacttcgcagagccaggttcacctttaatcactttttaaatgatttaatttgaatgttagtgttgtttttaattgaaataacattttcttagaaagtttcaagattatctcattgtaagctttcatctttactacatagacagataatcaagttatcagtacatacctcctctgagactgtgtcctttcatgaagttagtcttacagcaggtgaaatttgtccatctgaatattaccagttgccaagatatagctatcattttgtttcttaaaaatgtatgtggtatttttctgatttctaattaaaagccaaatatacttgactcttatatgaaactaatctacatttcctccatgctcataaaacaatatttacttagtactgtctgtatttgtaacaattaaatgtatagctttaacagttattagactttgggctccttgaggagccctgtatgttgcacagtggctccccagactgtaacaactcaggtttgttggacaaattctctaggaagaagactatgaatggggaagtagttccatacttgatgttctgactggaatcaatgtacagcaacgaagactagcacttgcagcaatgagatggagaaaaaaaatccagcaaagacaagaatctggcattgttgaggtattaaaacacaattatataggtaatacaaatagcattcaatattgtgactctttcacattttttttaaaagagaatgtgcttcaggaaataatgattctacttgtcttttttccccaaatttttgatggctcttttaaaaataatttatatatgtaaaatgtggcccatattgcatttcttccaaagaatcttttcagcatctaatgtcaggggttcttgacctgagtccacagaccttctcaaaggaatttgtagatcaaatctgggaaggccat

SEQ ID NO: 108361 - DNA, 1081 bp, Homo sapiens
atggtgaaaccctgtgtttactaaaaatacaaaaattagccaggccatagtggtgtgtgcctgtaatcccagctacttgcgaggctgagggaggagaatcgcttgagctggaggttgtggtgagccaagatcatgccactgcactccagtctgggtgacagagtgagaacctgtctcaaaaaaattaaaattaaaacagaataaaattaagtagttaagcaaaaaaaggtggcagaatttggataattttagaatataggtagctagtatatgtgtgggggttcattttactattttatttacttttgtatttaaaatgttcataataaacattttaatacatatatatatgtatataaagtaaaataattctaagtaagtcaagtttttttggtttaaatggtttggggcattttatttataaataatttctatgcgtagttgagattacatttttcctagaaagaagttgggaatcaataaagtacaatccatttttctctgcttaaggtggattggtgatagaaaagcagtgctttgatcccacctgtacacacattgttgtgggacatccacttcgaaacgagaagtatttagcctcagtggcagctgggaagtgggtgcttcatcgctcctaccttgaagcctgcaggactgctggacacttcgtgcaggtgtgtattcagatttgtggaagtttatttttctttaaaagcaagtgtccaccgggtgcagtggctcacacctgttatcctagcactttgggaggccgaggtgggtggatcacctgagatcaggagttcgagacatgcctggccaacatggtgaaaccctctctactaaaactacaaagattagccaggcatggtggtgagtgcctgtaatcccagttactcaggaggctgaggcaggagaatcacttgaacccagaaggcagaggttgcagtgagccgagatcatgccattgtactccagcctgggccacaagagtgagaccctatctaaaaaaaaaaaaaaagtaagtgttggctggcagtggctggctcatgccactttcagcactttgggaggccaaggcagg

SEQ ID NO: 108362 - DNA, 1342 bp, Homo sapiens
tctccaagtgtagaattgctctcatgttacaaatttgggttacacttaacaatgaaaacttggtatttaaggaaaatgttgggagaagcccacagataacacacttgctctgtttaatgctaataaattgcattttttctttattgttattattgtcacatgcagatgggatgcatttatttataagttctggggataggatacttttttgcctgtactttttacattccagagtttgtgcttgacttcatcttgactaagacagatgagaatatttcctagaatttgtttttagtcttatttggatcctgtcacactgcagcattttattgtcctcagctgtctgtgatcctggaaacatacgtgtgactgaagctcccaaacacccaatctctgaagaactggaaactcccataaaagacagccacctgatccctacgcctcaagcccccagtattgcctttccactcgccaacccccctgtggctccgcaccctagagaaaaggtttgttgatccttaatatggtgatacagcttttgcatactgctgttaggctgtattagaaatttgttgatgtcaatatcaaggcttcatcaaatgttgaaaactattttttgcattgtatcattatttgtatatttcataacttagaagactgagtaaaataccactataaaagaactgtgtatctgatcatttttaatgttaattttttctaaagtaaaactttcattccagattataacgatagaggagactcatgaagaattaaaaaaacagtacatatttcagttatcatctctgaatcctcaagaacgtattgactattgtcatctgattgagaaactaggtaccagtattttacttaaatccaaaatgtcccatataataaccatatttggaagtcaaatgtagtcaatattaatatcatttgtaaagtctagaagtagaggaaaagaacatgggtaacttgtctaaggctatacattgagtcagcattggaactttgattttaaaaagctctaaagtcagtagatcatgggatttaaaattcaaatggaatctagcagttgaggtttaagaatcttctgtgctgtttgactattcattcactaatgaagctttaaagacttactatataaataaaaccacattttaatgaacttgaaaggttaataatatctagagaggagctccctcttgtttttttgtttgtttgtttccagttagaaacagtgtggaggccaggcacggtggctcgtgcctgtaatctcagcactttgggaggctgaggtgggcggatcacctggggtcaggagtttaagactaggctggccaac

SEQ ID NO: 108363 - DNA, 1090 bp, Homo sapiens
aattaaggaaaatcacatttttaaatgtaccaattactttagtatttttaaaaaatttcttgacactgttgaatttctcctttgaagttttagttctgtagacatgtagtcaaaatatgtgttcctagctaaaacagataacttttctggaagaaaccttaaacctttttaaaaaaaaaaaatgtccctaggttcatttatttaatatttttaatgcatactgtgtgctagatggtgggcatataaaggtgagccacaacttttatggtctaacttatggatttaatgagtttggatttgttattgctgtttatttaaactgtcacttctattccttaggcagtctcgtcagacagtacctgatgtcaacacagagccttcccaaaatgaacagatcatttgggatgaccctacagcaagggaggagagagcaaggcttgccagcaatttgcagtggcctagttgtcccacacaatactctgagcttcaggttgacattcaaaacttggaggattctccttttcaaaagcctttacatgattcagaaattgctaaacagggtaacaagaaagaaatctttgcatttgtttgtattaagtacatgttgacctcttaaaaataaacagatgagcatgttgtagttctctgatctgaatgtgcaaacaaaaaaaacttcgtagatatttctggttttggtttaaacttgagccagaaaaataatttgtaaattgaggtacttcatcagtaaattgaaaaacattttcataaatttggaaatttagaattgggcgtttttttctagacatggtgtctaccattgttcttttattctagctaaccctttttgtgtttgtggagttaatgcttggtttttcttcctatcatcttattttcatttaagtcttttgaattctgcctagcacatacctacatttgttctttggattgtatgagtttctttctgaattctcctattttttttcttccttgagctttaccttaaaaacaaaattttcctatctctcatcttttttcttccttttcttctttttcacattgcatgatgacctcccattagatatatagattt

SEQ ID NO: 108364 - DNA, 2667 bp, Homo sapiens
taaatgttttgtaaatagttatattttattttttttactggtacttttaattgtgatatttttcatttttatgtctttaaaatatttctgatccatacttggttgaatccatgcatgcagaaccggtggatgtggagggctggatgtatgttgtggtctgtgttttcaagagcctttggggagtctgggcacggtggctcacacctgtaatctcagagctttgggaggcaaaggcaagaggattgcttgatgctaggggttccagatcagcctgggcaacatagtgagaccttgtctctacaaaaaatttaaaaaattagctgggcgtggtaatgtacacctgtagtgccagctactcaggttgctgaggctggaggatcacttgagcccaggagttagaggttataatgagctatgaccataccactgcagtccagcctgggccacagagcaagactctgtctctaaaaaattaaaagaatctttgggaaaaatcagacacatacacaaatgactataagacatctcagagtgtagtacataccatgagagtcagaagcaggcagggagctttacagagggataatcactacaggtcttgatgaaatgtctttgaagggggccaggcacggtggctcatgcctgtaatcctagcactttgggaggctgaggtgggcagatcacctgaggtcaggagttcaagaccagcctagccaacgtggcgaaaccgcgtctctactaaaaaatacaaaaattagcccggcatggtgatgggcacctgtaatcccagctacttgagaggctgaggcagggagaattgcttgaacctgggaggtggaggttgcagtgagccgaggtcgcaccactgtccagcctgggcgacagtgctagactatcaccaaaaaaaaaaaaaaaaaagtatttgaagggcttcctagttatttcatatacagtgcttgtggtaagggctgctttttatgttctgcagtattcatagttttagtacattactatagcctgtagttaatattcagtaaatgtcaagtcaataagtttgtgttcaaccaggtctaaacaaaatagttaatgtaagatatggtaaaaaagaggaacttaccttgaatggtgtatttgtgtttgtttcaagttctgacacagaccttagagatgagagagaactttcagaagcagttacaggagataatgtctgcaacatcaatagtgaaaccccaagggcagaggacttccctttcaagaagtggttgtaacagcgcatcttcaacccctgacagcactcgctctgctcgcagtggacgaagtagagtcctagaggcactgaggtgtgtacctgtcactgatggcagaaagactagatgacttgagagaaaggatttacgtacctgctgctgactcaattccatgagcttggcctaatttagcttttttttctttttttccccaatatgcagtaaaagctgaaatttaaatatcaagactagtgaaggggttatatgcctaggccttatttagcccaaacagtaaatattatattccagtattatctattgcttttggctctctgctgactagatttttcgttctagcttgtccttccatttcttgctcccagcagttctagatttcttactcggaggtggagcagacatggagatttgtcttacagcagcacctgcttcacagtgaggcatgattgatactttttattacctccgttgagaaagaaatgattttaagatctaatttgcctcatttgaaatggattcagtaggcagttctctctgctctttagtattagtattcaatagtatttgtattaaacaataagtacatatatattttttcagagtctttttctaatgcaatatgtaaaatcttaaagttatttttgttgggattttgcatgcattttgtattctccttgtaaaatttatcttctagaaaaggtgattacagtttctagtgtgatgtgacttaagctcagttgcataacttcatctttttcgtgatagaagaaaaaaatctataattgtgtgataagaattatgggacttgtattttcagttgactaattgaattaagtataagataaactagcatttatcttacgctaactgtattacatgaggcagttcattatctcagtactgagtaaagtagctttttaatatgcttcagatcatgttttatcattatagagaacctaaatcctgtaccaaatcagagtaaataaatatagtgtgagaataaaaggctatattctttatttttgaagcaaaggaactatttgggggttcctttggtaaattgttttatgggttttggtgttttgttttgttttttgttttttgttttttttttttttgcttctccacagtgtaagttttatggtaaattatttttactaagaatgaatgaatgagtgaatataaagaaaattataggacttctatttactgtcacgtggaatcattacaatcgcaccataaaatgcacttccctgtaattcagcatattgctgttccaccgtagactctggaaagtggttaccaatagccaaaaggcccttctgataaggcagcctttacagcaagcctcccatgtaatcatagtgcttataatttcaagtaattaaaaaatataactact

SEQ ID NO: 108365 - DNA, 1084 bp, Homo sapiens
agattttatacttcagtggatatgacatttaaaacatgaggacaatctgtcatttgtatgatgcaaatttttcagtgtaaactacttttcaaaccagttttgtgaactttttgccatattacagtataatgtattgcttgtccttatcctacttaacatcatctattcattaagattttgtcagtcctgtcttaaagcacaccattgtattgcagtgtgcccaagagtgtaaacatcttcctgaatctctttatccacatacttataatcccaaaatgagcttggatatcagcgcagtgcaagatggccggctctgtaatagtcgactactctcagctgtgtcttcaacaaaggatgatgaggtaggagatatggatgatacatttaccccctcttaagctaaaggtataatcatatattgctatgaaaccttatacagtggcttggtttgagaatttataatttttctttttcaatagccagatcctttgattttagaagaaaatgatgtagacaatatggccaccaataataaagagtcagcaccatcaaatggaagtggaaagaatgactctaaaggaggtaaaatattttattttttaattaaaaaaattttttttgagacaaggtctcaattttttgtggagatggggtcttgtcatcttgcccacactggtctgaaactcctgggctgaaaggatcctcctgccttgtgagccactgcacccagctgtaaaatatgtttaaattactaaatacaagcaaagcatatattagaggattgatttgtggtcccatgctgatcattaagtgataatttgcaaagttttatgtagtttaagtgtaaagcttatgaaatttatgaaactaggtttttatggagttagtgtgatacagccctattccattaaaggtaggtgaagttggtgattttttaaaaatctagtctttggtccagttcttttgagtgattttcaaaaagttttcttatatgtacaatatattttaacatatccacatggttttaaagatacaaaaagacatatgaagagtttcttccacccttattctccagccccccagt

SEQ ID NO: 108366 - DNA, 1235 bp, Homo sapiens
tttagaacaggaatatattttgaacttttgaagatttttttttttttaattctcagctcattttgactttctaaccttccttataatccatttcttgattatatccgtcgttgcttatttgtttccttctgggtttttttggtttgttttgttttcaaattcaactctaagattcaggtaagagacaagcactgctgaaaatgtaagctagttagtctctttgaaccaatttgctggacagtatggaatttttgttcacagtatatggatttgattatagtttattctttttcttgttatttggaggaaaactagaggaagttaaactgtaatccattaattttgaggattctcccccttctctctctttacccctctctcctcctctttctttttcctgtcctattaacccatcttgcttctctctctctctcttcttttctccatctctctctctccttcatatgtataggatgcacttgcagccttggaaactccaggacgtcccagccaacagaaaaggaaaccgagtacgccactctcagaagttattgtcaaaaacttgcaacttgctttggcaaatagctctcgaaatgctgtcgctctttctgccagccctcaactgaaagaggcccagtcagagaaggtaggattagttctcttattaaaaggaagttttagataacatttcaaacaataatgactgatctgtttcttttattttccatggacaggaagaagccccaaagccacttcacaaagtagtggtatgtgttagtaaaaaactcagtaagaagcagagtgaactaaatgggatcgcagcctctctaggagcagattacaggtagttggcacatctttctgtttcatggtgatatgactgaaatttataaggaaacctaaagctattgtgagcatctacaagaatacatttattttgtttcatgcatctttatctacaaaatctctccagttgatttttaatttaccacatctgttgaaaatagcctctcacatatcaattcactcttatatgtatataatgtatattttttagggtatgcacaacaaatattggagagcctattttatgccactaactattctagaaacctgggatccatgaaggatcagtatagtctaaaagaatccctgtgttcaaggagtttagagtctattaatagtaatacatctggatctgagattaagtttatttttactagtgatttttcaga

SEQ ID NO: 108367 - DNA, 2361 bp, Homo sapiens
aattcccatctatgagtgagaacatgcggtgtttggttttctgtccttgtgatagtttcctcagaatgatggtttccagcttcatccatgtcccgacaaaggacatgaattcatccttttttctggctgcatagtattccatggtgtatatgtgccacattttcttaatccagtctatcattgatagacatttgggttggttccaagtctttgctattgtgaatagtgctgcaataaacatatgtgtacatgtgtctttatagtagcatgatttgtaatcctttgggtatatacccagtaatgggatcgctgggtcaaatggtatttctagttctagatctttgaggaatcgccacactgtcttgggaagcattcttgactcaccaaggatggcctttgtcttggtataatgttttttgtttcaccatgacactctgtatcatcccttttatctcttacctcagtgttataatggttgtttattttgtgtcttcctgctaaatttaaagttccagaaaggcagtgaacatgcatgtcttgtgaattctgtatttcccatgtctaacactaggcctggcatggagtagctatctaataaggttttttgttaaatgttgaaaaaaggtggaaggcataggtggaagaatacagtaccctctcttgtaagataatagcatccatgggcaaacttcagggacatatcagcagcttgggaatacctctcagagtcattacttattttgccagacagactggtaattttatgactgaggctaagtgatgttcaggtcatattaaaatttgattaaggactttccaaaactagactgtagttaactctgagtacctgtaattgagatttttctttttactctgtcattgactagaaagacattcactgataacaatttttggcaaataggcttattgagacatagcaagatgaaacaggaaatctattattattttttcagttaatgtgcttgtctaactcaacatatatttaatgcataatctggtttgtttcttggaaagtaggtatataattttgtgatttaaagtgtacctgagaattgacatgaaaactaacagattaggatgccgaggtagatggatctcttgagcccaggagttatgcaagaaagaaaggaaagaaaacagtataaaatattacttcttgtgtaccgggaaaaagtgggcattagtggctcatatttgtttcttttcattttaaatctctagaacgaagtttggaaacagaaataacaaatggaatcaatctaaattcagatactgcagagcatcctggcacacgcctgcaaactcacagaaaaaccgtcgttacacctttagatatgaaccgctttcagagtaaagctttccgtgctgtggtctcacaacatgccagacaggtcgcagcctccccagcagtaggacaaccacttcagaaggagccctcgttacacctggatacaccatcaaaattcctgtccaaggacaaactcttcaagccttcctttgatgtgaaggtaaggtttataggcagtggtcccagagttaacagttttaccgtttataaagttaaagcaccaaatttggcatcacctctgaagtgtagtaataaattttccagagacattggcaagtagatttatgttactgagtttgaacgttttgagtcccagcatacatttagggttaaggtaacagctatagataaatatggtgtgaaattaggacatctgggttcaagtactggatcgatcttgaactgtatgactaggccaatcatttaacatatctgagcttcagtttgttttttcatacaaagaagataatatttgctctgaaaattcatagattataaagatcaaatgatgaaatcactttataaactataaaatgtaaacacactgatactttatatattggttctcagagtacacccgggatttgccttctgaaaatgtgtgtatatcaccttacttgaattgtttcctgtaaagacatgagttaagtctgtgttttagtttgatctcgtgagcattgtagtatggctccctttctgaaaaatgcatttgtaaatcaggggctaatgtaatcttccaaataattttctttgattttccaaaactgattttcatcattatttctttagtagcttttgacctcttaagtggctgttcaaacccactgtctatgatttctttatccacgaacctttgaagaattattttactcattcacgtgttgatatttttgcttgtagggtatttagaagcaatattttaataatttttattgtgttttggagtggacttactaaaaagtttatagattattcatattcagaaaataaat

SEQ ID NO: 108368 - DNA, 1155 bp, Homo sapiens
attttatggtgaatcatctaaaccagttttggaactaagtcctgttggagctatataattttaaactaattcaagtttccattatactaggaatacctagaactaacatgattgctcttgtccttcccaatggatgatggtaatactgataaggactcttggtaaccccgaagacggggtgaatccatatccctttattatacacgtaagctttagttttgtaagtatggtcaaaattatcagattccatgttacgttaatatccttgctaggaagtaaactgtataaggtaaattgttggttagaaaacatttacttttctctttcagttgaggctaagacgtctgaagccaggccctttaatgattctactcatgctgagcccttgaatgattctactcacatttctttgcaagaagaaaaccagtcttctgtcagtcattgtgtccctgatgtttctacaattactgaagaaggcttatttagccaaaagagtttccttgttttgggttttagtaatgaaaatgaatctaacatcgcaaacatcataaaagaaaatgctgggaaaatcatgtcccttctgagcagaactgttgcggattatgctgtggttcctctgctggggtgtgaagtggaagccactgtgggagaagttgttacaaatacatggctggtaagacaacactagtggttgaaataaagtatcgaaggatatctgaatgccaagaaggttaatgtttatttcttagacagttcagttacagtaaatcaatgcttggacttgaacactcttgattttgcttttagcaagggaaattcaaaattaaatgtgcaagcttcttggcctaatcccgatacagtagagattactgtttcccagggccacagcagcaacattccttcttaggaggtcactctagggtcatctcatactatttgtcttgttttctcataaccaaagcatcactggtaatttcactgttgatttttttttttttaacattccaagaattatgagaaaaatagtataaactaatacattagaaggaatgaaatttaaagcaacattcagtaactctaataatagatcttaccgattttaatagcctaatgtaattagtcgatgtatgtatatgtgtgtatgtatatatatac

SEQ ID NO: 108369 - DNA, 2680 bp, Homo sapiens
ggcaaattaccttttttttttttaaacttgccaacttacaaaaggtgggttttttgtttttgttttgagacggagacttgctctgtcgcccaggctggagtgcagtggcgtgatctcagctcactgcaacatcttcctcttaggttcaagcgattctcctgcctcagcctcctaagtagttgggattacaggtgcatgctaatttttctatttttagtagaggtgagggtttcaccatattggccaggctggtcttgaacttctgacctcaagcagtctgcccaccttggcctcccagagtgttgggattacaggcatgagccaccacacctggctcagaggtgttttgtatgatgttttatcctagactactaattctagatatagcttttaattatttcttacatatagaaagtatatgattccaaatatttgttaaaatatattctagtaatgggggtgatttaatttggggtataaatgcagtttggagtagatttgtcatacttaaatttttttaagggcaccttatgtaaaatagaggtaaaatgattttatattgattaaattggtttaaatatatatatactgatagctaaaaataaattactgcatacatgttatcctcaaagcattgtgttcagttctttgacttatatatattttttgttcagtcaactctgtgagtaaggtaacatcaatttataggtaagaaaattgatttaaagagcgtaagcaacttgcctattgtcgttaatcataggcagctggaaaaaacaacccctccccccgccccccacacacacacaatttaagcccaggtgttcagaattcagacagttaactacagtttacttttataattactttaaaatttacaagtaagcttcacagttaaagaagttacctgcattttaggaattggtatgcactaatatttagaagatgttggactctggcttctattttctttatagccacaaaatacttatcaagtatctactgtgaaagataatgctgtatgagattgtaaagagtgattaaaaactcaaagttgcagaactgttaaaaaatcaaaagtttcagaatgtatttattcatatatcttaaatgtacacaagttgtcttatttatacacagtggatttagatatatatttttagtttttttctattgagagaaagcatgttatgtatattaaatattttctttcttgcagatatatctttgcggttttagtggcagaaagctagataaactgagaagacttattaacagtggaggtggagttcgttttaaccagctaaatgaagatgtaactcatgttattgtgggagattatgatgatgaattgaagcagttttggaataaatcagcccacaggtttttttcgtttttaattcaaagcaatttctactacataatttttcttaaaattgcatatccacgcagttctggaaactgcatgacaagtgggatgatggtctttatagcttgcactaatacataactatgtgctatttttgtaggcctcatgtagtgggagcaaagtggttgctagagtgtttcagtaaaggttatatgctttctgaagaaccatatatccatgctaattaccagccagtggaaattccagtttcacataagcctgaaagtaaagcagctcttttaaaaaagaagaacagcagcttctctaagaaagactttgctcctagtgaaaagcatgagcaagctgatgaagatctgctctctcaatatgaaaatggtagctccacagtaggtaagaaatgcttgattagtatttgtagttagtaagaaatattttagtagcctaatacgtacatatgtgatttctgccaagttttctagattttaagttaaattaacctttttctttccttaaaattttcctcataactttttttctgagcaggcaagacaagagggtcctgaaccctttaaccctctctcctgtctccagctaactagctctattttgatttgttatatatacaggcattgcttggtttgtgtgtgagtttgtaatatcatgagccttttattaaaaccttgtaacaaatacctcttactggattattgtggtctttaatgcatgaaactgtactgtggactaccacctcagtatgtactcttatcatgtagtaaggtaaattgccagtgaagcattataaacatcattacttcttttttattaaaaaaaagcctttataaaatacctaatatagccaaaaatatatacatttaagtaaatttaatgtgtatcataacttaaaatctgaagttaatcagaattttaatctacctcgaataaaacaagaaccttagaaaactttttttttttttgaagcaggatttcgctcttgttgcgcaggctggagtgtagtggcatgatctcagctcactgcaacctctgcctcccaggttcaagtgattctttctgcctcagcctcccaagtagctgggattacaggcatgcgccaccacccctggctaattttgtatttttagtagagatggggtttctcagtgttggccaggctggtcttgaactcccgacctcaggtgatccacccgccttggcctcccaaagtgctgggattacgggcgtgagccactgagcccagcctaaaatactttaatgatcacaactagccctgct

SEQ ID NO: 108370 - DNA, 1029 bp, Homo sapiens
ggtaactttaattttgttgataggtttttgaaataacctgttatagccgggcgcggttgctcacgcttgtaatcccagcattttgggaggccaaggcaggcgaatcacctgaggtcaggagtttgagaccagcctagccaacatggtgaaaccccgtgtctactaaaaatacaaaaaaattagccagacatggtggcacacgtctgtaatcctagctattcaggaggctgaggcaggagaatcgcttgatcaggagggaggtggaggttgcagtgagccaagatctcaccactgtactccagcctgggcaacagagtgagactccatctcaaaaaaaaaaaaaaaatattaacctgttataatttgaatatttctgcaaagatagattgtaatggttttcatttcttggtttctcctattttctctatttctttcttaatgaacgccacaggtcagaagtatgagtgtgccaagagatggaatgtacactgtgtgaccacacagtggttttttgacagtattgagaaaggtttttgtcaggatgaatccatatacaagacagaacctagaccagaagcaaagactatgcccaattcttcaactcctaccagccagatcaacacaattgatagtgagtctcattgagattaaaataattattctgaagacagtcatatttctatgtaataatcagtatgttaataggatcactgagatagggaatttctttttcttgtttgctgtgcttctaggcataattgtataatagtcaaattgtataaaaagttagcactgaactgttcgtaattttcttttagaatgaatgaatgctgtcttttatactctgttgtaatgcaaaagatgatcaaagaaattaagaacaatggtagctgggggcttaagataaaagtattaatcttttaaacattacatgcatatattaatctttccttaatttacagttttgctgcagttatagatcatctgtatttgtataaaaattaaaaccatttctattttgtaggtgtc

SEQ ID NO: 108371 - DNA, 2148 bp, Homo sapiens
atgtgatcatttaataaatgctaattgagcccattttacgtatctgacttgaggtaggcattaggtatatgtagtaagcaaaacaagatagtcacttccctcatggagcttagagcctatttcaaggggcacacttcagtttcccctgcaactagataaacaaccacaagaccaaacaccacagaattgtattggcatacgaattatatcggcacttttctgggcttgttttcaacaccatccagcatatcccaaatatgtctccatgtcagcaactctcattcccaatgtgattacttcatcagcacacctccctagcatggcaacagaataatgatatttttgttggtattttgccaaaaatcattgcttttacttgtatagaataatggaaagattaaaaagttcatttatctaataggcaaccaaattacctttgggtttttaagtagagattcagacttatcattttggaaaatatactatgaccagcaagggctagagttaaggaaatatatatttttcccttaaaatggttttgagagactgtatctgaaacaattactttgttttagagacatgttattgaactaggtgaacaattagtgtaattctgttttggtggttctcctttgtaaaaaaaagattataaatcctaaaaaatgagggaagcaatagtgatatttgtgttgtttttcattattcttctggtaaatttaatatgttcttttttaaccatttgattcccacagaaaaataactagatatactgatataaacatggaagatttcaagtgtcctatttttcttggttgcataatctgtgtgactggcttatgtggcttagacaggaaagaagttcagcaactcacagttaagcatggaggtcaatacatgggacaattgaaaatgaatgaatgtacacacctcattgtgcaagaaccaaaaggtaaaactgtgtttcacaaagggacaaatgaaacattttctctagtatttaatattttatttttatttatttatttatttattttgagacagagtcttgctctattgcccaggctggagggcagtggcacaatctcagctcactgcaacctctgcctcccttgatcaagcgattctcccaactcagcttcccgagtagcgggattacaggcacctgccaccacgcctgaataactttttatttttagtagagacgggctttcaccatgttggccagactggtctctaactgacctcaattgatcttcccacctcaacctcccaaagtcctgggattacaggcatgagccaccgtgcccagccactaatatttaatattttaaaatctttacagaacagcttttacttctgacatgtcattaatctagtttgatactgttttctctaacatcttgcaaagatgttttctctaacatcttgcaaagttttaactggaagacacaccttgcggcacatgaggcagtaaaaaatgaaaaagacattacgaacaagaaaaattctttaaaattgctattaagtttggtgttacataacattattctggataattttttatcagcactcttaaaatatacacaaattgataaaagatgagttttgttaatgtttttattattgccctttatatgtatactgtgttttactaagctatctagattgagaagaaattacgattaaatggtaattgtccttaagtcagaactttgagtatggctgattgtgataggatcactgtgagtagagttgatactgctgttctttttctgaatctgaagacagttcattgttgattctctcaagaatgccaaaaaacctttcatgtgacatattgacctcaattcctctgtgatactgcttcaaaatacattgtgttgaagatttttaaggtaataaaagatacatattttcaatataatttatcttttggcttatctatcctggactttaagtagaagcctgttgacattggaatagtctgttcaaagttgggatttattatatagcacaaatttacaattttcacattgtacaagctggtttaaagaaattaagtgatggagcctatatgcaaacccaagtccaatattaattaagttaccccacagttgcttctgtcttcctgcagtttgtataaaagat

SEQ ID NO: 108372 - DNA, 1049 bp, Homo sapiens
catatgtttatattcaaccttacatatgccatcttttggaaggaatgcaactgccaaaatgactaatttattatctatcttaacatatgggaatggtgttgaaggataatgcaacataaaagctacagaattgccaaactcgttttctcaattatttcagaaatatttacagctgagaactttatcaccaaagcatttcctactctgtagctaatgctaaacccttggcccattctatgcctgtcaacttatatcttggtaataagagcttgtagattctgctcttccgttttcgctggagaaaagagtaatgacactatttttttccctgaatagtaagtccaaagagtatatcacatgccaaaaatgattgaatgcatcattttttcaaatctagaaaatataaaaatgtctttcttacttctcttgtgacttctcccaaagtgtttttatccaagagggaagcaaaataggtttcttcaggtttgcagcaactaaatattttttgctaccaacttctcctgcaataaggtgagttactgatacattaaggtctctgtatactcgtccgcccatcatttgtacatatttatgaacttcttcctgcagccccaaaagagaacacattaatgctgaagcaaacaatattgcttccacttttatacactatctcataaatacattttgctgttgacagtttgaatacataagtgttacataacattataaagttaaataattaaccaaattattttttgggagataagtatgaattatatttttaaaatattattttcctatatttatccctttcaactccatgaatgtattaaactattatacaaaggatgtataaatcttaatctttgcttctatataaatatacatgtgtatttttaacaacataaattatatctatataatatataaatatttatttttagccaggcttggtggtgcatgcctgtaattccagctactcgggaggctgaggcatgaagattacttgagcccaggaaatcaaggttgcagtgagttgtgattgtgcc

SEQ ID NO: 108373 - DNA, 2301 bp, Homo sapiens
ggtcttgaactcctgcactcaagtgatcctcccacctcagcctcccaaaatattgggcttatagatgtaagcagtaaggcagttttcagtgaaaggggcttttgaagtttatttcttttcttttctttttttttttcttttgttatagggtctcactctgtcgcccaggctggagtgcagtgacgtgatctcagctcactgcaacctccgcctcctgggttcaagcaattctcttgcctcagcctccctagagactgggactgcaggtgcccgccactgcacccgactaatttttgtatttttagtagagacggggtttcaccatgttggccaggctggtctcgaactcctgacctcaggtgatccacccccgctcggcctcctctgaagtgctggcattacaggcgtgagccactgtgcctggcctgaagtttatttcttttgatagcttgcattgtttgatttgcttttgtgtgtgagtgtttaatgtatagtatctctgagaaattatatagtcatctttatttttttcttgtaatgatttgctgatttctctacagtggtcatcaactttggtaaagaattggtgaatgttacaaaatgtaattttgtaagactggtggtcttttccttcttaactcatttaaacttttctcttttttgtagcttggctgcagaattgttggtcctcaagtagtcatattttgtatgcaccaccagcgatgtgtcccaagagccgaacatccagtttataatatggttatgtctgatgtaaccatatcttgtacaagtctggaaaaagaaaaaagggtagatattgatctcatgatgattgatcaatttatatatctatctcttattcttaatttttcactgcatagaagatagcttaaaagactttccgcttattgttcgtgacttttaacaaagttcagtatacaaccacagtgtgtatatatgtatacatgtacattttttaagtaaattgaatatagtagaatttgttttgttgaaaactggctaattgaaattttttgttttaatttaaaaggacactcattttttaatcacttacatttttccactataggtggacagtctttaaaaaaaaggattctaaatcgtttgaatcagggaggtggaggttgcagtgagccaacatcacgccactgcactgcagcctgggtgacagagcaagatttcgttttggaaaaaaaaaaaaaaaagcattctaagagagagctatagaaatacatatatatatttgggacagggtcttactgtcacccacgctggagtgcagtggcacaatcacaactcactgcaaccttgatttcctgggctcaagtaatcttcatgcctcagcctcccgagtagctggaattacaggcatgcaccaccaagcctggctaaaaataaatatttatatattatatagatataatttatgttgttaaaaatacacatgtatatttatatagaagcaaagattaagatttatacatcctttgtataatagtttaatacattcatggagttgaaagggataaatataggaaaataatattttaaaaatataattcatacttatctcccaaaaaataatttggttaattatttaactttataatgttatgtaacacttatgtattcaaactgtcaacagcaaaatgtatttatgagatagtgtataaaagtggaagcaatattgtttgcttcagcattaatgtgttctcttttggggctgcaggaagaagttcataaatatgtacaaatgatgggcggacgagtatacagagaccttaatgtatcagtaactcaccttattgcaggagaagttggtagcaaaaaatatttagttgctgcaaacctgaagaaacctattttgcttccctcttggataaaaacactttgggagaagtcacaagagaagtaagaaagacatttttatattttctagatttgaaaaaatgatgcattcaatcatttttggcatgtgatatactctttggacttactattcagggaaaaaaatagtgtcattactcttttctccagcgaaaacggaagagcagaatctacaagctcttattaccaagatataagttgacaggcatagaatgggccaagggtttagcattagctacagagtaggaaatgctttggtgataaagttctcagctgtaaatatttctgaaataattgagaaaacgagtttggcaattctgtagcttttatgttgcattatccttcaacaccattcccatatgttaagatagataataaattagtcattttggc

SEQ ID NO: 108374 - DNA, 1043 bp, Homo sapiens
ggaaagtgcctgtagtctctatccaagtttagtgtactgttgtgtagtgagtgagggatgggggaagagtactaaggaatgcgttagagaataatggtaaagaggtcatgtagggccttgtgggccatttttctctcagtggagagccattggagggttgataatcagaagagtaaacatgatctgacttacagttttaaagggattactgtatttaacataaggacctcaaaattggttcagaacatttctgagtgcttactgggtgtcaggatatagtagcaaacaagatacatagaaacttccaggggagagagacaaaaactatatatatatatataaatacgtatttttaaatagaatagactagaagggtagaggaagggtatttgagaaagcctgattaggatgggcatctctggggaggtgacatttaagcagacctgattgaagtgggggattaagtcaggtgaaaacctggaaaaaaagtattctgtgctgcaagatcaagagcagagcctctaaatgaggttatggttggcttgttccagggttggcaagaaagcgggagtggctggaatagaataagcaagagagatgagaagtaggaggtaaaggtggaaagataggcaggaaaccagactgtgttgtcttgaaggctgtagtaagaaatgtggattttattctgggtgtggtgtgaagacattaggttttgagcagatagtgacatgatctgacttgtgtttttgaaaagattattagctgctgtgtagagaacagatttagggcaaggaagggaaaaagagaccacttgggagccttctgcagaggtctaagtgagatgtgatggtggctttcaatagggaaaaggctggatttgagatggaatttgaataggacctaaatacaggagagtaatttcaggtacattcttattttattttttctttcagtccataaaagaattccaatcagaagaatatcttcagattattacagaagaagaggcattgaagataaaggagaatgatagatcactttat

SEQ ID NO: 108375 - DNA, 1020 bp, Homo sapiens
ctggccctggagccggcgggtgggcctttgacgccgagaggacgtggcttccgtgatcccagagccaggccttttcctggagatgggaaccggagcatctagccttatgcagggccaagaccatgctaactggcttccatgtttatatttaaaatctgtttactgagggatgaacgtacctcgcaggccgtgggtatccgcagggacagatacactctgtgtatccttaaaacaagtgcaattgaatgtccattggcctaaagggcttagagccttcatagcagggccttcctcagtgtattcaattcgggttaattttgctgtctgatttgcaaggattggtgttgtcatcttttaccttggctttgtccaagttccaggatttcttagaaatgccgttgacgaattcacgggcagagccagaatgtctgtctttaggcattcttgtctgcacagaaaaataggtaggttaaacatgcaactttttatctaatgtggttttgttcttgttaatggttcctttattttgacagttcagaaatgtccagaaatgacaaagaaccgttttttgtgaagtttttaaagtcttcagacaattccaaatgtttttttaaagctctcgaggtaagagttgaaaacatcttaataccgtgaattcattttcttgtttttaagtgtttttgatttgttgggctttatgtcttagaagtagatatttcactttcataataattttatagtctacattaatacagatatatcattatcacatatttttgaattgatctaagtacatcattatgtatttcggggggctggaagtctattatcacattgctgtttaatatggctgacctacagttcttggaaattaagttgctttcatttgtctcctagccagagtggtcctttgcgtgctgtagaaatttgagtcagttgtgtactggtcatacttgaaaattttttggttaattgttaaaaattatgttttattatgtacagtataataattggatgata

SEQ ID NO: 108376 - DNA, 1038 bp, Homo sapiens
tggctaggctggtctcgaactcctaacctcaggtgatccacttgcctaggcttcccaaagtgctggaagtacaaggtatgagccactatacctggcctgctttgtaatttgatcaataagaaatcttcatagagaactggcaagggcttctggaaaaatcattttgattaaagacatttaaaacaaaaaaggagtaaaactatgtgtttaagtgtctaaataaaagatggttgggctcactttaaggatttacataaaaagaaaataaattatagatctagtaagaaggcagctataatatttcaagggacctgttgatgtaaagatgagggcttacagaagcacaaagtcaaaaaggaacataacctgaagtaacagtgtaatgataagaaataaacccggaatgtctgcactgaaatcccagctccatgacttactggctatgtggcccagggaagtgacttaacctttctgtgcctcatatttctcacttgtaaaatggagctgagagagaaagagagatgagctgcccatgtgttggagtagacaattataccagagatgagcaaaaatggaaataataatcaagcttttgatcattcagtacatagtatcaccaagaagctaaacccagagaaagtgcccaatccctcagcaaaagggtcatgcagttttatggacccaggacaggaaggaagagcattgagtactgagtcagagtgaagacgaatgttttcaaggttcccatcttcccccagaaaaaaaatctccacagaagcacctgaggaagacctcaaaggaagtctcaaaataaagagggctctgagcaaaggtcatgggctaggaatgaaaacaggtgtaagaagagcgtggccagcccaagagagctgtgtccttgacagcagagtcccctccagagactgcattgcactggctgtgctctgagtctggggtggcgagggcggctttctcccacggagcctgccaggttaagccttcgtaattgcctacggtaaagtcacgtaggatttttggcca

SEQ ID NO: 108377 - DNA, 1075 bp, Homo sapiens
acccacccagtctacaccccaccctctctcctgaagcagcggcagcagctgggcgttaagggggatgccgggcaacccccggagttaacgtcctggtccttggggcgcagattgctcttcgtcatctgccctgttacgcttgagcgcgctgttcctcgccttccgctgttctcactgcaaagactcagggtcttgacaccaactttcagcctcccgtgtttgcgtgcgggcgctgggataccaaggtagtgagatagcacctgagtcccagtcagagtaaggactgcaaagaaaagttgacagttgacagtgcctggctctcagtggatccctaacaacagcaatagtaaccattatgataaaagtcagttccaggtgaatgaggtgtttcgtcacagacttctgtgaatttccccaccccagccatgcacatatactgattcccaaggcgtaatttttgttgtttttctctgtctattccacagtcttctggaagttaatccggagcagaaggagcagtcagagagctgttcttcttgttggcctttgtgattccgggaaaacgttgctctttgtcagggtaaatgatttcattgacacccctgttaagcttaatagaaaattttatagatcccagtattcctgtcatctcacggtttattttgtaaaagaagctgatgctgttaaatttggaagttaattcttgacttacttgggagaacaaaaagactcgtagaaacccataattgagaaatattggtcatttctccttttttttttctgtttgcccttgccagatgctgatatttagtctttatcacattcaaggattttatttaattagtttcattccagaatagcagaaggcatagaagctagtgtcctacagtttataattccttcgttaacaaattcttaggacagtttatcgaagacactttttcacagggtgatccttctttgacatagtgggctagttaggcttctttttactaatatttatttttaatacatttagtatttttaacagtgtattttaatgtggtgaataggagaggttttctgctttttaact

SEQ ID NO: 108378 - DNA, 1080 bp, Homo sapiens
cctgtaccctcaaaacatttatcagtgttctcattttatatttatgtgtaattttacattatgttcacctttctcataaattttgccagatcaggaaccgtgtctttggccactgttacatccccagaacgttgactagtgttttatgagtagaagatgctttgtgaacatttgtttggttaattaggtaccagtttggtagccaatatatgatactaaaggtttatattgtgaacgtggaactgtattgaaacgttaatgttattgctgccatccccagggcaatagtctgaccttgattgaccttcccggccatgagagtttgaggcttcagttcttagagcggtttaagtcttcagccaggtaagaaggaaagaagtgaagtgggcttgtctaggtctgtatctgtatatcaaagccactcatgtgatttgctctggtggtgtttgggaggcagcatggtatcctgtggtagaccttgaggtgaccttggggtcagccagttctgggttgcaagtccaccttcacctggatgatgaggattttatgggattaaaatgcttaaaaagtgttttttagtgtttaggaaatgttaacccttcttgtcattgttactaaatgtttgcatttattctgaaggtgaatttaataatgtatatgactattaaaatctgaaaaaagaattttaaagctgggatgaatcctagcagtttttaaatgccaacatcatttatatatatagtgtttttttgttttttttttttgagatggagtctcactctgttgtcctggctggagtgcagtggtgtgatctcggctcactgcaacctccacctcctgggttcaagtgattctcctgcctcagcctcctgagtagctgggattacaggcacgcaccaccacaccctgctaatttttcataattttagtagagatggggtttcaccatgttggccaggcttgtctcgaactcctgacctcatgatccgctggcctcagcctcccaaagtgctggaattacaggcgtgagccactgcacctggcccatatatattctcaaattacgtaaaattgatgttt

SEQ ID NO: 108379 - DNA, 1064 bp, Homo sapiens
tctttctctttattcctgttacacatgtgcatagttttgtcttggcatttatcatatggttctctatatgatgatttgtcttggaggacaggcatcatttcttactgtcttttttcagcttcagtcattgatacacagtagcactcaatagttccttgttaaatgaggatttatgttatatgataacatatgcacagacctgcatgtgtgtctgctgagtgttaatcaccaagattgactttgaagaagttcaggatagtttttcaagataatgatgtcctgttacacgttcacatgccagtttttcttgttttctccctccagggctattgtgtttgttgtggatagtgcagcattccagcgagaggtgaaagatgtggctgagtttctgtatcaagtcctcattgacagtatgggtctgaagaatacaccatcattcttaatagcctgcaataagcaaggtgccatcatgttttcttgcaataataattgagttttttggggattgctgctactaagaattatttccattatttacagttgttattattgaggatgagatacaattgctgtaaagaactataaattgaaggatttttaatcttaaaatttatttctactcctaccttttcaccagtcttctaaccagaagaccaaggaatgataaccaagtgactgctaactgatttttctttgatacagtgttttttctgattataaattattttactttaccaagttaagttcatcagattgacaatatgtgatatcagatgcacagttttgcagggtggagtttctgctttcaaacaagtttactgtacagcacattttatcaagggaagtttgctgaagttgttttcttttaacctgataaccattgaaaacttttctagtaatccccaataaaactgggcttcagttccgttacctgtacaataagacagactagtggatctcttcaggtctcttccagatctgaaattctgattctatgaagagttcaaggcatttctcagaagtgaccagataatattgataatgccttattgggaatgcaatta

SEQ ID NO: 108380 - DNA, 1905 bp, Homo sapiens
gaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaagtgatgttttttgctgtcttcttaaacacaaggcttttttgaatgattagtatatttcatggtaaagaaaacagcctgtctggctcaaagcaattaaatagaatgtaatggtgagtacaaatgagtgcacatgtcaggactcaggtctaactccttgtctcctgagcctaaagattgcaacatacacaagaacacactcctattcctaccccacacactcagggacaagcccaactaaagcttacaaggagaccagggtggctctgtccaggggagaagccagttatggaacagtgcattgagagccatggtaggagaggcccacagttctctggagcatgcagcaggggcaccccacctggccttgaggatcagggggagtcaaaggataaagcatggggctgatgacgtctgagggagtgtgatcctccatgtatggcctctgcctgctgtctcacatgtcccttctggtggtcacttgggctctaggagtatacgtcacctcagaccatctggcagaaatactccaggctcctaccccaaagcacatgtcagccttgctgctggagcacgaagacaatgtaaatgaaacatgaaatggaggagttgtgagaccctgaccctgagtccttacttgaaagctgctgctggtgttctgagtgtcttttggactcttatttcttgcccttttccttattaggcaagcagtaacttaggaagtaggtaagagcaataaatgtgacatgttatgtcatcatagtaggagctcatgggaataaaagtcagtggcttgatgcttctgttagaggcatgtgtccctctcagcctcttttatttttttctggttaatatct

SEQ ID NO: 108381 - DNA, 1040 bp, Homo sapiens
gccccatcatggagccctctctgctaagtagctttgtggccctgggggagacacttttagcattagtgttctcacagggaaaatgcgactgataataccacccagagtggcactgcctggcttgaatctcttcataagcacaggctctgcagtagtgactactgggaaaggcaggtatggggcagccctaccccagggcctgctttgaagctgagaagacacaaaggaaggagtgggggaagcggatagtgtcctactgttccctggtgcctgctttgtgctagcgagactgtggttggtgcccgggagggacccttgggatcagagcctgtcttcaggactgaccaagggcccagtgggctccctctgccctgctgggtgggtccctcctcatatctgccagggtctgcttctctgctgagctgatttccccccttcccctcatctctaggcagataaccatcgaggagggggagcagcgcgccaaagaactgagcgtcatgttcattgagaccagtgcgaagactggctacaacgtgaagcaggtgaggacacacctggcacggggcccggcacggggcccggcacggtgtagccctgtggtcagctgcaggctcagagctgccttgccctgaagggctggtgatgggattggggcagccaaccagaacacccatagatgcgcccagggaggggagagctaatttccggagctggtaaagcccaaaagagggagggaccactccgggcatggcatctggagaacataagtcaccagccaccgtagtagttgccagtcacggcccacgtagcaggccctaagagtgtccagccaccagcttccaggaggctgagggaagcagtggttccctagcccctcaccccactttggatgacaggtgcaggaaaattcaatctgatcagcatttggggttcatgccttgcgcttagcaagtgctcagggctgtggagggcaactcaggcctgggggaaagagcctaccatgatgtggttggaactcacaggagggcgaggcagtg

SEQ ID NO: 108382 - DNA, 1041 bp, Homo sapiens
catggaccctggccactgaattgattgatccaggctttctgtctcctggcctgtggttagaagggcgcagagcagttctccagtgcccagctaagtcttggtccttcatgaagcctgagttgatgccaagtacagttatactctagttccttaggaaaatttcatgctgaccagaatgtttaattagtcagaacaagccattttctgaatgtgctaggaatctaagaaacatggatgtgtgcgtgtaattaaaataattttttctgtaactttttattttgacacagttttaggattatacaaagactttacatatgcctttcacccagattccctgaattttaacttgttactgctttcatagaattcataacaattctgtgagataggcatttttgtccttattggatgtatgaagaaagctgagcctcagagagaataggaactaacccaagatcacacaagaaatgagtggcagagccaggattaaaacccaggtcggtcagactttagtgcacatgctgaccccatgtgatgtaagtgtgaatgtgtgggtatcctgctccttctgcccacagagctttctttcttgtattgttgatctgctagcagtgaattgtctcaacatatgcctttatttcaccttcatttttgaaagatttttgctaggtatagaattctgtgttgacaatatttttcttatagtattgcaaaggtggcacttcattttcttccggtttgcatagcgtctgacagggtagcagatatttctctatgttttcttaggtctgtgatctaatatattgttgctaattttgtttaaatagtcaattatcttttaaagagactcaaataatagaaagatcttacatacacatgtagtgaccatttcctgtgttcatcattccattgtataaatccgcatttccatctggtttcatttcacttcttcctgaaggactttctttaacatttcttgatgtgagagtgtgctggtgatgaattctgtcagcttttgtatgtttgaaaaagtctttatct

SEQ ID NO: 108383 - DNA, 1115 bp, Homo sapiens
gtgagcccctcatcctctggttactgggatatgtggggccccctgtcctttgggcactgggtatgtgagtcctccattctctgtcattaggtgtgtttgtgtcctgtcctctgggcactgggtgtgtgagcacccccgtcctctggtcattagttatatgaggccccctagccctgttatgcagcttcctgtccctccctgtctcactggacttctcttccagtggacacttgatcacttcctttgctttcttggatattttcccctatgcctgtctgctgggttccatcaccccagcaagctccggagtccccaaggacttgagagagagcagcattgtagaagggagtgcccctttccatgccttggagaacagagacccatcttaagctggctgcacaaaaagctaaggctgaaagccaaggggccagagtagaggcagacactgccgttttgaaccctcccctaacccagagaaggcagcctgttcaggtcaattggtgcacccccctgctcacgggtcagctcatgatctgctttaagttttgaaaccccaccctctaaaggcctgatgacttttgctccctgcccttcctgttcttctgcataggcagtgcccactggacgttactgagcaccaccttggtattcctttgccagtgtagctggtgcatggagtaatcctaattttgcagcatcaatgattacagcatttttcagtcaccacccttggcctctttgagcagtgccaggttgtgagttcagggtgggtaaggagagctgccccctcatcttggtgctcagcagaggtggctcttctgcctgaagcagctggcccagagaaaaactggtttggaaggctgggccacaaacaacacagcccagctttgacctcttccagcctcctctggtccctctgtttcccccaaccctggggcaggcaggaggaggaccattttggctcaggattggagagctgcaactttggcctgtgcaccagggacaagtccctagagataaggaaaacctttctctctgggagtggctgtgctaattctgagaaaggaagagaaaatgttcttttctgaccctgtctgtgagtggggggaataaac

SEQ ID NO: 108384 - DNA, 1079 bp, Homo sapiens
caaagctgctgcggtgaggatgtgggagactgcagagactgcatcaaggccccttctggtcagggtgggatcatggtgtagagaggttgtttcccacaaacatacagtcagatgggactgagtaaagcctccggtggtgcaattaaggggaagccagattacacaaagggatgatgggggtgtccgtggactggttatatgtgtccaacagaaagggatctggaggtcagagtggatctcacctgcatacttactcagctgggatctccactcctgcttctgctctttccgcaccgcaataaatacaggctgaattgattttgtagttgtatatggataagcaacagaaattttgagatagcttaaaataatctccaaatctcctcatttttggccagacctggatggaaatgttgtgcgcagttttggttccaccattttggagaaatttcatcaggaattttggaacctttggtatttataaattaggaattgagatgaaagggtagggactaggattagatggtgtaaagaaaggggcctctgcaggaaccagggtggggcaacctcacttcattttcaccaagaagggcaggagggacgggtgtccagaacagattcctgacagtgagggtacagctgaatgagactgatccgtttagacccaccctggttccctaaaataaatgtttatggcagcaatttatttggagatctatataaataagatgatttctcatgtgttgatgatttaaccacacgtacctgagggctgggctcaggccaattggcctcctaaaggagttaagtactcatactggctaagagtttttcttgactctaaaaatgagattctgttagtcatcacctcctttgatccatactaattgcaagaccagagtttggaggacttccatttaactccacttatcagcctgaaaccaggtacgaggttggatagcttaaggtaaatcttgaatctcaaattccatcagttaaagtcacttgcacctttccctcctggggcaataactgggagctctgctatttgaagggatatttcctcccaatgagagtgc

SEQ ID NO: 108385 - DNA, 1008 bp, Homo sapiens
aggacctctgagaaaggagtctagctggcatccaggttcccaactaaaactattactatggaagacgaagataatggatttgaggggccagctaattgtctgctacaaaagagaaggctggctgtggggttaatgcaggattggagtttttctggacaggtgtgaggatagtggggcaagagagttttagggtgttggtgagatgtagttcaggtggatagccatgagctccggctgggcgtggtagttaggtcaggagattgaggacctggaaccctgcagagtagatgtgggactaagggagaaagtggttggaatgggattagtcatttgtggctagagtaggatctgggttgaagtccagaggtggcagagttctgagagatgaaacacctggagtgaagccatggtttgggaaaccaaccatggtgagctggaggtttccagagttgaagcaggcacagagcatgtttggtgttcctgcacagcagtcacactgcctacacacatactctattctcatcatatacttgtaccacactccacttcgtgtccatctgggtatctcctcctcacctacaaaacccacctcccacaaagctgttcttgatccctaggctcttaaagtctccactctgtttctctggctatcagctggcatctttctctgcttctttgtagtttgtaacttaagcttacatatggccagttgtattagggttctctagagggacagaactaataggagatatatatatatccttttatatacatatatatatacatatatatatgtatataaaaaggggagtttgttaagtattaactcacatgatcacaaggtcccagtaggccgtctgcaagctgagaagcaaggaaagccagtccgagtcccaaaactgaagaacttggagtccagtgttcgagggcaggaagcatccagcaggggaggaagatgtaggatgggaggctaggcccatctagtctagtcttttcacgttttttttt

SEQ ID NO: 108386 - DNA, 2826 bp, Homo sapiens
gtgtcatccattgccagtctcctcctgttttgctgctctgccgtctttagcatgctgtggttcttagggaccccaagggcctagagcttgttccagataggaagatgagcaagggcaaaaagcaagaggcatgagttactgagtcctttttgtgaggaaactactaacttcctgtagtatgcttccaccaacaacttaatatcctgaacgcacatgagcactccatgcgctacaggtgggtaatgccaggaaattagattttgttattttttgaaaacagctttattgagatataattctagtatcacccatttaaagcgtgtaattctcagtgatttttagtgtagtcacagagttgtataatcatcgccacaatctaattcatttttattaccctaaaaagaaaccccatacccattagcagtcactcccaattccaccctcaccctcagctctaggcaaccacgaatctactttttgtctgtatagatttgcctgttctggaccattcatataaacggaatcacacaacatgtggtcttttgtgtttggcttcttacatttaacataggattttcaaaattccttcatgtatcatgtatcagtacttcattcttttttattactgacagatattccattgtatggatataaaccattcatcagttaatgcatattggaggaaattgagttttgagttgatcacgttcttgttgtatacaaaattgggcttctattggtaaggaaggcgatggctcttgaggaacggctagcagtgtctgccgctttgcagaaatgtgctggtatttggcttcctttagcaatatatttaatgcttcaaaagttctgtcaaagtacagtgattgtgaagagtcttagtgactgtagggagtgtccagtcagcttggtgtttaagttggtgagtcctgccattatttgagatgaaagcctggtaggaattactacctcacctttagcttctaagtctttgaccagaaaactctactgctgtattccattgtgaatgctgttactttggcctctggcccactgttttccacctgttcataattctgccaccaccttatagatttgagcttgcaaagttatattttcttcaatatttggcgtacagtatctaccaccaggtacctttttgctagcttcatgatctgactatttagggcctttagacgtaagccagagactggctgtgtgtgtccattgaaagtcttattaaaagagcttaaaaaatatttaatgatctattacatagatttattgtactatatttcatatgcctttatttagacaatacttgcattcctactaggttttttgactttttaattgatactatttggtcatagcattacttaataggcatctgaagaacactttagacattgcctaatttagagaacaggataccgtcctggagactctatgacgaattggttgtgggccctcattctagaaaaacactggaattaatatcctgaaaaaagttcctctagcccaatgtggttcaagccagaataggtttgacttacccataatctctttatcaggaagtgcagtgcttgataaatctgtgttcaagttttgtgttgggatctctaagcagtgtccctctggcctttgctcttccccctgtcccagtcctcagaacggcccacagataactaagcttaaaggataggggcagctttatgtgacctgacaagcattcttggccagctgagcagacttgtcttgtggtaagtactcccttagggtccttctcacctcttctgggaaggcaggaagaggaagagacaggagcttggcactgccgggcttcatggaaacctggactggctcccactgaggggcttccccttctccattttcctctgtgtccactctggaccttttattctttagtgtccctctgttgccagcctcaccttctggctcttgtccttatgtccctcttaaaggaacttcattccctttccacagggtgtagtacttcaagtgcatttaaacaatgtattaagacttaaagtagatatgaagattagttttttccacagccaccttagcagggcatcacatttttgagatgaaaggaggattacctgttttattttacaaataaggaaactgaattctgtatcacttcctagatacgagattgaaaataggccttttttcatgttggcatgtttttaggaggtagttggaattccccaggaagggaaattaatttgttgagtacttaccagcactccaatagtgggcattttaatatatgtctgtcaaataagtggaagttgataatagatttgtggagagtttggtagtattggagcatagtgtttaaagcagagggtggcagaagattcgaagagtaaatggcagatgctgtgagagcctaacacgttaagactttgttctggaggctttgtagattcagtaaaaggctttcatcaggtagtgatgcagtcacatttgtgttagcaatgatagtagcaggtggtcattgcctactatacagccttgtactgattgctgtacatgcatgatctcatttaatcttgacaacaattgttactaatttccattttacagttgaggaaatggaggttgagatagattgcacaggtcatagtggagctgtgattctcatctagggagtctgaccagagcacgcacaggacacctgtacagttgggatgagaggaaagaattgaaggatgtgttaggagagcctacttggtggtctcaacatttaatgacataagagacggtattgttggttcagagtgagaggtgttggat

SEQ ID NO: 108387 - DNA, 2081 bp, Homo sapiens
ggcagcttttgtactgattttactctagatccagggttcatagaacttagataaaactttctcttcctccaagttcttttcttaatttaactacaggaaaacacacattctttttttactgtgttttaggtttttacatgaaatctctgtatttgctgaaatattttgatatgttgtcatgaagaattgaaattcacacataatccaaataatttcttttagcttctttctagagctgccaacagatagtaaaatggatccgtttttaatatatcatcctctccatacccacctttagacaggcaacataactggcatcaaactgagcaaaagttatgaatactgtatccttactagcccaaattttcatttttgtcactctgcagatttgctgtgatggcctgttgctgggccttagatccagaggagaggcccaagtttcagcagctggtacagtgcctaacagagtttcatgcagccctgggggcctacgtctgactcctctccaatcccacaccatcaggaagaaggtgcctgtcggggctcacttgaagcctgtcagggatgctttgtatctaacacaacgccaacagaagcacatttgtcttccagaacaccgtgccttagaaatgctttagaatctgaactttttaagacagacttaataatgtggcatattttctagatatcacttttattaggttgaactgaaagggtttttgtaaattttttggccaaaattttttaaaacatacttactttggactaggggtacattcttacaaaataaataaacagtttttaaaattgtttagacacagatatttggaattagctatcttagtgccaactgctttttatttttttacttcatcaaggtgatgtaagtgactcacctttaaagtttttttagtgttattttttatcactactctgggaaatggtttgtcttcaagatgcaatacttttcttagtaaaggaaaaacagcataaaaagatacctggtctgccttgtacaagaaaaggcaatattagaggaagaaaatttaaagaaaagctagaggaaaaaaaaatttttttaaaaatacttattagaagcaaactgcccttgcatggaaaactgtttatttttttcagtgaaaaggaattctgctttcgtgtttttgggaaagcaggaactgagttcattacatctttaatttggcagaaattagcctttctgtgaaccagatgtggtttggggcagatctgtagtaaacaatggtgattttatttatttttactctctggaaaaggagataatacaattccagaaagtgaactcatatttctaaggttaagattcccttttattgcacctagaatagtgctatgcacagagcgggtgcttgagttgttgtcgttttttgtttgttttttaaatgtaaactggtaaattttgtgcttatcttcaaggctggcttaagtataaaattgttttttaaacacttgaaaaattaaaggatttgttttatattatgacagtattgaaattatttttcataatgaatgattggttattgtgtctggtaagtctttgaacattcaacagccagacatttgtgttttatttcatgatgttccagtcaagttccaaagccctaacacagttaagctggctcagactccaggttctagtaaaaagttggaattaatgttataaggaagtattaaaacactgaaacatttctccagaaccagcaagtaagggatatgtatgtatttatgctcagttttagttggcctaaagcagagttgaatgggctttctaaatagctaggcctgcaggtacctgccactactcccatcttcagaggtatataagggagaatgtgtagcagttggaggcttttgctgtttttaaaaaagccttatgaatcagcagcacatcgggaaaaatagctcacatagtacctggttttccacaagtaagccaagggcatgattttctgtgtacatttattaacagttctttggttttatgaaatactcatatgaagccagtccctggagtactgttttttaaaaggtccctttgaacc

SEQ ID NO: 108388 - DNA, 1066 bp, Homo sapiens
tgcttactcaagcaaggttggaagtttttttaatcctttaatttaaaactttaaatacagtaaaaatccatgacttcttatatttcccctcatttgcgtatttcacttaggatgctcttccctttaattaaactaaaattctgttcattttccacttctcaattatgcagactagctataatatttaaagttacaaattctcatattagaagaatcttggacataattcataatacgtagcttgtaatcaacagtaaactattacttccaatggatctaattacttagaatttataatactaatattggatgcactcttttttatcttagcaagggaaactaactgtgtatgatagacatttttttgtaaataacatttcgcttttccaaagcatgagttgagctgttattttttgtcctgtagctggctgtgggcgctagccccctgactgttgttttaaatgtcccctcattgtgcttctgctcctttactagtgggcctttggagtgacgctgtgggaactcatgactctgggccagactccctacgtggacattgaccccttcgagatggccgcatacctgaaagatggttaccgaatagcccagccaatcaactgtcctgatgaattgtgagtttttttgagcttgaaggcatgagttttattccatttactatattggaataaaggaaaaagagcaggtttccatattcacacagagccttcccttttgagaataatgactctttggatttaaattagactcttataaaaaaccacaaagtcagggagattcgttcactctttcatgcatttgatattagaacgtcttgcattttattttatagtgcataatctaagcactataaattagtctgagaggacgtactaagaaaattgaatgctacgtcagttattctatataaagtgagtatctgacttttatagttataaagtagttataaaggacatagtagttataaaaaacctctctcgttgtcattttgccttgccagttagtatcagctaatacagggaagatgatctggactagtaagccaaat

SEQ ID NO: 108389 - DNA, 1034 bp, Homo sapiens
taccattttttctttatgggtgaagttgggggcttaaaagttacatttaatattctatttttggacacttccaccagagtctatacacatgtgaaatacatatttttagatgtaaatgtagcacccaacaaatgatactgctgccttggagggaacattttctcggtcctttaagacatccttaacatttttgcatttcttcataattaaaaattctacacgatttatttagaaatacattgatgttttccatcatgaaaataatacattgcatctctgggctgtgttttcagaatttttactgaaaggattcaatatttcagtatgtccagattcttctgttaacgtcaacttttaactgttgagcttaagaactatgcacatcaagatttgactagttataaatgtctaatattattccaagatatgacatcattgtaggcattcttaagaatttctggatattgtttttattgtgttttcatcagatgtggataccaccataaatttttttatgtgactttcttttcctttatttgaaaatagagttcttgatttacatcttctttgaattacttagctaattatagtagctaacgtaattctgctcttaagaactactttctattaggagattactaaatgtaatcaggagtatgcagttaggaatttctttcttattggttttcttgtctttatagtattacattgtgtttaagaagcattttcttaagaaaaacaagtcaaggaaataacttccatgccaaatattatcagcatggtttatggcagtgaagagatccttttaaaagtatttgaacagtttttaggggataggacaaatcaaaatgtgttgcttgtgcctttacattatttattttgtgactatcaatgatcacctagaaaataaaaggaagtctggagttatccagagactgcatctgcagcacattgctacgtatgactcttttaactccctgtttgcccagtgctgtggagggagcccagtgcttgttgtatcctgagcgacctga

SEQ ID NO: 108390 - DNA, 1041 bp, Homo sapiens
tgtaggtttaaagcagtatttttggatggagtaggattgtggaataaaaaaagtaagaaagtgccatcatatttgtgtgctatttgcaaaccatgttattttttgttaccacaggcaatttctcagcaagacctggtacacatggctattcagattgcctgtggaatgagctacctggccagaagggaagtcatccacaaagacctggctgccaggaactgtgtgtaggtgccatgagcttgacgctgtcacttgatgtagagtgcttcctggatttggggttctctgcgagtcacagtgggacttgtgttgtatttaagggtggtgatgatccctactttttaatactctgattgcatttgatgttcatatctttacttttcagcattgatgacacacttcaagttaagatcacagacaatgccctctccagagacttgttccccatggactatcactgtctgggggacaatgaaaacaggccagttcgttggatggctcttgaaagtctggttaataacgagttctctagcgctagtgatgtggtaagtgccgggacccccagatagcaaaagaatagagaaacagctttctgtttttaaatgttctactatttttatcttttgggtttttaaaaaatctgctagctgttcccggaaatttttatccagaaagcaagtgtaattagctgccagtcaaccagtttatggagaggagctgtgacccagaccataggccagcactgtttgtaatctcatttcatcctcacagtactgctctgacagaagcactttttttttttttttttttaagacagagttccactcttgtagcccaggctggagtgcaatggcgcaatcctggctcactgcaacctctgcctaccaggttcaagcgattctcaggcctcagcctcccaggtagctgggattacaggcgtgtgccaccatgggcacatgcccagctaattttgtatttttagtagagacggggtttcaccatgttggccaggctggtcttgaactcctgacctcagttgat

SEQ ID NO: 108391 - DNA, 1133 bp, Homo sapiens
ataatgttaacctattacttagatacctagccaatgttcttaccccagtgaaaggtttgcatcacttcagcacagaagtgagtagcagggataaatgtagacaaagccaggattttcccaagaaacggttttatattcactgtagccttaaagatgtcttggctgaaaaatgctcagagcaagcatttgcagtgttgtgtctcatgcagttttagattgtaaggttttgcagcatcccatcaggatgaattagcagtctcaggaggtccttagggaattgaatgacattacatactaaattggggttatttgatactgagcattcagtccttgaggaaagtcttgtaaaggtaggttatagcttgattatgcttaattgttcttccttctatgaggtgatagcaggagtcctagttacaatgaataaaacacattgtcagcatgtagaaagtatattattctttccattcattgtagcagttcatttcatttttaaggtgaccagggcctatcacacattttgttttgatccttaatatgtatagactgttcatagctatacttatgtatttgtttgttcattcttttattctaattcattcagtacccattttgcacttggaactgtgttaggcagaatgaaaatgaaatgatcttcagagatcgtattatagaatttatcaagcaacagaatatagaatttattcagcaagaaaagacacctgtttttagattttaccttgtggtatgtaatacagcatgtttgcttcatgttttaacatccatggttacggattgtacgcgtattgaagtgttttaaagcattttgaaatcctttcttttcacacatttttccactggaatttatgaaaataattttattaaaagttaaaatagctgtatacataaaagatattaacctattttaatttcattagaagtgcttcacatcaaagtactcttgcgctatttctgcttgtagtttggccccttcattggcccaaagatgcctgatggtgaacacttcttatgccaaatggctcacagctctccctctgcaaacgccctcaacaagactgagaattagaggcagttcttgtgccaagccccacagaacctacccttcctgtacc

SEQ ID NO: 108392 - DNA, 1210 bp, Homo sapiens
tagtcccagctactcaggaggatgaggcaggaggattgcttgagcccaggaattcaaggctgcagtgacccctgatcatgccactgtactccagcctaggtgacagagcaagatcctgttttaatttttaaaaatgatgataataattctgaggtaagtcttatttgcttatctagagagaaagaaaaatgtgataatttatagggtgcttaatgtctatcaggtctgatgtaaattgagaagacatgctaataatatctaaaaacaaatttagcactttcccttcagaaactgaagggaagattaaattcagttttatgagtagaaagtgataaaattttatacagtttatgaagttaatttataagaactgtttctaaatttacttaaaggaatacatggaaagtatgaagggtttatgtttattggttgtaaaaagttgggttataccaatctaacaaaaaatctttggaattgcttttaattgaacaaaattgtttgtttaaggctgctacaaatacatccatacacacacacctctttaatattttctaaacaagtggtttaatttactatatcattcaatatttattttattcattcaccccttcccagcaccaaaaacacttttaaagggtaatatttatgtgttaggtccatcctttcggctaagaccaagtgtaagttaggtcccagtaggttttctgactaggagagtttacatattactttttgtaaatgtaaaatttgaactataaggttattaaacaacagccttttgttactcttttctcattttttttttaaggaaactccttaattcaaatatttcttccggggtttgtaagtattctatagactgtgtagaactgggctattattgacttgttctgaattaaggaaggaggtttttatacaaaattgggttgatttagggttggaaggggagataaaaggaaataatagtgataagaaaacacaatgagtatacttggactgtttcacaagataagacttctctttccgtatatgcttgacttgtagtcactggttgtttctgtgctttaccactgtaattataatgttctctgtgagctgtgcggaaataagagaaagcacagtgagtccttatgggggacagaggggaagtgcattgcctcaaatttgttagagagatagcgccacatgactgtctctgagattgattatt

SEQ ID NO: 108393 - DNA, 1074 bp, Homo sapiens
cttttcgtcatttctctgaggctaagcctagaaactcataaatgccattgtggatacctcattactgagctccaatgctcctggctatatcattagtttatttagtataattcaggaaaattttcatatacttagtttagatatggtgtttctgaaagcaagttaagatgtgtaatagtcacaaaaaacttttaacagtcgttaaaaccaaagatttgggtctttttactctagggctacagtaatgttgatcacatatgaccttgttatttttgttttatgttatattgtgccagaaagttttgtactataattttatgaatgttgtatgatctcattaattattacttttccttttaggtacttttgggcgtattttccatgggattttaatagatgaaaaagatccaaataaagaaaaacaagcatttgtcaaaacagttaaaggtaggatcttttttccatagtatttccatgatgctcttctgtctcaggtggctcctgccagcaaaattctgtctcagtttcccaatgtgtgccagaccttttaaatcagtcagtgttaatttagctgaaaacaaaaattgtcttatatgagcctaattgttttggaaatttgggttgttctcattaagtatagaaaaacagaagtctgttaaattaagacataagacatttcttagatattactcagttaattgcaagtcaaactgcatccacttgatttcattgttactatgtttagtgttggtatacttttgcaggtatagccatagttggaattgctggcctaagggtgtgtacatttaaaattttaatagagcccaggtgcagtggctcatgcctgtaatcccggcactttgggaggccgaggtggccagatcacctgaggtcaggagttcgagaccagcctggccagcatggtgaaacccctgtctctgctaaaaatacaaaaattagccaggcgtggtggctcacgcctgtaatcccagctactcagaaggctgaggtgtgagaattgcttgaacccgagaggcggaggatgcagtgagccgagatcatgccactgcactc

SEQ ID NO: 108394 - DNA, 1060 bp, Homo sapiens
gctcttcatgttgttaaatagagaattacttttttacctccactgtaattcagtttggaatgctttggatacttatgagtcctccttatgtattcctttgctggttgggacacatttaggtcaatcacagctaagtcaggtacttaaactgtccccagtagcaaatggtaattaatggaagcagattttctggtatgtcttaaaatgcatgattgccacttgttaatagttgactgttttctaagcataactagtttgcagatctttttgcaatctgaagagagtaagtagaccaggtagcatttcctaaagaataaaaaaaaatgagagatcaattaatgttatatttgcagtttcttttggtctctgaatgggatagaataggcaatctgttgtagtggtatgatttgagaagaaggaattctgaaccaggtagagtttttctttattggtcttttcaggcccataatagtttattttaaaattcttttgatttcagaaaagaaaatatggtggctgattaacatttaaaaaggtggtcaggttcactggaaatctgataaatgcaaagaaaacaatagttacatgcgattttttttttttacgttagtttgtgaaaaagtaaaaagataatttctaggttgacgggtatggaggaacacatgctcttttacattgctggtaggaatgtgaattgctgtaacattgtggtaaagtaatatgtacatatatatttttgtgtatgttccttacttccattgtttttaagtatatgtaaatctgtgtttgagagtaatatttaaaaatgggactaggtactgggaagaggagacaggaggttttgcagtgcttcagtgcaagagagttaagaagctcagtcaagcaaggtgaacttggctggagagagaagggaaaacctttgtgaggaagacaggtcagggtgtgtagctctatgtattgactagagtgtttgaagatatttactcagcttcaagcaaaatgtcttaaatgaagattatccaaagtcttttctgccttgagcatacaagttactctgtct

SEQ ID NO: 108395 - DNA, 3123 bp, Homo sapiens
tattgagtgttttctgtttaccagtactgtaccccaggtactttatatgtattatcttaacacagccacctagaaataggcttgaagagattaaataactttttcaggattgctcttctaggagcagggcagagcaggcgggactcagtgttgtaatagctatgtgttaataatccactattgtcattgtataaaacacttgctgtgtgccaggcactgttccctgtgctttacattcatgaactccgttaatcctcacacagtctggtgaggttagatggagcccatggctccgtggaattcattagaaagggatggtagtgttcttccattccaggcacttaggagccactgcttgttataaacagatctcattagaggcagagaattaacactgcctgagatatgcccatgccagggcagttggagctcatgtgtgtggctttccctctctcaacactgcaaattgatcttttcagtctctttgttacgcctgatgagtctgtcctggataggcagagcttctctttacattcaccctgaagtcctgcagaggggttggtctgcagcgtgtctctactgtagtctttccctgttagtttgtgactgtgggaaagtttattactcctttgtgggatgcttgaacttgtcatctggcagcatcttaatttttctcttccagtttccattatccccaccaccgcccccatgccattactggtgacagagtttccctttaaaatctttgattttatatttaatgcctaactgtctgacacatagtaaaatactcagtaactatttggttgaataaccaatgaatagagggaggaaaaaaaccattttgttttaccaatcattctttgcttttttcacaatagtttgtgccagaaatgaccattctgtctggtttatgttttctgtcccagggaagcgtggttttctctgttcattgattgactcagtgttagttgagctgtcactggggctcactctggcccacttgcggcttattgtgccaggtactggcataagtgctggggaaggagaggtgaataaacaggcacttgtcctgcctttgtggagtttatagtctggttggatgagacagatattaaacaaaaaaaatccttactggaatgtaggggtcacagtctttgtctgttgcattcattgctgtatctctagcacccagtacagtacctgacatgtagtagatacttaataaatatttgtggaatgaatggatgaagtggagttacagagaaaaatagaaaagtacaaattgttgtcagtgttttgaaggaaaattatgatctttcccaaagttctgacttcattctaagacagggttagtatctccatacataattttacttgcttttgaaaatcaaatgagataatctatttagattgataatttatttagactggctataaactattaagtgctagcaaatatacattttaatctcattttccacctcttgtgatatagctatgtaggtgttgactttaatggatgtcaggggtaggtccctaattgcttcttgcttctatcataacagtaagtcttggattcaaaaaaaaatttcgttctgaccacttagcatagtgctttgcttattttagggacccacttaatatctgttgagggaatgaaaaattgacatagatgtccctgtaacgcctttgtgtgcctacagtcttttcaaaaattctgaggtagcacaagagtgccacctactgttaagttaatggagagactgtgtctgtgcacttagtcatcagtgatgttggttgcagataatacttaagaagtactttcacatatctcatacaatttgagcctcacaaaaatcctgtgaggtagattatcttaatcccatttatttcctccccttttgaggatggtaatgctcctcttccctccccattattgaagtctggacttctaacagctttgatatctggtttgatttttgagtggtactcaactgtaaaacagagtcctgtaatccctttttgctctaacgactggagatgcataatattcacataattaatataactatagtagtatactataaattagtaacaataatttataaagatatgtttgagggctaggcaataaatgctttacttatttatttttcatgtaatcgttttagcaatcttatcagaggatagtgttatgcacactctgtccacgggaatttgaggttccagaggattaaatagtttgtcctaggccgtacagctagtaatcgatgatactggcagttctgacttcacggtttatgctcttcatctcttttctatattgacctatacccactgcattataaactcatatagatcaattctgtaataacgttgagccaaagaagctcttccagcactctgaccagatgatagcctaatgaatctttattatagtctctttgagttgcaaagtatcttcgcagagttgctggagaaacagggctaactgcagcatcacaagaagaagtatcaggttggtgcagtaattgcagtttttgtcattaaaagcaatagcattaaaagcaatgacaaaaactgcaatttgcaattacttttgcaccaatctaatagataacctaaaatgatggacatcttcagggaaggcatgctgggggggcatttcattaggcaaacatgtatcttgagatctatggttgtgctgagcagaatggtttgcatattataagtgctctccaaatgtttattgcaggacatttctatcttaatttttgctatgactttctacagatgtttggttacaatagcagatagtagtatattgtattattagccatagaaaggctacataaagacttacagtcctcattgcctggatgttatatatttacatttttcagatttgtgtatgggctcttgaaattgataaacattcatatataaatgttatagattacatagcagccgtgtgtgtgtgtgtgtgtgtgtgtgtgtgtgtgtgtgtgtgtgtgttttgtttcagagacagggtctcactatgttgcccaggctggcgtcaaactcctggactaaagtgatctgcctaacagccttccaaatagctgcagctacaggctt

SEQ ID NO: 108396 - DNA, 1077 bp, Homo sapiens
ccctgtttcttccttctagatcttgccttcatcattctccctttctctcttcctccctccatccatccagtaaacatgtattgagcacctgctctgatttaaaccattggttctcaacctggttacacattagagtcaaggagaagctttgaaaacatactggtatttgggtccaccttccagagattttgatgcagttggtttgtggtagtatttggggatcagtatttttcataaagcttcctggatgattctaatgtacagccagtttgagatatactgggttagatactatgctaagtgctgggaacagaaagaaagaatgatatactttatagtttcaagattttaatcttttacattaacctgtaattataaaagtatgtaatttgatgactgtgatatgtatagtaaagtgtgtgaatacaaaaggtgcttgtccagcctcagtgagtcagagatgacaaggaggacattatagtcaagttagggtgagaggtacagatggaatgataggtttattttcataacaaacacttcttacttccctcctctgtgatttccagttgctgcctgaagacatgccccagctttgtgacttctttgaaagccctcctttatgtggagacgtatcatccatactctttgaaccttttctcctcttattgctgtatccttacttgcgctccagtcaaatgatcacttattcctcactttcgccccacactttgcccttcaggacttttgttcatgctttcttcttcccacaagcctccatgcattttccaccagtccaaacttggtccgttcttcaaattccagctccattgctgtctctttcatgaagtcttttctaagcctcccaaacacccctttctctttgtctctgtctctgtctctctctctctcgtagcagttattgcactttttcttctataattttttgtgtaattgtcttacctttagaatgtaagctttttccagttagggagcagtgtgtcttactcattgttgagtcaccagtcctaattagtcttaacatgcagctgggaagcatatttgtggcgtaagaatatg

SEQ ID NO: 108397 - DNA, 1164 bp, Homo sapiens
ggcagatagattttgcacttgattagatttagaaccaactcttttggtaagaatagtccatagatggtaggtactctgtgctgcctattttgtcttttcatcaccttgggaggcacagagtatctggatgtcccaaaggggaatttttttgcctgtaaaataatgtgacatatcgtctacttgctggaatatttctgaaaagaaagaaaaaacattaaaaaaaatgtcactgttgccaaagtttacttttaaaattctggtgactttgcccatttcttttatgctagtaggatattacttctcacaaagagcagtactgcatattcttggcctctgtctgtgtcttccttgctgcctctcatcttcccgccctttctatttattcatccacccagtacctatggagagtctgtggtgtgttaggcggtatgactgaagcagaggactaaactgtgagcaaagagatcctttcctcgggggtttataatgtagtgggagaaatagacgaggcaatataggcaatgataccaacatagcatggcaagctatgataaggcaagcacaggggatttgggaacccaaggatagcttcctgagaacagtgacagctcttctgagagctgaagggtgaccagatggtggcaaatgaaggatgaatgagggaatgggaaaaatgcataggaaagcctggaatttggaggtaattgagcagggcgcatctagggggatctgcccagcagagccgtatccttggctctgctctggaaagtgcttggacagtactgctaacatatgcctccagaattcagaatttttttctgtccctcccaagattgaatagctttcctgtggcataaggtaattcttgatgaaagtcatgccttcattcaggctacagccaagtctagctgccctagaagtcatttggtctctacgttaatctgttctgatttattgtttgttgataggaaggttaaattttagaaaagttttatttttcttatttccatgtgtttttgaaagctgtaagttttatcttttatcctgacctatccccagaactccaaacttgtatatctgtcagtttaacgtctgtgcatggagatatgaggtacctagttagtagactaggtactccaaatttaacttgggcaaaactcttga

SEQ ID NO: 108398 - DNA, 1097 bp, Homo sapiens
tgtatttgttggtcatggttttggccaccctagtcatccagttcaggctcatgactcttactttattatgtgatcctaatgtatttatttatctggttttccagcctactatatttcaaaaactgtctgcaacagaaaacatctgtactatatggaatgttagtaggtgttactagcaagaaaagtttcttttatcatatgaggatgggaattatgggttagacaagttttgtgaccccataactcctttcagtctttatattctaatgttcactgtgaagctccaaagagacactatagtatgtggcttttcccaaacttcttgatcataggaacattttcactgagcatctagaagtaacaccctttggctaacagtggtatagactattgattggtgactgtagtggtgattatcagaatagtaacatagctttcattatctcgcaacacatacctgttgctgagttccagcaatgttctgataattatagtaattaaggattttcatggaaaagagaatttctaaagcatcatttttctcctttaaattcagaacttgaagaagtaaaaacttcagccttggacaaaaacactagcagaactatttgtaagtgttactgtattatctttatccattattagaaatgaaaaatggttgactgcatataaacatgattgcatgaagcttggaggcctcatggtatcaaatgataatgacaccatgctgttattttgctggtgctttgtagactggtggataggtcatgaaactgttagaatattgaatattttgagaactaaaatttatacgtattttgtaacgagtaagctaaaaagttttacaagcaagaatatcatatatttttgagtagtcataattaaagtatgaccatgaaatatgtgtaagatgtttattagcagagggttagaaaatctggcttgcagtctggacctaatcttaagctaatttcatccaggtgaaggtgtaagcttaaagatattatgttacttaaacctacagagcaggtatgcaaagtagatttttattttttggtatcggttgtgtttagatattattacaaacttcttttttt

SEQ ID NO: 108399 - DNA, 1027 bp, Homo sapiens
gtaatttctgttgttactattgctgatgtgtctgttaaggtttgccttatgatccttcagttttagtgtactggaatagcaggacttatgagacaaagtggtgtattaaaaacaatgagcagaagttgaaaacaattatctcttcattgatgtcttggtttgttctttaatactaacttttatatccataatgaattaaatgcttaatgtctagaggtgtggtagtctgaagatctctaaaaacttttgtttagttactttatttaaatgtattacttttagttttcttgcagcaaaaataagtaattctaaaatgtttaaaagaatcattttggggcattaatgttgatttttagaaaatgtaaaatatttttcttatcttttttaaacagtgtttcgggtagagctttcctgtactggcaaagtagattctgaagttatgatactaatgcagctcaacttgacagtaaattcttcaaaaaattttaccgtcttaaattttaaacgaaggaaaatgtgctacaaaagtaaggaatttatttaccaaaatatgttttacatgtatgtgagaaggtgaaaaatagagtttgttgttttttcacagatttaagtatgtccaactcatgattatagttgcaagtgagaaaagagcactggcaggtgaagttttgagataatcccagatggttggtagccaagaatctcactcaggcctcattcagtccatgctttctcaaatcttttgtcagaattgctaagatgttttccattaggaatagtgctaaaatggttgaagaggtaaagaaataagaaaaatctgttgggacttctgagtaactatgttaactgtgtttcccttatcaagttacttttatgcagaagcattgctctcgggtgagatagacctgggttggaatggcagctctgctcttttcaggatattgatacaagttacttaacctctctgaggcttagttttttcatctgtaaaatgggcataatacctgtttcagaggtttgttgtttt

SEQ ID NO: 108400 - DNA, 1039 bp, Homo sapiens
cccagtagactgtacatttaacttttgagcagatctgtttctttaaaggatgattggcaagtgagagtccttacagatcgatacatgccaaactagagaaaattggacttcaataattggcaatttcttctctaatcccagaaactgcagttttaaaatttatatcttaaagactgcagagggaaaagagaactaccttgtgaatgcctcccatttttagacagttcctcaaaaaaggagccagcaaggaggcttccacagtttcatgcttcatattcctctaagctgctgataggaccaaaggggctgccttctcaaatctcctcctcagccctttgcacctctccctgtgccctcattggccagctacactcacagcctcatttccttcccttctctcctccttttcaccttgccacactgagatgctcaggcgccagtcttagctgcttttttaactgcagttatggccctggacccctttgccaggccctctctgcttactttggggttctggtctctggtctgctccttctctccttgtgataactgagacctagaataaaggagacagcaagtttctggggaaatagtaagtgtggctttgaatttgttaagttggaaggctgtaggataattagatagaattgcctagtaggtaattggacacttgagagggattgaaggtaaaagagagtgagagaaattgacgattaagatatcccatcagtggtgaaatgggctagaaccctagtgtactaggattgaaggatttacatttggagaggaaaatggacctttccttgggactagaatgaaaagaatagatgctctaatagatctgccggggtgttgaaaagaaaggcagaaatggggttcctctgtactagtggaaagggacaaaaacattgagtgtgaggaggtggggaaggcctgtaaggttggaataagacgagggaaaagagggtcagtgaggaagggattgctgagtagaactaagggcctcccctgagactggaggtcattgttgtgtaagagc

SEQ ID NO: 108401 - DNA, 1279 bp, Homo sapiens
cttgcctgagtcagccactgttgcctgattattgtctttcctttggaaatagttcgtgtgtatataagcttccatgcatatatgtatatatacatctttcaacagctaacataccacctacttttctgcagtttgcagagcactgaacaatatcctggtcaaggatctctgtcacttgatacagagttgtactttttcccccttcaaatggctgtattacttattattatatagttgtactttggttattgatcagttcctgtgaggaaattaagacccagatttggaaagggatttgcttaaggtaggagaagtagggttagaggaagcagaaggtagagatgacctgaaatgggaaagtcacacgtgagggcaggggaggcttgatgaagggtttgtcacctgatcatttaaccctgaggtgtaatcatgaactttcagaaggagggccgtggctctcaagctctaatactttatcagaaaccctcggttcttgctttttaaggtttgccagaagatgaaatatttgcttccagagatctgcaggctccctgatatgtgtcggttcaacatcgtagatactttaacattagtttcacatatcacagcttctggtaatactgtttctcagtgttttcgccattttgtcttgccacacagattgtggtctcttcagaggcttgaagctgtcttactcttagcgcataggtcacacatgccttagtgagtggtcaggaaagaccattgtgttaattgcattttgagttgggagtagaactctggtattgcttctttttcacaagaccacacacttaaaagcaggctactgagaggctttaacagatagtttcttctgtattccagaacattccccaatatccaggagaaacatgtaactgtgtctgttaagtgtcagtagctttttttttttttttttttttttttttttgagacagagtctcactctgtcgcccaggctggagtgcagtggcgctttctctgctcactgcaacctccacctcctgggttcacaccattctcctgcctcagcctcctgaatagctgggtcaacaggcgcccgctaccatgcccagctaagttttttgtatttttagtagagacagggtttcactgtgttagccaggatggtctcaatttcctcacatcgtgatccacccgcctcagcctcccaaagtgctggcattacaggcatgagccaccgcgcctggccgtcagtagctattttagatatctgaaaagcgaaaatttgccagaatgt

SEQ ID NO: 108402 - DNA, 1043 bp, Homo sapiens
cagccattcatgcatctaatatttaagtagttacaagtaaactaagaccccagccttgtttgtgagatgtgcaaggtaataggaagatggacatttgaaacaactccctgaaatatgttttgttaagtgctataaaggtggcttttaaaataaagagagatggtttgctgatttagcacgaatgaaccatatgtacagctttgagaaaccaatagtcaacttttaaaatcatttggaaaaaatttttgaactgttgaattattagaacttgagttaggccagttcatgtggatcacagaccttgaaataaatttgaacttaaaatcgtctagggaaaaatgaattttttttgataagccttaagagttttgcaagaataactttggttttttagctttgaatttgagttgtttaaaaataaaattttgaaaaaatgccatgctttctaacaagagagcaacatttttcctttgctggaattggcaatgggaaatttaagtctggttaatgtaactgaacagctgaagtattttcatcctaaatcagaatttaaaaattctgtgcattctaatgacaaaatgctacctctttagttcgtggctgtccattcttgttcttgtctgctttccagcacagcccccttgtctcttggcatccttgtcaaaaattaatcagcccaaaatatgtaactttctttctggactctcagttctcttctgttggtctacatgtctgtcatgccagtactacactgttttgattaaagtagcttcgtggtgatctttgaaaccaggaagtgtgagtcctccaactatgttctttttaaaaattgttttggctattttggcctgctcacaatttcatattaatttgaggatctgcttttactcttgtgcaaaaatgggagtcagaagtttgatagggattttagtgaatctgtagctcacttgggtagtattgttatattaacagtgttaagtcttccagtccatgaacatgggtgtttttccatttatttaggtctttaattctttcagcaatgt

SEQ ID NO: 108403 - DNA, 1367 bp, Homo sapiens
tgtgggtttgagggttgttttttttcctcatgctacacatgtgagagaactctatccaattatggctaaacctgtcccctgtgagtcacatcctgagttgactggtcaattccaaaggtgctgcctaaaatgctgtttggattttaagaatcacttttgggacaaatcaaacatgtgagtatttattcaggcacctgagttgagaagttccatagcattacttttggtgttttgatgcagttacgccaatgttctgaaaaatcttgccagctacacatcctaaagcaaaacaaaaacttgtacatgaaacagaaccattagctactctaaaattatgtcacacttaaaggtatacatttttgtgcgttgttgatgtaaatcaagtgcaatattttctaataaaaattttattaaacagcattcatttgtgaaggtcctcttaaaatgtgccaaaataaacgtgtgtgtattgctcagttacataataaacagttgttgaatgattctttttgtgtgttcagcagtgataatgctgagtggatttcataggtctcattcttatcttttttttttttttgagacggagttttgctcttgtcacccaggctggagtgtaatggcatgatctcggctcactgcaacctctgcctcctgggttcaagcaattctcctgcctcagcctcctgagtagctgggatcacaggcgtccaccaccattcccagctaatttttgtatttttggtagagatgggatttcagcatgttggccagtccaatcttgaactcctgacctcaggtgatccacccaccttggcctcctttcaaagtgctgggattacaggcgtgagccaccttgcccggcctcattctcattcttatataaattttaagctggaatagacagcacacaagtctctagttagggatcacctgtaatttagggaggaggaggaagagcgtatcttgctgtatgccaggtactttacatatgttctcttttatcaaccataggaagtcggtggcattgactgttttttgtttgtttgtttttaaacagataaagctgagatgctgaggttgtgggcaattaacagaatttgctgtaggtcacagagatgtgtggggctatgtgactccaaagtgcgtgctttctctactgtgctgcctttgaaggttgacagttgacttagtctttaaccaaaatcatctgagaagctttaacaaactacagattccttgacctaccctgagcaatttgttgaattgatctgagatggggctcaggtaaattaacgttttgaatgccatgtttaattaattacaggaggtacaggttttccacatttgaacgtctctgaaatcagaac

SEQ ID NO: 108404 - DNA, 1035 bp, Homo sapiens
gttttggaggctgggaagtccaggatcaaggctttggtagatttgatatctgctgagagccctcttcctggtttatggatactgctttctccctgtgttctcacatggtggaaggggcaaacgagctcccctgggtctttttataagggctctaatcccattcatgaggactgctcttatgagctaatcacctcccaaagggccctacctgctaataccatcccttagtggttaggatttcaacatagaaattttggggtgacacagagaaatgagaaaacaataatcttagagtaggtatgtattaatgactagcctggttttttggtagtagtagggcacacggtcctgatggaagtgtataagttctgaaacaccgaaagcttcagaagcttttaaactctggttggccttcctgtgttcctgggccctggttcatcgcttgcatttacaagcctgttacttgcataacaggctgcaatgtaggcattcatttctgcattttactgatgaggaccctgattcagggccttttggacagtgagtagaaggccaggtcttgactcagtcctgcctgagacctgaattcatactgtctctttatcagctctggaggagtgcaattaaccaaaaactcaaagagtagaaccgcaagcctcctgccacaggtgcttgtttgtggtctttattattatgctaattattcttgcatcctcccatgttctttaattgataattttcattgtactgagctctgtggaattccggagcctgtgaaggtggcatatggctgggcagtgccagaagcttgggaagaacatgctggtgggtgggtggggaatggtataaactggttatgccaacagtggtggtggtgataggggtcagggggacttttgggaagaggccccatctcccaccagttagaaattaactttggataacttgcttctcctcttaaaataaatatcttctggaaaagtcaagaatgttcacattttatttaaaatcaagtcaatactagttgaaatcact

SEQ ID NO: 108405 - DNA, 1612 bp, Homo sapiens
ctactatgtatgtatcctcagtagcttcttaggaaggaatgatgggagataaattacttgaggccttgaatgtctgaatgtatctatcctgtcctcatactttatagatggtttggctgaatttaaaatattaagtagaaatacattttttcataattttgatggcatattcacagttttctgtcttaagggtttttgatgaaaagtccaaagccattctgatgcctctttttttctgtttttttgaagctcaggttctttttctctggcattctgaagttttataagtttttgtgtggttggttggttggttctttccttcctttcttccttttctttcttgtattaccttagtgggtcctttcaatctagagactctttttagttttcagaaatgctttttttttttttaataattcccaccctttattttctctctctctgtgtgtgtgtgtgtgtgtgtgtgtgtgtgtgtgtgtgtgtatttctttctgagatgtctgttggtttggttgttgaacccactacaaatgatctttaaattttcttaactaatctcatgtcttacgtatttctttgtactggaaggagtgggagggggggaatggttctcaattttaatgatcatgtttttaaattttagaatctttttctgtttccatttcattgcatcttattttatggatgtattatctttacttatctctgatgtgtgtatttttattttttctttgtgtttaatatatttttaatatttcttctgtttcctccagtgtggttattcatttcagggatcttttctttgtttgtttaagtcataaatatctggtgatccttgactgtctataatgaagaaaaagatcctgaggagctgattgcagaggagagaacatgtgtgtattggtggtctagtgacttgtgagttcaggtggacttttcattgggagtctgccccgaatatcaacacctttacatctcgtttggggccagtgttcacaatgaagaaatcatcatctcctgcctctggtatgcttggtgatatgccagctgccagggtttgggttacctggctgagggagggatggaggctgtagccttcgacttctggctacagttctcctgtcactgtgattcagtttcttcagaaaaaactttgggtttcctgctggaactggggatccaaaagctttgaacacctctttcggtggctccccccttgtctaggctaagcctcacatcagcctttggcatctccttggtgcctcaagacctgagcctcttggaggtcctgaggggcagtgaccattccttcaagtactttgccatcttgcaaaagtttgtttaaaaaagcatgttgtctttccttttctgtttgtccttatggtttgatgtctttgtgattttttttttttaaactatcattttagaggaattttggaaggaaatggaggtaagggattatggtcattccacaatgtgtaaatggcagttagggtttgggtttaactattgaagatgacgtgtggcagtctttttatatgaacaatattacgagtagttaatggtggttgtagtagtagttgacacttttaaaagtgctgtcttttgtctg

SEQ ID NO: 108406 - DNA, 1048 bp, Homo sapiens
gataaatgcctcttgcaagtccaaaggctcctacctgggggcacattccaggtgtgttgggcaataatttggttatttccctgcacaggtttgcctcttcttgcatcaagttggccttcttttgaagcttcaggagccttgaaaagagccctgcccagtctctcttctgaagcctttcttgctcaacacagtgtactatggaaatcttcacagcatattgcattatggcaaaaataccaaaatctcaaccatagagtgactacaaaaaccacggctaggtttgccttgaaaacacaataaccttttttaacttaaaaagaaaaacaggcccctctctcttcctttctccaccattgtagtgtgtgtttggctccgcctctctccatgtcttctcacaagactttcaagattaagcaattcctggccaagaaacaaaagcaaaatcgtcccattccccagtggattcggatgaaaactggtaataaaatcaggtacaactccaagaggagacattggaaaagaaccaagctaggtctgtaaggaattgaacatgagatggcacacatatttatgctgtctaaaggtcacaatcatgttaccatatcaagctgaaaatgtcaccactatctggacagttggacatgtttttttgggaatatactttttctctctgaatctgttaggaactttctggttggctgggttccgtaataaatacatgagacctttcatttcaaaaaaaagaaaaataggcctccttcccaggggctccggatttcatcagccttctgtgcatgcccagccatacaaaccacgcagggatggctccaagtgcactgtggcctctttgaactgcaggcctttgcacatcccaatccttttcctcgcaatgcctttctcatctcttttctcctccagcttgaacatcgcttcctcctggcagcctcccctctccagcttcctttctgctcccacaggaccatgatggggaggacagctgggatgtgcagaatgaaggaactcttgctagcagacattagtctgtagc

SEQ ID NO: 108407 - DNA, 1691 bp, Homo sapiens
gagctcaggaggaggaccccaggggagaggagagctgtgagagcaccggcacccccagaagactctgcttcttagcccacattcctccgggccttatggagaatgaggattcagccttgacttcttgcccaaggcctgctactggggtagcaactgacagctcagaaaggagctgagctccctctgccctgccagttgtcagtcaggcagggagggagtggctgtgttggtttggggaactaatttccacggacggctgcccgtggacaccaggtggactggttcactaatcaagtcagccatattgttctctggctaagtttggttccagccaacgtcatctgctcttcagttcctcactgccttcttgggatactaagacttgaattttttggggactattaagggtgttagtcttggagaagacacagcctcaccttctcacttgctgtgggtgaggggccatttaagtggactgggagacagtgcgcagtttgtatataattccctttcttgtggaacagaagactgaggcctgcaggttccgatgtgtctccatgggctgtgctcccctcttcctactgtcagtttctgaaacttctgactggcctcccagttatgcctcctcctcaagttcctggcccgtggatgttaaagctgctcgattcccaggatctcggctgccttttcctctatcttgagccctataaatgcccacgggacccccaccaccagcctcttgaagtggctccacagctcctgtccctggaacatcctgtcagtttggtcataaaccctgagccagatgaaatgagccaccgtgaacagacatctgccatgcccccaggtgggcttcggtggccctacccggtaccagttctttctgagaaactggagatgtcttgttagcataagtgtcttcattcccacctggagggtttgggagaggagcaaagcagttgaaaactagttaatgagctacaagagtcaaatagtcctctgaatggagcccccatcacaaaacagtgcccaggaggctggctcctcaagctacccatgcccagcgccctaaagcagcaccagatgctttggaattggggtgaaacacccacatggcagcctgctagcagcagtgactttgacttctggtcttaaagagtccctcacttcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaattttttttaaaaaattcccctacccctgtttaaagctgaaaaatacatttggttcatgtgcattgtttacaaagcaaaaagaaaaaagaggaaaaaaaggcaaaaaatattgtgaaagaaaaaaaacaacttaatatattttggattaatatttggtatttcttttaaagtattttttgtgctgtgaacattttctgccaaagaccatgatgtgtgtctgtatgtttaagttatcgtaaatatttaaaatgtaaacatggctgttttgttatgccaccctgtaccaggattgctgccgcattccactgggtataacagtattttaattaaaaaaaaataattaaaagtgatg

SEQ ID NO: 108408 - DNA, 1050 bp, Homo sapiens
tcacttcggacttctgtgtaaacaactcttggtgtttacaaaccaaatagagttatttctccactcccaaacctacccttgccacagaggtagtgtgactgaaccccctggtttgcccagttctgttctaatgtacaccagttttcccagtataattattgatagcaccccctttgccagtttggaggattatctgtctggtctctatgcccttgccctaggattcagggcaggggtatggggacctgtgctgtatccccatttcggtagaggaaggatggggaaatgtatgctgtgtatggctgaacacgtacatgtacaagtgacagtcgtgtggaggcgaagaccagtggctgccacaccccaacctgcacccttgaccacggtctctactccttgctctgcagagacaggcaggtgccccaggtggtagcagtggcagtggtgggtctccagagctcagcgccctgcgactgtcagaacaactgcgagagaaggaggagcagatcctggcgctggaggccgacatgaccaagtgggagcagaagtatttggaggaacgtgccatgaggcagtttgccatggatgcggctgccacggctgctgctcagcgtgacaccactctcatccgacattccccccagccctcacccagcagcagcttcaatgagggtctgctcactggtggccacaggcatcaggagatggaaagcaggttcggcattgcaggccaggcacctgaggttgggggggtgggtggcaatgtccagtcactgccctgcccttgatccctgataaacaggcccctttccccatagagctcagcagtccctcctgcttctgagctgaacctgcatgattggcacaccaggcactgtaaacatgcatttgcccagaaataccgagtccttggtctgcccaggagactcttactgtggaggtgttgggtgccatccagtgcttgggccctgcctcccctctccggagtgccgccctccaggatgagggctgtgccgccactatcatctgatgaatctggaacccatcctt

SEQ ID NO: 108409 - DNA, 1069 bp, Homo sapiens
agcttgctagtgggtgagaagaggggggccggccgggaggcgtttccgctccccggggagcgagtgagcgccgagctgttcttggctcctcgctggagccattaatcttgcagccgcgggtgacctggatgcctggcattccagagccgcgagctgttccgctcccggcccgccccccgccgctccctcccgtgcgcgctgcctggcgcccttcgcccggctttgggaggagggagggtgagcacaaagggagcctggaacgtggaggtgggggctcgctcgctgcccaaggcgcatcccgggtcccgtcggcgcctcgcctgccttcctgccctcctccgctggccttcgggcgtcctcttcccacccgcacccagaccacttatttcttactaaggagctctccttcccgagatcccgcaggcccaaggttttatcagggtcctgttggtaggggatggccagagctcaaagcctcccagcccccaccagggccttagaggttggacaaggctgcaggaagcttctggaagcagagggctgggtcctccggccccttcctcccccagggctgaggaaacccaagcagctcttccttgctccctagtagctattgcaaagggaggtgtctgattgacctcccttttatctggggtcagtcaacactaggaaagtgtggccattatcaccaatgccatctgcttttcctcctaggcaagccacgcagccccccagcactgcccttctggcccttctaggccagcagtgccccctggggatctggccttgaggcctgaggctggcctgttagctccacccccttgggaatatttcttctctccctgcgccccagattctccagctataagatgagacagagtccttccccacagagtcatgctaaggctgaaatgagatgcaggccctgggcaaactgaacgcacaggtggactaggggagggtcctccctgcctgagtcccaacctggctgcccctcctcaatggatgttaacaccccactcaatggatgttaagccagcgaagtatgaacacatccgtttcaatatta

SEQ ID NO: 108410 - DNA, 1373 bp, Homo sapiens
gttttccgctgaggctcagttttagcagatggcctcaggcctcccttgactgtcctgtggtgtccaagttaggtcaaaccaccccatcatggctggagtctttcggtgcccacttctggccaactgtactcagtttcttggtggaagccagccaagagtagaatgtttccttctggacactgggcacagggaagctgtgtttagtcaccccgcaggcagctacttccaaagtacctggccctgggttcactcagcatctggtccttggggcagccgatgggaccgttgcttgctggtcccagcagtctattctacttccggaggctacaagcttctgaccatcccaccatagtcacctggaggttttgctcctgtttggtggcctctcatctgtcaccttttctgatggagagtagtgggtcagcctcgaatcactccctgggagctctcgccttcattcagctctgctgtctgactcttgcagctggaaagcgaaatccagcggctctctgaggcccatgagagcctgaccagagcctcctccaagcgtgaggccctggagaagaccatgcggaacaagatggacagtgaaatgaggaggctgcaagacttcaaccgggatcttagaggtgagagccagtcacacaggtggaggttggagaacctctgcagaggacttacttcttttgttctagagaaaaattgggaatctctattctctgtcaaaagtgcagatgaactcagagagccaggctgagacccctttggagctgccctgatagagagatgcttgtctctatgtactgggcctaggatcccctcagggatgatggctcttgacagaggaggctcccacccatggggccctgagctgagctggggtttccttatgaacccatccccaatatggaggatacagccccatcctgataggacgtcaggaaaaatcccaagctggcagcttcacctgacactaaaacatctttccttcccttgaaacagagagattggaatctgcaaatcgccgcctggcaagcaagacacaggaggcccaggccggcagtcaggacatggtggccaagctgcttgctcagagtgagtaggggccccactaagaagcctggcctgtgtgcaggcaatgggactgctgcacaccctctggactaggaagattggccttcccccttgcaaagtagtactttgggagcaggtttactgcccactgtatgcccaacactagactggatctggggatagtggggataagtggcttccaaagaagaataggatctagttctgtatcttttaagaagatcagctgacacaagagggaaagccagggagcagtgatttgctgagcttcggtgctgacc

SEQ ID NO: 108411 - DNA, 1050 bp, Homo sapiens
ggccccagccactgtgaggcgggtatgaaacaagcatcctgacattaatcccctctagccctgctgtctgactcttgagagcctcaggcagaaacatttggaaaaggccttccctactggtccctgcctaacactagagggttgaataattatctgcagtaattttaataatatattaattattgataataattaaccatcttcccagtatgcctaggagtggggtgaccccgggctgctctggtgggagccatgagggtctgtgctgtctctgagcaccgtctcttctgttccccaggatcctgcaggcccaggtgcctcctgtgttcctccaacagcagcagcagtaccagtacctgcagcaatctcaggagcacccccctcccccacatccagctgctctcggccatggccccctgagctccctcagtccacctgctgtggaggggccagtgagtgcccaggcctcctcagccacctcgggcagtgcccacctggcccagatggaggccgtgctgagggagaatgccaggctgcagagagacaatgagcggctgcagagggagctggagagctctgcggagaaggctggccgcattgagaaggtaggccctgctggggcttcagaagggcagaccagaaagagaccccgaggggctacctggggagtgggtagtccaaggagaggcagaggagcctgaaaactgtttggctggatttctccctatccctctgtcttccacctccctcactcctcatgcaccctcctgagctgactccagacagctggggaacagccgagaggccggcagagcaggcctggagcatgaacagttgctggccagtggtgattagaaagagcccattcaccagctccttgcacactcgcacccttgccctgcacacaccccctcccatggacacctcccacagagagccctttgtgtcccccacacaacagcaagtctgttccaggccagccctggccaaaaagaaaacttctcctcttggaaaaaaaatgggcgacttgttggaatcacaggccagcta

SEQ ID NO: 108412 - DNA, 1844 bp, Homo sapiens
tgtcactgacccacggtaccgtgcccgcggcagcccgcacttccagcatgctgaagtcaggtaactctccccaccttgggctttccaactcctggctttcttccagcacaggtctctcagggaggagagcctcaagatcacagcttgtgtcagagctagcaagatccaccccacctccaacctgagaagggagagctaatgcctggcagagaagagggacttagctgaggtcccctaagaagttagtggtgtcccttgccttaattcagagataggcaccattgtctgcttagctgtagcattcaagtaactagagtccccagagtacacaaattgcagcagggggttaaaggttagatttcagaaagaacttcctaaaggcaaggttgggaatgattgccaaactgtttccaagttaagcaggaagaaggtgggacttccttctctggagattttttaagaaaatatgagcagcttgctttctgtgattattgggaggcattcctaactagaggctggaaaggcccagtggtctgattagagacctctcagcatcttacaccagggcaggagcttacttgtctctcctcttcatttcctgccatatgctccctgcgtctgcagcctgcagtgggaaaggattctgggtccaagtgggcccttttctggtgaggctcaggagaggctgctgggccatggtagggacttagagtttgattctgagtgtgctgggaggccctcaggggatgtgatttggtttaccttttctaaatgctctctctggctacatgcagagcatggtttgtaaggggccagaatggaagcaggaagacccggggaggcaagaagtctagagagtttggagaaataagtgttcctagaaacaaggccctgcctcacgcttctcatcttgcccagcatcttttccagagaagcagacacagccatcactgctgcatctccccctatgggagtccaagaaaccccaccaagggaccccaaggatttcagactcttcctctggtggcccaaggtcaaagtctggttctcttcatgcctgctgtgttcctttagtaaacacccactttcccaccgtccggctttccttgctctcgagaaatgagtgacatgatggggttggtatggcggaaccagaggttggagcctcatagtttttctccagcctccacccctccagactcgcactttatcgcccctctcagggctcggtcaggaagagtttcggaagctgagtggtggtttcttcttttggaccagccttattgaaccctgtcaggaaaagatagtaatcacggcaaggaagtagactgtttgcaggagaacaaaaagcaggggagggagaggacgaggagaaaggaaagcaagtgtgaagggaaaggagttgctattctttctcagagctaagtcatccccaaagaatgccagttgtgtctgcctggcccagtgcaggggggagcaagttcttgaagcaaccttgagaatggccattttagcagtggaatggagagtttgagcactccagtggggaccctcttcccagctcttactggaagccccaccttaggtagtaggagaaatacatctgcccaatatctcctttcagatgatccagtgaagattatttgttaggaaacgggctagactcctagcctagggtcctgagaagagcaggggggccataggctgcatggcagcaagagtcaggggcaggctgggtgtgcattagtgctgagatgatgcacccagaaggggaattcggtttttgcggggcttctgggacttggaagattctttgtgaaactgaggcagttgtgacactggga

SEQ ID NO: 108413 - DNA, 1149 bp, Homo sapiens
tgcgggctgatttggttaggtgggggttacaggtgcctttgcccccaactagtccaagaattcctctttgtcttccttggaaaatcctctctggagccacgaattggccctcacttagaaagaatgcagcctgctgtccagcccggtgacgtcagcgttagagtatttggaaaacaaagagggctcgagagggagggaggcggacccgcgatgcttaaagacctctccgggcctcgggctaccctcaccggctcgccccaggcgtaccagcggccaccggtgctccaggtccgcccgggctcgtggtggggcgggagccctggctggggtgccagaacctcctagcttggagactgtctttggttccttaggcgagcaggagcccaggccaaggctggagacgcgcgctggcttagaaaggcggccttcagagagcgcagcgggcgagtgcagcagaggttcgcggccgggggcgcggaagcaggtttttgtaaaggcccaggcgtttgatgtctgaaaggacgtgaatctgaggggcttggccgggacaaattcgcgatgagaggccttggagatgttccttgctcccagtccgggcacactatggagcgcctggaatctgtcaggaaggctccgcattccttcctgccgctcccctgccttctctgtgggagtcggcccagagagtgattatcataggaaatgcccgcagataaaactccagggcgaactgaatcccatacgaattgaatcccatttgcttgctttgcctcgggtagctctggagtcttgcacatctacccctcgttgtgtgtggggggcgcatgactgggtgccaggaaggatgggtacagaggtgccctccagactcatcccccactccccagctctgggcagctggagtactggggtggggagagggaaaagatcgggaatggctgctctgccaacatgccatagcccaaactgaagcaggacactagggctagtttagtggcagaggaggggccacattcctcccacccacccccccaacccctgcccatacacacaggacctgtggcagtgtggattctgtttagttttccctggatcccagtttggagatttgtgttggaagaggctgtggaaaggaagctgggtgagaga

SEQ ID NO: 108414 - DNA, 1043 bp, Homo sapiens
atggttctccaggctgagcacggtggctcatgcctgtaatcccagcactttgggagatcgaggcaggtgggtcacttgagcccaggagtttgagaccagcctgggcaacatagggaaactcttcctttactaaaaatacaaaaaaaggttagtccggcttggtggcttttgcctgtagtcccagctacttggaaggctgaggtgggaggatcgcttgaacccgggtagtcaagggtgcagtgagctgtgattgcaccactgcactccagcctgggtgacagagcaagaccctgtctcaaaaaaaaaaaaaaaaaaaaggctttctgagacagcccatttcccatttccccacatcctcaccaatgttgaattttgtcagtctttttaagtgttgactttgtaatgaatgagaaataatatagcattgctggtttagtttgaatttctttgattattagtgaggtgtcagagttcagctagaaatgacagaagccactcccttagtttatgtagaaagtgatttaatatagggaattgagtgtttaacattttgtcagataaggtagaatagcaagttcaggatgagcttcgaggactgattcccagaactccagctcagaacggacccaccaagggagctttcccttccctcatgacctggaagctggggatttgggaagctgggcccccaactgctggctcggcaatcagaaaccaggaagcctcagccatatctggtctccagaaccatactgcctcagctgtgtggtagatgctctacgtcctggccacaacgcccacgaagctggagactggatctagacactgaggtctttgctgttgttaatgcagggaagaaaccaaaaacaaacaaaaaaaaaaccaaaataaccccaatcaaaacacaaaaaacaaggaccttctcaactctgtctgccagtggagttagtaggtctcttgagggtacaaccaatcaagagaaaccaggtcacagagaaaccagctcagctcttagggagccaggaagctgcaggctgtggctt

SEQ ID NO: 108415 - DNA, 1049 bp, Homo sapiens
ctggattacaggcgcgagccaccgcgcccggccctgtgagccatttttacaaaaacttccacctgccttggcccaaacctcagcgttcttaggcacaggagctcatgaacatactgagataacactaaactggactatgcgaagggaccaactacagacctgacacaaatcctcaaggcaagacgatgtctgaagttgagcttgtaaaggaaatggcttccttccttaaaatatcacccaggctgagctctgaaaaaagcacctccagatggtgggttccaccccgctccaccaccccaaaattgcttattgtgtgagtctccatagtctcagaaactgagagtacctttgatgccagtggcttccgggctttttggattgtcacttggtagcagggagcacccataggatgatgcctatgatgagtcagggcccaaccttggaaacagggaaatccagaagtatcctacaagctagccagccttttggattagattatagcagtttcagagaaaaatggggaatcagccatggtcaaggagctaaataagcatcgtgaccatttgggccagaaattgaagggagtgtagcgttaagaattagaggaaggaacctccgaggaaggagctaccccaaagggaagcagaaactggagaaactttagcagtatgaggttctaccactggtgttcacctagaagtgctttattcagatctcagcctgggtactattttagggaaggaagccgtttcctttacagtatgttcgtgtgactcctgtgcctaagaatgctgaggtttgagccaggggctagaaaggaaacttagctggccattatgaatcagggactcatcaaaggcatcacaaacaggaaaaggtgaatgttcaagttagaagagaagagctacattgagatgcaacatattaatatttgagggcctcgtttaacgtgttgctctcctgtcacactctatgacactggtctgtcagctgggctatgcctgtccagtatacactataaaatatgtatcagttggggttggagagag

SEQ ID NO: 108416 - DNA, 1036 bp, Homo sapiens
gggctgccgtgtcctggtctggaggcggcccaggctgccttggtgattctggcttcgcggcctcatggcttgcggccggtttgcgcaacggcctgcgaaccaccaggcgcgtccccgccggcttgggtccgccccgaagcccagtccctcggcctggcccgctatgccctgcacactggcggagtctggcgtggcgcagcccggcgtggggttcggccccgccaggtggtcagcccttcctcggagtccaggtggctgggggcgcttcggagagtggccaggtgggcgagcgagctgcgcccagtactcaccttccccggcggacccaccttccttttcagcggagagaccccagtgcggcctccctgccagggctgctgtctagctagcgctgttgggactacttcattcacggcacaaggggacccgctcatttagtgtggcatgttaaggttggcagcttttaaaatagtgagttggtttaaacggttatgttagtacaagaggtacggaaatgtggcataaatcgtggactgaaattggagaaccctgaactaacggctccatgcacacaaatgagggatagaaagaaataaggacggtttcttaggaacactttaatcatggagatacttgaagacagtacatttaggcttataatgtggtttttcttacgtcccttacgacatcaggagagtaaagatgagtatgatgtcagagacaggtcgtcttttacagtttcagcaccgtacgctgatatgcacagagtagttttccctgagccttatgtctggttaaacttattaaaagaatttattattttaataaagcagtattgtagggtagatgccctgtatttatacagttcctcaagtgcttgcatttattttttagatacgaggaaatcataaggatcgttgattagatttctgttagctgtagcttaatgataaagtgtatatattttcttatttggcatgcagtaccatttttagattgatttttattttgagtttgctttttgactgtggcatta

SEQ ID NO: 108417 - DNA, 2046 bp, Homo sapiens
tcttaatatgagcattaaaagtaaaagctcaggccgggcacggtggctcacacctgtaatcccagcactttgggaggctgaggctggccagatcacctgaggtcaggagttcaaaaccagcctggcctacatggcaaaaccccatctctactaaaaataaaaattagccgggcatggtggcgcatgcctgtaatcccagctactcgggaggctgaggcaggagaattgcttgaacccgagacgtggaggttgcagtgagccatgatcatgccactgcactccagcctgggcaacaagaatgaaactccatctcaaaaaaaaaaaaaaaaaaaaaaaaagctcagcaatcctattctttgcttctggtaatttattaatttacattaatgtcatttaattatttacttcaggtagatttacatctgctatatttttacatgaaaaagatgaaaagccacttgaacatatcttctgtttttttaatgatctgttcttctttataggggatttttgacatcttgtgaagcagaactacaggagctcatgaaacagattgacataatggtggctcataaaaaatctgaatgggaaggacgtacacatgctctagaaacttgcttgaaaatccgtgaacaggaacttaagagtcttaggagtcagttggatgtgacacataaggaggtaaagcaatttatttgttcttctttttgacatttttatcttgtcttttatattaaatgtgtttcttaagtatttgttgaagaaagaatttgtataccaagttagtttattgttttttattataattctgctgttttattttagaagaaaaattcattgtgaaaatgtataagaatgttatcatttatttcaaggatcattttaccttggttacatataatatatacataacttctttaagaaaatgtaaaagggtaccacacattgtttgtttaaccttcatcatattacatgtttatattaacattcactgagtttcatggaaattgcttttggcttcactgtatggctggtattacaaaagaagttccagattaaagaatttgcctcttttggttagatttaaaacaaagttaagagaatctttaaaaaaaaacaaaacaaaacacgtttaccatgttgaaaattagaggagaagaaagaaaagaagaaaataaaaattacttgcagtcccaccactcattgatattggtaatttgggggaaaagtttaataatatttgctggttgccttctcataaatttagctggtaaattaggaggaagtacacagaatattggaagggaagtagaaagcatttatgtgtgagagttgcctgttaatttttggtatggatgtcaatctcagaaggattggaagagttagagttataggggagcactggtcccatttctcactctgaagaccttttctaccagtagggtcaccattcattaaggctgtcatcagcttattcaggtacacttctgtgagtggtacacactgagattgtgattttgttgagaaaacttattaagaatagtttagaaatgtttctcgtaacaaagagtttgacttgttaaaaatgttattatgcttacccagaaaatttctccttggttggccatttgcaacttgggtcaaagtagtgcgtggcaacactggctgtatcaaagttttctgctaatgctgtttgctaaattgcaattaatttaaaatttgactaaaactttgagaatatattttaaaattacacaccatgcgaaaatacagaaggtgatgcaaaagtacagtgaatggtgatcttgtttgattttttaaaaatcataatttaggcagggtcaatgttccttttatggtaggctacttagctagcactttgtttctcctagggcaaaacaaaattctgtttagcaagttgaaatgaaagtggttttctggttgataaatagattgtttattttgttagaaactcattaaagaattatgtgtgattatgataatatttagtcactgtaatgctaaatttgaacttattcctgtggc

SEQ ID NO: 108418 - DNA, 1044 bp, Homo sapiens
gtgtgaccaaaatagtaaatcagtgaaagaaggttatgttctccattcttcaaaactgagaagtttattagtatttagcaaatctagactcactggttaaagtatgccttggtttaactattagtttattatatcaatactgagtttaagatcacagatttgagttgatagtgttaggtagctattacagtattaaaaagatagtgttttgcaattatgtattatctgagtgcccattttggcagtgggtttctagttgtgttttgctgagacccagggctgctgtacagattaagggtaggactaagggacatttcagcaagctgggctctaacccttttctccttctcaccctcacccaatatctgcatttatttattctgcacaggaaacctttcctctttgaaagaaaagtttatattatatttaaaagtttggagacagttccatgcttagcagttgttctagtgaatctaaacctaaatgttgatgttcttcctttataccattgtagggatctggttaaaaaaaaaaaaaggctctttgcactgaaatcttgatcggtaatttatacaaacagtatttgtctatctcttcacctctctcctaccctctctctggcttatgggaagtttttagcatctactttatttgactacagtatatagtacaggatttggacctgtactgtaaataataaaatctttaaatctgcaatagatagatttcccagagatatttctacttgtatttctaaagtaaaattgtgtgattttacctttagaaatatttcgagtaagggaagtttacctctacagattatttatattcatcttcaatgtgtagatgaagtaccagccaggatgctggattaaaacttgtaaaaactaaaaagtttggagctaaaacccaatactgctgggatgcatagcctaaaacatagtagtcagtaaacgtatcattcagagaaaccagtttgagatgcattatatttgtttacctcttttaactcaggaagtgtccaaaaactgatgacagaaccaa

SEQ ID NO: 108419 - DNA, 1714 bp, Homo sapiens
ccgcaccctgccctaagttcttatttcattgagaagacagaagcaattaaaggagaacctcttaatctttctgtcatcaaatctaccagtctgcccatacctgtgcctttctgcacttctaagaccaaccactccacttgtgtcctttttctgtagttatatcctttctcttctgcatcatcaagttctttctgtctgctgaatctatccactggtataaaatacgctgtaacatcacccatctgggggaaaaaccatcccttaatcctatgtctccgtcaagttatttccacatttctgtacttctctttaagaccaaattcttcaaaagagttgtctatactgactctacttctttacctttcacctgtttagcagcccttcacttaggttttcctccttgccacctcagaagcagggtaggaaggggtaacagttgacacatggtgatcctttttgttctgctgtggtgttgttacttccttgggtgttaattgaatcctgactaatgctataccatacccacctaaacacttgtcattgtcgtacttatagaattttttttggtttttcataacctctcaactttttgattgggaagagtgtgatatcttgttttaaacacatgaatcatgatcatttgtacactgacattttctgtatgtaaaagataaaattgcttttaacatgaactgttaacctttaggcaaacaacaagagaaatatcattttacactttttaggttatctttaagtaatacattttttgtttttacatttatttctggttttggaaaccagtaagtattttcttacttttatctacatgttaaatacacaaacatgcatacacacacatattttctgctttattccttttggaatacttggagtacttgagatagtctttgttattattgaagtatatgtgtactcttccgtttgactaaaattaagtttattatttttgacgttgggacaacagtttacatttttatcacagtttttttattgattggctttttagtaatattttaaatgactgaggtgatgtttaagatattggctggatattttttggatatcaagaatgtaaattagatagtccaatttataggtttcaggattttggttttaagtatgggatcttatttttgtcatacagtttggaatctgtgagtgcaacgtgtaaacagctgagccaagaactaatggaaaaatatgaagaactgaagaggatggaagcacataacaatgaatacaaagcagagattaagaaggtaaaaatctgcatacctaggattgcaaaattgtatgtgtttatggacaaagctgtggattgggagattataggggttatttttaatgagaaaaaaatgtagttcaagggaccacttgatatttaggagtggaagagtttgtggaatgtgcatagggaaagtgccttctttctttggcatcgcccctgatgcccaataaatatttttaagataattgaaggctgtcccctttgaactcaaaaactttattttaaacatgttttgatgaaaagttttctaaaagacatacactctgttgcttgcaaaaaaatatgaactgtcacttaatattttcttattgcctaaagatagtatttatgtattgtctcctgtgctatgatgtagttagtatccttgtcagctattgaggtatgcagagctgtttgtgtctatat

SEQ ID NO: 108420 - DNA, 1033 bp, Homo sapiens
ttctgcagatttaatttaagagaaatttaatgtcttgagataaggtgaacttttattttattagctagtaacatattattctatctaaatgctttctcttaacttttggtgctttcttttctgcttctttatagttgaaagaacagattttacagggtgaacaaagttacagttctgcactagaaggaatgaagatggaaatctcccatctaactcaggagttacatcagcgagatatcactattgcttccaccaaaggttcttcctcagacatggaaaagcgactcagagcagagatgcaaaaggcagaagacaaagcagtagagcataaggtgaagcctgaacaaaaccttttttaaatttgaaatttgttttaaagatggagttgattaaagacataattttcataatatttaattcagtgaatttttattagatacctgctttgagctgagagtatgctggctagcaaagagtttagtgagcatggtggggaggtgagagtagacacagacaagtaaagtgactgtatcagtggtgtatggtgagagtcactagagatcacaagcagcctgaatctagaccactcgctgcaaaggccttccagaaggtgtgatagcaaagctaagttaggagcaagctgggtgatggggaggaaaagtgtttcaggcacaggaaaatacagaggtctctaagagagagtagaaacacgcttgctgtggttgaaactagagtacaagtgggatgagtggaaggtatgagactggaaagcagggactggctgctgaagggctacgttagccacgtaaaggagttatactgtgaccttgaggtcagtagggaatggctgcaagcaggagtaaaattcagtggtccttaaatggagaataagcagggagacagagcacccagatgctgttacagtggtaagatggtggcctgagcagtgggcaagggaggcagagggaaatggatgaattctggagatactgggctggtaaaaatgactgggcattgtatttgattggcaggg

SEQ ID NO: 108421 - DNA, 1264 bp, Homo sapiens
gcctcagaatcatggtgggaggtgaaaagcatttcttatatggcagtggtaagagaaaaataaggaagaagcaaagtggaaacccctgataaacctatcagatctcatgagacttattcattatcaccagaatagcacggggaaagaccggccaccatgattcaattcccttggcgttggtccctcccacaacacatgggaaatctgggagctacaactcaagttaagatttgggtggggacacagctaatccatatcaatgtccatctagatattgtctttgataagctgtgttgcttagatggttgcagttggcatctgtgcctggatcttggtgggtgtgtgtgggggggaggaatcagggcacagcgcaggtcttctggtactcccttcataggctcaccttccagaggaagggccagctgctgctttttgtctttgggcacttctacaacttcttctctgtggactgtgtcctgcttacccttggcctggggccatgttgtttcttgagctctggctgcttttatccatctggccaggtgcagacttacgacatcagaggaggacactaggatttggcatcaactttgagcgtggaagaacatgtggggggatgttgaggagagaaatccctcagcatcctagtcccattggacagtggccagtcacccttggagccgtggcagtggaaagggctgagcaggaggatgaggaataattgcaggtggcttcattgacggtggcagcagagagaataccttatctgtgaaaggcagctgggccttgcagttaattgttctgttgttttcctcttggtatttttccagcacatcaacataggacctttgcccttggctttctcattgacgctgaggctgaagccgggaggtgagctggggatgggggattgggaaggggcctcattccaggtggtttcacgtgaattcttggtgctgaactatctgtgcaggttcctccagggctgtctgctcctgggggccgttgtcacaggaccagaaagcccatccggggatgctctcagctcctttgacaatgcctccaaatggtttgggatggtggaatgcaggctgtaaactagatggcaaggaacaaggtgtcagtatcagaaaatccaccgcattttggacaggtgctcagaggccgggggcaggcactggtcagaacacactttgggtgtcgaaccataatgtagtatttggtttaatcctggtcacaccacaggtgtgaatccgttgctggc

SEQ ID NO: 108422 - DNA, 1048 bp, Homo sapiens
ttggtttctgggtctgtcacacacatgcccacatggatctgaatgtggaggcccttgtgacttcaggctttgctttgcttttctcactggctctgtttgtcttttccctctgcatctttggtcaaatttgtctactctattttctcttcttttcctccatttattccgttctcttgtctgtcttctctctagacttgtttcgaaaagagggaaaagaaacatacatttcattgatagaattttaatgagtgaatggctatttccattcattgtttttattttgtctctaggagtctgtcttgatgcgaattgcaattttaaaaatgaactcttttaatagtaaaatacaggaaatcaatgattatcattgaatcaatagcaaatattacaagtgattttgtcatcaaaatgattaataatcacacattttgataaaagatcattaattaaaaagaacagtagcttttaaaaattttaaactgtctttgtaggatgccttccttcttcagtctcattatttttctggagcattctttgcttccttcaccttcttcagccccattcttgattactcttggcttatgagaattatttcaagcctcccttttcttctaacatattttgaatctttcattccagatactcattaagaaccagtagccaaagctgttcattgttgaattttacatacctgatgagagtgactgcttccaccttgcaggatgacatgttccttcccctgctctacctaccctgcctatctctgcctacctaccctgcccacttctctaagagtttcctctagggccaggcgaggtggctcatgcctgtagtcccagcactttgagaggccatggtaggaggactgcttcagccccggagttcgaggctgaagtgagctatgatagtgccactgtactcctcccgcctgggtgacagagtgagaccctgtctctaaaaagaaagagaatttcctctaataaaaacaattattttggagagtgttttatctgtggagattgattttttcagtcattttctctctgac

SEQ ID NO: 108423 - DNA, 1056 bp, Homo sapiens
acttgacagatttataaaatgtatacatgcacagggaccaagaggcaggctggttggacaatgggacacaatttgaagttgtggatggacttctcatttcagtcctgtgagtgtatttcactcagtgtgaatttgaggcctttcttgaatgggagcaggccaaatggccgtcctgccttgctgtgacaaccctatttggacctagagtctgggtgggtgggcagctctgacagagttatgtcccttgtgttcctgcacatcccaggttgggcctcagctgcccatctctggcccaggggggttggtctggcttcccttcttgctccctccacagcctggataggtgttccagcaataaggcattggagtctgattcagatcatagataaatctggcacagttacttacctttcttgggtgtggggaatgtgtcctcctgcaggagctccagctgtggcacaccctgtagtctcaggtgtgcagccctttccaagggcagacacacaacaacaggattgctttctctggctgtgttcactggctcccttgccttcttcagggatggggacagtgagaacctgatagtgaagggcagggttgaccaacaaggtccacagcaagtttctggctcagcctggaagagatgcccctgcttctttaaccaatggtaggtctggcagtgggagaggaaccgagcagaagcactccttgtctgtcttctagtctttttttttttttttttttttttgagatagagtctcactcccgttgctcaggctggagtgcagtggcatgatcttggctcactgcaacctccacctcctgggttcaagcgattctccttcctcagcctcctgagtagccgggattacaggcatgcaccaccatgcccagctaatttttgtatttttggtagagacagggtttcaccatgttggccaggctagtctcgaactcctgacctcaggtaatccacttgccttggcctcccaaagtgctaggattacaggcgtgagccactgcatctggcttgtcttctagtcttaaaaaataaat

SEQ ID NO: 108424 - DNA, 1040 bp, Homo sapiens
gttcttcaaagttatagccatatgtcatttgcctaatcacccagagtctcttccccatttaagtttttaaactcaactcatcaaagagagcatccagatggaaagaacacagccatctagtactttaaataacagcaggaaaagcattgcactgattcagcaacagtctgagatatgtggggagcttgtccttatacttagatagcagttgtcaacaagcatgcatttccatcccccacaattatttaccagtctgtggctccctcaggagtttggaggaatacacaaaataaaattattcaaataagacgagagccagaaagagttttaaagatccatgtggtccagcatttcccccaagaatgttctgagaagcaccagttgtgggaaatgttaataggttctccttggaaaaaaggtcccactgtcaaataaatttgggaaatattgtgtactttatcaccctcttggagattcactgctcatattagcattataaaggccatgagaaatcctgaaataaaggaacccatttaaaattattaaataccatagaaccatatttttgaggggcagggttttatagaactgtagtctgggaaatatttatctggttccaccccttccattcagcagattctgaaattacatgacattggtcctcacaggtggcaaagctgggacacaagcctgcttttctggctgccagttcaatattctgctacctgtccaccccagggcctcagtggttcccaggctttgctgcacactggaatcacctgagggcctttaaaaaatattgatgcctggttctcactcccataccttctgattagttgtggtaagatctgagcataagggttttttaaagctcctcaggtgattctaatgtgcagcaaagtttgggaaccactggattaaggttggtaagggtaaaatttcaccttctacactcacagaagctcagataatcctaccttggaaattaactctacccttcaaacacacacacatacacacacaccggggggacttcatgg

SEQ ID NO: 108425 - DNA, 1028 bp, Homo sapiens
tccctttatcattatataatgactttctttgtctctctttacagtctttaatttgtagtctattttatccaacataaatataactactgctactgttttccgatttccagtttcacagaatgacttttaccaccccttcactttcagtttgtatgcatctttataggtgaaatgggtttctcgtaggcagcatatagatgggtcttgtttctttatccattcagccactgtattccttttaattggaggactgagttcattcacatttagtgttattattcataagaaattacttaactactgccattttgttgcttattttcaggttttgtaactccccttttcctttcttgttcttattgtcctcctttgtggttaagtgattttctctggtagtatgttttaattcattgtgtctttttttcttgatagcattaccctttatttagcaataggaatatcctttatacagaactagtgatttcacatgctttattttcaaaatcaaaatgctcatccacatacttcagaggaccatgggttcacaattcattctaatgatggtgttttttcaactatagtccacaataaccacatatcccagtttttgtttctttgtctatgtttacacacacttttgggtagccaagagctccccaaccagttacacaatattatccaactctctacttcactcataggttgctctgtcatcaaatcagtggcaaagtttacattcacctctttctgacaacccacaaactgaatttttctggagtctttattatcatcaacctggctggcatgcatgaccttctctccagttggcaaggcccataccccaaaacacctggcacctgagggcaggctcaacaccactatgctgctccagcccacagctggtaaatcattgctgctgccatcttcaattgctatttttagtgactgtattacaggttttgcatatggtggttatcatgaggcttaaaaaaaatcttatagatataacaagttattttaaagagatg

SEQ ID NO: 108426 - DNA, 1050 bp, Homo sapiens
tacacagacaaacctagaatacttaaatactataattgtagtatgcaattcactcataactctagtatgaagccccaaagacaaatctattaaaaaagaataatagtaactaaccgcaggctgttaagagatacataatgtaaaactatgtaaattgagacaactaaaagtcaaaatgtgggagggatggagttaacatgtagagttattttttatttttccttaatgtctattcttttattttttatataagttgtcatctctttaaaataacttgttatatctataagattttttttaagcctcatgataaccaccatatgcaaaacctgtaatacagtcactaaaaatagcaattgaagatggcagcagcaatgatttaccagctgtgggctggagcagcatagtggtgttgagcctgccctcaggtgccaggtgttttggggtatgggccttgccaactggagagaaggtcatgcatgccagccaggttgatgataataaagactccagaaaaattcagtttgtgggttgtcagaaagaggtgaatgtaaactttgccactgatttgatgacagagcaacctatgagtgaagtagagagttggataatattgtgtaactggttggggagctcttggctacccaaaagtgtgtgtaaacatagacaaagaaacaaaaactgggatatgtggttattgtggactatagttgaaaaaacaccatcattagaatgaattgtgaacccatggtcctctgaagtatgtggatgagcattttgattttgaaaataaagcatgtgaaatcactagttctgtataaaggatattcctattgctaaataaagggtaatgctatcaagaaaaaaagacacaatgaattaaaacatactaccagagaaaatcacttaaccacaaaggaggacaataagaacaagaaaggaaaaggggagttacaaaacctgaaaataagcaacaaaatggcagtagttaagtaatttcttatgaataataacactaaatgtgaatgaactcagtcctccaattaaaag

SEQ ID NO: 108427 - DNA, 1035 bp, Homo sapiens
tgccccaggggcgcccgcggaggagggtaggcgggggcggcctgggccctcccacttttcagggctcctgggccagttcgcccgcacagccctcgggaacttgttaacaggaaagcctggcagagaaacaaatgccagcgttttggaagaactgagagtcacgtcgttaggcgctgaggctttcttttccttccccgccccctgcccaacctcggcccgacttggccaaagaaggatgtgtcaccagctccgggccgcggacgggattcccggcccgccaggagccggggtacctgaaacaaaggtaaacggaggccgggcggcccctggtcctgcaccgcggccgcgctggagcgcctcggtgggtctctcccgcgccgacctggccgccgccgccgcggaggggcgttctcctgggggacctctcgatggaaaccagctggccgggcttggagttgatgttgcatccgaactctgttgtgctcccgttattcccagtcctcccactctggtaaagcttaaggaaattttatccagtcttggtggtcagcaaatgtaggggaagacaaattattgtttgtaaattataaggtattttctaattaggaaatggcctgaaaacattaaattcttaacacgtaagcaaaaaaagagtaattccttccaacatctgaggaagtattcctcctcaaatcttcatttatgtacaaaacatcccccacacctttggtgccaggcatttttctttgttcttccttagtctcaggccttagtttcttgtaaacagaacccagcgcctagaccctaagaattgccatactaggtcagagcatgggcgtccagttcagtaggcagccggcttgtgttgtagtaaaactgttgtttttttttcttggtggtatgttaaaaattatctcagtttctttcagtagtccatgaaagccttttaaaaattttctaagccactgctaatttacacacacaatttatttacatttattgcatccaaatggcccttttatcacctctggcaga

SEQ ID NO: 108428 - DNA, 1514 bp, Homo sapiens
attctctgcatttccctctcaccttattggaggtttagtctttttgctagttcctcatgatcttcctgacgcctaaaagttggagcattacatggctcattaatactccattcttccttattgactcttatttccttggcatttcagtcagtctcatgactttaaataccatctatacaccaacaactacatgctgactaccaaatgtatatctccaagttaggaaggaaataactgcagtaacgtcttttccttgcttatgtccttctctgacggcctattcccaactcagcagccggaggaatcttgttaaaagtaagttatccactcagaggctttacactttcctacaaggcccctacataatctgaactcctctttgtctttctgacctcatctgttactgctcttccctgtgcttgctttgtcccagtcaaaaaggggacttttttcttcttccaacaagccaggtatgttccttccacaggacctttgtttctcctagtaaagcttcctccctcgttctctgtctcccttccctttcaaactctgcttctcagcactttggggtaaaagggaggggtatcctcccaccccaaccccctagactgagcactaaggctatccccttcctcttgtttgtttattcatcttacactttcatttgaacagagttcctccagttgaaaaagcagcttgaaaactgcttctctgtgagattagaaataaaaagcagagattagtggttgtgaatggaaatgtcattaagggcttaggaatcctagcaagggccacttatcccttccattttgtagatcgtaggcatatttcctattttacagccttggggattgggccccagaatactgctgttgtgagtactgatgtgctcctaccaatgccaagtcttccatcaagcactgtggcccagctgttagcattttgtcttctctcaacatgatacatcttggcagtcttggtattcttctagtagaaggttgagacccctttcccatggtgggccctcaatgagtggaggctcactgggtgctggcagcagtattgagatccaagtattaaaggcaattgagggttctgtgtaatgaagagtgtgttgattctactgagaaatgccccaggccttaaaagggcaaacaggccacatctagtgacagtctatctagatagcaagtttagacacttcatcaggggcagtgtttctcagcctttgtctgcaaacctacaggcctttatgtgggccctctggtgggttcatgttattaaaatctggaatggtgtctgttctgatttgttgttttagaagaaaaggtattatttctaagaattttagccaaacaagtattatataaatacagtctctttgctttccttttcctagatgagctgatttcctagataataaacaagtagataaattaatataatttcagatagtagtaatagtgctatgaagaaaataaagtggagggcttttcccctgatgctgaacactt

SEQ ID NO: 108429 - DNA, 2720 bp, Homo sapiens
gtaaatttatgagagcaaatttccatgttatagaactgttgaagaactaaaagaggatattctttcatcaaaataattctgcagtatcataatattactaaataaaattaaaaagcacaattattaaattattaaatttgccacacatgtgcagcagctactgtatcctgatagtgaccaaacctcaaatataaatggtttcccttcatgggaaaagccattatatttggaagaaaccactgaacattgttattaaatatattttcagctaactgtcatttaggagaattttcatgaaacaagttctagaaagttccaagtcccaccagtaagtggatttgatattatggcagcaacttacagacttgtggttagtactgtgaaccactacagcagcgtggtgatagaccggcgttttgaacaagctatacattattgcactggaacctgccacaccttcacacatggaattgactgcattgtggtacaccatagtgtttgtgcagacctcttgcacatccctgtgtctcagttcaaagatgcagatctgaactctatgtttctaccccatgaaaatgggctttcttcggctgaaggagactatccccaacaggccttcacaggcatacccagggtcaagagaggatctacatttcagaatacctacaacttaaaggatattgcaggagaagcaatcagttttgccagtgggaaaataaaagaattttcctttgaaaaactcaaaaactctaaccatgcagcttacagaaagggaaggaaagttaagtctgactcatttaataggaggtcagttgatttggacttgctttgtggccattataacaacgatgggaacgccccatcctttggtttactgcggagttcctcagttgaggaaaaacctttgtctcatagaaactcactggatacgaacctgacttccatgtttcttcaaaacttttctgaagaagacttggttactcagattttggaaaaacataaaatagataatttttcttctgggacagacataaagatgtgcttggacatcttattgaaatgctccgaggatttaaaaaaatgcacagacatcataaaacaatgcataaagaaaaaatcagggagtagcatcagtgaaggaagtggtaatgatacaatttctagctctgaaactgtctatatgaatgtaatgaccaggttagcatcctatctgaaaaagttaccatttgaattcatgcagtctgggaataatgaggctctagatttaacagaactgatcagtaatatgcctagcttacaactgactcccttctccccagtgtttggcactgaacaaccccctaaatatgaagatgttgtccagctctcagcttctgactctggacgatttcaaactattgaattgcaaaatgacaagcctaattctaggaagatggacactgtacaatccattccaaacaactccacaaattccttatataacttagaggtaaatgatcctagaactctaaaagctgtccaggtccaatcacagtcattaaccatgaatcctttagaaaatgtttcttctgacgacttaatggaaactctttatattgaagaagagtcagatggaaagaaagcattagataaaggacaaaagacagagaatggacctagtcatgagttattaaaggtaaatgaacatagagcagaatttccagaacatgctactcatcttaaaaaatgccccaccccaatgcaaaatgaaattggtaagatatttgagaaatcatttgttaatctacctaaggaagactgtaaatcaaaagtttctaaatttgaagagggagaccagagagattttacaaattccagtagccaggaagagatagataaattgttaatggatttggaatctttttcacagaagatggagacctctctaagagagccacttgcgaagggtaaaaactctaattttttaaatagtcacagtcagttgaccggtcagacccttgtagatcttgagcctaaatctaaagtctcttcacccatagaaaaagtctcaccttcctgtctaacaaggattattgaaaccaatggacacaaaatagaggaagaggatcgagccctcttactgcgaatcctggaaagcattgaagactttgctcaagaactagttgaatgcaaatcaagcagagggagcctatcacaagaaaaggaaatgatgcaaattctacaggaaaccttgacaacttcctcccaggccaatttatcagtctgtagaagtcctgttggtgataaagccaaagatactacttcagcagttttgattcagcagactccagaggtgatcaaggtaagacccaacaattttgagtcctaggaactctttaaaaaatgtttagtgtttgaaaattttataaagaaaaacttttttgttagccattttttgttctactaaagctctgccctacactaggaatgatctcactcagctcagagtcagtaaaaagcaaagattatacaagatgatagaggaaaaaaaaaaagcaaagactttagactcagactggttcctactgccctccccatacccttcatcttcttcccagctctgtgaccaaagaaaaattacttacctttaatatcctcatctttatggtggaaataataaggatcaaaataacttgtgtgaaacataagcaaggttccttacacaaagtaggcatttaata

SEQ ID NO: 108430 - DNA, 1048 bp, Homo sapiens
gtgaactaactcacaagtaattttacagctcccttgtatcttgatattagatcaaggaattaatgtgtgtcctctattcagctatttgcagaaagctatttgcagagggattccaacaggtttaaaaatagaccttctggacctggagtacagtactcacatttttctcttgtagagagggaatccagttttagagacaacaaatacaacttaatgaacattttacaatttaggtagaaaattaccagaatttttcatagaaatatccttgagaaactagaatttctgtattaaaagccttgtttgcactttgaatcaatagattatatattagcgtgcatacacatctgtaacaaatgtttgtttaaaaagtatgttaatcctggtaatctttttttaaagcaagacgtatttgtctatatagacaattgtgtatgtgtgtgtcgtaatgtatgtagataacaaagactggtggttacttctagatcattaaaaatgtcttccctaagcaagctgtgcaattgagtcatttctgcctatgatgagtactttgcagagtccctactttcttgcttaaaacctatggcagtgtttcaccaaacaagtgcctaacattgactacaatataaatcaaggactgtacaaatgctggccatccaaaatccagcaagaaaccatagttttatggttattctgacccagaataatctcaaattatttgggtaaatatgaaattgcttttttgtaggtcaaaaatgatcaaatattggaaatgctacagtgacataatagcacaaggatactattctgaatgaatatctaaatgatactgtgtttatagggaaagacaaatggagaattgaagtattttacccagctaattctattctaatgctgctcctagactggactgaaaccactgtatccaaagtgagcagatgctaaacttgctagtaaatctggcagaatttatgttactaggttttcttccataatgtttgtaaactaccagttttattcagctactttaaggtttaaattatatatc

SEQ ID NO: 108431 - DNA, 1046 bp, Homo sapiens
caaatagttgatggagaaacctatgtatttttttaaacgtaaatctatgtaaacttgagtactggcagataattaataaattaattaatttagtgcagataagcattccctagaaacatgcttaccacctttaagagtacagtgagcccttaatctctcctgtctctgattgtggtttcttatattgctggtgagaattttcagtaaatgaatactgtttaaattttttgtgtctcataatcttatttttcttttagattcaaaataaaccagaaaagaaacctggaacaccactcccacctccagccacctctccaagtagtccccgacctctctccccggttccccatgtgaataatgttgtgaatgcgccattgtccataaacattccacggttctactttcctgaaggactcccagatacctgtagtaatcatgaacaaactctaagcagaattgaaactgctttcatggatattgaagaacagaaagcagacatttatgaaatggggaaaattgcaaaggtaatgtaactactaaatgatttacaatctccccttctttagaaaccctgatcccctccccttctctagaaacccggatcccaccccccttcactgcctctttgctctgtttttaagcatgcatggaattgttgttgtttttcccatagtgatcttccatttcaacctcctatttaatataagaatcccttccaagacatcaccaactcataaattcattctctgcttgaatgctttcagagactagaagctctaccttgccaggcagcctggcctattgtcaaatacttgtttgttagaaaatttttccttgtgctgaataggaatctgatttttagtctcacccattgatcataactgccctaatgccagacaaggaagcattagaccatctcaatacagtcattttacccagaaataaatggatttgacaataggaagcaagtctttggaactttcaaatatatccaactgcttctgagttaaaatcttatccccctaatgtcaggactactctgactt

SEQ ID NO: 108432 - DNA, 1076 bp, Homo sapiens
gctctttttaccactgcttcctttgggagaagaaaaataatcagtgaaagggaaatgaagtgggtaggaatgactgcaggtaaaattgttaagaatgcactgtgacctcctacctccaggattgcagcttccatcttccttctctggtcttctcctacaccacagcacacacatcctcaatctagacacatttgcttcttatctcctcttctcccattctatccaaggttttctccagagttgcaattctgctaaacccattaaaacaccagctaataacaaagatgttcatgcccaaataaaagttaggatataaattatcccagatgtatttgaatttccatagagtctagaagaccgagagtcttcaagactcaagtgaataaggctataataaccagaataaggccctcttgaatcataccaccttgatagccacccttctgaccagttaatcaatcattaggccaacccaggagatacttcccacctcatatgccttcccaaaacattgagccccataagcattacttgaatcaggcatcactgtataaattagaggtaaacaaaagaagtgatgtgaaggcagttgggaagtgaagacttgtgagcagagaattttttttattcttcttggaagtacagaggcaaatccaaaatatatagatgtagatttaaaaatacagtgctgatttttactaggaattacacttaacataatcaaaaagctaaaagttaaattggtcccaagtatgttcataaaatggcctttgagaaagtagtggagatctttaatgtttttatttggttttattttccttttggaaccaggttattcagagaatattctacacagtcaacagatcttggagtggaaaaattacttcgacagagataagaaaaagcaactttttgcaagtatgcctttcattagaattcatgtgtaatgagcaatttagataattttcttactttatttaacaaatatttgagcgcttactctattcaaagcactgtcactactttcagtcattaagcatttatcaaatacctgtcgtgggatgctggaatgtttt

SEQ ID NO: 108433 - DNA, 1043 bp, Homo sapiens
tgctggatacagagtcattgctgaaaggatcaagtttaaaatcttccaaggcctttccaagacccttcccaacctagccccagcccacccctccaggcttatctattgtgaagccgcctctgtacgttttatccatgtctatggaatttatcaagtcaggtttagtgtctgtacacttcactcttttgctccagagtgcatgccttcaggcagagatcccttattattctcttcatttttaccccctcacccaaaacattccagcatcccacgacaggtatttgataaatgcttaatgactgaaagtagtgacagtgctttgaatagagtaagcgctcaaatatttgttaaataaagtaagaaaattatctaaattgctcattacacatgaattctaatgaaaggcatacttgcaaaaagttgctttttcttatctctgtcgaagtaatttttccactccaagatctgttgactgtgtagaatattctctgaataacctggttccaaaaggaaaataaaaccaaataaaaacattaaagatctccactactttctcaaaggccattttatgaacatacttgggaccaatttaacttttagctttttgattatgttaagtgtaattcctagtaaaaatcagcactgtatttttaaatctacatctatatattttggatttgcctctgtacttccaagaagaataaaaaaaattctctgctcacaagtcttcacttcccaactgccttcacatcacttcttttgtttacctctaatttatacagtgatgcctgattcaagtaatgcttatggggctcaatgttttgggaaggcatatgaggtgggaagtatctcctgggttggcctaatgattgattaactggtcagaagggtggctatcaaggtggtatgattcaagagggccttattctggttattatagccttattcacttgagtcttgaagactctcggtcttctagactctatggaaattcaaatacatctgggataatttatatcctaacttttatttgggcatgaaca

SEQ ID NO: 108434 - DNA, 1522 bp, Homo sapiens
cttgaggccaggagttcaaggctgcagtgagccatgttgtgcctctactccagcctgggcagcagagtgagaccccatctctaaagttaaaacaaaaaatctgaaggcaaaacaccacaaacctctaattctataactagccaaaataccaaccatattagagggtagaaaaaaggcattttcaaagacccaagatctcaaaaaatgtacctgccatgctctttcattcaagaagctactagagaatgcgcagagtaacaaaataatgaggaaacaaagaatgaggaaaatgcaagaaacaagaattaggagaaaggcgaaaggaatccctggatgaaactgagcgaggcctagagactaagcagcccagattagagtaggtcagaagcaaccaaggaagacttcatcaagaacatgcaattgacagagcacctcatggaactgagtgtggatttagacaactggcagaatttgggggttgaattagtagcaagtacacagaaaactaagcaaatagataaaagaaaaatataaaattataaattctgaatgttgagcaagttaactgtgttaagaggatgagaagggcgtgtaggtaaagtggtgacaaattacagaagaactaaagttcaactttcataatgtgaaatctactttttgtttggttggttggttgtttagttggtttttatcttgaggcgggagtctcgttctttcacccaggctggagtgcagcagcgcagtcttggctcactgcaccctccacctcccaggttcaaacaatcctcccacctcagccgcccaagtagctgagattacaggcatgcaccaccatgcgcagctagttttttgtatttttagtagagatagggtttcaccatgttggccaggctgatctcaaactcctgacctgaagtgatctgcccacctcagtctcccaaagtgctgggattacaggcatgagccaccgtgcccagcctctaataatagttctgaaaataaatacaagaaaggagcgatatagacgtgttatctgaaaataggaaggtaaaaagcaaaatggggttgaacacggttgattctgggtggaaaaataaagggaagaaggggtccgccattttctctaacaaactttgtaaaactatatctaagcctgaagtgtatgtaatatgtaacttttactttaaaagaaacatactaaatctggataaataaaaggtctttaccaggcccatgataatgattgtccttatcatctagcattgagtattggttccgctgcatggatgtggatggagacggtgtactctccatgtatgagctggagtacttctatgaggagcagtgtgaacggatggaagccatgggaattgagcccttgccattccatgatttactgtgccagatgcttgacctagtgaagccagctgttgatggtgagaccaagcaatgggacagatgcactgttcacctatgtatcagaggagggcaaagaatcctagattgtcctaaattatttaac

SEQ ID NO: 108435 - DNA, 1046 bp, Homo sapiens
ccatttgaggtgtagaaaattaccttaggagttttaccttagcacctcttttaaacctgttgaaatgaaacatttttcaggtaggattttttcagcagtatacatttgtgtgatgatctatctccaattctttgtctttgattttttttatttctcgtggctgtcttctttccaatcaggatgttgagaacgatgggcctgagccctcagactgggaccggtttgccgctgaggagtatgagacgcttgttgcagaggaatctgcccaagcacaattccaggaagggtgagtaagtttccctatgtcttatagaatttttaacaggaatgcgcatgtccagagtattaaaacccccttacaaaatccttttctgttttttccatttttgaatagcataaaaatgtgatttagccaactttagttaaatgattattttttccagcaatcttcactcatttcctgacagagtcttctcatgtccatttcctttaatgagtctcatctttcactggaaaccgagatcactgaacaatcaaactactgttttagtgatattgataaaccctgtacataaaggaggaggctaaaagaactaaagctctggccgggcacggtggctcacgcctgtaatctcagcactttgggaggccgaggcgggtggataaccagaggtcgggagtttgaaaccagcctgaccaacatggagaaaccctgtctccactaaaaatacaaaaaaattagccgggtatggtggtgcatgcctgtaatcccagctacttggaaggctgaggcaggagaatcggcttttacccgggaggcagaggttgcagtgagccgagatcatgccattgcactccagcttgggcaacaagagcaaaactccgtctccaaaaaaaaaaaaaaaaaaaaaaaaaaaactaaagctccttcaataataataaagatgatcatgtttagaacaaatctttattatacatggttttgtgcaggaagtaacttctacatgtatttctactagtcagggcataattccataaagggacca

SEQ ID NO: 108436 - DNA, 5140 bp, Homo sapiens
cctgaatagctgggattacaggcacacaccaccacacctggctatccaaagggttttaaccctagtttgtgcttctggtgtctgatcttcacctctttaactttatagcctttggaggaagaggataagaaggtggaccagaacgtattgcttggggagagagacacagaatcaaggatgattttggtttgagataactgaatggggaatatggcatgaaatcaagcgagctaattgaagattcttccgtttcttctaagatatattttctgttatctggtctagtgagtttaattcatctcaattttgatagactacttatgtcatctaaacttcagtttatgaaatggtaaatttattttactaaaatctttgctttcctccttctcccccttaggacatttgctacaagatcctattgcacccaccaactccacctgccaacattatgtctgcaaaacttgtaaaggcaagaaaatgatgatgaaaccttcctgtagctggtgcaaagactatgagcagtttgaggaaaacaagcagttaagcatcctagtgaactgctacaaaaaactatgcgagtatataacacagactacactggcacgggatataatagaagcagttgactgttcttctgatattttggctttgcttaatgatggatcattgttttgtgaggagacagaaaaaccctcagattcatcctttactttgtgtttgacacattcccctttaccttcaacctcagaacccacaactgatcctcaagctagtttatctccaatgtctgaaagcaccctcagcattgctattggcagttctgttatcaatggtttgcctacttataatgggctttcaatagatagatttggtataaatattccttcacctgaacattcaaatacgattgacgtatgtaatactgttgacataaaaactgaggatctgtctgacagcctgccacccgtttgtgacacagtagccactgacttatgttccacaggcattgatatctgcagtttcagtgaagatataaaacctggagactctctgttactgagtgttgaggaagtactccgcagcttagaaactgtttcaaatacagaggtctgttgccctaatttgcagccgaacttggaagccactgtatccaatggaccttttctgcagctttcttcccagtctcttagccataatgtttttatgtccaccagtcctgcacttcatgggttatcatgtacagcagcaactccgaagatagcaaaattgaatagaaaacgatccagatcagagagtgacagtgagaaagttcagccacttccaatttctaccattatccgaggcccaacactgggggcatctgctcctgtgacagtgaaacgggagagcaaaatttctcttcaacctatagcaactgttcccaatggaggcacaacacctaaaatcagcaaaactgtacttttatctactaaaagcatgaaaaagagtcatgaacatggatccaagaaatctcactctaaaaccaagccaggtattcttaaaaaagacaaagcagtaaaggaaaagattcctagtcatcattttatgccaggaagtcctaccaagactgtgtacaaaaaaccccaggaaaagaaagggtgtaaatgtgggcgtgctactcaaaatccaagtgttcttacatgccgaggccaacgctgcccttgctactctaaccgcaaagcctgcttagattgtatatgtcgtggctgccaaaactcctatatggccaatggggagaagaagctggaggcatttgccgtgccagaaaaggccttggagcagaccaggctcactttgggcattaacgtgactagcattgctgtgcgtaacgctagtaccagcaccagtgtaataaatgtcacagggtccccagtaacgacgtttttagctgccagtacacatgatgataaaagtttggatgaagctatagacatgagattcgactgttaaatcagtgggtcttttaaacctactcctggtagggaaatagctacagttttacggcagctatggttctgttggtttaacttgccggagctcctgcatatagatcacttgtatcaagtgttttcattgctaagttatatgtgttagtgtcggggaaatagtttgcagataatggaggagtaaccctacaactatatgtccttagttcttacagaacctcatagtttgagaacaaagctgatgcaactgatttatacaaaatgaactttggcaagaaaaataacattaacctcattgtttatggccatgctttgtgcataatcaaagtttatgattaaatgtaaggaagtggtatctagtcagtccataaagattgtgctaatttttttgtggaaaagtagccattagttcaggaaactcagtgctgccttcagatgtcattgatgtttctcctgttggaaagctgatgtgtccagctcaacctttgtgctgacatcataccatttctgatcatgaaatattggctactggtgtatgtagcagttcttaaatcagcagtattatgaaaaaaaattccccctcattagaatgtttaagaaatctttttaaaaagtaaaattctgtcagactacaaatgtttagctgttactcatttctagggaagaaattctaaatccctccttcactttgagcagtgttctaattggataaatgaaggagagtagttttattctgaaggtaattaaatttagactatgtagtatgtgacagaatttttttaaaattataaaaagattttatttagtaattgggatttacttaaaataattttggaataatgctcccagacttgcccagatttgtgtattgtacttattgccactggccgccactttgacttattttctctaatagtttatttgccacagtctttattttgaatatgctcctagtttttttttagggtgctgttcattatgaaggcttctttatagaggcctaataagaatgcctttttataaagcctgtgcatttaggtaggttgaagctaggaggattttctttagaatgctcttttgcatgtaaagcacaaagtatgtttcagtttaaatgcacttcttccggttaatttttatggggaagacaagtgagtcacaaacattctgttgaagggaaatctagtcagttgcttgaaagagcacagcccaaataaaacaaggactgactaggtgtaatgaaataacctgtgatttaaaagaagagctgcagctttgacagtgcttatttaaagaaaaatactgctggaaaatttccaatttctactacgttcaccatctctagtaagatctgacatatgctgaagttatgttttgatttggcacacagcatgttcaatgatggttactcgcctagtacaagacatggagaagaaacctttggacacagagcagatgacacctccttctgttttgtagtgtatcctggtgtcattttctgtgaatgtggtcaggtagagttgtttttgttgttgttgttgggcttttttttctttttttttttttggtctcttttggtggggtgggggtgggctaaagccataggaagaaaaatgtgatgtatgtgtccagtatgtactattttgtttttgttttgcaagaagagttgaactatttttgataacaagagtaaatggtggaaaatgcttcttagttgtcttgtctttatttgctttccaagatttggaattttatttaattcctttaagtgttagcagtgtcttatgaaacgtgtatttacctaacgtttgtaacagttttgtgttgaacccagatgccctgctatataaagttgtaaatctgttctttattcactaatgatcactgcaaaaatgattagaaatgagattgtacacatggatgaggatatattttgcaaatcgaccaaactttcctaatattatgatcttaaaattcatagagtactttattgcttcccaagtttgataatcttgtgggtttttttttttttttgatgcatgggaggttggcaatatagacaaagtggaaatcattagtatgtgagggccttgattgttatgtaatattgccaatgatgaattcaggttgtttttagcacaagtttctcttttttatgctggtattctcactgccacatttttggaaacctgtattacaccttaaatctatcaataaatgatagttttctaattctatgttgtagaatactgaagagtttgggatagcatgctctgaatggtctgtattatatacatctggggaagagtaatcacagtgccttgatttttatattatttttctttataccacgagttacttaggaatgctgacaaatggctaacgagggatgattgagagattattactgaagtaactggatttacttcatcaggatttgaaaccaccaaagaacagcagcatttaataagacacatcctgaattgttgagtccttgttattaatataaatgatcaaatgatcttttaccttaggtaatagttttagagctgacaattttatctttttggttagccttattaagtctgcatttccgggaggaggtgtagtatggtcctagggataaagaattccttttatttcattgtattcttagttaaaacaatttattggtgaccttgttgaagaagagtaaaagttttatgggaatcagatgaaaaataaattgtccataaccatatcatagataaaaaacagaaatgctttagaaaatactaagttcaaagtatggtattttatacttttctctttttaaaaaaattaaaagctaggcacagtggtgtgtgcctgtaatctcagctacttaggaggctgaggtgggaggatcacttaagctcaggagttcgaactcagcctgggcaacatagaccttgcctctgaaataaaatttaggtaccccaaaacatgccgttacacattcttttaaaataatgcattatagatgaggctaaagtctaccttgattcctgtgaactccgcctcattcacaaaccctggtcctcttccctatcccctgaagaaatcatttctcagtatattgtcattactacaaagacctttctttgtagttttcacatgggctcaaagagttattctct

SEQ ID NO: 108437 - DNA, 1052 bp, Homo sapiens
atcatgcccagctcatttttttttgtgtttttatagagacgggtttcaccatgttggccaggctggtcttgaactcctgacctcaggtgatctgcctgccttggcctcccaaagtgctgggattacagacatgagctactgtgcccagcccagaaccatagaattctttttttcagacggagtctcactctgtcgttcaggttaaagtgcagtggcaccatctgggttcactgcaccctccgcctcccgggttcgagcaattctcctgcctcagcctcccgagtagctgggactacaggcgcccaccgtcaacgcccggctaattttttgtatttttagtagagacggggtttcaccgtgttagccaggatggtctctatctcctgacttcgtgatccgcccgcctttgcctcccaaagtgctgcgattacaggcatgagccaccacgcctggccaggaccatagaattctaatgatgtgatcttcaattattttgtgaaatcttattacctggataagagtcaggattgctttatcttgtttggcagttagagaacagttgttgattcacaatatttctggtcagttaaaacattttcacaggttagtcgatagtattgttcattattttctctgttcttacagactcttagtagttttgtcagttattgagttgaaatctgaactatatgtgttttcagtttctcttcagagttttatcataagtttttgctgcatgtattttgaagctctgttggtaggtttatgaaaccttttggaacttatggaatatagttaaaataactaccattttaataactttgatttttctagcctgggcaacatggcaaaaccctgcctctacaacaaatacaaaaattagctggacatggttggtgcgtgcctgtagtcacagacccttgggaggctgaggtgggaggattgcttgagcccaggaggcagaggttgcagtgatcgaggtcgtgccactgcactccagcctgggtggcagagtgagaccttgtctcaaaaaaaaaccaaaaaacaaaact

SEQ ID NO: 108438 - DNA, 1286 bp, Homo sapiens
ccgcggcgtcttgcactagatccgggaagccgctgcccgaccgtcgtccttgccgtcgccgccgcctccgcgccctgtactgggatggagtaagaggccctgcagcccgggagaagcgtgccgcgcctcagacggggccggggcctgctcccgcgcctgccagctcgacttgaggaggcgcctccgtgtccggagatggagctcgagtgcaggccgcctgccgagccgcggggctagactgagctccgagtcccgccccgagcgcccaagccgccgcgttctgcgctctgtggtcgctccggacgaactcgaacgctggtttctctctcatatttttggtctggaagtctcagggacggaggggcgccaaggccccatgtgtgggaggattgtttcagctccacaaacttgcacggattttggttacttgtttggccaatggttcggctctgatttcttccgaattgttgcaaattcgccatcgttccctggctgcttactaagttggatccggaatttcttttcaaccgggagccattggtgtcgaagtgtctgcaatgaaccccgtgaatgctactgctctctacatttccgcgagccgcctagtgctcaactacgaccccggagaccccaaggcgtttactgagattaacaggctcttgccttacttccgacagtccctttcgtgctgtgtttgcggtgagacgctttttattgttcccttttcaatgcttgtttttaaaagccttctgggcagtggtaacgtgagcgggttgacggcctggtggttggtattaagcttttgttatttgtgcagcgctgtacggtcattagttttgaaacttgctgagggacttttgcccggcgtttcagaaaggcagagaaccctttcataccgctttgtgcagcggcgttaacgttcaaaatggtttaattcgcctcggttcatctggtggtggtggtttaagtgggggtaagatgcatgcacaaggctttttttttttttttcttaaacctttgccgcgggagctgattacgtacctacggcggttaaaagtggttaaacatgatcaaaacatgcacatgtgggcacatgtggcgtgtttgcatttccccaaactggtgttacgtgggagtggtgggctaagctgatgaacccacagctggagaacccggcgcggaactttgccccaggttcctccacaaatgctttgacggtttgacggttaacagcgagccggggaaggctgttggtactcgaagtgctttttagctggtgagacttt

SEQ ID NO: 108439 - DNA, 1040 bp, Homo sapiens
ctatattgctcaggctggtcttgggctcctgggctcacctacctcggcctcagtcttgcctcttgatcaaatcactcatctctctgtgcttgatttacctcatctgtgaaatccagatagtaagctagtgcatggtaagtgcaaaaagcaacacctggcacaatgcttaataaatgttggttaaatcttataatcattttctgtaggaagtgggacgacaaagttaagggtctaggtggtcagagaagagcaaggactatgtcccttttttgtgcagccaggcaggccctgtactttttctctgcgcgaccctcctcgggcagcaccgggtctcgaactctcacgccttactcccaagcaggttctgtagtccagcccccgcggctccctacagccagccgatgctgcgcaagcgccgtacccacgctttagcacatgcgtactcaggtgcgccggtaggggacgcgccggcacagcaaaaatggcggcggcattacgggtggcggcggtcggggcaaggctcagcgttctggcgagcggtctccgcgccgcggtccgcagcctttgcagccaggccacctctgttaacgaacgcatcgaaaacaagcgccggaccgcgctgctgggagggggccaacgccgtattgacgcgcagcacaagcgagtgagtcctgaggggcctaagtgagtcccgcccctggcgtccgcgacctatcactgcgtgcccggcttgcggcgtccgaggcctccctgccaatccgcacggtgcctggaggggccggagcaagggtgttcaccttgaaaacctgtagcgtttctcgtggaggcgggtataaccagcagaagcacctgtgtgctttttcatactgtttaacccttgggatttagacggatctggctcgtctctagccagctcaacacttaacataagcttttgggcaacttattaaatctctgtgggtcattttaataataattcttccttcacaagtgtatcgttagaccatagatagcaaaatgataggcgctcagtaaaaacc

SEQ ID NO: 108440 - DNA, 1026 bp, Homo sapiens
aggttttagggaactgctgcccaggaggggaggggagagaaaatacttgcctcagaaagtaatatgctgaccatcctaccagttacggggagaaaatgcacatataattcttaaagaacttcactgattaggtctgttgcctcctgtatagaatttctgtgggaaaaaagccaaatgttatcttattgttgtctttatctttccacagataatgcctcaaacatctctgtaaccagatgcttttgcttttctgttttggcagaggaatgttacggcatccggagtcatccctcagatttctctgatcatgggcccatgtgctggtggggccgtctactccccagccctaacagacttcacgttcatggtaaaggtaagaaagaagggcctgtttttggtgccgtttgagatttgtgcagttccttacctgcaataaaaataattcctgacccagatctaggttgttacctgcattctcattggctttcagcatagtgatgataaggtgttaatggagagagggttttggcatgaaatctgtagcttgtgggggttcagtggcaggggatgcttatgtacttcattggtgggtgattttacttgttgatctgaattgcaaatgattttcaggtaatcaaagaatcctgtcctttgaccagatagatgactgtttactgagtcctattcaagaagtttctcatggaaggcttttctgtaatctgtttattgggaagttgtttcttcctttatttcttcagctccttgccattttattacattgtgtccataatggtaaaggataaatctgatctcacacttcattttcagaggtacatatctttattacatgactttaatggacttatattttaaaaatatttttaaatgaagtctatttgaagttatacatgagtaattaccattcatctcaaaccttgctttaaaaaaatcagccttttcttcttaaaatattaataaaaatgaacattggatgccaagacagaatggttggggggaaaaagtagt

SEQ ID NO: 108441 - DNA, 1055 bp, Homo sapiens
tccatgagcctgcatgtgacaggttctgtggtgattttgcccagagggcctgcagttttgctttttgaaggagctttagcagattaacctaacagggaatgtgaacccacagtggtttatgcagagctctgcctttgcatttccaagtccttgttcttttaatgttccaggaagttgggctgggctctcccagggctgtgtcttgttcactataatgtccttcagtgccctacacggtacctagaatgtaggaggtattcagagaagataaatgaaagaataacgtttagaggaataaactcattttttcctctaaaagagaaccagaagatcttttggattgatacttgtcccaggttcagttaatatggtggttaaaaaggaatgactctttggtgactgctttgtaagcccagcagggacagaactggcccagtccctatgacgtgtcaccccatttcctttcccaccccattcccacaaaaggtaactggctcttcctatgttgactatacctgccttttttctgcctaaagtgaccgtctggttcctgagcttgacacaattgtccctttggaatcaaccaaagcctacaacatggtggacatcatacactctgtaagtgccacatctgtttgtcttgcctgtcctagtcagccacattcatgggcattgtgcttcggcttagtgaggaagcactggaccacttggcctccatgtcagacagcacaggtcgggaatagggtgggcacaggaccagtggccactgagtagtgtgttctggaaagacctagtggctatagataccctagtggcacagatggacttgagggctggagataggagtagtaagggccagcagagctcaggagtctttagaaggccctctgaggatcataaattaggggccatgtccacagagtctagagtgaggccagagtgatcattgttaagtatcattggggccctctgctcagagggggttttgtctttatagagaagagagtacacagggcatcctagaaggttggactgtgtgtgtggaggtccgtggg

SEQ ID NO: 108442 - DNA, 1031 bp, Homo sapiens
aactcagcaatcccattcctagcaatttaccctgaagatacacttcccaccatacaaaattatagatgtacgaggttacgaccattacgttgtcatttgtaattgcgagatactctaaataacctaaatgtaaattttaaaataatgtaagccacgtgtagattggttgaataaactttggtacatcacacagtacagtactatgcagaagtgaaaaagaatgatgatctctatgaactgataggaagtgattcccaggacatattaagtgaaaaaattcaaagtgcaagagtgtctgtactgttactttccatgtaagaagggtaaattaaaagatacaaatgcaaacacacacataatacatcagaaaataatgagattaataacagggtaggtgggactagggtggaagggatggggaaggaacactattaaactgtattagtattttacatattaaaaaataaaatcaagactggggaaaacctttaaaatgaaatacaaacatgaacctgttttaaatgagtgtcttttgaacctatattttgactatatacctttaatctaaagaccaaaatagctgtaaaaaaattctagctagtaggtctgttttttgtagctaagttagcagttctgaaaccattttctctgtatttgaggatcgaataaataagtacattttgagggtagtagcagccagattctgctatcggagaagggagttgtgaatatggcaagagaaaaaaatctagaatgaaccctatagttgcactggagtaggattagaattatcagcatgaactcatggtttttcatatagctggactttggacgttttagaaggagtcacacacacacacacatccctaaaaggaacccaggccttttggagaaatggctgattgtagggctggggcaggaaagaaaccaagatgaaccagaaagtaagatacttccaaaatataaggtagtgctcaaagaatgatggggacactttagaaggacacaggaaccagcatgaaggaactttg

SEQ ID NO: 108443 - DNA, 1050 bp, Homo sapiens
tttactccttggaactatgctaggaggcagtatcgtccctactttgcaggtaaggaaccttaggtcaaaaggcaaagtaatttctcaagggcacgttgccatcatcagtggagccagaatctgattggaagctctgaggactctctaagaccagcccttgaatgctgcctcccactgatggctccctgcggcaaggccggctgtgtctcagctggcggcagccctttggtctgtagtgagtctgtagtagtctagttctgggcctctttggccagtgacagacaggtggattcttcatcttccctgtttcctggagtttgaggggtccttgttaccattctgcaacaaagaagtgttggtgcctccacagaaaccagctttggatggctgctgaggacaaatccccattgtggatagaactgggaattgcctggatactcagtatggataatctctctctttctaggatgcttggatattaattcatctgtgaaaggggctcgttttgtcagattctgtgatgcattcaatattccactcatcacttttgttgatgtccctggctttctacctggtaagtttttgacagagtgggggctaggagagttgcctttcccagtaaggtgcccactttatttggagatcttcttgcagaactccccgaggacttgtgacttctccatgtattctgggtgtccagaagatagggctgtgtaaggaatggccctctccagaggtgggaaagacctcacagctgagagtggcaggataaccatgtgaggacttgtgggtatctagtaactcttcctcatgtctaggcacagcacaggaatacgggggcatcatccggcatggtgccaagcttctctacgcatttgctgaggcaactgtacccaaagtcacagtcatcaccaggaaggtgaggacctcatgttggaggccatgaccctgctcactttcctacagcatagccgtggtgggaggtctggcagagttttaccagggctggaaggagtacaccttgctcatccttaaaaagatctcttgagg

SEQ ID NO: 108444 - DNA, 1042 bp, Homo sapiens
ccttttcttgccaagtgctcctaggccagaagttggggagctgtcagaacaggccagctcctgggatacaagggggaattcacagggcctaccatctctgtatcaggttgggcactgcttatactgctggccccagggatggtgcccaggctgagcagaaggttgaggggtggcatcatctcgggatgcagatgatccactcccttttctgtgcttcaccagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaacctgggaatccaaatagttggataacttagaataactaagtttattaaattctagaaagatctcttttgtgccttactgtaaaattatttacttttttaaacattttaagttgtattttttgagcataaattcgatttttttaggtggaaatctgaaaaatcaatacaactagaaagaaaaatagtacacagtgttatcatctagagctgatttttatttcacacctctgggtattgttctttttcctctcgagttagtttttttatccataggtgagatatatagtaagtttttaaggcaaagtatttcttaggcttaagtttccttattttaaaaatagggtaatatgccctatctatctcctaattcctccatgaattgaggattaaatgtgatgtttgcaattgtggtatatgtgtttagcagtacagatgctcaataaggcatagcaccctatgttgactcaggttatttccagaaatgtgttcttaaaattaaaaaaaaactttttaattgcgaaaattttcaagccgatagaaatgttgcaagaagtgtattgtatccacttcacctagattctccagttggtaacattttctccatttgctttatttct

SEQ ID NO: 108445 - DNA, 1037 bp, Homo sapiens
taaagaaagagtgaggaggtctaatgccaagagaaactttttaagacagtctggctctgttacctagattggagtgcagtagtggtgcaatcttggctcactgcaacaacctccaccttgtgggctcaagccatcctcctaccttagcctcacgagtagctggtgtgcgccatcatacgcagctaatttttgtattttttgtagaggagttttaccatgctacccaggctggtctcgaactcttgagctcaagtgatccactcaccttggccttccaaagtgctgggattacaggcgtgagccaccatgcctggctgaaaacttcatttctgtagctgcattgactctatgtggtcttcaaaagggcactgccagggtgcaattatgcatgtaagcccagagtctcaagccgtgaggacccatgctacaggccagtggatgggtgttccctgaatgcctcatgcaaaactcagtttgcaagagactccctcttaaaccacagatgacttggcctacacacactccagagaaatctaaggaatgaaagaaagtgagctattcctaaattctgctttcttaaaaaaaattaaaaagccaaaacaacaaaaccaccaactcactaataaggttaacttgctgccatttaacagattatcagaaattgcaaactctctcaagagccacaggacagaaaatcatctctttaaagccatacctggtagaaacaataggatgactaccacaagcctgattttgaatagtttattaaaggaaaggtgaagcatcagtttcaaattgtacaaaaggaaaaaaaacctcatattgcaaatgtacaatttacagaattactagcaaaaccaatcaaggagacaccgaaaatacaaaaatttgattgacttcaaactgaactggaaacccattggagtagatatttagcctttttgtgtggcatggtagtctacaattctgtcagcatctgttttccatacaagactgtcacgcaaaggatcaatttgtgcatgtgccagggcacctca

SEQ ID NO: 108446 - DNA, 2483 bp, Homo sapiens
tatttcatataaaagccagattctcttcttcctttcaaaattgactcttagcagttccatatatttatgatactgtcagaaatattagctgattatcacaattcattgtcttaatgatctcagaaaaaaattaagaaaccgatttctctttccagcctccatcaagaaatcggcgagagagagctgagctaaggccagacttctttgactctgcagctatcatagaagatgattcagtaaatgtcaaattattactgctttttatttatggttcctgggtcctgtttatgcatgaaattaataattatgtttctcatcatttttctagggatttggaatgcctatgttctgaagtctgaagaaaatttacaaatctggaactctattatttagagctagaggcctatatactgtgatagcttgtatggggaaaaacacttttgatgtgatctgatttgttttttaatcaaatgattaaggtcaatccctttttgcagtgacagaagaggagcatgtaaattacccaagggaatgttggtgaatgtcaactcagaaagactgacctgaaaatcatttgtgtcctactattggacttatcccaatacagatgtgtgtgtttttctggagggaggaagaaattttaaatttttaaaacagctgtcaagataaacactgttatacacctgttttatgaaaactcaacattgagtaaaaaaaaacatatttttaactttattttcctgttgtacaatttaaaaaccgttttaacattttgcctttttatgttttaaaagctaaccatttttattaaacctatgagtaagcagctcatcctaattgcgaagagtgttttggagttcactggatttggttgacctttgtggaacacaaataatgaaggagcagaacattgacaagctaagatgaaattctgacatagtacatctctgccaaaaaccacacaccctctgtggatatggatatgaattcccagattttatatactcttgaataaaaggtttatttttatttataagtgggcataaaataagaaatgtccatgcagccatttttccaacagatgctgtacaccgttcattttatatagactagggagattcaaatacagtgcattttctattggtatttgttctgtgcatttttagcaacttctaccagcaaataaagtattctcagtaaaacgaaaatgattctcaagttatcagtttgctgtttttaccacttatttcatgccctgccaaattcaagttacacagacttccattttcttaagataatcaatcatgaagaaatcctttatcaatcattcaaaagtaattttaagtgtaacataactgtgtttacttcccatgcacttaatacccttatgcgctaattttgtgaattaagtttactgattatagaagtatgtgctgcatagaagtctgtgcttagagggtgaagttcctaagcttaccttgaattacagctacatttcagtgttaaatgtgcatattaagaataattcttttggggaaagaaattatgaatcttcaggacagtctacaatggtttagagttacattctgcctagacttttatgacttgctgctattgttttaaaaaccccacttagtctctctcttcctttctgatttctaaagtaagcctcagaatttccaaaccaattcatccacagctgtttctgggctggtttttaaagtagctgcaacagaatcatgaggctttccctttttatcaaatacgaaaaacattttttaaaattctgcacacccagtgatcatcttttgtgcgggaaagcaagatgatgatggatgattttattcatccttttagtaaagacacaaaacatttttctcaacatttgtacagttctgaaaaaaacctggtcaccaaaaatatcttctctgctaattcagcaattcttgggctccagttaggggagctggggcctcactttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtattttcggtgtctccttgattggttttgctagtaattctgtaaattgtacatttgcaatatgaggttttttttccttttgtacaatttgaaactgatgcttcacctttcctttaataaactattcaaaatcaggcttgtggtagtcatcctattgtttctaccaggtatggctttaaagagatgattttctgtcctgtggctcttgagagagtttgcaatttctgataatctgttaaatggcagc

SEQ ID NO: 108447 - DNA, 1978 bp, Homo sapiens
atgattctgttgcagctactttaaaaaccagcccagaaacagctgtggatgaattggtttggaaattctgaggcttactttagaaatcagaaaggaagagagagactaagtggggtttttaaaacaatagcagcaagtcataaaagtctaggcagaatgtaactctaaaccattgtagactgtcctgaagattcataatttctttccccaaaagaattattcttaatatgcacatttaacactgaaatgtagctgtaattcaaggtaagcttaggaacttcaccctctaagcacagacttctatgcagcacatacttctataatcagtaaacttaattcacaaaattagcgcataagggtattaagtgcatgggaagtaaacacagttatgttacacttaaaattacttttgaatgattgataaaggatttcttcatgattgattatcttaagaaaatggaagtctgtgtaacttgaatttggcagggcatgaaataagtggtaaaaacagcaaactgataacttgagaatcattttcgttttactgagaatactttatttgctggtagaagttgctaaaaatgcacagaacaaataccaatagaaaatgcactgtatttgaatctccctagtctatataaaatgaacggtgtacagcatctgttggaaaaatggctgcatggacatttcttattttatgcccacttataaataaaaataaaccttttattcaagagtatataaaatctgggaattcatatccatatccacagagggtgtgtggtttttggcagagatgtactatgtcagaatttcatcttagcttgtcaatgttctgctccttcattatttgtgttccacaaaggtcaaccaaatccagtgaactccaaaacactcttcgcaattaggatgagctgcttactcataggtttaataaaaatggttagcttttaaaacataaaaaggcaaaatgttaaaacggtttttaaattgtacaacaggaaaataaagttaaaaatatgtttttttttactcaatgttgagttttcataaaacaggtgtataacagtgtttatcttgacagctgttttaaaaatttaaaatttcttcctccctccagaaaaacacacacatctgtattgggataagtccaatagtaggacacaaatgattttcaggtcagtctttctgagttgacattcaccaacattcccttgggtaatttacatgctcctcttctgtcactgcaaaaagggattgaccttaatcatttgattaaaaaacaaatcagatcacatcaaaagtgtttttccccatacaagctatcacagtatataggcctctagctctaaataatagagttccagatttgtaaattttcttcagacttcagaacataggcattccaaatccctagaaaaatgatgagaaacataattattaatttcatgcataaacaggacccaggaaccataaataaaaagcagtaataatttgacatttactgaatcatcttctatgatagctgcagagtcaaagaagtctggccttagctcagctctctctcgccgatttcttgatggaggctggaaagagaaatcggtttcttaatttttttctgagatcattaagacaatgaattgtgataatcagctaatatttctgacagtatcataaatatatggaactgctaagagtcaattttgaaaggaagaagagaatctggcttttatatgaaatagattttttaaaaacaaacagtacttttggcttttaattatgttggcaaaaacaaggcacaaaactttcaaactatcatgaataaacaacatgttaatacatataaataactttgggcctacatgcccaggccatatcttccctttaaagtcacagaaaaattacagaattcattaactactaggtgataaacctctgtgaattccccaaagcaggtagatggaaagttattggaagg

SEQ ID NO: 108448 - DNA, 1083 bp, Homo sapiens
actccatctcaaaaaaaaaaaaaaattccttagaggcatgtttacacacacttccatgtgccaataagtttagagtacaagtgcagatttgactccataaagactgaggaaaagatgctatattcttccttgttgaattctggagaactttcagctgccaagccaacataatttctgttagttggggatctgctgtccagctaggtacacctgtgagtgcggcaccagcccaaaacagaggtctgagaacccttgtttggcagagatttggttgatagtttaagcatctaacaattagcctcagccagcttctcttggagacttacagatatctttgggcaacttattgccttttttataaaaaggcaccagaataaatccagctaattcctccaacatgggattaagtaaacctaccttggctttcttagcttggggctcattagctaaattcatcatctgctgctacaaaattaataatagtaccctctcttagtcctcagatgcagatctcttggttaggccagccgaagttagaagacttaaatcggaaggacagaacaggaatgaactacatgaaagtgagaactggagtgaggcatgctgtgtaagtgttacatggagtatcacaagaacataacaactatgtgatgcccatcattttgtgaaatgacttgggtttctttgatgtttggtcttaggagttaaaattataattcgtgatatgctatgcagcataggaaaggagggtgtgagttcttaacactttcagcatttaaatcctagctctgccacttggcagctgcatggccttggacaagctctaaaacatctgtgctggctaggcgcggtggctccgcctgtaatcccagcactttgggaggccgaggcgggcggatcacttgaggtcaggagttcaagaccagcctggccaacatcgtgaaaccccgtctctactaaaaatacaaaaaattagccgggcatggtggtgggcgcctataatcccagctactcaggagggtgaggcaggagaatcgcttaaatccaggaggcggaggttgtagtgagtcaagatcacgccac

SEQ ID NO: 108449 - DNA, 1071 bp, Homo sapiens
gcctcaccctcctgagtagctgggattataggcgcccaccaccatgcccggctaattttttgtatttttagtagagacggggtttcacgatgttggccaggctggtcttgaactcctgacctcaagtgatccgcccgcctcggcctcccaaagtgctgggattacaggcggagccaccgcgcctagccagcacagatgttttagagcttgtccaaggccatgcagctgccaagtggcagagctaggatttaaatgctgaaagtgttaagaactcacaccctcctttcctatgctgcatagcatatcacgaattataattttaactcctaagaccaaacatcaaagaaacccaagtcatttcacaaaatgatgggcatcacatagttgttatgttcttgtgatactccatgtaacacttacacagcatgcctcactccagttctcactttcatgtagttcattcctgttctgtccttccgatttaagtcttctaacttcggctggcctaaccaagagatctgcatctgaggactaagagagggtactattattaattttgtagcagcagatgatgaatttagctaatgagccccaagctaagaaagccaaggtaggtttacttaatcccatgttggaggaattagctggatttattctggtgcctttttataaaaaaggcaataagttgcccaaagatatctgtaagtctccaagagaagctggctgaggctaattgttagatgcttaaactatcaaccaaatctctgccaaacaagggttctcagacctctgttttgggctggtgccgcactcacaggtgtacctagctggacagcagatccccaactaacagaaattatgttggcttggcagctgaaagttctccagaattcaacaaggaagaatatagcatcttttcctcagtctttatggagtcaaatctgcacttgtactctaaacttattggcacatggaagtgtgtgtaaacatgcctctaaggaatttttttttttttttgagatggagtcttgctctgtcatccaggctggagtgcagtggcacaatcttggc

SEQ ID NO: 108450 - DNA, 1375 bp, Homo sapiens
actcctgacctcaagtgagcagcccacctcagcctcccagaatgctgggattacaggtgtaagccaccagctaagatggtttataaagatttgagcagattaaagcattatttacaaactgtcctgataaaatattacctagttgtttttttttttttttttttttttgagatggggttttgctatgttgcctaggctgatctcaaactcctgagctcaagcgatccacccatctcccaaagtgcagaaattaaaggcataagctactatgcccggccaagtttctacctataaaaattctaaattattctaatatgataaggcttcttaaaaagtattactgctttggttttccttctgaagaattttaatcccaatacatagtatgaatcctgttgcttttcctctcaagtctcagagatgtgtgtgttaggttcctcttttgccatcgagcatcctgtttctcctcgtatttctcaggtttctgatatttttttagacctgtacattctagatgggcttttctgtgcctggaaatacctacccattgtctggttaaagtaattcctctgatctgaagctcactactcaatctcttcttagttaacaaagacacatttcatcatcttctattcataacacatttcattcaacatttaattcaaaacttttattctctaccacacttaaaattttatgataaaaagattattatcacttaagttctgaacctggtaaactcgtctgtcagctgtctactacatgtcatcttttccagaaaatcttcctgtattcattaaaagtttggtcactgtctatatgttcccacaacctcctgtgtttggcacatcagagcattgaccatggtgaaatcaaacagcctgtttctgttctctatctgcactcacagcatattaatacttaatctgtagtacttagcacagttcttaggaaggcgcttggtagaaactcactgaatgaatggataactccagggagaactctcatcttaaatagaaatagatacttctaatcctttaaagattcctcaatgaaaatatttcttttaatactttctcattttcatctctgaaggatgaaactctgcagcctaagggttctgtgcatgcaacccatcttagtcattttgtaaatctcaaattgacaaaaaagttttctttttttaatttaaacaaattaggttatctggttccacacaagcttctcttaatcttgaaaataatattgactgtaccactaatgaacattatggatagttaaaatctctaagctttagtttcttttgtgaaaaatttagataacagtgttgacttataagacatttatacacttatacgtcattcgctatgtgcca

SEQ ID NO: 108451 - DNA, 1304 bp, Homo sapiens
ttgcttgagccagggaggttgaggctggacaagaccccagcctgggcgacagagtgagaccctgtctcattaaaaaaaaaaaaaaagaaaagaaaaacaaaaggccaggtgcagtggctcatgtctataatcccagcactttgagaagccaaggtgggtggacctacttgaggtcaggagttcgagaccagcctggccaacatggtgaacccctatctctactaaaaatacaaaaattagctgggcgtggcggtgggcacctgtaatcccagctacttgggaggctgaggcaggagaattgcttgaacctgggaggttgaggttgcagtgaaccaagatcacaccactgcactccagcctgggtgacagagggagatcctgtctcaaaaaaaaaaaaaaaaaaaaaaaggaaatgcctgtagtcattctttagagaaaagtccaggatcctacagtacaaagacaagattttatattttctttctctggacttttaaaaaagactttaagtcccaaagctgtaatttgaaaggaaatcttaaactttgtggagattttgttaaacttgaacagtaacatttatattaattcttttattccttttgaaatatagatgctttgagctggagctgcaaggttaaaaaaagaaaaggaatacagatgctgcctaatttactgactgatgctagatagatatgaggcattactatacaatgataacgttcagataatttattgaatgctacctatgtgccaagcactgtgctcagtactgtgtgtatactaagtagtttatttgtagtatctaatattcacgggaactgacaggataaatactctgctaatccttcatttgatgaatgatttaaacttagagaggttaagtaatatgctcaaaggttgcatagctgataatgagaaggccaggtctgaattctggaactctcatgttagaatttgtactcctcatcaacagtcaatactgtttccccaataatgaaaagaatcattagatttaaattctaattaattttgccacagattttagcaaaacctttattagtcatttttttaggcagcacaggtaagatgctgaaagataagaagttataaaaagaacaagagagaaggctcagatcacagacctcctcttggtttggagaaaatttattagaagcatgaagaaggatgaagattatttgagaaaataagcatttttactttgaggcttctcttagtaattttaacaggaatgctttgttttaatagagcaatttttaggtttttttttttttttaacatat

SEQ ID NO: 108452 - DNA, 1453 bp, Homo sapiens
tgtgaacagtggaagtagcagcagcaaaacctcatcagtaaggaataagaaaggacgacctccacttcataaaaaacgagtagaaggtaagtctgcctttacactataagaaacaatttgcctggttttaaagagataaagtagtaaataatcttttgaagcaagataatagtatcaggcacatgattttcttgtatattttattcacaatgagatgttaaggcaaaaaggttgaaacagatgaagtaagacagaaaagcatcaaggaaaaagaagttgaggaagcatggagcacaaaggaagacagcccaaaagaggaaaaaattagctaggtctataaaatcaatccccatactatatgcctctaatacattaaaatataaagtaagatagtcacaatgctattctattaaaattcttcctaatatagatgagatacaggtaatttgagggtagatttctgcagcaaattgaatataccagaatagttgttttccagttctaccacttggttggaacagtaagacagtgatggcctccaggtgtggtggctcacatctgtaatcccagttactcaggagaccaaggaaggaggatcaggaaattaaggccagaaatttgagaccagcctgggaaacatagcaagactcccatctctaagaaaaaaaaaattttaaatgggtggcatgcacctgtagtcccagctacttgggaagccgaggtgggagaatcacttgagcccagaagtttgaggttgcagtgagctatgatcatgccactgcactccagcctgggcgacagaggaagactcccatcatttaattttttaaaaaggcagtaatggctaaatctggttttataaccctcttggactatggggaatgggaagttaaattgtcatgaaaatctgatcaacagtaggtattcctatatgttaaaaaaaaaaaaaaacctaaaaattgctctattaaaacaaagcattcctgttaaaattactaagagaagcctcaaagtaaaaatgcttattttctcaaataatcttcatccttcttcatgcttctaataaattttctccaaaccaagaggaggtctgtgatctgagccttctctcttgttctttttataacttcttatctttcagcatcttacctgtgctgcctaaaaaaatgactaataaaggttttgctaaaatctgtggcaaaattaattagaatttaaatctaatgattcttttcattattggggaaacagtattgactgttgatgaggagtacaaattctaacatgagagttccagaattcagacctggccttctcattatcagctatgcaacctttgagcatattacttaacctctctaagtttaaatcattcatcaaatgaaggattagcagagtatttatcctgtcagttcccgtgaatattagatactacaaataaactacttagtat

SEQ ID NO: 108453 - DNA, 1026 bp, Homo sapiens
tgtattagaggcatatagtatggggattgattttatagacctagctaattttttcctcttttgggctgtcttcctttgtgctccatgcttcctcaacttctttttccttgatgcttttctgtcttacttcatctgtttcaacctttttgccttaacatctcattgtgaataaaatatacaagaaaatcatgtgcctgatactattatcttgcttcaaaagattatttactactttatctctttaaaaccaggcaaattgtttcttatagtgtaaaggcagacttaccttctactcgttttttatgaagtggaggtcgtcctttcttattccttactgatgaggttttgctgctgctacttccactgttcacagacattctatcatcttcacccccagtgactaatgaatttctataggagatgagtggaagccatacatcctccctcctttccatcatctgctcggtaaggaatttctctaggtatgaatgactagaaacacaatagaaacagcagtgattttcagagaagcagttcatacatcacttactttttcttaatctgaggctctctttctgcaggttctgaagaatacctaaggacacacattaaactattaacagtggtcacctttggaaagagagggactgaggagttaaggttttgtttcacttattcttgggatactttaaagcaagtgagtgtattacctaagggtgtgtatgtatgtacggtctttcctatatttcttcctttgcttttaaacaccaatgttaaaaaaaaatcagaagtttagctcaaaaagattattgagttttcttataaagtgttcaagccaaagcaggatttctaagatggtggagtaaggaggctggcatgccctctttccagcaaaacaacattttaactagtaaaaattataaaataccgtaatttaaagtatttgccaattctcttaagggcatacagcaaatggagaaaaatttattcaagaaaatctggccaggcaccgtggctcacgcctgt

SEQ ID NO: 108454 - DNA, 1364 bp, Homo sapiens
gagcccagggcaggcggatcacttgaggacaggagtttgagaccagcttggccaagatctctgctaaaaattagatgggcatggtggtacacgcctattatctcagctactcaggaggctgacgcgtgagaattcctttaacccgggaggtggaggttgcagtgagctgagatcccaccactgcactccagcctgggtgacagagcgagactctcaataaaagaatgtgtttttttattattattagaaacaaatttctgtctgcatttaatcacaccactagcatgaaaattaactcaagctattaataatagacaatttgtagaaagggaacagagtagctaaaattcaatgcaagaagagaaacatttcaccttataccttttacatattttttaattacctattctgaaaataactgtttaaaattctgagctataggttttttcttctttttttctttctatcagttatttaatgaacttgttcaagagcaaggtcccaacctagataggacatctgcccatgtcagtggcattaaagaactggcacgtcgctttgcccttacatttggattggaccagattaagacacgagaagcagttgccacacttcacaagtgagtgagataaacactttgttatgcagaatctgatttacttgaattttaatgaaataactcttatatgacccatttttaaagtgacgatagaattttaagttataagaactttggagattagtttagagattctaaactgggaggatgtttttaatttgaaaaaacttaaaccacccatttgttcatcttacaaagtatggaaagcaaaatttaataacatattattgtctggtctgtcagtaagaaaacagtgggtttgagagactatacaggctgggtgtggtggttcacgcctgtaatcccagtgctttgggagcccaaagcaggaggatcatttggggccaggagttcgagactagcctgggcaatgcagtaagaccctgtctcctgcaaaaaataaaaatgagccaggcatagtggcatgtgcctgcagtcctagctacttgggaagctgagccaggaggatcacttaagactgggagtttgaggttatagtgagctatgattgtaccactgccctccagcctggaaaacagagtgagaacctgactctgaaaaaataattattatagaattttttgttaagactatacaaaactgatttgggtttcattattgtgaaaacagaagtaacagaaaatctttagtaaactcacacagcttggtaccattaccagctctaagaagcaaatattctggcaatgtattaataattctctgtccagggtatcttcttacctct

SEQ ID NO: 108455 - DNA, 1099 bp, Homo sapiens
aacatgaaaaacattttcttatctcctggtgcccttcctcatgaaatactttttatatttttcttcttaaattactactttttaaatttccagtttgacatttcatctagtccaagaataaatcaccttaggattgcatctatttgaaatatgaactctaggattttcttccaaaagaaaagacacctaacctatgtctttgtaccagaaaatatccacagtaatgcactgacaaaatgatataaaatgacctagtttaaatgagatgagatacctagcaaatattaagcacagagaagtgcaataatgttatttccattctttgtctccctctctccaaatttcttacctgttgcaaactgagaatgagagtcttggcacactgaattttatcaatctgcctggttttactcagtgtttccttaataatatcaccatagtcattgtaatactgtgagggaaagaaagaaaacatggctttaaaattactgacatttcatgagataaagaataggttggtgtcacctcctttgaaaatgaaaaaaaaaaaaaaagaacaggttggttggtaaaagaaaggaaaggtaaataaaaaagtgttttatttcttcatcttaaacataacaggagttaaataactaaagttacaggaatgcacatttgatgtttaagattatgaactaatactagtaaaaccaaaaaagctgggaattccaggaagagaggtggtgagaaaaattccccattcttgttttttcttgtttgatacagggtctcactcaagctggagtgcagtggtgtgatcgtagctcactgcagccttcaactctgggctctggtgatcctcccacctcagcctcctaaatagctgggactacaggcatgtgccaccacgcctggctaatttttttaaaaaatattttgtagagatggggtttttgccatgttgcccaggctggtcttgaactcctgacctcaagtgagctacccacctcagcctcccaaaatgctgggattacaggcgtgagccactgcacctggccttctccattcttgttttttgtttttgcttttatttgtttttgagatgaagtctcac

SEQ ID NO: 108456 - DNA, 1051 bp, Homo sapiens
caggcgtgtgccaccacatctggttaatttttgtatttttagtagagatggggttttaccatgttggccaggctggtctcaaactcctgacctcaggtgatccacccatcttggcctcccaaagttctgggattacaggtgtgagccaccgcacctggccttatgctatttttttttcttttttttttttgagatggagtctcactttgtcacccaggccggagtgcagtggcatgatcttggctcattgcaacctctgcctcccgggttccagcgattcttctgcctcagcctcccgagtagctgggactacaggtgcccgccaccacgcccaactaattttttctatttttggtagagatggggtttcaccatatgggccaggctgctcttgaactcctgaccttgtgatctgcccaccttggccacccaaattgctgggattagaggtgtgagtcaccacgcccggccccttatgctatttttaaagaggggattccctaccagcaagcaagcctctatatctagggactcaggaacagggctgcaaacacaacatggtactcttaatggaatgctgaaaccatgacttgtaagtcattttctaaatcgaagatatttatttctggttttcagagaattttaaaatattgggttgaatataattttggagaagttctgaatttggtatgaatagacacctacttttacattccagattcttttaaatgaatattctgagagctgaacatgaaatggatattaaacaagacctgtatctttcttctctaacttttctagaccagccaatcaggcacttgtgattggacataatattaacaggaacacatgtattaaagaacaactctggagtcatggaacgaccgaaaggaaaggcttagaactaactaatggaacagaatttccaataaataaaaggtgggggcaaagattctctaagaaaagaagtgaaataaaatgcttacatgcgactaaaaatttgttcctacaaggatcactattatttctcacgcctggccccactcccttc

SEQ ID NO: 108457 - DNA, 1027 bp, Homo sapiens
ctttgctccagtgccccctagtgctggtcctgtggaagtaaccttcattttttctttgtagcagaaaacatccttcttccttcagctccttctggacatacacaaagacatttaaagagccaggcaaataagagttagggctaaaatgggccgggcatggtggcttacgcctgtaatcccagcactttgggaggccgaggcgggcagatcacaaggtcaagagatcaagaccatcctggccaacatggtgaaaccctgtctctactaaaaatacaaaagttagctgggcatggtggcgtgcgcctgtagtcccagctacttgggaggctgaggcaggagaatcgctttaacccaggaggcggaggttgcagtgagccaagattatgccactgcactccagcttggcgacagagtgagactctgtctcaaaaaaagaaaaaaaaaaaaaaaaaaagagggctaaagtaatgccctattactttctttggcctgcggatctagaatttatccttattttttttctctcctgggaggagctgtcctgctttctgtagtcttatatttgtgctactctctctgccttaccctgcatgtttctattctagactgcaatagggagggcctgggccaaacatccctacctctggaccctcaccctatttcaaatcctttatgtcaaagaaagtcaatataccctaggtagctacaagtccaattattattgaggtatttagctgtaaaatttgtccttccatcactgtcttgactaaaggttctcctctgaaaattccaacttgttgacctgcaaacagactggagaaaagagcagtaagggtgaaggtgggactgatagtggccaagccccatgagaagacatgtttaaccttgctgtccttcccacaaacatgcattcctacaaatgtgttagaaataggctcagatgtgtaaaaatctacaggctgctttctgtagctctttcttttctcttccctacccactccttcagaatagcagtgagcaagagata

SEQ ID NO: 108458 - DNA, 1890 bp, Homo sapiens
ccagcctgggtgatagaacaagattcggtctcaaaaaaaaaaaaaagaaaaaattgtcacaaccaccccaacctttaacaattttttttcagcctaggaccaatgcagaataatgcattgcatttagttgttacatttgtttttgtctcctttaacctggaattgtttctgagcctttttgtttcatgacattttgaagagtatagactagttattttacagaatgttcttacttgagttttgtctgatctgcatgtttaaattttagtttcacattcttggcaggactactacataaatgatattttgtcctcaatgcatcacatcaggaggcacgtgatgtcagtttgttcattattcatattattaactctgatcactgactaaagtgaggtctgcaaagtttctcctgtgtagttagcagtgtcctttttaattactgaagtgagctgtagacgtattctttaaaactatgtaataatcctgtttcttatcagactctgacataatagttttagtaccgatttatgatctttgcctgactcagttattactgtgagggtcacagagtagtgactaaaatgatgattttctaactctgtcgtttattttgtatttcttagttggcactctactgtaaggaagaactttcctttctccatttattcattcattcactcactttttacagttctgaattccttttaaaaaaaattggtatcactgtagactcatggatacctattttatttctgttttatttgacaagttgtaaatcagtactctttttttattttggttctcaaattgtagcagatttggccagtgggagttcctttcaatccagttcctatgtacgttagattttgtttgtttgtttgtttgttttttagacgaagtctcgttctgtcacccaggccaatatggcaaaatgctctctctactaaaaatacacaattagccgggcgtggtggtccatgcctgtaatcccaactactcaggaggcttttgtgatcttggctcactgcaacctccgcctcccgggttcaagcaattctctgcctcagcctcccaagtagctgggattacaggcacccaccaccacgcccggctaatttttgtattggtagatatgggatttcaccatcttggacagactggtcttgaactcctgaccttgtgatccacctgccttggcctcccaaagtgctgggattacagatgtgagccaccacacctgacctttattattattattttttaagcatctccatcctttctgacacacgaatatgtttcagggtctgcttatgcccttttctgtgctaatgaattatttttaatctatgaaaagtactaaaagtgattgcagttgtgtaacaacaataatcattagcttgtgaaaagcacacatttcagaatttattgtaatatctcttatacccacttttgtagaataaagtcaaggtatatttaaattctattctgttttgtgactttgttcctattttctgttggtatagttttaaatttaaatatcatcccagataacctctaagaaaaataattttttattttattttttatttttttcatgaaaccatttgaaagatgaaatattttctggaaaaataaaatattaatttcctgctttatagtttgtacaaccctcagtagattctaaaaatggaaaaccaatcgatcatttacaggtgtttttgtaaatagtatttgccatagaacaaaattgtgcgactacacccataaaaatgaagtataatcatgtatcactaactttgggcctctcaagtcatcaggatagaaaacttttattttgctcttacatacaaggtactattttaagctccccgcttgtctgcccaagctgga

SEQ ID NO: 108459 - DNA, 1779 bp, Homo sapiens
atttaatgagtatttcctttatggatctttttcaattctgcaaggaaatgaaaaaaaccttttttttttttttttttttttttttttttttttttttttggagacagagtcttgctcagttacccaggctggagtgcagtggcgcaatcttggctcactgcaacctccgtgtcctgggttcaagtgattctcctgcctcagcctcccgagtagctgggactacagtcatgcgccaccatgcccagctaatttttttgtgtgtatttttaatagagacagggtttcaccatgttggccaggctggtctcgaactcctgacctcaagtgatttgccagccgcggccttccagagtgctgggattacaggcgtgagccagtgtgcccagccgaaatgaaattattttattcttccactcacctgaactgagctcaaatttaaatttccttccattctagaataaaacagatgcatttttgtttatttcagtgcacatgatctcacaaaatgggatctctttggtaattgctacagattattgaagactggaattgaacatggagccatgccagaacaggtaggagtttattggtattccttctgtatgactctagaaagttgtttttctgaagtcatatgattatcagaagccttttatagaaagtaattgacgattcattagggcagctgcctcttttgagagaattattgctgtagtaattaaatgttattgataggtgtattatactggcttatgtgttaagagtagaaaaaacttttgctataacatatcttaaaaattttactgttaaggtagacttttctctattaggagaaataccattaatatctatggcagcaattttaaaactttggataatgaaaattgatgatgggtatattccagccgtgttctaggtattaatcatattaagtatggcttagtttttatattagaaccatagttaaattaacatggcagcctttaatagactttagaactttgtacactcatatatacaagttagagtagaaggggcagaaattcaacaaactttgcctaatctgaaagagacttcagtagaataattactctacttgattcagtatgagaaaggaaggagttattttgtacactgcagatattcatgtagaccaaaatatcatctccatcattaagtgtaggtaatatttaggggttatctcattcatttccatttggtagtatagaatgcttagatgataccttattactctaaagcagtaagaatttcaacagatacaataataatcttatattaaaaattaatcatgggctgggcacagtggttcacgcctataattccagccttttgggaagccaaggcagggtggatcacctgaggtcagaagttcgagaccagcctggccaacatggtgaaaccccatctctactaaaaataaaaaaattagccagatgcagtggcatgcgcctgtagtccccagctacttgggaggctgaggctggagaatcgcttgaacctgggagacggaggttggagtgagccaagatggtgccactgcacttcagccttggtgacagagtgagactctgtctcaaaaaaaaaaaaaaaaaaagttaattatgaaaacagtactttattattgctgtgattaattcatttaaattgcctaacattagtcattttcttggtccctacaaatgtccctgattatattaggtgtttttattgtagtttgtgaaaagacactaaatattttaccctctcttttttaaaatg

SEQ ID NO: 108460 - DNA, 1032 bp, Homo sapiens
caggattgcgccactgcccttcagcctgggtgacagtgtgagactccatctcaaaaaaaagaaaaaaataaatatataaattaagacaagacaagatggtctgctttgatattgttaactttctctcatgttaataagatgtgtaagtcagtaaataataattactaagtgtttcagtaatgaaggtggtctaggtgcattttacttgttaaaatatatactattaggtgtttcattgtggtttaaattctgtttacattggattttttaaacttccggtcagaaggttggtttggcttggcttgggtttggttggttggtttaagctagaaaagtaacttaccagatgggaacatttttggaagtcaaccacagtttcactgatcgaatctaggtaggcagagtctgagaaattaggcataacagttgcagaactgtatctacataatgacttaatttttcaaatacattttatctctatgcatgttgtaccacatgcaaaccacatataagctctggcatggagtggcatctaaattaattttctgtgctagtattttgctgtattttatgacaacaaaatgctaccagtaacttttttttaaagtaattttttagataggtggaatgtggtagaattccagtggagaaggctgtggttagcagttggagatgtaggactaaattttgggaaagcagacacactgtgacagactaccaacatcagtttaaatcacagtggccttaagactgtcttacagtgtttgtgtgtgtgtgtgtgtgtgtgtgtgtgtgtgtgtgtgtgtgtgtgtgtgtgtcggggggtgttttacagcaaaatcaagttgctgaataaatttttagtataatgtttggatctggttcttgtcaacagctctgccaccaggtaacaagaccataaccaaatcaagtaacttctggatatcagcttcttaaactgtaaaatgagaaactttatttttttttttatgggtttttttttttttttttttgagtctgggtcttgctctg

SEQ ID NO: 108461 - DNA, 1062 bp, Homo sapiens
tatggatggtctaaggatagtttctcagaatatgcgaattaggaaagtttgaagatatctccctcaaacctttgcctatattatttacaagcaaagatgctaatcagtattatttactctggctttgatggaattcaccaggacatgttgtgtgcatttgaaatgcagtcgaaatgaagtactgaattagtgtcagaagaggcagagcattacataagtcattaaaattcacactgaaaccagcctagtaacatggtaaccccgtctctacaaaaaaaaaaaaaaaagccaggcggggtagcacactcctatagtcccagctactccaggggctaagttcggaggatcacttgagcccaggaagtcaaggctgcagtgagccgtgattgtgccagtgcactccaggctgcgcaacactgtgagaccctgtctccaaaggagaaaaaaaaatcacactgaagttaagagtgattatagagttaggaatgaggaggaaatccaactcaagtgctgaatgtgccaagataacagtagataaccaatagtagatctagaagggtgactttcatacttttgggccactacttatgatgagaaaaatattttctctgacaagtacaagcacatataacagattacagttaatgaaatagtatttaccctttctatgtgctatgcactctttctactgtgcatcattttttgaatcttagttctcaatgcattgaattggtttaataacccaagaatggattgcagtctgtagtttgactaacactgattaccaggactgtttaactgaatgtaatgagcctcaaaagtggaagatcttttatattagggtggagaagttacttgtaagtagcagaaaccagaacaatgccaacaccttctgtacttgccttccctgaaaagcttcattagagtaatattctcagggcccagcatggtggcacacacctgtaatcctagtactttggcaggccgaggcaggcagatctcttgaggtcaggagttgaaggccagtctggccaacgtggtgaaaccccatctctaccaaaa

SEQ ID NO: 108462 - DNA, 1043 bp, Homo sapiens
ctgtctcaaaaaaaaaaaatatgaaagagaaattaaggtacagtatagattaagaaattttattatattgtgtagtaggagctgtgtaggagaacagaaacaagggaggccaggcactgtgactcatgcctgtaatcccaacactttgggaggatgaggcgggtggatcacttgaggtcaggagttcaggaccagcctggccaacatggtgaaagcctctctctactaaaaatgtaaaaattagtcaggcatggtggcaggtgcctgtcatctcagctactcgggatgctgagacaggaggatcgcttgaacctgggaggcggaggttgcagtgagccgagatcatgccgtagcattccaggctgggcgacagagtgagactctgtctaaaaataaaataatttaaaaaaaaacaatgaagggaaagaaccaaatcaaaggacatgcagtcagattactgcctaatagactctatatgcagattattacttgaacatgttttctagggaagtgaaaaatcaatacaataaaaggaaaagaggagtataagaaacattggtgagcaaataaattaaaaaacaaaaaacaaaaacctgagcgctaaacctaaaaactatgacattgatgtttaaggcaaatatctattaattagtttttaaatgtaggagtatagtgttcaaattaaatgaagagaagtgaaaaataggctaaggattttgataacggataaatgctagaaaataaaaccctgaatgaaggacagataaagtaatcaagaaaacatcacaaatagagcacagaaaataaaatgccagcaatattttcagcatgagtaatcccagtaaatataaatcaattaacatattttattaaaatgcagattatcatttgggattgaagtaaatgaagaatagctttatgctatttacaaacacatcttaaaataacttataggaagtttataaataataggctggataaaggctggaaataactaataaatgattacacaaagatagcagagggggcaatatcagtacaag

SEQ ID NO: 108463 - DNA, 1041 bp, Homo sapiens
tttaccattaatgtcattttactaaaaactattgggttcatagataatgtttccagataataaggtgtgaattttttaaattattgatgaaacatttggttatatgttataattacatgactgtgaaatcagtgtttaggaaaatagaacttagggccaaggcaggggtatcacttgaggtcaggagttcgagaccagcctggccaacatggtgaaacctcatctctactaaaaatacaaaaattagcccagcatagtggcaggcacctgtaatttcagctacttggaaggctgaggcaggagaattgcttgaacccgagaggcagaggttgcagtgagccgagatcatgccactgcactccagcctgggtgacagagcgagactctgtctcaaaaaagaaaatagaactcagttaaaaattacatattctagtatcaatcatacaggataatagcagtccttatcattttcacacatatttgaacattgattgttcattgtaaaagtttccctttacattttatatctagtttaacctgtaggacattgttcagatgccaccattttccgacctataatgacatcagttacatatttctattgaaatagatgaataatctgatctctgattttttttttttttcggagtctctgtcacccaggctggagtgcagttgtgcaatctcagctgtctgcaagctccgcctcctgggttcatgccattctcctgcctcagcctcccaagtagctgggactacaggtgcccgccaccatgcccggctaattttttgtatttttagtagagacgggatttcaccgtgttagccaggatggtctcagtctcctgacctcatgatccacctgcctcggcctcccagagtgctgggattacaggcatgagcctctgcacctggcctgatctctgatgctcgttctccctgctccccctttttgttgttgttgttgttaaacactgaaatgatttgtgtgttgagggaagactaaagttcatattcatgtaactttgcaatgccctgttt

SEQ ID NO: 108464 - DNA, 2499 bp, Homo sapiens
acctataatcccagcattttgggaggatgtagcagctggattatctgagatcaggagttagagaacagtctgcctaacatgacgaaaccccgtttctactaaaaatacaaaaaattagctgagcgtggtgttgggcacctgtaatctcagctactcaggaggctgaggcaggagaatcagttgaacccgggaggcagaggttgcagtgagccaagatcatggtgttgtactccagcctagttgacagagcaagactctgtctcaaaaaaaaaaaaaaagctgtagaagaattgtgagcattttattttcttctcgttgaatctgtattttctgaattttacattattgtcttttatacttaaaggggaaacattactttcaaagtaagataaaagatgagacaacaattattaagtcttgagctttataatgaactttagcaagtttaaataaaagtagaaaggaaaataaacatttgctttagatcagatgttactttctgtatttttcagtggaagtgaagaagctctttccaatgaagactgtgaaaatgtttaccacttggtgtactcggcacatcgccctgttgctgtggcagctggagagttccttcacaaaaagtgagctaattatctttgaaaaccggttctacttttctatgttgttttcttgttgttttagagtttgtagaagagagtaatagtgactgaacacagtgctgaaaatgtccatctgatactccaggggctataacagcctcacagcctatgtatacatggtgaatcacagccttgaggatgctgtaccttgtgacatactccttttttctgaaatctgagaggatgattctcagctagatgtgagtggagattggaggaatgcatgaaatttataaaagctaacgtaattgataattcatcacactagttttttctttaaaattctgaggtctgatcttactttcttaacatttgtaatctaaatttgaagcagtatcacctttaaaatgccttccaaattttcattttttttcattctttccattatgatgatttttttgtttttttgtttttttttgagacggagtttcgctcttgttgcccagactacagtacaatggtgcagtctcgactcaccacaacttctgcctcccaggttcaagcgattatcctacctcagcttcccaagtagctgggattacaggcatgcgccaccctgcccggctaattttgtgtttttattagagacagggtttctccatgttggtcaggccggtgtcgaactcccgacctcaggtaatccgcccgcctcagcctcccaaactgctgggattacaggcatgagccaccacacctggccatgatcaggattattttaatcagtaattcatagtaattctgaaagttttatatatatatagttgcagtttaattttttttaaaccttatttttttgtaaagcataacgttaatgagagtgtatgcatgtaaacatttaggatgtacatgttttagcgtgatttactgtatatgttctataattgattagtagattaactcattctttaaatcattttaaaatatatattatatgtaagtatatatgtatatataagtatatatgtatgtatgtatatataaatatatatttatatatgtatgtatatatgtatatatgaatatatgtgtatatatgtatgtatatgtatatgtgtgtgtgtgtgtgtgtgtatacacacacacacacacacacacacacacacacatatacacatttttttttttttagagagatggggtcttgctgtcttgcccaggctggtcttgaactcctggcctgaagtgatcctcccacctcagcctcccatagtgttgggattacaggcatgagccactgtacccagttgattaattcatatttaaaatataaacatattcttggttataggtgtgtatctttttgctttgttttgtgttttggatttttgttcatggatttaaattactagctttgaataatattcacaagtgattttaaaagtttattatgtattctaacttcttcttatgctgaagtacaactataaatcatggactaggcaactgttgtgcatcattgactaactttgataatgagcaggcctggtcctctctccagtatctgcattcagtgctacaataacaaattgttctctactcacttgtacctctcaaagtgagaaaagttatttctatgtaagaaatctctgttaagaaagaaaccagctacttactgggcatgctggcaaaggaaatgaagaggaagaaagtcaaggttttcaggcatgacttaaaataatattgcatttcctagtgactctgacagctctggctagtagaataatgctgattttatatttatctttggatgttgtctgtcactgataccaagaatgtactgtagtctttcttttttcagcattattttattctaattagtctctattctctacttttcaaa

SEQ ID NO: 108465 - DNA, 1066 bp, Homo sapiens
tggctcacttgctcccacaccactaaccccttgctgtgtggcccagttcctaacaggttacagaccaggattggggacccctgcttttactacatgttctttaaataaacccatatgaaattgataagtgaatctctgctttacaaaagatattaccatgagttcttatttattacctttggaagaaggcttacctgcttaaaattttctttacagcttgttataaagatagtaattttgtatgttaaggcttccttgacacaaggtttagggaacagcaattgttgagaaagattttaaattacaaacatttatactaacatcccctttgtgtgagtaggactacaatactgcagtttcaagagtaaagctttttatttaacctatcattagtattgcatatatatcccagaatacattatattagatctgtcccagcttattttctgttcatagttggtttgttttacaacttttttttctcaggatcgcattgtatcaatgacacttgataaagaatatgatgttgctgtggaagctattcgattggttactctgatacttcagtaagtaatatccattactattttaactttattgatattttaataccttttccccaggatttttaatgtcctatctatatatagtccttatgtatatgtttatcattttaggttcaacttttacattttaacgttagatttaaaaagtgttttctgtttttttctatttttgttttttattttcactattgtttacttcttccacataaaaattattttatgcagcctagagaaaataccaatgatgtaacttacctttctgtttaaaacaaagcaggcccagtatgttggctcctgcctaaaatcccagcattttggaaggccaaggcgggaggatcacttgagcccaggggttcaagaccagcctgggcaaaaggggagaccctgtctctacaaatgattaaaaaaattaactggcatggtggcacatgcctgttgtcctagctacttaggaggctaaggtgggagggtcgcttgagcccagaaggtcaaagctgcag

SEQ ID NO: 108466 - DNA, 1010 bp, Homo sapiens
gccactgcactccagcatgagcgacagagcaagactccatttaataataattttttaaaaaaagattaacagttcttttgagaaacattattctgtacttggatgttgtgactctgattttcttagaaagtttaacatgtttcttggctctgtaatagttgtgaggctctcagaaagctccaaatgtcattgtctagcccagtgaaaatagagtaattgggtcaaaatagtttaatagaagctttttttttccagtttggtattattagtgtttattttatagaaaacatgaaaaacagaagatacttaagttggaggccattcagaatgcaaatatatacaaacagcattagaaatatttattgcttatggaaagcgagtatgaatgcattctagctttgtatattaatttgagattgtcttttttttctctctctagtgatgctattgctgagattagagccatttgtattgaagaaattggagtatggatgaaaatgtatagtgatgccttcctaaatgacagttacctaaaatatgttggctggactcttcatgacagggtaagttactctgttctaagctttgatggaagttatgtttgtctcagtactaaaatgctgggaatcaaaatgacagtagttgatttttcaggagttgtaatcatgtggaaattttaagatgatgcagctgaataactatttacttgatgattgtgatgaaactggaagcatttgcccaggggtgaagaccctatcttgtttagttacaatattgtcttgaaccaagtttgacaacctggtatatataaagttttcagagaaagaaaatcattatattctttttctaattcagaatcaaaggagatttcttttttcttaatatataaaaactaagcttttttttaaaaaaaattttctaggaccatatcatagtagagtgctttatcagacttgaatagatttgttggattttagaatatttgatctaaaaatctaattctgccttct

SEQ ID NO: 108467 - DNA, 1027 bp, Homo sapiens
gtaaagccttcatgtttagtttttaatttcaaggcctgaatgctaggatgttgtaaaaattagtctgtcttatgattgtctttattcctttcctcttgtcttactattttttgcaccccctgcattactctttgctttggatgctcccaaatgcctcagctagacatctttcttaaatggggtgaggctattggaaatagagattagttgtttaaaaataaatttaatatgaaaacataaaatttggaggactcttatgaggaaatatgtttatatcaaaagatatgttgtaatcaaatcagggatatttagacttacactgcatttttattttatactgtatctccttgaatatactattagttcctggagagcaagaaagcaaatatataataataataggaatcacagaagaactgagacttcactagagcttgaaagaataatcagtgtaggtaatcagagtagaattcagggtattataggcatagggataaccacaaacgtgtaggtgctgatgcacttgagctatttggactaaagaactaattgtgtaagatgattggttattattatatttctaagggtcttttataataaggaaactaataattttaattatcttttgccatgtaacaaattactcccaaacttggtggtgtcaaatatttatctcaggctgggggcagtggctcacgcctgtaaccccagccctttgggaggccaaggcgggtgcatcacctgaggtcaggagttcaagaccagcctggctaacatggcgaaaccctgtttctactaaaaatacaaaaattagccggatgcagtggcacgtgcctatagtcccagctactcgggaggctgaggcaggagaatcacttgaacccaggaggtggaggttgcagtgagccgagatcatgccactgcactccaacctgagtgacagaatgagactccgtctcaaaaagcaaacaaaaaaacatttgtctcataatttctatgggtcaggaatttgggagtagcccagcta

SEQ ID NO: 108468 - DNA, 1064 bp, Homo sapiens
aaattaattagtttttatatgataaatgcaataaaaataatttttaacacttggaggaagttgcagaaatttgaatgattttgcaataaaagtattcccaaacttattttagtaaagcctgaaacaaagcatacagcaaaagaataaatctgagggaattttattgtcaacattcatgtatgtagtaaaagcaaatatttcactgaatattactatacagtaaattacagaataaattagaatagtagataccaccttgaatgtaattcagtgctgttgttgtttttgagtaataataaacacaaactttaactctgatcagttttgttgcctgaaatttgtatctttgccatagatactatttattttgttactgtacttcaccataagtagccaggatcctttttatcttctgttatacctcttattgggaacttggcctgctgtctgttacaggctagtgagatgcagagtaatgtttggatacattagatggagtaggaagttacttttagaacagcaaatatgttaattagggatgttcctttaaccaagaaaggcaaaaccaaacccagggacctgatttagacagaagagttctgttcctaaggcagatgatattttggagataggaatctgaccacacttagctataccaccactccttgtttgtgattgtgaagtttgtgtctagagagagacagtgaaaagttctaaaaccaatatgatataaatgtaaaggaataatggaaatatactggtattttcacacatctgtactacaagtgagaaaaggattgaaaactacccagaatgaaaataaccaggaattaaaaacaattggagctgttccttccaaataaaatgatcaggatttcaacttatatatattttttcatttcagctgcaagaaaatcaggatgaaatcgaaaatatgatgaactctatttttaagggtatatttgttcatagataccggtaagagattttaaaaataattttgaaggcttttcacttaaacaattattgattttttttgtggcccaggctaactgtaaaactca

SEQ ID NO: 108469 - DNA, 1073 bp, Homo sapiens
cacaaattgattgtaaacatctaaaacatctaaggtacctttgacacatttaagtaaaggtactaaggatgcatttatatatactcatatttgatgatcagtagagaggtttaggcttgattagtgtgcccttacgtgtgtatttttaggagtaggagaaaggagttgttgaagatagaactgaaatcctttcttctgttagttaggatgaggctgtgtttaaatggaaagtgttaacaagccaagctgaggtagagaaaattatgttgcagatgagtttatttctataaattagttatcttttatttaaacttaaattatgcctgggttgtaaaacagaaattcactagtttcatttcttcatccattggctttataaatttgtaatcttatatggataaagttttgattcataggtattataatatttcttcatttcatagccatgaagctcatgactgctctggtgaatgttgccttaaacctcagtattcatcaggataatacccagagacaatatgaagccgagagaaataaaatgattgggaagagagccaatgaaaggttggagttactacttcagaaacgcaaagaggtaagtttcatgggaactgatgattttatgttctgtaaatgtgtggaatatatatgacattagtactttttaagttccctgtaaaaaggtttatgtgtatatttagttagattatttgatgtcagggtttccaaatgaagctggagtgttcattggtgatcatgtaagtgccgtctgatggcagaaaggaatcatagaacacctctgtttttgaaagaagttggtctgggagttaggcaactcaaaaaggttataaggctataggctcaaaaagtatgataaatactgaagtcagaaccgtgagccagcaaagctacatttccaggaaaaagctaaaggctacatactagctggtatataaggcactcctatgaataagattggtctcagttttacaatgacattttcatatatgtgttaaaaatgattttatactgttttttttttgggggatggagtttcgctcttgttgcccagg

SEQ ID NO: 108470 - DNA, 1051 bp, Homo sapiens
attaacaacatacgtttatacggaattttcaaaggataaaacttttcagttgttctctcaatttactttaacgtattactgtaattcccatgtgtctacactaattaatggttatatcttccaaggctcacttgtataaaatgtgagacatagcagtcacctacccttcaacaaagcacagagggcttgctgagaacttaattccaggctggacaacaattatccctcttttcaaggacattttgttctcatctttgccctcttcttatttttaatggtatatgtacgaggaatagattaaaagataatcatttttattcactttgcaggacaagtcttggggactagataaaatgggcaggaacatttaatcctctgcttcaaagactatgtgcatggacagttacaaggcagttatggccagatatgattatcggctttggaataaaatgctccttgacattgcttaaatcttagctgagaagagagacaatcaggttagttattttgtagggtacagatgtgatgagttccagagcttcataagtcatcagagtggtcttatcagtagtatttttaatctgttttccaaatatcccattttcctgttatgaattcaatatgtgtccctgttgtcagtgtttatgcattgcatttaattgtatacttttacatttttattaaaagttttttttatcattatatagttctttatgtctgtttattccacactcataagtatattcttatttttccattggaggtaaactctctttttagaatatattttaccattaaattgaaagagactgttaacaattaaattttatattttctttaatcccttcgttggaattttcaaacatactgtcctagttatttggcccattttaataagctttacattgtagttttcattaactattgatcttcagagctaagtgcccttatttttatttgaaatagctatctcagtgggacatagtagtacagtttgtggatttaatttatgtaagaaacattgtgtcataattattttggtggatttaca

SEQ ID NO: 108471 - DNA, 1043 bp, Homo sapiens
ctggcaatcatcctttctagtctaaactttaaaaaattttttttactgtttcagattacctcaactatgatccaaatacaacaaagtggaactattattttcaaccaaagacttagaacaataaagtagatgctggttctaaaatagtaattttgagtattttaagaattacttagttgtggcagatcaaaatcaaagagaaataaagcaatcaaatgtgctatgaaagtcacctatttctttctataactgctttgcaaaaaagggttcctatgtaggtaggaagaaaaaaaaagctttcatcaaactctgtaatgtgacatacttaatatgttctttttctgttttttaggacagtggtgattatcctcttaccatgcctggacctcagtggaaaaaatttcgttcaaacttttgtgaatttattggagtcctgattcgacagtgtcagtatagcataatttatgatgagtatatgatggacacagtaatctcccttttgacgggtttgtcagactcccaggtcagagcttttaggcatacaagtaccctggctggtaagtaattaacattttatttccttttcatttagttttgttgactatgttttattctgattacaaacttaatgagaagatttaattaaaaatttaattagaataaaacagtcatttgaatagtttttgttaaaatttatgcctgttttcataactggcatttgatagccttaagaatgaaaattgaaattttctggccagtgtcatcaaatgtctgtctgaatgtttagttactaatgtacatccttatttataactgaagaaattttaagagaccactaggccaaattctttggaaaacccaagtaataatagttgaaattccaaatttattgtattttttcatcgcataattacattgttttattgctcattattattatagataagtgggtaaatacttgtttatatacttgaaacaattctgtccattagggtaacaaacattcttcctattcctagtgctataataacttaaacatactc

SEQ ID NO: 108472 - DNA, 1048 bp, Homo sapiens
tctttgaaacctagtaagtcactttttattggcctttaaaaataagggagtctctacttttattaggctacagagaaataatttcaggtaagtaattttctcgttcagatagaaacacacacaaacacacaaacttttttgaaaatttatttgctataatatcaaatttttttgaagttttcatttttatattttttttccacagtccgtggtggatgactggattgaatcatataaacaagacagggacatcgcacttctggatttaatcaacttttttatccagtgttcaggatgtcgaggtacagaatgttgaaataaatgatgtacattgagcctgtcagtccagcagtgtgacttttacttcacctgccactagtcgtatataatttaccctaaaattaaagattatctgctaatctttttctgatagagaatattattggtaagttatataaggatattccatttttgttcttgttcagttttgctcctataaagtaatacatttatatagtttttgaaattttgggaggaaatctgaaattcgttcagtagtttcatgaattgattttttagatcataggcttttataatttttactcatattatttgtatgtatgctccatattgggaagtgtgctagttgctagcattcattcttttatatccctgccagtatttcgtactcattttatagttaagtttaaatacttttcttaaagtaacacaagtagcagaatcaggtgtcttaagtttacaactgtaagacagtttgttaaagtgtaattttatttttatcattttaggagataactgctagatctttttcttctctagataaatcttaacaggttaatttgtattacatggggggaagtgagttgttaaatcaccattctctgcttgtgaatacagaagaatagtaatctttaattgagataactgaccaaattgatttcttgaaggcttgtttatttatgtacaagttatcacttaccatattgacatgagtagtttatcaaatatttacagagcaccaccctta

SEQ ID NO: 108473 - DNA, 1040 bp, Homo sapiens
ctgcctcagcctccccagtagctgagattacaggtgaacaccaccatacctggctaatttttgtaattttagcagagacagggttttaccatgttggccaggctggtctgaaactcctgacctcaggtgatctgcccatcttggcctcccaaattgctgggattataggtgtgagccagtgctcccagcctggaattgatttaaaagacgtaagtgagaaaactgatctaggacaggtaaaataattgttgaaggcattggagatgaaatttatagctgttccagttcatataattatttgatatttttcctaaggctctgtaacccagatattagtaatctaaatttactcttcagcaaaaagaacaagaatgtgagttatgattcattccaggaactcctttcagtagttgtagttcattgagtgtcctgagttacttaaaacaagacagagtataatctggcatgtatagtcttagaaaatgtttatagatgtcatgctgtttgcagcattaatgggctgggatatgaatgtctcctaactggatgcagagaggacctgaaaaaacataattaagaaagttaaaagccccatattccatattaaaacttcatccttcacctgtcactcagaggcttgccttggtatgttccttgctagcttctcctcagacctacagaagtagaaattgtggattgaaagatattggatgtatcttcaataagaatatcaaaatacctcagcattatggctcaaattaggatagagaacactgaaccaagaaacaaagcttcagtgactgggcatggaaggagggatggcttatgaggctgatctatcacaaggtggaggagtggtggtaggaatcctggcaagggtcctaaaggctgatcagtcttttgaatgctgatagaaacaggatggcttgcatgtgatagttaatagctaggagacagcagttatcataaagtacctaaaaagtaagtactgtaatattccaaggttactgggataatagcccagttttagataagggcca

SEQ ID NO: 108474 - DNA, 1240 bp, Homo sapiens
tagagctagatccttgaaggaagttagaaactttaaataggaattttcttagcctctgttcagttacacctaaaggtacctactgttactcgtgagcttagcttttagcaaatatattgatgttattatttttctgtacttgctgatttcaaacacgtggttttaaattaacatgggtgttttagataatattaagtcccttcatgatttcccgtaaatcattttccaaaggctttatccctatatatatagaattttatacagattatctagggcagatcaagtaagtaaagagatgactgtagtgtttgtgattatgatgtgtgtgtgtgtgtgtgtatatgtatatgtatacacacacataaaggattatacatttactggttttatttaatgtttaggaaaaatggactttatgtatttacatacttcatttatattattgtttatagatgtttaaatatatgaaatatggtggactttctattagtttaattttcaaagagggaacctaacttactttaatgcttctagccaaattatcctgcatgtaccctcagtaagaattgaaatacagaaaacattgcatgaataaagctatatccaggtataaatgagatttcttaaaaattctttctcaataaatttggtttgaatatgcctgtgcagtttctcattgtacactgacttgaatcatgtatgaagcagaatccttgcaaaaagctaattcacaatttgtttccaaactactaaagaaaactgaatgtatgttgatagaatttctcactatttgctaggttttagtcttagcttttgagataggaagacaaaagagatttgtttacttccagtgaggacctttgatctcagtacaggatttcttaatctggagtcagtgctaggattcttggaggacatgaacacagatggaaagagtggtgaaaaggaaaaaattggaattgattaattttatttttttattattattattattattattatttttgagtctcactctgtcacccaggctggagagcagtggtgccatctcagctcactgcattcaagtaattctcctgtctcaacctccttagtggctgagattacaggccaccatgcccagataatttttgtgatgttttgtttgtttgttttgagatggagtctcactctgtcgcccaggctgtagtgcagcggcgtgatctcggctcactgcaacctccgcctcccgggttccaac

SEQ ID NO: 108475 - DNA, 1858 bp, Homo sapiens
aatttattgtctctcattggagacacttatctcattggagatgagagaccataaattggtaagtgaagcaggcatataatgggaatgaattaaattactcaatagagagcataaggactgagaagaaaagatacttaggggagacctctaggtaatactagcaggtaagaaatacagggaggggaaagataactgaaaggaaaggaaaaaagtcttgtctgttaagagagtttcaagaaatgtctattgcatttagcaacgttggtgtcactggtgagtttggtgaagtagcaactgtagaatgagtttgtatgtgaatgaatgaatgtatgaatgaatgaaattaacaggaatagatacagtgactgccaacaattttttcaaatgatccttggccctaaaggtgagatagagataagattatagcaagtattaactttttaaaataaagttggggggaggggatggtatgttaattaaagaatgtaaactccatcagggcaagaatgtttgtctgttttgtttattgctgtattgccagtacctgaaatagttccagatacgttcagcatatttgttgcatgactaagaaatacttgagcatttcagtaggggtagaagttgaatatatggcatttcccagaaatgttttctgtacaagatttctgaggaagtaggagagtatcaatgaatgtatgcagaaggaaatgtcaagaaggggcaaggttaaaatattcaacattggcattattattgtacaaaacactaaagcaatttttaaaacatcatctaggtgtggtggctcatgctgttaattccagcatttttgaaggccaaggtgggcgaatcatttgaggtcaggagtacgagaccagcctggccaacatggtgaaactccgtctctattgaaaatacaaaaattaactggtcgtggtggtggggtctgtaatctcagctactcgggaggctgaggcaggagaatcacttgaacctgggaggaggatgctgcagtgagctaagagagtgccactgcactccatcctgggcgacagagcaagactctgtctcaaaaaacaaaagaaagttaccttcataccttttatgtataaacttatgttttgctctttgcacttttttgaattactgagaagaaattttaaagtttcttttggttagggattatatttcttctatagtagtgatcattttatataaagcaaagtaaacctaatcgaatggaatctttttttatctttttttcagtctacaaataagaaacctcgaaaatctccaggtgagaagagcagaattgaagctggaattagaggagcaggccgtggaagagctaatggacaccctcaacagaatggggaaggggagcctgtcacattatttgaggtggtgaaactggggaaaagtgcaatgcaggtaaattttaagtttttatttcacgtataaagcaatacagttaataacttgggtggaatcagttagtgtgtatattggcactttatatacttctgttgattatgtaagcaacctttcagtttatcctgaaaggttattattttgctttgttttgcaaagagtgtcaggaatggctgtttaatcgtaagatgtacttttgtttaaattgttctaagtaaaaaggtctactagaagctgcccaagagaatttttattgtcttgatattttttttttgaatctgatttagtgtaagtaacacatgtgtctttcagagtatttgaaagaagaagggatataaaaaaagaattcttaagtagtgaattaggaataaccagaactacatcatttgtaactttctttctttctttctttctttttttttgagacaga

SEQ ID NO: 108476 - DNA, 1017 bp, Homo sapiens
taattttttcttttctttttttttttttttttttttttagtagagatggggtttcgtcatgttggccaggctggtctcgaactcttgacatcaggtgatccacccgcctcagcctcccaaagtgctgggattacaggcctgaggcaccgcacccagccctcttttttttttttttttttttccacaccaccacaatatcattgtgaagtcccagtataaaatattttattaatatcaccaaatagccagttttatagtttgtaatcatcttatgaacatttaaaatctagttcggtggttagagtcatgacacaggaatgatccaccccctgcaactgatggttatgttgcttaaccagttattgtctatatgtcttttacagtgagttacacaacaagactggttttttgataagttaagtcatttttccctcttgtttgccagaatttttaattaattactcctccaggccaaccttaaaataaaaaacaagatgaaagacttcttgtattttgctatacacttgcttttatcctctacttttatttaaaggaaaaaaataatgggggaagacatgcagtatagtaactttttgtattatttcttcatttgtagaagtatttggtggtacagtattctttacaaacgtattttgggaaaagtgagagttttgcacttggaagctgttgactattctagttcccattactaccatgtgatttttctgagaccataggcaagtttcattgctatcctggcaatctcaggatataactgcagaattggaaataagactagatttgcttaaaggtaggagaatgaattgcccacatgtttgcttacttgaatttgttctccccaacttgaaattcttcacttacaggattcagattaagtactgtctccttaaagaaacttttttatttttcctaaagagaatttaccaccccaccagcaggctattgtataattcgttagaacctgtttaagttttatgtgtgtacagctgaatcctt

SEQ ID NO: 108477 - DNA, 1015 bp, Homo sapiens
ttataacttaggtgtttgtattttttttttgaaaagactggcataacactgcccttcatgactttataaaataaacaaaataaataaaaatattcctaagccttcatatttttgtactgaagaattagtcttttgcagttatattttgcatttatttttgtatagcagctatcatttccacaatcatttcttcctcttcatttccctctttatttgggggattcatttcactcactgttatgtgaaattaggaagggaggataacatttttagtttgctagagagtttctctgaaagtagaagtataaaccacttctaatcagccatatagcaggtggtaaggaaagtagtgaaacagaaatgcattatacttattaatttgttcgctaaaataatataacattttctagggattcaactaatgaaactactgcccattccgatgctggcagcgagcttgaagaaacagaggtcaaaggaaaaagaaaaaggggtcgtcctggccggcctccagtatgtattatgcttgtcttctttgttcctttaatagtgaccgtgttaatgagtttatatgagttgttaattctagtgctagtatggttaatacttaaaaaaaattcagtgacacaatagagattggaaactttttttcacataaattgtcttggcagtgatcagaaaaaggagatgattgtagtatgattttgttgccctccttctctttgtaaataaatggtagtccatgtgaaggcatagagaaggtcactaacagtgaatgaggtttagttagttaagacttgctgcttttcagatgcaactctgatttcttatgagctcccaagtactgttttggagtttggggccagtctcagagtatattctcattgataacctgattgggaagtttagaagagctctagataatcctactttgagagatagcttaatgtattgtacgagcatcagtcataatttaagcatgcataaaccctatagaagatactgttatctgctt

SEQ ID NO: 108478 - DNA, 1017 bp, Homo sapiens
tctgctggccttggcctcccaaagtgctgggattacaggcatgagccactgcacccggctgtatggatctttatgaaaaagcttgctgaccctggacatcatttacaatattatttatagtttcatttttgttgttttgttttgtttgtttttgagacagagttctactctttcgcccaggctggagtgcagtggtgctatctctgctcactgcaacgtccatctcccgggttcaagcgattctcgtgcctcagcctcccaaagtgttgggattacaggcatgagccactgcgcccagtcttatttatggttttaaataccagattaactttaaagatatataagttagagtaatatgataactttgaagatttacaagtgggtaagtaatgatgtgagaatattactggcagcggtgtgtagaatggcttgaataagcagcagtagggagataaattgagattatcatggggagtggtgattgtggtaataatcctggaaagagtgagaaacagattatattgttctgagaaggatggctgaggtaggattatgttagcaggaggcacaagaagactgatatcattctatcaattcgagtttatagacaggataatggtgacaataaatttgtataataacttaaagcatacgtatgcataacttaaatcagttaattaattgtatctctgtgagtagaaagtcagaggtaagtcaggattggattcaattttagatgtggcatttggtgaatttgaggtggcattcaagtaagtatgtcatgcatgcaagataaaaatcctgagtcagagatctggaatgcggtcaggtgtactgatagggtattgaagtcatttgcatagaagttacacattaactggatgaaatctccaagggagtgtaatataaatggagaagagcagacctaacagttgagctttaaggaagagggaatgagcctaaaagagcatttggtgaaggagattgagaaatagtagattgtgagttggacttacc

SEQ ID NO: 108479 - DNA, 1374 bp, Homo sapiens
gctcccgtgatccagtcacctcccaccaggtccctccctcgacaggtggggattacagttcgagatgagattttggtgaggacacagagccaaaccgtatcagcatgatagagatataataagctatatacttagaaagttacttggtgcagtatagtattagatgggaaaggccaacactagaaacaaggagacctgtcaggagaaggatgttgcagtatctagggaaaagatgataaactagttaccctggagatagaaagaggtagacagaatttagagagctctagggagcaaaatcattttttaaacaagatttgatcttactcttccatgctcttaatttatgtctagtagtgttataaatgtgaacattagccatttgcaggagttttgaagagcaattggtcaaagtttgaatttccataccccttgacctgtcattttcactgcatatatcctaaagagaaacttgattatgtagtaagatttatttatgtacaagaacagtcatttcagccctgtttgtaatagtgcaaaactagagacaaactaagtgctcattgataaggaagtagctaaataagttcagtgcatattatggagtgccattcaggaatctaaaatatttatatggaagattctcatgtatgtaacacttaaaaaattgaaatattgatatttatattttgagagagagagacagagagatgcaaaagcctaaatatttatggcagcgtcaaactattaacagtggtattctgcagatgggattcagagttaggatgagataaagtgaaacttttccttgtattcttatatattttctgttgctcgaaattttctttttcaaaagcctagaatttgttttcttatgtcttaataattaaacatacacatactaacacataacagtgcattagctgtttgttggcaatagttctcactgtttaagctgactgcagttggcagcattattaaacaaattgtacttttctgactcttggtaggggcatcaataaacaatactgctgaagaataggttagtttcactaatgggtcagtaattatattctagaaccaacctgctcctatagttgcctggacacttgtaagcatcaaaagcacttggagattttgtccacacaagataaatacgaaacatagtatttgcattgtagtatcttaacatgaaaatagaaaattcaggttgatcttgagatctaactggactctgccacttactaagtgtgcgactgtggacaagtttatcgggttttcagatctttcatttcctcattcataaaatcaggaagataacatgcttcttacaaggtttttgtgcatatgtattatagataacatatgtaaact

SEQ ID NO: 108480 - DNA, 1195 bp, Homo sapiens
gctgtgttgagctttggttgttaattgataaatgtggtatcctctctgtgaaagcttttaaaatgcataacacgtatttcagaaagcagctgttgctatggcaactctcgggtcacttgcagctcagcttacatgattggctgttaatggagtctaatatgcttgagaagagaattgagcaaatgaaagagggttttgaaggaatcctgttaaagctcttgaagttaacagaacagctcacaaaaatttaacacttatattactgttaacacaattttgctggaagtagttttatgaataatgacagtgagacaggacaaatttttggaaaaataattttcaaaatccttttaggaatgttgtaatcttgtcacttttccttattttactgttgtttaaagaaacactttcacagctatcactcgcgttctgtgctctattctctgaagtacctgtctcagaggagttaattacaatgaggcgtgagaaggttgttaattgtgcagggtcaaaaagagtggtaaaaccaggaatagcgtcaaaattttactctggttacatgaattagattagaattgcctcttacttgattcttaagatagccccatgaatacttgcctcattcttaggggtatttggatggtgtgaaaagggaggttgtggtgtgtactgtggattttgaggccagtaaagtaagtaaaattaagcataattaactaccataataaaaattaatagagccatggaaaatggcacagtaacatatatcttgttaaatgacagaattttcatcagtctccacctactactacttttgacagttaaatataagtaaaacataattatcagaatttataattcagatgaaatttactaatcaataatttaacatcacctcggaaatgatttcactttgtaaaaacttcagttggttagttcagccatatgtacttggaaaagagtactaaggcatgtagcttattttacatatctgctgtttctacttagggtcttaaaaaattattgattatggtactagtgttgaaattgatgaactgattatgttacagctatgctggtgtatagttatatttggttttttggttttgcaagcaaaaattggtgatacaaatcaatatctaccaacaccctaaattacctttgatttttttttttaaatttcctattcaagtaa

SEQ ID NO: 108481 - DNA, 1048 bp, Homo sapiens
ccacattttctgatctgagagtggagtttttttccttccatatgtttatgatttgatttctgagtttaaaaacaaaataaaacagctttctgttgttacctgaagatcaagggtggaacaaagagtacatttgtatgctcagtccaccgtgttcaattggaaaccttatagtttacttaacagtcctaagttagtgttacattttggtgttttccagtttttctaagagtttatttttgctatatctacatgaggagccatgcttatttttaggaatgatgaaaacatgattgcttgtctgaagcctacctgtaaaatctttcattccccttatctctggtgctaactgattgggtcatggttaagagtgaatctatctctgatcaaactgtcaggtttctatctcacttattaaattctgccacttataatctatgtgctcttgagcaaattgcctcatttctttgtacctatttgcttattctaaagtaggaatagtaatatctacttcatagggttgttgtgagagttaaatgttaagggcatataaagaaagttcttaggacagttcctggcttatattaagcatttgataactgctgtttgtcaacatcatcatcataactatactcatccatacatatatatcctttttaaaaaaacaaacagcttttttatcctcttacacagtttttgtataggctgtgtaggtttatttattttcaacccacttgattttattttaatttaatttaatttaattttactattttattttatttatttgagatggagtctcactctgctgcccagactggaagtgcagtgatgcgatcttggctcactgcaacctccacctcccaggttcaagcgattctcctgcctcagcctcccaagtagctgggattacaggcgcctgccaccatgcttggctaatttttgacatttagtagagatgcgatttcaccatgttggcaaagctggtcttgaactcctcacctcaggtgatccacgcacgttggctccccaaaatgctgggattaacaga

SEQ ID NO: 108482 - DNA, 1309 bp, Homo sapiens
ccggctaattttttgtatttttagtggagacggggtttcactgtgttagccaggatggtctcgatctcctgacctcatgatctgtttgcctcggcctcccaaagtgctgggattacaggtgtgagccactgtacctggccttttttttttttttgagacggaatcttgctctgttgcccaggctggagtgcagtggcgtgatcttggctcactgcaagctctgcctcctgggttcacaccattctcctgcctcagcctccccagtagctgggactacaggcgcctgccactacacctggctaatttttttgtatttttagtagagatggggtttcactgtgttagctagggtggtctcgatctcctgacctcgtgatctgcctgtctcgtcctcccaaagtgctgggattacaggtgtgagcctctgcgcctggccttctttcacttctaaaggcctgtttgattatatcatacctacctggataatctaggataactgccttattttaaagtctgtaaccctaacgctatgtagtacagtatatagaagagtaacagcaagggacaaaaatcataaagggcctaaatcttgcctagccacagtccttcctctggcttccatgatccatatctatctcacatacaaaatacaaccaccccattccaaggtcctcaaagatctcattgtataacagttcaatatctcatctcaagcttttcagctcagaagtccttaatctcacatctagatcatctaaataaaaatatgggtgatgctctttattgatggacctgtgaaactaaagaaacaagtttacttcttccaaaataagtgttgggacagtaatagacattctggttcaaaaagggagaagatgtaaaaaaggagtcgcaagtcccaagcaatttcaaaaaccagctggagaaactccactacatttcaaggcctgaaaataatcctttgtggtttgcagtttcaccctctgggcttgcagctctgcctgctctcttagatacttttgttagtttttaaaaaaatatcttttctttttcctcaggtttgatggttcttggttgcccatccatattcatgaaaggaggattaagttggtctgtttaagtaactggaatgagattctctgttgcaggtttatttcatccacaggtctttctcttggctgtggcatgtggtagtctttaatgccttctcaaaggcatgcgtttctcaaaaaattggttttgggggcaaaaaaaaaagttgctctttttgtgtgtaaagcacagatatacatacaatacacaaatgtat

SEQ ID NO: 108483 - DNA, 1648 bp, Homo sapiens
gaaaacctcagtatttggctttcttcaccagtctgaacattctgccttggaggtaccactgaagaagtatagggcatcatgtagaaagcaagcatagttggaaaattactgacctctaatatttttaatggctgcatcatattccatcctttgacatctgtgatagttctggaagtgttttgcttcgatctcccttgaaggaagtctctattgaggagtgttagctgatagcttccagctgcagagcctttgggattggctacatcattgagccacattctcctcaggcagctccctcccagtgactgatcccagtagatactacggtctgaccatttctgctcaacatggggcttctctcgagttctctgctgggctggcagatcagaactgtactgttccgtgtcctttcctgatttcccctccttcctcctctgctttcacagttggcagcctgcattgcagcctgaaggctttctctatgcttactcctcttgctttctcctttcattcttcgtaggcatttctcacaaaatgtttcttaaagttttaactccatcttgggcctactttatttttttatagatatataaatataaatataatatataaatgttatatattttatatatattatacataatatatattttatatattatgtataatatattatgtataatatatatcatgtataatatatggtatatatcatgtataatatatatgtcatgtataatatatattatatatcatgtataatatatattatgtataatatataatgtgttttatatatatatatatttgagacagtctcactctgttgcctcggctagaatgcattgtggcatgatctcgcctcattgcaacctccatattctgggttcaagcaattcttgtgcttcagcctctcgacatagctgggattacaggcacatgccaccatgcttggctaatttttgtaattttagaagagacagagttttgttctctactaaagagaaccaattggccagttatctactattctctaccagttggccaggatggtcttacctcctggcctcaagcaatccgcctgcctcagcttcccaaagtgctgggattacaggcatgagccaccatgcccggccaggtctactttctagagaacctgaactgacacacaaccaggtggtttttaaaaaataagtatttaaagacattatcattcattcttatggtttaaaaaacacagaaatggggccaggggcagtagctcacacctgtaatcccagcacttcaggaggccaaggcgggcagatcacttgagatcaggagtttgagaccaccctggccaacatggtgaaaccctgtctctactaaaaatataaaacttagctgggcgtggtggcatgtgcctgtaactccagctactgggaggctgcggcaggggaatcactggagcttgggaggcggaggttgcagtgagccaagatggcaccacaaaaacacagaaatgcacaaaatgaaaaataaacaatccaccccttctccaaactctaagaaaaccattttcatatgttcataatcatacctatgtcataatctcactgatatcattatttcattttctgtctgtctgtctatctatctatctatcttt

SEQ ID NO: 108484 - DNA, 1364 bp, Homo sapiens
actcctcaccattgagttaatttggtttcagcttgatataatcatttacaagatctgggttctgcttcccatgccacctattttggattttatgtatttactttgttcattccacacagatggtttatcttgtttcattcttcttaatttaatgctcagtgttcacttaagatttttttttttttttttttgagacggaatttcgctcttgttgcccaggctggagtgcaatggcgcgatctcagcttaccacaacctctgcctcccgagttcaagcgattctcctacctcagccttccgagtagctgggattacaagtatgcactaccatgcccagctaattttatattttcactagagatgggatttctccgtaatggtcatgctggtctcgaactcctggcctcaggtgacctgcccgccttggcctccgaaagtgctgggattacaggcatgagccaccgctcccggactcacttcagttttaaaagagccacttgtggattggatttatccttacaaagttgagtgagatatatattgcttctagtgcattcttgcttttgcatctaggaagagtatggattttgcagtccatcctagattgccctgtcaagtatttagctgaaactttggagcaagttacttttttgagatcgatccatccatccatccatccacccacccacccacccacccacctacccacccacccacctacccacctacccacctacccagccacccacctacccacccacccatccatccacccatctacccacttatcatcccagaggcactgtagtgctgccgctccttgcttttctgtttttccttgacagatacgttgaggtataatttacataacataaaattctcccattttaagtgtacaattcagtgatgtttagttaatttggaaaactatgtagccaacactacctaatttcagaatacttctatcaccccccaaagaagaaaatctgtgcccatttgtagtcatttctcattttctaatcttagggtactactaatctattttctgtctctatagatatgcttttttgggacatttcataaaattggaatcatttatatgctcttatgtttggcttttatttagcaatgtttttgaggataatccatgttaaggcatgtttcaatactttcttgtattttgaagagttcttcattttattaatttgtttacttcatggacatttgagtttcaaacatttggctgttgtgaataatgctgtgaacattcatttacaagtcttggtgtagacatatgtttcattcctctttggcagatacctaggattggaattgctcggtcatgtagtaaatttatgtttaat

SEQ ID NO: 108485 - DNA, 2436 bp, Homo sapiens
ctggtggtagattaaaggggcgagagaactgtcatttctcaagtatctgttataggcattatttttggtgctttaaatacatagccatcatttattgaatacaagctttttattaaggctttcaagtgctttagattcattacatgccattttcttcacatataacccttcagagaatatggcaaagatgtttttacagatgagggctttgttaggctctttttcttctctctcctcccctccccttcacttcaaggggaaatgatcataaacatagatggggaatgagattggggtggtgctgggattatcactgctgccagctcgcctattacttaaggctgtccaagttatacatttttcatttcatttatatactggaaaagaaggcagatggtatttattcttacatgagagacagtatcatgtaaacaaaataatcatatattatgatgaatgctgtctatgaagggaataaatgaggtgttatgatggataataatgaggtacttaacattaaaaaaggccaggaaaggcatctctgagggtgtgaaatttaagctgaggatgtgtacagaacctaggcaagaatggtccagatacagggaagagcaaggataaatctttttagcagaaatggctctaggaattcagagaaggccatagtgactagagggaacataatgcaggaagagtacagtggtgttgcatgaggttagagaggtaagcagagtctggattatgtagggtgtatttgggatagttaggactcatagattttattataagtgaaatgagaagctgttagagagttttaagaagaggaatgtttaaaaaacattcttctaggacgggtgcagtggctcatacctgtaatcccagcacttttggaggccaagacagattgatggcttgaggccaggactttgagaccagcctggtcaacatggcaaaaccccatctctactaaaaatacgaaaattagctaggcaaggtggcgcacacctgtgatcccagctacttgggagactgaggcaggagaatcacttgaacctgggaggcagaggttgcagtgagccgagattgtgctgctgcactccagcccaggtgacagaacaagactgtctcaaaacaaaacatattcttctagcttagtggttctcaactgagggcgattttgcttcccaggggacatttggcaatgtctagatttttgattgtcacaactgggaataatggtttatgctgctggcatcagtggatagaaacctagggattatggtgtatgctactgacatcagtggatagagacctggggatgatggtgtatgctactggcatcagtggatagagatcagggatgctgctaaaccttctgtaatgcacagaacagtaaacaactattggcccaaaatgtcactagtggcaaggttgagaacccttgcttttgctattgtgtgaatattggatggtgggtggggtgtggggaatgcaagagggagggttaggttgttacagtgtacaggtgacagatacagtgccttggatgatggttgtaatagagataatactgagaagtgttcttattctgtatgtgtattggagttagagtagataagtgaggaaagggataagtcaaggacgatctccaggtttctaactaataattgagtgatttgtgatacagtcctaaagtagggaagactgggaatgaagtgttctgatttttaaaattttatttcattgaatttgagttgctattaatagaagacacaacactattttagggtacaataggaaggaagcagtaacctcatgctgtctgtacttggtcacaccagccattcattgctttgaaatcttatctgttctcagggatatggcagtttcttctacctttatttgtattgcgtggcatatgataggctgtccttctgcatgtgtctcagtaacaaaacataatacagcttcatctacttgtggctgttctcatatcccataagtcatcactttactgttgctttgcaagaaaacatagaattggcgttattactagcaataattaatacttaacttgctaatacagattttttttgtgcctttctgcatacttaataacttttcagtgccaaattgtagagtagtattttgaaagcagttaaacacaacatgcatggaaccagcaatgttaatagctcaactgatgatcattggtcaagctagtcagattttagaaataggaaataattcttttgtcagaagaccttattttaaacacacacacacacacacccgtataattttgttttctagttcttgcctactgaagagtggtaatattgatgtatagagtgactcatttgcttagggtaagatttttggtaaaggttcactaagaaatttagaagcttccttagttgatttaaaatacgggaa

SEQ ID NO: 108486 - DNA, 1053 bp, Homo sapiens
aaaaaaaaaaaaaaaaagcctggcgtggtggctcatgcctgtaatctcagcactttgagagggcgaggtgggtggatcacttgaggctaggagttcaagactagcctggccaacatagcaaaatcctgtctctactaaaaatgttaatacaaaaattagctgggcgtggaggcacatgcctgtaatcccagctactcgagaggctgaggcaggagaatcacttgaaactgggaggcggaggtttcagtgagccgagatcatgtcattgtactccagcctgggtgacagcacagctctgtctcaaaaaaaaaaaaaaaaaaaaaaggaaaactacagatgttgtagatatttcaaagtacaatttcagtacttcaaaattagggtaattgttagactaacctctagatcttatttactgtgttaaagaatcatattacaatattttaagttgctttaatatattgataattgtatttgaatataattaattctcttataagcatggtaccattcacaaagagggagagtttagtggatagcttgatgtagggtagacaggaaattttaaattcataaatccctttgtctaggctgagcgtggtggctcactcttgtaatcccaacactttgggaggctgaggctggcagatcacttgacctcaggagtttgagaccagcctgggcaacatggtgaaaccctgtctcaaaaaaacaaaaacaaaaacaaaaaaaccacacacacgcaaattagctaggcacgatggcatgcatatgtggtcccagccactctggaagctgagtcaggagaatcccttgagccagggaggcagaggctgcggtgagccaagatcgtgcctttcactctcgcctgggcaataggagtgaaatcctgtctcaaaaaaaacaaaagaatctttacagaagagactgtctctctttcccatccctcctttatttgttttgttaaatagaaatgaaacctaagttctttgttgttacatgtcaaagtattagattaaaaaacacttagggtttaggagtgctttttactaa

SEQ ID NO: 108487 - DNA, 1050 bp, Homo sapiens
ctgtctcagtctccacagtagctgggattacaggcgcacaccaccacacccagctaatttttgtatttttttagtggagacggggttttgccatgttagctaggctagtcttgaactcctgacttcaaggatccgcctgcctcagcctcccaaagtgctcagattataggcatgagccaccgtgcccagccttgttgtttaattttcaatatttgggattattctagataacttattactgatttctaacttagtttcattttgagtcatatctttatgattttaatcctttaaaatttattgaaacttattttatgggccagcatatggtccatcttggttaatgtatcttttatacttgaaagtgtgttttgcagttgttgggtgtagtattctgtaactatcaattaggttaaggtgttttaatagcacttttcaaataatctatgtatttgttgttgttttttgttgttgttgttttgtctcattctatcagctgccaagaagaaagttaaaatatccaactatgactgtggaattatctgtttttcccttaattctgtcaagtttttctcactcattttgaagctctgttgtaagacatgtacaacttatgattattatgttgttttgacaaattgacctttttattgtgatgaaatgtctctctgtttctggtaataatcttttccttgaagtctgctttatttgatgttaatatagccactccagcgatcttgagcttactgtttccataatatatctttttctacctatttacccaaaactcttcattatatttaaattgcttttgatggtagtatatagtcgagtattgctttttaaaaaattcctggccaggcacagtgactcatgcctgtaatcccagcactttgggaggccgaggcaggcggatcatctgaggtcaagagttcaagaccagcgtgaccaacgtggagaaaccccatctctactaaaaatacaaaattagccgggcattgtggtgggcgcctgtaatcccagctacttaaaaggctgaggcaggagaat

SEQ ID NO: 108488 - DNA, 1468 bp, Homo sapiens
tacaagggatgtacgttgcgtgctttatctaatgcatgatgatctgaggtggaacagttttatcctgaaaccttctgattccccaccccatccgtggaaaaatttttttccacgaacctggtccctggtaccaaaaacgttggggatggctactcctttttgccagtcagtagtgaaggatgtcataaatcttgccttcttccctgccccccgtttgttttttatttatttttaattttgtgagtccatagtaggtgtatgtatttatgggttatgtgagaatgtcttaccttctttatgaaatacattcctttgtgctatgggccaaaatgatgtaccatttagttgtccaagaatttcaatggaattttgctgtaaacataatagcaatggcttttaacttgttttctagcttctgctagcagttacaaaaacattttacattgtagcctagtacaaacacacacatccacacacaatgaaaataagtttcatgaaataatactttatctttatgcagtgcactctgatattttctgatcttttctattaggaatgctggttgtggctgggcacagtggcccacacctataatcctagcactctgggaggccgaggcgggtggatcacttgaggtcagaagttggagaccagtgtggccaacatggcgaaaccccgtctctactaaaaatacaaaaattagctgggtgtggtggcatgtgcctgtagtcccagctgctcgggaggctgaggcacgagaattgcttgaactctggaggcggaggttgcagtgagctgagatggcaccactgcattccagcgtaggtgacagagtgagactctgtctcaaaaaaaaaaaaaaaaaaaagatggttgcagtttacctaagaaatgtcacgactcacagcagctaacactgggaaaagcattgaattgtaatctcattggtaaaaaggaaagtgcaaagtagagccatgagaagaaaccatttcacttccatcagattgacaagcattaaaagtctgataatgtcaagtattggtgagaatgtagagaaattacattctcacttttgtcagcagtgtaaattgatacaatcattttctgaaagatgttagtaagatagtaaattcaagcttcatgtattttaaccccagcagttgtactcctgtctttatattcctgatgaatgaaatccttgtatttttattttggagacggagtttcgcccttgttgcccaggctggagtgcaatggtgcaatctcggcttaccgcatcctctgcttccccagttcaagcaattctccggcctcagccacccgagtagctggaattacagggatgcaccaccatgtctggctaattttgtatttttagtagagacggggtttctctatgttggtcaggctggtctagaactcctgacttcaggtgatctgcctgcctcagcctcccaaagtgctggga

SEQ ID NO: 108489 - DNA, 1043 bp, Homo sapiens
aaaatgctgggattacagttgtgagccactgtgcccggccagagttgtctttcaaggtcactacttgttggcacaattaatttccttgtgatagtgtgactgaagtccccatcttcttgttagctgttggccaaggactgctctcagatccttgccgtgtggccacatagttcacaacatggctgttagcttttatccatgctagcaggagtcagtctccctatttcctgtgtgtctgacctctgactcccccctttaaggtcttttttaaaagctcaccagctaagctctgaggcccttgtggtaaacttaactgattaagggccttaattacatatgcaaacatatattttgtcatataatcaccgtaatgatatcccgttatatctacaggtctctcccacactcaaggggagggcatgatacaagggtgtgggttagtggaggcttttaagaattttgcctgccgtaggaaaagaagtatcttcacatttacctcttcagattccggacatacaaggagaggacctaggcagagcagtaaccccacttgatcagcttactcttacttatattgccttttcctcaccttttttcctttcccgtttcctggtaccttagtttacatgccttcctctatgaaataattttattgcattgagaggaaattaaaaataaaaacgaaaatttaaaacgttataaagaagggaggcaatgggagaagggagtttgtataattattttttctttcatttctgccactaagaacacctttttaaaaaatttaaaaaaattactattattggcctggtacagtggctgacacctgtaatcccagcactttgggaggccgaggtgggtggatcacctgaggtcaggagtttcagaccagcttggccgtggccgacatggtgaaaccctgtctatactaaaaatacaaaaattagccaggcgtggtagcacttgcctgtaatcctactactcaggaggccgaggcaggagaattgcttgaacctgggaggcggagcttgcagtgagctggg

SEQ ID NO: 108490 - DNA, 2764 bp, Homo sapiens
aaaatggcgggcggcaactcggcgagccggacgcgcaggcgccaccgtggccgtccttccgccagccgcgggcggcccaagaaccgtccacagcgcccttatccagaagcctacgcctctcgcgattggctgaactgcgcgagcgctccgtgtgggggcggggccgccacgcagcggccacgtttcccgccccgctggtgcgcgtgcgcgcaatccccactggaaagcgtttgcgcgcgcccctgccgcggcccctagctcgcgcctcagctccctcccctttccgggcaggcccgtcccgtcagcaaggcagtgagcaccgcggccagcagagggcggtccggacccaagtctgcagcggcgccattggcgtgtggaaaatgccaccagatggcgggttaggattgcagctccgttgaaggcgcggcccccgctcccgaacccccggcgaccaccccgtaacaacccccccacatcgggaataacacaccggagacttttggggggaaactaggtcgatggtcggcggcgcccggatgggcagctgaggtgagtgcgggcggcggcgacggcggcggggggcgggaaagagggggaatgcggcggcagcggcgcgggggctggaagcgccgatccaagatggaggccgggcgagagcgagagagcgcgagcggcgagcgggcgggccgggcgcgggccccgtgcgggggagggaggccgcgcgggcctgtgcggggtgcggcggtcgtgggccgtccgagtgcccggagagacgtctgtgggcgcggtgggcaccccggcgtcttcgtcgcttgccacccctcccgcgggcaccaaaaattttgcccccgcccgcccgggcactacggcgacaggcgcggaagcctttgtggcgcgctcgggcccgccgccaagcccgccctccgcccccccccgcccgggctctcgggagtcgcccgcgcccagcggggccgggccgacgcgggctggcgcgaatgccttccgccgcctgccgacctgcgtttctgcggtgttttagcggcggcggcgtcacatgacaacgagttcatttcagcggaggggcctggggggtcgctcggcggggcggctggcccaggcttcttgttggcggggtggggcagcggggtggcggctgggggagatgcatcaatgctgggctttccagctatctgccctctcagcccccgacgggggcctccttgtgaaacgtgtccaggcctaagcactgccccgctagtttgccagtcccctgagagacgaggccaataaaagttgttttccctcctttctcgaggtgggggcggggtgggaaactagagtgcttggagttggacctgagccccgtttgcagggtccgaactgggttcttcttgtatggtatgggtactaagaaattttcaggttttaggattgtcacgtcacccccatctacccacatttgaaatgttatctgtcgattctcttcacattgcagggaatcgtgctccgggagtataagtcataggatagttttggacacttacagacaaaaaaaaaacaaaaaaaaaaaacgcaatttgtcataaaaaaaaattatttgctgttaaagttggtgttaagatggatagagtttattctcgtgattctgactagaaagacttgcatcttcgcaaaaatagtgtttacttgagaaagtatctgaattggcacaaagttgtgtgatttgtaacttatctggaatttgaatgactctacattttagttttcctcgtgttttaagaaaattgcacattccgatggtgaagcacttagggaaatatacagaagagtgaaaataaaaataacttgtttattgtatggtaatgtaacgtaccttgttctaatattcataatgtatgaggaattcagactgaaaaattttaaccaagtagggaaatatggaatggaaagaagcagaaatgttatttccttgcttttgatgattaagaatacttataagacaaattgttacccaaataaagttgtagaagatctacaggtgttttgccacgcattttcctttacatatttaaaacgtacttcgagtaaactaaattaattcaagtgatctaccagtggtcattttcacaaacgaactgcttttgagtggaaatttttctgtatccacttcagtttcgatgttctgataaggctaaggaatatttaaatagatgcaaaatatggaagtttgttgtgttactaggattgcctcctttgaagagactaataaaatgactgtagatttgattggctcttttaaagccttaaaggcactatggtgtaggggagaaggagtgggtcctggaccgaagttactttgaacgtcccctgggtttgtggtgttcagggtgttacctttgagccttactttctttatctctaaaaatggggagctgggcccagtggtgcactcctgtagttccagctactctgtagtgaggcaggaggaacccttaaacccaggagtttgaggcttacctgggcaacatacaagactccatctctttaaaaaaataaaataaaatggggatagtatcttacggtgattgtgtaacaagatgtctgtgaaaaacacacatttaattgctgtaacttaaaatttacagaattttgtacagttttaatctttttttccttgattctgactctgtgtatgttcataatctcagtgctgtgagaagaaataatgtactctgggaaagatacgttcttgtttcccctttta

SEQ ID NO: 108491 - DNA, 1045 bp, Homo sapiens
tgccagctactcgggaggctgaggcaggagaatctctcgaacccgggaggtgaaggttgcagtgagccgagatcacgccactgcactccagcttgggcgataagagtgagactctgtctcaaaaaaaaaaagtttcttttgtcttttttttttttttaattcagtgatgttactccctccagttgctatgctatcaacgttcctttcattgacacattctcaaaagaaacagttacggttttcaccaatccccatcccctacttgaaaccctttttccctttcttttaagacacttccccggatctacacctacctagtttgctggtcttctgatttctttgctagcacctcctctttcttcaatctgttctctactacatgccttctcttaggtctcccaaaattagtctgttcttgatttttccttaactgagtttcctcgtgttcagctacttgccagaaagctgcagctcaaacacttaaaataattcatctctcttatttgaatttcctaatttatcctaacattgtaatttcagctagtgtagtgattaagaacatgaactgtgaaaccagactgctctggaaagctttgtaaccttagacaaatctctttctgtctcaatttcctcaactgcaaaatggaaatagcaacagtaccaatctcatagggttgttacgagtgttaaactatttaactatttaatatttaaactatttaatatattatagaaatgccatcagcattattacatttattgtttttaatcttactaagaagtttttagcatttttttaactctgagggcatgggtaatcaactttctaagtttatagaaatctaaaattgtattttgccctcacacttaataattgattataagtcatttttataatcaattttataaattgtttataaataattacatagcagcctaggctctaaattgtagggccagacttgattattttctttcaaaaaagcctaagtcccaccatacctcattcagatggcttgcttttttttctactgctgccatcctt

SEQ ID NO: 108492 - DNA, 1036 bp, Homo sapiens
tttctttccttccttccttccttccttccttccttccttccttccttccttccttctttctttcttttctttcttttcccttccttccttccttccttccgtccatccatccgtctgtccgtccgtctgtctctctctctctttctttctttcttctttcttttttgacaggatctcgctctgttgctcaggctggagtacagtggcctgatcacagctcctcattgtaacttgaacctcccaaaggccaggattacaggtgtgcatcaatgtctggctaatttttttttttttttttttttgtagagatagggtctcactgtgttgttcagactggttttgaattcctggcctcaaacgatcctcccaccttggcttctcaacgtgctgggattataggggtgagccactgtgcctggtctgttgctttcctttaaacccataccccttattattttagtattcccttggtttttaatgttgtgtggacttgaatcatagaattatagagcattattgctggaatgttggaatccaaccttgtgttttacagataaggaaactgaaatacaaatagactagatgcaccaaaattcaaacatttagtgatgggggcagaacaaagactcaacccttgatcttctgacgcaagttctgtgtgtttatgaaaccatactacttctcatctcttgtaattttgccttatttgcctcacattattttgcattttgtgtatttatgccttctcatagattgaaaacttcagggcaggggaaccttcatatttacattgtaaatttttttttttttgagacagagtttcgcagtttttgccctggctggagtgcagcagcatgatctcggctcactgcaacctccgcctctcgggttcaagcaattctcttgcctcagcctcctgaggagctgggatcacaggcacctgccaccacacctggctaattttgtatttttagtagagatgggtttcaccatgttggccaggctggtctcaaactcctgacctcaggtgatccgc

SEQ ID NO: 108493 - DNA, 1414 bp, Homo sapiens
gccatttatgtttaattcccatatagtatataagacttagatcaattaatgtacttacatgtttgctgtgttaattatgacaataaattcattatgttacacgttttcataattggtggtttatatctaattgctcataatttagcaagattattgctcttacgtttgtagtcacataatggcttctttctttagataaaatgtaataatcttcagattataggatgatgatactgatcttggatcagtttattatagttcagaggggtaataagtaatattctgtaatgcctaacaaaataatcatatagacagtaatgtcttatatacctaagatatttataagtttgtcaaagaaacagaattatagttgaggtttttttaagagcaaactttttgcttatctttctttattctcattcctttgctctgtctcctagtctccactaactactcaataaacatttgttgagtgaataagtgaatgaattgtgctatgcacagcacttttgcctttgtcattattttgtgccttctcatattggggatgatttcaaagtgatatttccaaaagtggacagaattagatggaattttatttgacctacactattttttaaaaaaaaagaagaaaaacttaatttttaagtagcctttatttctgactagcctgtaattttttgttttcccagtggtgggatctgtttcattagttgtttcattagtaagagtatttaccaattaaaattacttgatgagatactagggtttaaaaagctgaagagaataaaatcatcttatgaattgccttgtctttttgcattacttacagcatatccaagttagttaattggggactttctcccccttcattgtttactgtgagatctgtaccccaaccaaacttccggacttagtcacttgggtattgttacttagctgattcttatcagaagcaggaaattgtcaagttatgtgttaaagtacaacagaatctaaaactgaacaagagatttccctttagaattttattttattgctagctggttccttacattttccttagggtataactactgacttgccaaaaaaggtcatatttatcatgacctatatacacagccaacagtacccttcctcagtttacaaattatacacaatatgactgattaaatgatttgacaaactttgtgtcattaatatatagctatacctatagaatttataaaagtagtttgggaaagaacatgttttcaggtgttttgtctagcattattcatgtatttacattagcagttctctaagaaagggttactaaagtggatctcttaaggggtctacggagccaaaactattttcataatactaggatgttaatttcccttttcactagagattccagaggctacatgaa

SEQ ID NO: 108494 - DNA, 1017 bp, Homo sapiens
ctgttggagtttagacttataggcagaattgcctctttggcaccaaggcaacttatgtacatggcacataatgaattttaacatctaatgaccttatgttttgaacttcacttaaaaccctccattttgtttttctatttgataagagaactgtggatcattactgtacattagcacctacagagctcttttctattttgtttctctttttccctttatttctccaaagtttttgttttttatttttactggccctccattagggcctgagacagtggagcccacttcacactggacttggctaagctgataggaaggaaatatgcatgggcaaggaatggcctcttctttaaaaaaaaaaaaaaaaaaaaaaaattaaactctccttagctgacaggaaggaattgggagggacagaatttcatttttggtgttcaggcaaacatgctatttgcgtaattgttctttgtctaggtgtagaagaaaagtacaatttctccttgtgcagacagtttgggagcaatatagcatgactgacaaatatgaaatactgttgactcactactttacattagtttttatttatttattttttatggttttgtagagatggagtcttgctctgttgtccaggccaaacttgaactcctgggctcaagcaaccctcccacctcagcttcctgagtagctgggactacagatgcttactaccatacccagcttagtttttattcttattcaacattattgttattctagaatgttcttctaattatcaataaaatacaaatatttaatgtttttaaccattgtaaaactgcaaaaactaaaatatagtacaatttggagtaagatataaagtagtggattatcagtttctgagataaaaatatttccagtgttctaaaggtaattaagtagatataatgtgatgtttaactgctgaggtaactttttaaatacttttgggttttgtgattaagaccattatttttagtttttcaatggaagacaaat

SEQ ID NO: 108495 - DNA, 2104 bp, Homo sapiens
ccagttagacttttttgttccattttaagaggacactggtatcttgggattagagtgaatgtgacagtaattaacaaaatatagtgaaaaaactattatcatagagcaaaggggggaagtagtccagtattaggtattactgtatgtaaatctaaaatcccatttaaatataatttttatttgttaatactccaggatgcattccgtactacagtattctgatgttattgagacagttttatcaagattttatctctatttaagtcttaggaaatctctgttaactttattactgtattacagttattgctacctttattccagggtgcttggaaacattgttttgagttagtgatctgtagttaacctgtaaagagatataagtccagcttttacattagataaacttttcccttttctcataatttctgtatccctttttggtaacttaaatatccggtgtaattaatggatttgtttcgcaatggttgtgctggtggagacattgtttgaaagttgagaaggaaaaggggaaaacaaaaggattaattcatgaatatattttaactataaaaaatatatatgctttaaagcatcttccaaaataagtctgaataataaggtcatatttttggccatgattatttacttgttatacaggctgtgttataatttagaggaaaaaaaagttttggaaagagaagcctcagaaaaattttctattgcctgggtgtgggccaggtcacatggattgggtgtgggaagtttcagtgttgcagaacagacgaggaagctcactgagaattatcctgagctgtgttaacaaactgacagaacacagaatttttactcaaaatggattggttaaacgtctttaaagattttttcagtaagttaatctgtttattaaatccactgttttcttgaagttgtgaattagattttctgcttttgtaaatttaaaggaaaactcttatttggtgggtttatgtaagctactacattatgtgtatgtaatataaaccaaatgattggtgatatatccaaaaattgtagtttcgacttggtaagtaaaataattttaaaatgttttagcatgaatgtttaacaagtagagaaaggatataaatggtttgagtttgatgcagttctaattcagtaattttcaacttagcacagacatttgaagtgaattaaataaattgtaaacattaaaaacattagataaaaaggattaggtgaacaaatttcttcatcctcaactttggaattaacttttttttttttaactactttttgcttactttttttttagcggaacagtgtaaagataatctttaataaaaacactagtaaagagaatatttttatttaattaatgtagtattgctagaaattgatgttttgattaatgtgagatttgatattttgatatgagttatgagaacagctatacaaccaagaggaaaatagtgaattcttgactgttattgagtttgggtcatgaagtaaaactaataataatttataagagcctaattctgctgattctgctagtggcctccttatgatcttatagtgaacttaatttgatctccttgaacatttgcttggtgtttctagaaaaatgaacagaggaattattatagaagtctcttatgcacaacaagcctaaggaaacaaagagtaacctgacaagagattccagagaaaagggcaaaagagaaaaggaataagcactttgttgaaaaagaatgttgtaattgtaatgtgaagactcatttgttagctttagtgactccctctggaatatgtctcttctgtttactttttggggagttactaaaatttcagatctttgcatttttcattttttgggtaagttttacctttgaagaacttacttatttgctcattcatttgtttatcaacacattcttattgagagcctactccaagccaggcagaaatcatagggtgaaaaactaatactaactctagcaaatcttacattctggtggagaggtatatgatgattgttattaataatacagtggatttcatatctagatttagtcataagtgatgttgaccataaagcaac

SEQ ID NO: 108496 - DNA, 1351 bp, Homo sapiens
tgagaggtgcttaggtggaggtatgctcccttatgtgtgtgttggccaaataaaacatgatgtaattaatccacttttgatagatattctttaacaatggtattgagaaacttggatgcttccaaatgctggcatccagtatatcaaggatttgcaaaccaggtcacataaggaatagttatgggtacaaagacttgcctcagggagcacagctgtcatatgaagaaggaatgttcacagtgcttaaccaggttcttaagaattcttgtggagtttataatgcattgttctggttaagaaacagtgctataggaaaagagaagtaaagaccagtgggtggtagtgagggaaagatcagaaattatctttacactttttttttttaatttaagcaaagctaacaataaaaaactgcctcagaatggtacacttcctcagtgcttagatctgagcagtttccttccaactacagccaggtccagctatataatgcaagaataaagatttaagtaatctttttttttttcttgagacagtcttgctctgccacccaggctggagtgcactggtgccatctcagctcactgccacttctgtctctcaagttcaaacgattctcgtccctcagcctcccaagcagctgggactacaggtgcatgccaccacacctggctaattttttttgtatttttagtagagatggggtttccccatgttggccaggcatgtctcgaactcctggcctcaagttatctgcctgcctcagcctcccaaagtgctgggattacatgcctgagccaccttgcccggccaagtttaagtaattttgaaaattaaacaccataagcactagaaggtaggaaaatagtaaccaccattgatggagttcctgctatgtactgtaagtgctttacacatagacttctaaaaattttttacaagcattttatgaatttatttttttacacaccaccattgtacaaacaaggatactggaggtttttttttttaacttttagggttgggggtacatgtgaaggtttgttacataggtaaatacatgtcatgggggtttgctgttcatattatttctttctttcttttttctgagaccaagtctcactctgttgcccaggttggagtgcagtggtgtgatctcggctcactgcaacctctgccttccaggttcaagtgattctcctgcctcagcctcccgagtagctgggattacaggtgcctgccaccacgcctggctaatttttgtgtttttagtagagatggggtttcaccatgttggccaggctggtctcgaactcccaacctcatgtgatccatccgcctcagtctccca

SEQ ID NO: 108497 - DNA, 1029 bp, Homo sapiens
ggcaagccattgctcaggtccttcagggagctgccagacaagttgaaacccacaatcacaattgtttaagaatgagatctgtattgcttcctctggcattaggagtgcaggttactgtccacacagccatcactgacttggggtgtgggggatggtgggcaggcaacttaggatgcgatagcactctctttaccacaaagcagcaacttctttctttaccaagccttgccctagattttataagttttttttttttactagattccagagttctgcaaaagttgagtctgacagtatttaccagctcattaattgcattcattgctttttgcagggacagtgccttggagttccttactctactatttttggtggtatcaccccaaatgtagggatttctctgaaggctatcattaaccggaagtaagaaaattaggaaggaagaagttgatttaggggtatagactggattatttttatttggacatgagtgttgggtttgaggtactgatggcacaatctgtgggtgtctagtgacagttggaattgtaatgcctgaattccagaaaggtcttagagctgcaaagagatctgggaaccttctgcacagaaattatagaaaatgaaagtgtatgatttccttggaatagagaggaaggtcaagtatgtcatcttgtgaaacactttcagctaaggaattcttcatttattcattcagcatgtttgctgactgctgaatacataattttgtttttcctttgttcctactactgatgtatgtactgctaagcgttggagacagaaacgaataagatctcgttttctgccctcaggaagttcactcatattgaggaagacagacaagtaaacaagtacaatgcagtgttataataacaaggttagaggagcctagacagaggtaaacaagaatatgtaaacaggttgggagggaaaataagaaattcggggaagtcaaagaagaagaaaacataatggagagagtgggctgtgatcttggttgctgcatat

SEQ ID NO: 108498 - DNA, 1031 bp, Homo sapiens
tttaaagatctatatagagttgaagatctctttttaataatgaataagttcattcttttggtaatcatttttttatattctcctctcatggccctttttaatttcaacaggcattggaaaagtgaaaagaaaacctagtgtgccagattctgcatctcctgctgatgatagttttgttgacccaggggaacgtctctatgacctcaacatgcccgcttatgtgaaatttaactacatggctgagagagaggatgaattatcattgataaaggggacaaaggtgatcgtcatggagaaatgcagtgatgggtggtggcgtggtagctacaatggacaagttggatggttcccttcaaactatgtaactgaagaaggtgacagtcctttgggtgaccatgtgggttctctgtcagagaaattagcagcagtcgtcaataacctaaatactgggcaagtgttgcatgtggtacaggctctttacccattcagctcatctaatgatgaagaacttaatttcgagaaaggagatgtaatggatgttattgaaaaacctgaaaatgacccagagtggtggaaatgcaggaagatcaatggtatggttggtctagtaccaaaaaactatgttaccgttatgcagaataatccattaacttcaggtttggaaccatcacctccacagtgtgattacattaggccttcactcactggaaagtttgctggcaatccttggtattatggcaaagtcaccaggcatcaagcagaaatggcattaaatgaaagaggacatgaaggggatttcctcattcgtgatagtgaatcttcggtaagttgattttcggaggtaaatacaaatagagctctgggtattttaaaaaaaagagagagagaaatggagaggttaagtggcttccctaaagttaaccaggtaacaagctgggacgtaacataagcataaatgttccaaagctaaagtccgcattctttctagctatctattttgaataaaagagagctgtggcagtgttgctaca

SEQ ID NO: 108499 - DNA, 1073 bp, Homo sapiens
cagcaagacacatgagacatagattagaaaacatgttgtacaattttaatttacaactgttggaaataaaaatcacttaatttttttccagtgcttctccctcatctggttattcaagaaaacaaaacagtctctgagatatttagcttttcaaactgtaaatagatgctctagtgttatttatttttttaatcccacttgtattattttacctctagagcatcttgtattaggacatgttatatttatgccagtgggaaataagttatggccaagttttgcaaaaacaggaagcagtgagatacttgtttttttctcctcactaaatatcagtaattgtcaggaatggtattacctattttcatttcctcttttcagctttaagttttgttgattgggacactaaaactgatgtatacctgaggaaaaaatagaatgtgctcatggttagggaaaattatattatttttaattttttaatttgttttttaaccaagtaggaatttgggtgtatggataagaggccaatctgcttctgtaggctatagaagaaaaccagttgtattttatggtcataatttgtccccctattattctggagatttaaatttaagtaaagtagccatcagtattttaattgaaaaatactaaagccacataactgagtaggatgtcgtatgatactttcaacaaattccctaatgctgcctaagcatatggatgttttaattctttgctgttataaatagatatctaatacgccagaattactgatggtaaaattgaagttgtgtaacttgtgaattttttttatcaatgttttaaatattatttaaatcttaaaatcatttaaagacttatgttgccactgggtggcagccatggcttctcccactaagcaacagaagtgaccaaatataattaagacaaattttcatctctattacatctgcttttaaaacattttagttcatattctattatttttctaactcagtactcctttgttgagggtaattattagtagttaagtttttaatggaaataaaaatcatgtatgcttatctttgctg

SEQ ID NO: 108500 - DNA, 1020 bp, Homo sapiens
tggaaattaccatttttttcagaaacactcagttacattgtccaaatcaagaaatgaggagtgtggcattacagtactccctaagttttccattttaatactttgctagaagataaggggtcctttataatcttgcatttatatagaacttttaactttccaaatggcttcacaatcaaggtcactttttttcttaaaggacttttgatatagtatagatgctatcttatgttttgaacactactgttttttaaagaatgccaaattactgtttctggagaaacacattattagaagcattggcttgctactcgattctgataggctggttctgttagtgtttagcaagtttttgtgactcaattctctgctatcttttaaacacttgacagaccagcatgatatgcatgcccccacaccctaatttcttgctgtaacatgacctaaaccaaatgacttaggaactgaaatgtttatttctagtttactaatgaggtgcaccttgtatctgaaagcatacatagtttgctgagatatgtttaatgagtagaacctaggttaggcttggtggggttttgaacagaggaggagtttgagctatcagccaccttgttcacagagggaagtgttctaaattagtgtctttgagaatatttcctggcgggttaaaagtagatttctaaggtagttgctttaaataaatttctgtgctcagataatttatatctttagactgtggagaaatctttcagatagccttcatgaaattactgagacaaaaaggtgaattccagaatgagactgttaagtgttgtctattttaggctaaacacaggaatggttattaaattgatattttttgagtacttttgaaggaaacagtaatcattgagtaaggatggcttctctaggagaagtaatgtcaaacttgatgttttctagacttaataggcaagggggatgttacagagaacaaattcatcaaggcatatgatgatgtcaagatgcaaatattttttt

SEQ ID NO: 108501 - DNA, 1043 bp, Homo sapiens
agaggaatcaggaagccaagatggagaacaaaggtaacattggggacagacgttgaggccatgtatgaagcactcttaagaggagcagtgagagactgtacaagcagctagtgaccagaggtcaaagtacagatgtggccactgactcacagtgctggaatcaaggaaaatatgcaccaggttttcttgactatggtgtggtaaaaagatatacagcaatgtttattgtatacttattttgtgccagatcctgttctaagtttcacttaatcctcacaacagccctgagtcagacactattataattgttcccaattttcagatgagaaccataaagcagatagtttaaatgacttgcctaaagaaacacaactaaaaagttgacaccaatcaacctgagacaaagattatttatatactagagactcccctgcccatataagcatctaagctcaaatttcgcaagctgaacatttgcagcctttttctatagcacccccaatcctgcctgtcctgaccacactccacccacttcattatttcacttgaggtgctgccatccacccagttacccaaactcagaacctgaaagccatgtttggctcctcctccccagccctcttaatgcactcaatatccaggagctatcagttctatcttctttatcttttgaatttggtcatttctctctgcagacatgagaaacctagtggaagccaacaatgtctgtcacctggatcactaccatagctccctcatggccctcctgccttcaatctggccccctgtgctgttttctccaccctagtcacaaactttttaaagctcaaatgcagggaatgacatggtcatatttgagctttgaacccttcctttgaccttcattcctctcaggataaattccaagctcctcaataaggcattcaaaactctctagaatcctgtttctgtctgccactaagccctatttctcgccatttcaaccttgttctcgtgttgcaccaaacttcttcttgcttcctaaaaacaacattcctggctga

SEQ ID NO: 108502 - DNA, 1131 bp, Homo sapiens
gagccaaaacgaactataatcctaaaggtcagctggccctggggctgagcaggctctagtcttctccaggtgttcaggtgcttgcagctattgaatagtgataaggacacagaaattgctccatatatttcattaacaatgaatacagactgaacacctacatgtgtagacattcttctaggctcagggatacagttgacaaggtttctggattttgagagcttacatctagaggaggatacagatgataaatatactaggccagcattctctagtatggtagccaccagccacagctggctatttaaatttaaattaaattaaattaaattaaattaaattaaaatgtctgtttcctgccacactagtcacattttaggtgttcaatagccacatgtggccagtggttaccatattgaacaacatcgatttagaatatttgcatcatcacagaaagtttatttttggaaagcactgctctagggaattttggatagtaatcagtgctaggaggaagctaaaaggctgatgccatagagagttgacactgaggctcctttatattagatggcctgggatggcctctctgaggaggtgatatttatgccatatctgaaggacaagaggagccagccatgcgaacagcaggggcagagcgtttgagatggagtgaacagttagtcaaaggtcctaaggcaaaaagtgctcagcattttggagaaatgaccaatgtggcaagaatatcacgcttcggagcagagtgagagagaaggccaaagcatcttgtaagaccactggcaagagtttggatcccattctaagtcctgtaggaagccattaaggagagaaacgtcacaatctgctgagtggtgaatggttttgagaatggcaggtgtccaagctgggagatcacagcaaggcaaggaatgacagtggctgagattagggtgatgaccctggagatgaagagataaaagagatccagacacattgatgtttatgcctagctttccctatctggcaataaaaggagtaagggacgatggatggttggtagggaggagagtggaggagctaggataatgagaaagtacttattttacttacctgtacaaagtaggtgaacgaagt

SEQ ID NO: 108503 - DNA, 1080 bp, Homo sapiens
aaaggggattttaatgagtttctcggcaatgaggctagagaaaatattatccatctccccctgttctccaattcagcagctcggactcctgttttcatcacagtcctgttagataattacagccccaaaggcctcctgttccttctttctgtgttccctgaatcttctttcccagagccaggacctcttggaaattctcagcctctgttagttgcccgctctgggagcccgactcctcacatccgtcatctctttcttctcccccttcacctgctgtagtgtccccactgtctctctttacctcagctccttaccattcctttccctctacacccttttcctttggttcatagtcaggatgtgctagttgcattcaagccctttttgatactaagaattcagggggacaaatccaaaccctggagactactgtcttccccttagtgatgctaatgaatataattcctgatctgaaattacctgcactttatttggctccatctacttttctgccacttactccctgtataaccataggctacgtaccctacctctctctgggtttgtttactcctcagttaaaaggaggattaaaatggcaatcacaacaccttgctacagatatgttaggaagattaaatgggataacatgcagggtgcctagccttcctggcatatagtaaatgcctataaaatataacaagtgtcatgtattattattaaattgtatctacctggtagaaactaatggagtggactactttattaatttagatttctctctttttcctttcctatgatatttaagctggaaaacccagtatagtttaaaaaatcagttgttcagtcattgtttatacaatctagattcacttaaataatctctccagtttttatgtagacccaatgacatgcagaataataaactaagggagagggtttggtccacaccttcagggtcagaaaacagagttttaacccagatagaatggtgaaagggcttataagaaattactgaactttaaagctgtggtctgtgcatacccagagtctttttttctttctttctttctttttttt

SEQ ID NO: 108504 - DNA, 1125 bp, Homo sapiens
ggtctatggattctctctccaactagtatttgaatgccattgtgcttaaccagaacacgtatgttattattagaagcaccaatgaaatctattattaaataaaaacacacctattattaaattagccaagcattacactattggaatgctgtttgtgtagagtaagttagaaaaaaaaaatagacaactagggttattttaggaagaatggtcactactttgattgttttcaactactgactactctaactttggccctatattcagatttgattaagacattcctttctaaccttgcatgaatcctcatcttggattcagatgcctccctggaccctcccatgggctctgggtggatgtcaaaagctcgagcaacttccaataggtcttgaaagggtacttggattgtgtttacagcagtttagttttttaaacattgttagccatggacagtgtgtttggcataataatagtaattgggagtacaaaaatgagcaagctgtggtctcttatcctaggattcagtcagatggtagaaaagcatgttccaacgaagtcccttatgctatgatgtggtcagaattgtgacgcagtcctttgcattatcctgctgtgcacattttgatggggctcccaaaccctgaaccattgcactttcagcaactttgaagccgctgcttacccttctctgatcctcatttcatgccccccagtcctgcaagaaaagcaccaggcactgatcacagactcccaggccagcagcagcaggtgtgagaggcttaggggaaggagaagaagggtagcctctctctgtaaaggtgaactcctgtctcctctaggatgcaaagggaatctcgattcagactctcagacacctggaatccctgctgagagtccagcgggagcagaaggcccggaagttttctgaatttctgagtctgaggggaaagcttgtcaaggaagtcaccagcagagcgaaggagagacaggagaatggcgctgtggtgtcccagccagacgggcagccttcaggtacactggggagagggcttgctcagggctgtgacctgtaagggtcccattcttgccaaaacttgtttgcacatgaggagggtatagtctctg

SEQ ID NO: 108505 - DNA, 1620 bp, Homo sapiens
ttgcaaatgattcagttaggaacctattggctaaagataacagaatagtctattaggggctattatttttattttcacagcaagagaggtgacagttgctgggcttggttagcagaagtagtatgccattgtgaatccagactgtgtttttctttttaccatcttcagtgtgatgacttttgtttaccgcttcactttcatgttgcaagcagactactgtagccccaaccatacaaccatatttggcagaagaagttgatgaaaaggtcccttcccaagacttgtgcttatctatattattggtcaaagctgtgtcacatgggaaactacagctgcaaaaaaggctgggaaagtaaacaactagttttgcagtttggagtagaggtaggcaaaggagacagcagtggggaatggatactggatgagtcatatgtcagcatgtgccactgcaggtaataaaaagcaaccgaagcttaagtagaagagggagtttgtcataagggtagatggagcatctcacagagctcacggcagggagcagctgagtctgggagtaaactgaaaccagagacatgaatgtggtcatcagttttccttttctgtgtgtctctgttcctttctctataactgctttattttttccttttaccctgaagatcagcttctgctgcttatctgttttatgtggtaaaacaaatatacgaaccaagaaaaaccacaaacaattggctgccagcagctttgacatcattcattaccagtccagagctctttgccttaacttgggtgttgggtccggctgtggtgtgaagtctcattgttcacctgtggctgtcctgcctgcagccatgaagggggaaggaacaggaacttcttggagcaggggggttgagcagacagttcagtgaatgtctacatctggcctcctgtccgggaatgtgtctgactccttcctcccagggagtgctctgctcagacgcccgcattgtgggagggagcctctcccttgccctggctgttttccatgaattataccaataggaacaactgtgtgcctgtcccactctgtttctatggggctcctgccctcgaggcataattcttctttgaagaggggacattcttgcctccccaccttggaaaatggagcatgctgccattccctttcacacacggaccccagagatgtgtcagggggctggggtggtgcatctgagctccttccagttcccaacgtgagtcatggaatctgtagccatcccttcctcactgtgctaggcagacactgctcaaagcagagttctcacaatgttctctgctggttgtaacccgctctattccacctctttgcagatccagtccttgtctctcaggaaggtggaaggtaagtgtctacacagggcagtgtgtagcagtcttgactattgtctctggcttttctccctccttttccctctcccccagtcaattcatgggtggtggattggtgacagcagcctgtggacatgtagtgtcaggcttctgggccacacaggctgcagctctgtttgtgctgaaggcttcccatgcagctggcagggcttcttgcctggcttgctcctgtctgtaaagggatggagg

SEQ ID NO: 108506 - DNA, 1034 bp, Homo sapiens
ggagtttagaaattgttaacctttggaaccagtattgtttagcaatagttgagaagtgttagcaagaatgatatcaagttaaacttaggcacttggagttacatccttaaagccttaatagggcttatgagttttatacagtcatacagatagaaatatgttgcttttgttactacgacagtcatatattataagaaataatcaaaggtgggtggaaaggcatcctctctttgatccaattttctgtacctttttcttcaggtcacacacactgctagcccaggaatcactaggtattgatgactctacttcaagctgtgcaaagccctttctggagacagccaggatgttttgtagggagagaggcaggagtcctcagggagtggcctggggtgagaccctcccataggctctaagagtctcattctcatcagtgtattccagactgaggaagaaatggggcagcagtcaggagagctcgggattttgagtatagcagaatttaagtgaaatggaaactacactctttaatttgttcttccatggaattgctttttctatgcaagggctgagcccccaggagagcccttgtgaagggaatgctgatttgtgtgaatatctgtaggtgagtaggtatctagtgaggatgagttgggaggatgagttgggtaaggcgtgcccctctgacactgttctgggtataaaagacaacatcatgatgagatcttcatctgaataaaactatgccctggccttttcagaaactgcgggcactgcagtcccacagtgtgatggagtccaagctgggatcactgcgagatgaggagtcagaggagtggcttcggcaggcacgggagcttcaggccctgagagagaagacagaaattcaggtgagctgatgctccatgcctttcttcccagaggaagccaagagccatcttctcttccaatatattctctcatttatgaatgtagagaagttgaaggacatcaaagttctatattttcagaccttctgccagtacatgaaagca

SEQ ID NO: 108507 - DNA, 3057 bp, Homo sapiens
aaagtaacagtcattcctttgacacacaacttaggggtatgtgtgataaagattattttcatcctattccgtgtatgaagaattacctgtggttgttttaacattctttcttaaatcatgattcatattgtccaggcaaaggataaaggacagacagccagagcaaccaaatttttagccttggacaaatgcttaccacatagagattttcttcaggtaagaagagtgaagtggctttataatatagttgtactcttccagagacttaaaaaaatataattttcctttcggaatttttttgttctgtttgtaatttatgtattctgagaattctttgggggtatcttacttattaatttaaaattaaatggattgatttaaaattaaataattgaaattaaatttaaattaaattcctttttattttattaaattatattaaagtgattagactgttacaaatatatatgtatttcttaacattgatttcatcctgtagatattagagatagaacatgaccccagtgctcctgattacttggaatatgatattgaatggctcactattctcagggctacggatgatcttattaatgtgactgggcgcctgtggaatatgccagaaaataatggcctgcatgcaaggtaagtcagactttatttaggacctgctttttccattgcatgcataatttttatatctcccacctttgttttgttttgttttgaaacagggtctagctctgttatccaaactggactgcagtggtgtgatcttggatcttggctcactgcatcctctgcctcctgggctaaagggatcctcccacctctgcccccagagtagctgggaccacaggcatgcaccaccatgcccagctaattttttggtatttttggtagagatggggctttcccatgttgcctaggttggtcttgaactcctgagctcaagctatccacctccctcggcctcccaaagtactgggattacaggcgtgagctgctgtatctggcctccacctttgtttttaatcaagggaattattgttgaatgaatgtcagaacaattcaaagtttgcaggttttccatctaaaagagacaggaaaatggactgttgagcattacctcaaataaatttataagtgaataagtgtacataaaaccatgatatggtgaagatatagtccacacattaaaattgttttggagtatgagttaaagatggctttttctaagaattatttttttttctaaatggtcctttgctaaattaactctaactttaaaaatggaattttgatagatggcttattttttatccttgcacctgaagtctgtaattagatttcatcatttattgtttagagctgataaaatgtaaaaagctattgttttgtacttttataggtgggattatagtgcaacagaagaaggtatgaaagaagtattggaaaaattgaatcatgatctcaaggttccatgtaactttagtgtaacagctgcttgttatgatcctagcaagccacagacacaaatgcagctgattcataggatcaatcctcagacaactgaattttgtgcccaacttggcatcatagacatcaatgttaggcttcagaagtccaaggaagaacatcatgtgtgtggtgaatatgaagaacaggatgatgtggagagtaatgactctggagaagaccagagtgaatataatacagacacatctgctctgtcttctattaatccagatgaaataatgttagatgaagaagaagatgaagatagtattgtaagtgcacatagtggcatgaatacaccatcggtagaaccttctgatcaagcttctgagttttctgcaagtttctctgatgtcaggatcttgccaggctctatgattgtatcttctgatgatacggtggattccacaattgatagagaggggaaacctggtgggactgtggagtcagggaatggagaggacttaaccaaggtgccattgaagaggctgagtgatgaacatgaacctgaacaaagaaagaaaattaagaggaggaatcaagccatttacgctgcagtggatgatgatgatgacgatgcagcttaagatgatttacttgttttgtttttgtgtttgttttgtttttttgagatggagtttcactcttgtcacctagactggagtgcaatggcgtgatctcggctcaccgcaacctccgcctcccaggttcaagcaattctcctgcctcagcctcccaagtaggtgggactacaggtgcccgccaccacacccggctaatttttgcatttttagtaatgacagggtttcaccgtgttggccaggctggtctccaactcctgacctcaggcgatccacctgtcttggccttctaaagtgctgggattacaggcgtgagccactgtgcctggccgacaatttacttgtcttagtattatatgtagatatgtgattttttgagactgtatttttagagctgaatttttgactaaagacttaactttataataatgaagatacattagagaattttagttagatattgactttatctttaggcttttgtatgtttcagatgcaaacatattaaagtttcatatatttacttgactgggtatctttttttttgaagacatacattattcacttccatttttacaataaacacttacttaacatctactctgtgccaagcactctgctataatatgggaccataaagatgagtaagacaaggatttttgcctccaaggacttgttatcactgtaaacattttgatgtatacaatatggctatattatattttgttttataaaatcaagtcattgtatatattatgatgtatgctttcttttcatttattataaatatttttcctgatcagcttttaatatctgtcaaataaaaattgaaattgaagatggtatataagatttcaggaaataaactactctgaatactaaacattggtaaacgtacaatcttaatttgctgagattagtataaccctgctgacttttgcatattgagttttttttg

SEQ ID NO: 108508 - DNA, 1243 bp, Homo sapiens
tattgccgtgattgtcacaggccacaatgtgggtgacaggtcaggtctgacagatcttgagtggtactgtaataggaaagtgaatgcaccagctgctgcaaatgatgggctgagtctgaggcaagcaccatggatagctccaaggcagggctattactgcctgtaagaatctgaagcaaataaagcccttttttatcaggaaggcgcctggcctgtctgaacaatactacttcgaaggtgtgccatgaaagatggtacccaggatctctaagtaattacatgacagcaattttgaataataatttcaactattcttatgggccaggacaacacctcacccatatctgaatagcctcactttgttatgtgaggattgagaagttggcatttaaatacatcctagtggacttcttgggtcatcttatcaccttgggaggcatataaatgaacctcaaccaatccagaggatatctcagtctttgtgaaactcctgatcatttttgtaaccttgcatgtgctttccagagatagttcttgctcccttggactttcagattatgctgtctcacacagtgggttcttatctcatttgctctatccagaggtatcttttattgaccctccgtttaagcattctcatctacagtgaagagtaaatgaattgaatttaatagtgagaagaaaccttaaagatcttctagagccagatagctctttatgatttataccatattttaaaagggaaaacatcatagtacttgattagaagcatgaatgctaaattactttcagtcttgtgaccaccaagcattttatggcaatatttaatagtttacaagggcaataagaatgcattatcacattaaaaactcactacagagccagatgtggtgccgtacacctgtagtcccagctcctcaggaggctgaggctggtggatcacttgagtctgtgagtttgagatttgagaccagcctacacagcatagcaaaaccctgtctcttgggggcaaaagccaaacaaacaaaaaaaaaactccagaaaaagtaaaggctgctcttcatatcccttttaatctaactgtgccctggcttttcttttatgaaaaaagaaactccctctttgtttgagtataaaatcatggaatcttttcttggaagaaacctgcagataatctttagttcattcttgtcattttttattgaggaaaactgaaaaccggagaggctggcttgcccactgt

SEQ ID NO: 108509 - DNA, 1077 bp, Homo sapiens
atgttatttaaacaagtaaagcaaaatattatttcaatatatctgtgtaataagttattactgaaatttgttgcaaaaatagcaagtcttcagtatctgatgtatagtttatacaatttggatgctaaatttttattggaaatacttgattcatatttaggtgtcataaagtttatagttgaaaatgtaaactcatatacccaagtagttccaaatcattcttaaaagttttaaaataactgaatccagtattggttttttaattttaattaaagtttaaaatataaacaaaattcacttcctagccacatttcaaatttcaattgccatatgaggctagaggctggcttactggacagtgcagctctttaccatctggcgcctgttctctgcctcatctcctgctgctttctcctttgctcattctgctccagctataatggcctcctattctttgattatggcagatacttctcattttagggcatttgaatttgctgttctttttgcctaaaaaaagctctacccctaggtaggtgcacagtctgctccttcaccttctttaggacttcgctcaaatgtcacctttttagacgttctttctcttatcaacccatttaatatctgtacaaattgccttctctccctacctcttatatttctaggctgccttctgaaagaagagagaagaggactgggaggggagaggtgacctgatctacaaggagcagtgaaatatcagaattgtcctatacagataaatgaatacattagacaaaagcgtagagtaagataaggttgaataagtgatcataccccttcagcttgcttgctgtctgagcaacttatatgattatttttgcgtatacataacaatttcagatactaagcttcttaaatgcaaggctctgccttaatgtcctcttataccttctttggcatctagcatgtaactttgaccaaaaggcagtgtgaaatctccaattgtggtccacctattggttagccttttgtgttttacatcctgcggtgcctctctatcctctgttcttttcagtgccagcaactagtatactt

SEQ ID NO: 108510 - DNA, 1133 bp, Homo sapiens
gtaagaatataatactgtatttttgtatttaaatatgtttagctacacattacctaccattgtgttacagttgcctacattattcagtacagtaacatgctgtacatgtttgcagcctacaagcaataaactataccatatagtctaagtgtgtagtaggctataccatctagttggtgtaagtacactctatgatgttcacacaaggacaaagttgtctaatgatgcatttctcagaacatatccccgtcgtcaaataatgtgtcctcgtcgttaagcgaagcatgactgtaattgattttttagcttgggtctccagtcttcaatacttttaaagataattttgtttttaggtgatattaggctttcagttaaaatgtatgctatttttgaccatttagaaataaatatattcatacttgattgactgaaatggtttctccagcaggtctagatcctttttttttttttttcttttttctgttattttaatagcaacatatagtgctttttctcttggttttcatcacgcttataatgctctaatttagacatatgctgtggtaggcactgtacattttaatatgcaagccctttttctctgccacactaaaaatctctttcagagcaaagaaagtaaagtagaaagtttaacctctgtgtaaatgtgggagcttatcaagtccatttattagcatgcaaatttaagattttagccagattttggctgaaaatctttctcaacaaatgcatgtttgtaacatcttaatattgacttcttttctcccactccccaaaagtgggatatccccaaggcttacttattcttatctcacctcaaagataattcagtgtgtacaaagtcaaaaatcaatccttgtcttctctctaagctttctgttgtttcctgcacccatgtgcccagacatgaagtagtcactcgacatgtcacatatcacatttttgtacctattaaatcatcttgttaactgcttcctcaaaatgacctttgtattaatgattcctttggctgctccactaatcagttttgtataaccagatacctagatggattgattaagtccttcaacaaatatttattgagtgcctgcctagtaccaagcattgtgcta

SEQ ID NO: 108511 - DNA, 1870 bp, Homo sapiens
cccaaagtgctgggattacaggcgtgagccaccgtgtccggcctgtccttttagtctttaaatttatttcaggtagggcctactaatgtgtatgttttccctacctcagctatctagtttagtcttggtaaagagctcataaggataggaatggagagtggaactaacttcaaactagccagaggcaggggaaataaatatatactgaaaggtacctcctctttcctgtgccatgcaaaggctaaaccagtcagcacttgcacatcaagaaacaattgtttgggtggctgtttattgttcctttacttcatctcctctagcttcattaattcccccagctcttcctccatttctcctatcttttctgcactagacttccttatttactataatgatttgaaaaacctacaggttgtggaaaggggactagtctggtaacattactcttctgccagggtttgctgtattaccaaagtgccattaatgtattctaggttcctcctgtgggcacatgctagtgctgcagagcattgcccaagtgaggggcagggcttcttcataccccagctacctatcctgtgagtgcttgtcaacctcaggttccacattaaaacatcatgtgtagactcagacttagaagtgaggattagattggattagaatggaaagaattaaaaaaaaaaaaaacatctcttaggagcttctggaaattgtaaagcatattatatatggttaaggattgggcccttggtattatcccaaaccagtaacctagttttgaggaatagtagcacaattcatgggtgttttaaaagttagcgcttcttaaattttattgtaatattgtttcctctccttctgttccctgtctccaatccatacataaaagtattctatttttttattcgctttgaaagccacttggtaattaattgttactaagttctctttgtcttaccaactgtattttgtatagtgttcttttaattttgattagggatttatctagttaaatttaaattgctacttcctgatttttttcctattcaaaattagttctaacttttatagttaattttaacttactgtactctgcagctgtacaggtgttattgttatttctttgaggcctgttagtattttaagcagatttacataattttttagaagagtttagattctgagacattaaaatttgcatttgcagaattaaacacattttttgtttgttcatttatttttacaggttcgaatgcaagcactgaaatgtttctcagttttagcttttgaaaacccccaggtatcgatgaccctggtaaatggtaggctggagctttcagtggcacctacatgatttaattgatgaactttttagatttaaagaatttccttaatcattgttgtttgttttatttctagttttggttgatggagaattgttaccacagatttttgtgaagatgttacagagggataagcctattgagatgcagctcacatcagcaaaatggtaaaagtcaggacaatgtgggaagaaagacagtgctttatcaatatcttagagtatttttggacaaccaaatttgcttgcttccaatccccattttattttgagattttgaaatttgaaagtcaggagtccatcccacattttcttaaatggatgtgagttttttatactcagcttattactagtaatatgcagaacaggaactctcgtataacatctgagactgtcttcagaaaattactttattacatcctcaaactactgtccttctacttcagttgaaataatactgaattagattagatttaaccaacatatactatgctaagtattagccagggaaatacaaagatatagaaa

SEQ ID NO: 108512 - DNA, 1491 bp, Homo sapiens
caaaagtagtggattctccaagctgggtattgacataaccgtataatcttattcttggtcatggaatcatctctgttgttacattctcattctttaggtcaggagtaatctttttgttacaggagactaagttgtcccatgttactttccaccacagtctattttgttacctttccctatcttctctttttcccagtttcatactgtgctttgggcctgctagtgacagctaaagcatcatttaatcttgaatttgggaccaaaaaggccaaattgtgctttttctgaaaacctaagttccttagaatagatcggtatttattttgacttgttgcatctcagcctgtttgccctatccatttctttaagcataggagatgaacattctgtaagagaaagtttattcaaggaggtcatggtagagagaacattgcctcttaattagtagccagtactgtttcatgaatgtaactgtatttttcatgccagtggttccaatggtaactattctccttttgacctctccctcatgcttttgagtttcaaaaaacctcatttggtaggcagttgttcatttggcttttaactttgaaaataaagcaaactattaagggtatatctttactctgtcttaagaagggcctaaaataaccttcactggtatttgtattagtaatgtactctactctctgggtattaaacttatgtgtctgctcttctttcagtagtggtgtttttccagtagaagtgatgggttacatacatttaaccagttgccttgtctgttttccttctggtcattttttcacactgacactgtatcttaccaatacaaagatacatgagcaacccttagctactgcctcatgaacgccctgagttgaccaccccaggaaggcaaataaaatgttttgatggccatgagagtaaggaaacaattttaagaacatgtagcctatgcatatgcaaatcatttaactagtacgtagattatcccttctgttagtttttccatttcatttccatcagagtaaaactgtaacaacaataatccttaaaaatgacatcgtaataccaaacttgagtaatagtttgttttgtcatctttatttttgatgatggattatccaaaggtttctgacccgaaaagtatagacactagacccgtaaagagaaatcttcacatgttaataaatttgtgattttcatgatatgttagttcaagtcagtattatatcttaatttatgactagaatgtagttaagactttaagagtagatacttttagaacttatcaaagtgagtattctgtattgggaagttcttcctataatccatcagtgtctgctttgaacagaagttttggaactattaagaattgccttcagagccaccccaaattatatatatatgtaaaatatatatattgtcttttgctttctgtggaattttttgttacctacgttatattacccaactgaatttctccat

SEQ ID NO: 108513 - DNA, 2042 bp, Homo sapiens
ttatttcaaagcaaacatactagtgatatatatatgatttatggatgttgacgccaatgttcagtttgggtacgttggtgtattgcaaggggagaggcttttataacaatagatttgaacatttttaaaaaattggactgtgtaacttaaatacacaattatttggtttaggatggttattagggcccattagaaacaggagaagtattttacccattcttaaagctctaaaaaaccatctcatggactgaaaggtagatagacagatggaccacaatgggaaataggatgtccatttgtacttctttgtacttttttgttaataaactgttttggaattaatggcttaatttgtgatatcatgttctagaaatacctgcaacatgacagtctaatcagtagtctattaaaacttgtattcataatgtgtataatttcctggtaaggctaactcctgatcgtttctgtagaaagatgacaaataaagaaaaagttataattattaattatagttttttgtgtggtaaagcaaagatactgtgatattatgtaatggggcttatatagcattttaaggaagatatttaatttctgggaaattaagtgtttgaataatttacagttcatagtaactactgaagagataaattgtaaaatggaaactataaagtaattttgtgataaaatctacttgaagactggccataggcgtggaaaaattttattttcagtgtataaaaaatgataaatagtagcacttttcttttgagtgcatttcttttccttttttgttgttgaaataattatttgggtagatttttatttactttctccatgaaatatttatttcttgtttacacttatgtcttatgaacttgactgtattttttgtgtagatccttaaagtacaatgtttattgtttgatttttttaaaatgcaatgtttatgcttgccaagatggaatttcagttaactgagtcaataagtagagaaactgagttaatgagtggagagtctctgaaagaaatttaaaggactgtagatctacttccctcaatccctacttctccccctcaaaaaccaacaaaaagtttgtttgtttcaggagaaaaacatgaaatgttcagttggtctgccatttaaattaaaaatgagaacataattcaatacattcggtaaataacatgtattctagtgccctattatggccagttaaggaaaggaggcagaatgaagaagagaaaataagcaaagtagagacaatgagaggtatacacagtagtaaaggagaaggacgctggcctctcttcatataattgtgtctcttttactgcttctaaagacttctaaaggtctgctgtgttttcatttcttgataccttctctttgggccagagaatattaagctgaagatggaatgtgacttgtagatcagagatttaccacccctgctttgaagcagtgttggtgtattcccactaaaataaaccaactgtataacattccctggaacttaataagcactcaataaatatttgttgaataaatatagaaatgaaaatgcagaaatcgtacacagagtgactttttctttaatttgtttggacctttatcctgcatggagcaaaattggtattctaattccgagtgttgcatcctttattactctatggcatacttgaaaatttcttaatttattgtggtgtcctgtcagctagagtgaaggaggatggtgctggtggaaagagttgtgcaggtgagagtgaaaaatactaccattgactgtgacatgaagagggagaagaagccccagaaaagatggaggatcactgagcctggcaacagttgtggcctggccgtgttaaacttagaagaattcaagctacctgtaataattgatcctgactctgaatggattttggttagagagagtaagagcataggcaggaattgagagctcagtggaagaagggtccagaacacattagcagtaactgcaatgacagcaatgccaagtaaaaattagctctcatctctgcca

SEQ ID NO: 108514 - DNA, 1034 bp, Homo sapiens
aattttgagatagattcttctatgacaaataattgctgttatgaagaccatcacttgattaggacctgtcgatcaccagttaagttggaagttgaaaaaggattatcctctcttactcttcaagtaactagtagaacttgttagaaatgttagtgaaaattaagggaaattagaagtaaagtgtaaattaaaattcaaggaaattggtatactaaccaggatgttggttttatttttgataaaagtaaacacattgcaaatgttaagtacgtattgtaaccttcattcccctggggcacctgactaatggagccttggggaaagttttctgcttcaatttgaatacgtatattttagctggagatttctttcgaggaactagaatgtaagctccatgagggcagggatttatttgtgttttgttcattaatgtattcccagcatctacaacactgtctgtgcatagttgacacttaataaataattgatgaatgaatgaatgaatgaaaaaatgaacacacagacaaatggatgaatgagcaatattgcattattaagcacccattatcttatatgctcttgtctgcattaggaactttcctaacctcactagcaattctgtctgtgtgtaaagacaggaaatttgaaatggagaaaatatacctctggtcatatagtcaggggtttcactgttatacttagcatagagaaaaatgcaggaaattcccattttttcaagaggcaggcaatcctgagggcttgtcttctgcttgcttggctatcaatcaaagaaaacatgttttatggtattgtacttgcttcatttcaaaataattttgaccattatttcttaattagaaaatatagagtttttatctttctagatgtatgatttttttaaagtttgtatcattcacacgtgtgaatctggaccaggttttctaaggataaaagtatgatttggtttatagaaattaacctttcaggaatcaacctatttgcaaggttatatatactgatataaagtatttttc

SEQ ID NO: 108515 - DNA, 2239 bp, Homo sapiens
tcggatttcataattccttgcctcaaactgtggttaagttgttagttaccttcttaaagcaaatccaccaaagaattttatgtgaaccttgcaacattcattcacaatggtaagtatttttaaagaaataaccatgacaggaccaggttttgccacttgcccacagtattgagacctttggccttcaacatactgaaagaagcaaacctgggagtgataatgctgtatatataatagaggtatttataaaataatgaatttttatttcatagtttcattaaatggagatataaaattgagtgttatactatttgtggtatgtcccttgcttaagccattgaaagtatgatggacaagttggtttattgtttattatctagttaaaagacagaggttatatacaccaagaaatgggctaaaatatctttattagatctgtaaatctaaatgttgtgacttagttggattttcaagaacattctttctggaaatgaatgaaatatttggaataattaaatatgtatggaatagtagaacttgaaaagattaggattgtgataagaatcagggattgttgctatgctctttcctatgaataaagtgctagcatagaggttggtaaactacaacctgtgggtactgttacctacattataattttgtagcttgcaagataaaattatttttgcattttttgatggttgggggaattaaaagaagaatattttctgacatatgaaaaggaaattaaattcaggtttatgtccgtaaagttatattgccgtacgaccttgttggtttatgtgttgacttttgactgttttgcactaccgaggcaagttgagtagttgtgacagaactgtatgtcccacaaagtctaaaatatttactgcttggcccttacagaaaaagtttgcccaccctgtgctaatactgcatagctaaccataaactctttttttttttttttttttgagacggggtctcgcactgtcgcccaggctggagtgctgtggcacgatctcggctcactgcagcctccgtctcctgggttcaagcgattctcctgcctcagcctcccaagtagctgagattacaggcgcccgccaccacgcctggctaattttttgtatttttagtagagatggggttttcactatgttggccaggatggtcccgaactcctgaccttgtgatccacccgcctcggccttccaaagtgctgggattacaggcgtgagccaccccgccccccccccccccccacccggcctaaatagaaactctcataaaccagtttggcgaaataccaaacttcgcatatgcctgtgtgtactggcatatagaaagaaacagggccctgaccagaagagggagaagccagttgtctgactttctgaagaaaggcattatcaattgttgacagtagacattgtcactggatactttcctacatactgattcccttgtttgaatgattttggcatgtgacagaccctagaaaaattagattaaaactatggctttgggttatgattggaaatcttactgggttctgtgtattggttagcaaggttctctgaataagatttttcactatgcttgagagaaaaaaaaatctagttcacttattaagcaaatatattaagcctttgctaaatataaagtgttaggtggtatggggcaagcagaaatcatataagtcagatacttaagtcaacagaatctgtttgggaaaccatatacaacagaaatataactactaccatttgttgagcactcactatgtgctggaccctgtgctaagcattagcacattctctcccttaattgtcataccaccctatgagatagtttttgcagatcaggaaatcagcaatttgaccaaggccccccagctagtaagtagtagagtctctgtcttatcccagtctctctgactccaaagcctatgtttttaactattacatcactttatacatgctaagttaaataccattatagatccaaattatggcatagaatggcaagaaattttactgaagagtatatgattagcctaaaaaaatactacaaactgagagaacttggtatatagcttaatagtttgtcctagctgtttacaaagcattagattcagaaaacgccatttctctcacatagcttttggtactaagtgggtaatgagatgctttaatccatctgtacactcatcatgtaacattgatgtatgctcaga

SEQ ID NO: 108516 - DNA, 2979 bp, Homo sapiens
gagtaaagatgtgagaacattatggaaaggtagtttttggatcaaggtagataggctttgagcttgaagtacccaaccttgacaagagtaaagaaaacagcaaaagcatggagacctttcgtcagaagtgggaagttgcaatgtgtgtccccaaaatcaaggtccctacgaagatgaggtgggcacagagtggctgcgagcatgagggaggcagaagaatttgaagtaagaggtagctaccataaggaacatgggcatctccagggggttacaaggctggtcaccagcagtgagggtgccgctgaggtgggatagcttacacggaaagaacagtcatgtttggtggtttttctagagcaacatcagcagttggtatctggaggaggagtaatgaatggtgggaggacagtgaaaaagggaaactgtcttctaagtggagtgtctgagcaggacatccatgccagggggaaaagatatgagggagtcacaaagagtaggtagactgagaaagggaggaatttaggggctagaggtgacaatgaggacagagagtgattgtgcatatcagtaagaatggaattaggtttggtctagggcgaggagtagatcaatatgtaaatgttttggaaactaaaacaccagataaaaattaccattcctaatctacagctaaaatgtggttccctgttcttaatagatgatattttccctgatcattgttaatttcaacaatattttcttctcttcttgtttggctgaaacatcctgaggttttccactctctcatgttctaaggtcagacttctgaatcctctcattttagtctaggtcagtgatcttcaaccttggctgtgtactggactcacctgaggagattaaaaaaaaaaaaaaaatttaggtgcctagccctgaccctggagaatctaatttaattggtctgctgtatggcctggacataggattaaaaaaaaaaatctccccaggtaattcttctgcaaggacaaccaaggttaagatctattggtctaggtattctcccaggtgagagtaacgactcccattaatgagttgcccatattgggaactacctggtgagtacaagaggactaccttaaccagggctgtattacaagtgtggctgagcatatagactctggagtcacatgcctgggtacgtatctcagctgtgtgattacaggaaagctctgtattatccagaataatgcctacagaagagtgagggttaaattgggtaatataacatgcttagcacagtgcttggcacatggaagaactcaacaaatgtgtttgttaatatttgtgttgtgatgtcatgagtactttattctaatatgaaaaggctgtttttcaataggcccacacaagtcaaattcagtttccttcacacactatttattttgtatctagacattgatgaaggaaaattgcaggttatcttatttttaagttgaaacaataaagcttcatgattatagtgattatatgtagcagcacttcgtgctatagtgaaagatggcaagggttacttttctaaaagtttcagtcggttggtaagaaagtagccacagggtggctctgtcctaagcccagatttcattttgtgagggctgagcatggactgtgatttctttagaacctcactctggaaggaacctgcccaatgagagttcatttatttcttttcctttttctcaagattatttacataacacctctgcagtacttataccatttaatttttgtgttaaatgtctttaaaaataaacaacataacctgccccttacgcctgtcattcagcctggcaggtccttagtgggctagacctacctttctgatgagctgcccgcccccagcgcaagatgattgtttgagaggtaaaaactcttgccaaaaacaacgttaaacttttaatggatgttaacatacttgcatttacaagcagtgaagtttgtcaccttcatgttgttatttatgcagcattaacctttttctccagatcattgagactgaaaatatgatggaccgaattgtgactggcttgtctgagtctagtgtcaaggtgcggttagctgccgtcaggtatgagctttaaatggtctgaataaaaaccttttgccatatatttaacctgtttcctttctggtccttcactgagtaaacacagactacaaatgttcctcaaaaatctgctcaggtgaattcatagagtatataacattgtctaacagagagcctggcctccaaaccccataaagtggtctgatgtagttcacttaacaatgtagatatgcttgaagtgtacattagtcattgtaaaatgccagccagtttgtttgaaaagtaaaagttttgatttcttgtgaagctaattttgattattctttgtagatgtttgcacagtttatccagatctgtgcagcagcttcgaaccagtttccaggatcatgctgtttggaaacctttaatgaaggtaagaagaaagggtcagccagtaacagctgtactcacagaccctagagtgagctgagctagctaacactactccctggtctaggagtatgtctgatttttgtgtagagcattttgaacgtttatctcctcaaatctgatattctaagcatctacaaatgcttcatgtgtgagggggaactacaggcctgattttctttctttttttttttttttttttttttttgagatgtagtctagctctgtcacccaggctggagtgcagtggcatgatcttggctcactgcaacctccacctccccggttcaagcgattcttctgcctcagcctctctagtagctaggactacaggtgcgcaccaccacgcctggctaatttttgtatttttagtagaggcggggtttcaccatattggtcaggctggtcttgaactcctgaccacgtgatctgcccgcctcggccctccaaagtgctgggattacaggcat

SEQ ID NO: 108517 - DNA, 1545 bp, Homo sapiens
ggatattttttaacataacatttttggtgttaggtcttctcttcaggccccttttgtcccccccaaaaaaggttcaggacaaatgaatctgaatcaagacttagagcatgtatcaagtggctgctaataatgttatcccctgatacactacaaaacttggtctttggtctatcattttttttcttaagtgatcatataccttgcatttagtcaacttaattttttagagttttgttttgtttttgcatacctgctatgtactaagcaaagccttcaagtacagtgagctaccaaaaacattttatcacagaactcttactcttggcttaaagctttaggtttaggaggcgggggcatcaatgtggcagaaataggcaagagaccattcaggcaggaagaatataaagtgggctttgaaagcaagaggaaaacaggaggattttctggggagcagaatagcatgaggagaaacattatgtatggtatgtgtagggaacggcaagtatacctttatgactctagtggagcagtgggatataatgagacataccagtggacaggtaaggacgaagtggaagagttagaccaatgccagtggccttgggaattgacatgctgagtggttcttccattgaggaggttcatctagtgacagagtatatgatttatgtgttgaggtcctggaataaagcagtaggagtggcttaggaaagaccatatgaaccctggagctacttcagtggaaggaatgatagattgagtgtatgattcactactcaggagctgtcagggggacaccaagagttttctattttctagtctaaacaagtgtcacaatatggtcttatgaggcctatcagaacagtatgtttctttaacaacttattttcagtgggcctgcctaagcagtatgtaacattgaacttgacccattttcatccattggcacatcttcctgagtttcactctttttcaccctattagacatatgtcatctcttctgaatactcctcattctctgagatccttttgcttcctgaacctcattaagagccccaaatctcagaatggttatttacctacactctactctccagctacagtatcagtgcctttctatgcttggaacacacttgcttatggagtgtgccagctcccaccagcaaaagtttatttcaggaccaccatcccttatccaaaactgttggggccagatttgacatttctggatttttatagttgaggaattcatgtacctatttagttgttgagcccaaatttgtatccaagtagtcttatgtttttcatttccctgctacggtacttcccttattattcactatatcacatttaatcctaaatagttctatcaaggaggtcttattttcctcagtttatagatgaagaaatacaggctcaggctagttagtggaagtgtccagttggaactaggtctgtgtgattccatttctgagaaccagtctcccacactgtcctgcctatgcagtagtagcctgcttgattcgtcagtgctcctggtcaaac

SEQ ID NO: 108518 - DNA, 1589 bp, Homo sapiens
gataatccagtcacagctggtgtaccaccgttaatcatccttaactgctcttatattgctccagatctaccttcaggatatttagggtctagttaggaaataggtagatgagctcaggcaaaggatcactaatacgatttttttatattgaaaaattaactcccaaccggggcaacatagcaagaccttgtctctactaaaaattaaacaatcaaccaggcatggcacacacacctgtagttctagctactcgagaggccgaggcaggagaattgtttgagcctgggaatttgaggttgcaatgaggtatgatcatgccactgcactccaggctgggcttcagagcgagaccctgtctgaaaaaattaaaattaaaaaaaaaatagattctgaaccaaagtgggggagggaaatgctataagagcattttttttgtgccaactgacaaaattagagtatgggctatagatttgattaaagtattattttaatttattattacctttcctgaatttggtaactgtactatggttatctaagataatatccttgtttttaggaaatatacattgaaatattaagcgtaaaaggggcatgatgtacgcatcctactttcacatggttcagaaaagatagataatgtggattaggtacatagtacgagagagatgataaattaacaatggcaaatgttaaaaactggcggatctgggaaaagaatatctgagcgttccttgtattttttgctactttataagtttgaatttatttcaaaataagtttttaaaatataatttgtacagttgagaaatgtatacccctttttctgggtatatagatctgaattgcttctgacgtttctataatcctcttgacaagtgacctttaagcattcatcggtgatggtaaatcttaatcctctaaggtttgaatattttttagaaattaccaaaaattcatgttcagtcaagtatcataaataaagttaagtagttagactaaagcatggtattttagatgtaaaatgtggcatgactgtaaaagtacaggactgttttgcttgtataattgataagtagtcctgaaaatatcctaaaagataaattctgcagcatgtttggaataagactgacagcttggaaggaggatgatttggttttctaagttcctttatatttctttcctttaccaaccatattacttcatagagttcgtaagcaatgcacaagatgtacacataaagcagaaagtgacagagtctcagcgaaagatgagagtggggagctaggtaatgggatcataagggtctgtgtgaaatgtacagataactagaatgtctcctgaatcctccaggactacaaggataaaaggaaatgacagagtggtttggttttgttttctttcttttttttttttttttttggcttttcggatttatgagaaaataattgtctttgcccttctcaaggtgatttttatggctacatcactccctgctttgcaaaagttgcctggaattgagtaagagtggggaagaaatcacaaagtgccaaggtatatgcatgtttagtttgcaaactggactttaa

SEQ ID NO: 108519 - DNA, 1542 bp, Homo sapiens
caagatagtattaggaaatctacactgtgttttccatgtctctggcttcccccattaccccagtccattttttatgcttccccctttttttttttttgagacagagtcttgctctttcccccaggctggagtgcagtggcacagtctccggtcattgcaacctccacttcccgggttcaagtgattcttctttctcagtctcccaagtagctgggattacaggcgtgtaccaccatgcccagctaattttttgtatttgtagtagagacggggttttgccgtgttggccaggctggtctcgaactcctgccctcaggtgattggcccacctcggccccccaaagtgctgggattacaggcgtgagcgtaccgtacttggcctttgcttcctttttctttaatatatttgggtttgaggacccccaatgattgtgctttcatattctgtcaggtcaactttatgtatgtatgtatgtatgtgtaatgtgtatatacatgtgtgtgtgtgtgtgtgtgtgtgtgtatgacatatttgaaggcaaactgcagcttcaaaatataataaacactgttctttggcatctagttctatatgctatagtgttttgcatgaagcagttgtgaatcatattgttttaacttttagaagccttgtattcgtcctgtggtctttgtttctttgataattatggatttcccattgttttacagcatatagataaaataatgagtactcatggaaagcaaattatgcaagccgtcactcttattctagaaggggaacataacattgaggtcaaagagcaggtacgttgttcctttctcttggggaatattttctgaatgtgagcacaaaggaagttcttaagagtctcctgaaatattcaaatctgcagaagacagagtgctgagatgggagatgctctagaaataggaagaaatatcttccaccatcccttaaactctctttaagacttcttcctgaaatagaggaaaacatgaccagcgtctacagttttgctctctgtgtcatgcactgtgcacactgtccctgtctctacaggagcagtcacctttcatcatcctggaatgaatcctttttccaggataaataagtgatttccaggataaataaatagtggtttctagccctctccgccgccatgctctcaactcaaaattcctgcgactcgctgataaaataattcctcatcctggagatagttttcatttcttttctcttaggcatcttattcctcatcccataaccctacttccattaagtttcaggagggcaagttaagggtaggtattaaagtacgaagctgtgcatttatcaggacagttgggaattatttttctttattttctgggatttatcatgggagttttaatgaatatattttattttgctctaaaaacaaaagtcacctgcaaacttaagattttaacacaggaccagagatactggcgatcttcagttttttgacataggttttggctacatggttatgttctctttcaaaattcattaagctggac

SEQ ID NO: 108520 - DNA, 1071 bp, Homo sapiens
ccagcactttgggaggccgaggtgggcggatcacgaggtcaggagatcgagaccatcctggctaacacggtgaaaccccatctctactaaaaaaatacaaaaaattagccaggcgcggtggcgggtgcctgtagtcccaactactggggaggctgaggcaggagaatggcgtgaacctgggaggtggagcttgcagtgatccaagatagcaccactgcactccgacctgggcggaagagcgagactctgtctcaaaaaaaaaaaaattcattaagctgtagacatataggtatgtctatctgaaagaaactcgcccaaggtcatcagtagagagttggacccagagagtctaacttcaggggctgtgcttctcatcttctgtattcttgagttaaagtaattcagccagccttggaagaacagtccaggaagtaagagttgtaggtcttaggagctgcaattgaatttgtgagcaaaaagttggtaggtttgataaagtgattttaagacagatattttacgtgatatctcttaaaattttttttaaaactgtgttttgatgaaaaaaatttaacacagagaaagtataatctcataagcatcactaaaattagccgaaatgaaatccattactgaaacacaacaatgaagaaagtacattgttcaaaataaaccattgtactttgagaggataggaatgaattttgtctataaagacaacttacctggatagaatttcagtaacttgaaaagcgaagcaagacagaaaggtgaggcaagatttgaatgagggcaaaatgaaagaccaacaacagtattgtttttgcaggacacaaaggaactttctcatacagattttggaagtgatctggaaataggcgagtatgggaggctaaacagtcggctcactagctagaagtttaatgcttctcaaaagcacctgataaattatttttttgactgacatacaattgacatacaataagctgcacatatttaaagtatacagtgtttcagttttgacacgtgcatccacctatgaaactgtcaccacagacaagatagtaaaac

SEQ ID NO: 108521 - DNA, 1022 bp, Homo sapiens
actgccctggaataaatagttccccagtgtttgcttagctattggactatacaatttatgtttcatgtctactgtgtctcagaggcagccttttctggtttcacacctcaggacttactccctaataatctagtgacagcagtgtgttaatctaggagaaataaaaccacacacgctttaggatattttggggcttgggccactgcaagaaaacaatctcctcaattagcttaattagcttgtcttgcaaagaaaaagtttaaaattggagaaaattatgtgagtctgaatcccagcttcacctctcattcctttgaggtattcctgactgggttccaggactgtgtcacttcctccgggaagttttccctaacccttgcagtatccaacaagtgctctttcttcatgccttctctattctctgtttacttcaatcacagtgaaatgtaattgtttgtgtgacagcttcaaagtcagggagtgtgtttttttttcctgcctcatcctgatgccctgcagagggcatacccataatagttacttagtaaatggtttgttgaattgctaagcttggcactgttggtatccctatcatagtcctttcaccattatcttaatttttgcctcctgctggtctggctttgagaatggaacagctgacaagaacagtttttcctttgagaagactgcagtcatcagtgcagtggttgtcctcaaggtgtactgtccttccagctggcacaggcttcctccagtcttcacattagaccagcctggactaagttgcttcatacattttacttcttttctcttcccctaacagggttcaaaaaagttaaaaggtcctaagtgcacatggctggtgtagctggtggacagggtctaggccttcacccagaaggtcatgagcttaggagcaagcagcaggtggaggcctaggaaagggaggcttccctgggaggggagttgcaacacctacagagcttccaccaaagagactacattgttgaaggaacattgtg

SEQ ID NO: 108522 - DNA, 1090 bp, Homo sapiens
tccccagatgattccaatatatagccaaggtagcaaatacaggagagcagtgggtctcaaggctgggttggctgcattagaatcacctggggaagtttttaaagtgcagatttctgggccccatccctagaaattctgattcactgagtctagagagagccagtatatgagtggtcactgtgggctcttcagtggggaagactccaggggattactcagcagcagcgcccaaaacaaagtgcaagaagggaaactggattccgcccacagacctagataccacgtaccacttgtgtactggggagacaaagccaccctcaaggagatgttagtctagttggaagatagaacagaatgatatgaaattggaagtgccagctgtgctgagaggcaacaaaaagtgctgggaggacagaggagggtagaagacaatagaaaggggaagataagacctgcttagagtagtaagagcctggcctggtctggccagggccatgggtatgtcctgaaagaagtggtgaagctgggagtcagtggcagagggccttgtaccaggctgaagaatctcaccttgaccctgtagtccatggagaaatcagtccaactgcagaacccaggatagactgcaggcaggatgatcaggaggcagagagacgagttagaagactgtcagagagtccaagcatgagcgggtccaactacattgggagagggtagaggacaaggggtacaggaggagtagggagtgaaggacactggtaaggctctagattgttaattgtacatcaaagagagcatttgcctgggtcatgttcccagtaacctggctttaatcgtttaggttcacaagaacgccaggataaattacgagacatgggcatcgtagatattctacacaaactgagtcagtcaccagattcaaacctttgtgacaagtgagtatgaatgtgaaaaggccttgctttgggctgtgttggattctttcgtgaaagggtttgaattgcttggtaattaatggccatactttttaaaatcttttagattcttagattttcttcataattttctatgagccactgtacgacatttg

SEQ ID NO: 108523 - DNA, 1069 bp, Homo sapiens
actcttgtcgcacaggctggagtgcaatggcaccatctcagctcactgcaacctccacccaccaggttcaggccattctcctggctcagcctccgaagtggttgggattacaggtgcccgctgccacactcggctaatttttgtatttttggtagaaacagggtttcaccgtgttggccaggctggtcttgaattcctgacctcaggtgatctgccctcctcagcctcccaaagtgctggaattacaggtgtgagccacagcacccggcctacattctatcttttcctttccacctggccaccttcttcccccatcaccgtaacaacacacatctcacattgatcagttatggtgtcatcaggtgtgatgagaagaacaagatgaaattgtagccttcttccacggttctgaggcatgtgaagcataagacagcctcatcccatgggctcttggccccttccatgcaccttctaatcacctcaacaccatttcctcggtcagttttcttatttgcttcccagaaccctaagtgttctccctagtgttgtgcctcactgcataaaacctacatggcagtaagaaaaagtaaagaatgtaagacctatcacaactatatgccagtgacaaaagaaaacatagaatgtcagcacataccagggactgtggaatgtcactgagctgcagcaggtttaagtgcaggaacagccctctgagagatccacaggaagaagaatatagccagagtagatttcaggtgtctacccactgcagatctcttccccttaaggtaggtgcccacctgggctcaccccaattccctctggagatttacttttttagacttccccagctatcatcattgaaccatagggttttttaccccaattacaattctgagatgatggctaacaggaattttgtgatttcagggcaaagatggcactgcagcagtacctggcatgatgggagtgcccctgggcacctgcgagcatcccacctccttgtttaaggaagtacaggaaccagcctcatttgattccttctatttgcacaagtcaccttggactg

SEQ ID NO: 108524 - DNA, 1780 bp, Homo sapiens
cccaaatagcattagaaagctgaaggcccaatgaaataacactttcacacttaaactctgtggataaattttgcctgtgggtataaacagatggtcaaattaaaaatgctttactataattaacttttctgatttgaatgaagggaaatgtatttattgaaacaaagctgtttgctgctttatgcaggtgcagtgttcagtcagcaaggaagtgggaagagtggacatggtattgtgtctacacccaagttcttaactaagcttctcgctctaatactgcattctgtttctccttttgtgccctgattgtaatccaaaatttatgaactagaaaagaatgtccaatttaataagttgcatttttttttctttaagcactttattcagaacaatacatgttcttctggtagtgtttggataatatgattttaacacatgctaataaaagccaagaaaaatcatggcaacttctaaaaaggagtctgttttccaaatgtctagaacattaggaaacatcagaagataatgtgtacacgcttttggaacctgtgattcttggtaaatgaagggctgggaagtggctttgcatttcagagtgggacccagtgccttaaggtaagtgtggttcccagaggcatctgcagcagtctggggacccctctctttttggcctccttctgaaggccagcagacccttcacaggtggccactcccagccacaagatatcccatccccaatatcatgtccaccccctccatcctcttctccttaggtatgccccatctccactaccaccagcttgcatctccactaccacagtatgcaagagcttgctatccctctgcaaggacacacaggtgctcttcgtctactacgcactgccaccttttcccatctctgaattgtaggcacatctcctatctcaaggcctcactggaaacaaagccaaggacacctgcgccagagtggcgggaggatgatgaggtggctagcaagagagggaataatcatggtgggaacctctgagaggacccaaggtaaggcgaagagagtaggagcagggccaagcaggcccctgtttcccataactaccacaggaaaacttggaagtgaggtctaaggagggaagggggactcccaccccagatcttgatggagggctgacagaacggttccaatttcttgccacctggggtaggaactggtgctgtccccatcctgccccttgcctgtttactgggcagagaggcacatgtttatttccagcatgagagaaggtccaggatctggctttagggaaggctgagggaaccccccaagggccactgagtggactactaagccaccttttctctatctctgcagcccctggctcctggctttggcaagcaatctgccctcaggctgagtggaggtccagagccagtccttaaaaccaccctccttgacttcatggagcccagcctgccctcctcgtcaggcactcacacccaggagccgagggatcttaaagccaaaaacagcacccatcctttacttccatatttgcttctgttgtgtgaaaccaggcctagggtctccgccagtgagttccatcctctgggagtgggctgatatttgagccactctcgggaacccccttacaccccattcccctgttccttatgccatgaaacttgtggactcttagagatgccctgcaatgctgaacccacagcatccctgagtcaccagtaatgggaggaaggggcatgtcaccattcctcccactcctgcccc

SEQ ID NO: 108525 - DNA, 1409 bp, Homo sapiens
tctctaagcctcacaaaaattgtgttagatgtagttaaccttttatagatgtggaaaccgaggctcaaggaagttaagtaggtcacctgcagtcataacctgagagaagcagagtcagaaaggaatctggccatggtctgtctcttcctgaagtgcatgctccttccgttagaccgtgctgttcccagcactgggtgaccaaaaatgtcatgatcccttctctcctggtgcttaggggacctatcccatggaggtgtggctctacataatcagtgcagtgggcaaaggcctcatgaggagcagggatggagcagcctgtgcacaaagatgtggtgaggcagcagaggtgcagaagacgctggctggcaaagagaggcagcgagtccctcgctggcaggagtcttccctgactgtcattaatcttacagtcacaaatgaacccctaaatcatttgtgcacttttttttttaattttgaaaaagaaaagtgtaaagggtagtataacaaataccatgtacctattacccaagatgaacagatgtgaccattttgtctgcacttgatccttttcacagtagggctggacttaaaaccagaccactcatcctttgccctggccagtttggcccatcctcagcctgcaatgggcttttgggagccttgctcctgagttttcatgtattggctctctcttggggcttcatgtcctcagttaatgccagtgggcctccctagaagttgttgactaaagaggcttttgctgcttctgaccacattgtggagaagccactctggggagagtgtgtgtttttggctatgatctttttcagagaagttcatctaccctcacaaacacctgccttgaccattgtgggtttagccaagctgtagagcatggtttagtcatagctgcctaaactgaactgtaatattaatgataggtttgtatgtttggaagacagagaaaacatattctctttttataattatatgacaatgataacaaaatgctttttgttgttgttagcagtgaagtctcactctgttgcttaggttggagtgtggtggagcaatcatagcttatcacagcctcgaactcctgggctcaagccatcctcctgcctcagcctcctcagtagctgagactataggcatgtgccaccatgcccatctaatttaaaaaaattttttttgtagagatggggtctccctttgttgttcaggctcatcttgaactcctggtgtcaagcgatcctcccacctcgacctcccaaagtgctgggattataggcatgagcccccacacctggacacaaaatacattatatactctaaagtataggattactttaagagaaggaaactaaaagtatgatggcttactttgtaatccataacttcacagtttt

SEQ ID NO: 108526 - DNA, 1044 bp, Homo sapiens
caatagttttacacagagaggtttttcattaggccaaggttatacagctagcagaggggctttgattcatgactttttataaaagtgctgtatgtagaaagcagaggggtgggaagcttccctcgaccccccagccaatactgacctttggacaggccttgcctcgcaggaatggagcagcaagctggttactgaggagaaaaaatgcagcagtcatttagggcttggggagggagatgtgaaaagtagccttctgctgagtgggcttaaaaccctgggattggaagggtccctgagaagccgtcacacccacctccagcctggttcaccactccaaagctaggtggccagtccttcttcctccgcatctgcttcacagacctttgcagaggaaaatctcacactcattgccatgcctgcctcgttttcaggaagtttcccttttatttggcttcagtccgtctctctgcagtctggttactctttaaaaatgaaggttgaattgcctctccccacctcaaggaagaacctagaccctatgtctttcttatttttggtcaagcataaacattttcacattcttcattaatggtgtctaacatcttaaatataaataatgaaaacacagcaaagcagcagccttttttgaatgtgcctttttggcctccacctctctgggctctgacatactcctggggtgggctgtgtgcctgtccctgaagaatgccaggctggcccatgtcctgcaggccaagtaacccctgctgctgctctcttcagtgagatcatttcctttgatctcacacctccttgcaccaaagccaggccaagccaaggcagtgcgaagagttgtctgccttagaacggccgtgccactcagatgtgtgtgtgctcaagaaggatgggtacagagtgttgatttatttgggttacacaatgtgtaaaactttttcattggtggccagtatttaaaataataaaatagccagaaatctgagtttttgcatagactcagattgctggctattctttaaaaatttagac

SEQ ID NO: 108527 - DNA, 1042 bp, Homo sapiens
tggcattccaggagactctgtgcttgggttagttggggagtgataatgctggagtggtgggtgggacaatgctagtggtggttgctcaggccgggggcagacatgggccacagtggtggacagccttgctaggccttggcctgggatgtgggtaaagggctgtttgcactgccaagggagaaaaaggaagagaatttggggcagagaggtgggcaaaggggcccacccttgggcaggtgagggaggtgctggctgaatccagtttgtgcagggttgagcctgagcagcggagcagaacagtgaggaggtgcggggctctgtgagcagagggcaaagcggagtcagagcagggctgggaggacagcagcctgccaggctctggggaggccaagggcgctcagtctggggaaccccagagtgtgcagaggctggccttccctggttgagtgaccaccagcatgacgttcccaattgcacgcagattcctatggaaggctgcaggagtcctcctctttcactgcgggtgagactgccccagtgctaggaaaatattaatagacccccagggactgagaacaaggattgaaaaataaaaccacttcctactctctttcctcagctgccactccaagaagttgtgagcttgatgcagctctgccttcacagagcccacgccctgcccctcatccctggactgagttctttcccaccctcccggttgttggttgctgggcagggggcactgtgaggggctggggtaggaccccagaggccaggtggccaagtagcaggcattcctgtgagccagggatgccagcagggaatattgctctgaaggttctgtggcctcttagacactgaggcccttaccaactcctcggttctgagagccgcttagacccaccaggctcagtggacaagcttgggggtgagtggggcagtgttttcattttgcaacttgccaggcctgggtgctgaatcccagcttctcttttcactagcctgtgcccttggtagaatgcctctctccccttggtaaaat

SEQ ID NO: 108528 - DNA, 1086 bp, Homo sapiens
gtacaatccctggtctgtgctgaacagatgccagtggtacccactccattttgacaacaaaaaaaaatatctctagacattgcaaatatccctggggagcaaaattcccctgactgagaaccactgccttagctggcctcagcagcatcaaaacaaaacttcgacctgctcctaccccctcctccccaaataaaatgattcccgcatgactttgtgtataatacagggcaagaagcagagagaaaggagccacaatcatagaattctgaaacttggaaggggcctcagagtcccagagctcaggtgtgctaagctatcatggccccctttctaagcttagacacagcttcaaatccttctcagcatagcagcccagttaataagaggggatgtgaaagatgaacctccatgccagccctgctcagaccactgccctcgtgttaacctgtacaagtagagtttagtggccaaaaagcttatttgacatggcttttggctatacttgctaaacaagaccagtggtactgtgtcctcaacaccaggcctggcacataattggtgttgaataaatgatggttgaataaatcactttaacagtggactgtctctggctagtgagaccaggggtaatgcttttattttcttttgcatttcttcattttcaaacctctttataattgagagtattactttataaaggaggaaaacatatgaatattttcccctaagttaaaaaagccctctgtctcattccacatgtcttgctgccgcaggtctgacctacgagaaacatggcaaccagcgccgtccccagtgacaacctccccacatacaagctggtggtggtgggggatgggggtgtgggcaaaagtgccctcaccatccagtttttccagaagatctttgtgcctgactatgaccccaccattgaagactcctacctgaaacatacggagattgacaatcaatgggccatcttggacggtgagacctgggtggcagccctgcattgggtgggatagtagatggggaggatcagggaaatttgacaggtttcagtggggcaagatggtttccttaatgttg

SEQ ID NO: 108529 - DNA, 1052 bp, Homo sapiens
ccaccagagtcaggcccgatttagggcattgcccacccaggccttcctcgggaatagacaccagattcccagattagatgcttctccactccattagatctgctattaagaaaaggaagacttggccgggtgcggtggctcacgcctgtaatcccaccactttgtgaggccgaggtgggtggatcacgaggtcaggagtttgagaccagcctgaccaacatagtgaaaccccgcttctactaaaaatacaaaaaaaattagccaggcctggtggcgcctgtcatctcagctactcgggagcctgaggcaggagaattgcctgaacccaggaggcggaggttgcagtgagtaactctgaacctttctggggctgaacttttctggagtggtctgcacccctcagatggccaggacttccctgggcatctggatcccaggggtcctgctcccctgaggccatgccatcttcggggaggtgctaagcctggaggtgccctcagttgccctgtaccccactgaactccaggggatctcaactctgcagtttctcttcttccaaactcagaaagaataaaaacgtggcagcacgatgatgaggagaaggaagagaatgataattttgatgacggggtattgaatgggcagaaactgtgtggaaggcccgtgctaagcacattgcatttgctgtctttgaatccttacaaatgctatcgtggtagttgctgttgttatttctgttttatagttgaagaaaatacagcaaaagtttcacacaaccagcaacagtttgagctacctgttgactcctacccactgtcagtctggttgtgtaggaaaatcctcccccacagcacagtggatccttgtgcctctgggaaggggagctgaagtcccaggaagaagtgggtgtggctgaactatcatacctcttctgcccttcttactcctcacccagggtccttcagagaaccaggtgctccggttgtgatctcagtctcacgtcagagatttgcaagctgcttaaggaagccttctctgtgacttccacactg

SEQ ID NO: 108530 - DNA, 1045 bp, Homo sapiens
ccagttctggggatcacgggccttgtgaaaacttatcccaagaccccctcactccattccccacagctgcagggtgtagcctccagcatgagcgacccccaaagctgatggccggcacttctcccctgatgttttccttaagccagggtgttgaggaggttggggccactggcaaagggactcttccctgtcaccagggagccagttggtgcccactacaggactttagcccccttccccttggggagtcccaggtgtcctggctgtctgcaccctgccagcattttggagaagttcaagaaatcagccctttttctaggaacagtgcacggtgaatgcatcagcccttttgcccagcacccaaccccactccatagacacccattacccagaaaggggagcgcaaattaaaatagtaaacacccctcatcactatgtgtgttcaactaagtgacattatttttttgaatctattcttaagcttccttaccttattcttctgtaaaatgggcataatcattcctgcctcccatgacgggtttgtgaattagagatacataaaacattctaggcatggggctgggcacagtggctcacgcctgtaatccttgcactttgggaggccaaggcgggcggatcacttgaggccaggagttcgagaccagcctggctaatatggcaaaaccccatctttactaaaaatacaaaaattagccaggagtggggatgcgcacctgtaattccagctacttgggaggctgaggcatgagaatcacttgaacccagcaggcagaggttgcagtgagctgagattgcactactgtagtccagcctgggtgacggagtgagactctgtctcaaaaacataaaaagaaagaaaagaaaagaaaaaagaaaactttaggtatggcccttagaggcatattatctctagaaattgttttctctattgcttgatattccgtgacccttatttcaccctgtaggggtgtcataaaagtttttgtttttgtttttttgagacagagtttcactctcgttgccc

SEQ ID NO: 108531 - DNA, 1066 bp, Homo sapiens
gatcaaacaagagctgggatgaggtgggggccagctccgacggggccagggtcacctgggcccagaatcctggtcatggcccagcctctcctcagccttttctaccacgtccactctggaggggcccagaaagagggacagaagtcatcccaaggtggagcaacagacctcagaaagaaaaatggatagaatcagaatgtatttttgataaatgaaacagtctttcatcttcaagtatataaaaagatcactttattctatttttagggagctattaaatatctctgtgcctagagaacaagagggaattggaaaagccattagtaacactttccaacctgaaagagtgaaaagccctaaatgatgcttgaggctattgggggctggggcttctgtggggggttttgaaagcacctgggttcctcagaacctctgggcatttttaagggtgtaacagggctttgaggatctctgtgccactttgatcaagttgagctttgccttccagattccgtacatagaaaccagtgccaaggacccacctctcaatgtcgacaaagccttccatgacctcgttagagtaattaggtgagcactgccctctccctagaagcgggcctccacagcatgggttggctcctggaggcagctgggagcttgaggaagcagctcctgttctgaggccatgaggctgtggaattctgggcctatttttggatttcttgtccctccttccatttctttcttttgctttttccacctacctctgccctccccgcagctgctaacgggtttgtgggtgatgtctgctgcacatgttaagtggaaatgccttcctgtctgatgcagtggctcaggctccctggaaggcagctccctccagcctggcttcagtgttctcctcacaccaaagctttccacactgtacaaactaggtctctctcctcttccctgccctgatatcagagcaccctttgatatttcccctgaacaaccaatattctgattccaaggttcaaatttcagaggcattgcacatgtatctcctttcccaaccccaccagct

SEQ ID NO: 108532 - DNA, 1042 bp, Homo sapiens
ttcctccagttcctgtgcctatgcccagctccaccctgtgctgtggggccagtgacttgacttctgtaagctccagtttcctcacgtgtaaagggaaaggacccacttccagagtttgctatggggcatgaacaacaggcctggcctcagggccactctgtgtggctgtgtgagtaggggcaggaagggagagaaaggagggggcacattctagggagggaagtctctgggctgcaggatagatttacatgtctgtgcctcgtcttggaagtatggtggtcatgctcgttgctgacaaagcccagtgccggggggagagctggcagctgtcccctgctacaagaagcctctgacctagcccttttggcatttcttccagtgtcccagggtcaacggtgtcaaggcacacactaatacgtgcaaccgaagacgtgtgactgtggacctgcagatctggtgagctctatcgggctgggtatgggcttcggggtgcaggggacacagtgggaacagccagtttgaagatggagtagtatatatatactctgacttgggatgtggaacccctcacaggaccctcccctcctcccagcttctcccatcccctggcatactctgggttccaaggcccaggcagcagagctttcttggaaggctagacctgggtcacttggagagtcagaccagctgcctcagagaggatgtgtctagtgggagcaagtgtgataagaagatgtgaagtccattggtgaggcccagggagttccaagcacaggctgtgagaggtcagctggagacctgggctctgcggcacctcaggaaaatagagaatgcaaagacacataagtgactagttcagggggttgggcaaggatatctctttgaaatgaggttcataatgggtgtgagtcaggaaggagggagattcagtccaggaagccttcctggaagtggcaagatttgaattgcactttaaaagacaaaggaccaactcctgaggatccagagtgttgccattcctttcccatgtctcattctgccc

SEQ ID NO: 108533 - DNA, 1064 bp, Homo sapiens
ggtgagcatcggcctacagcatttccggagtaggaccatctacaggaacctgaaccccacctggaacgaagtgtttgaggtaagggtctccttggctgcttctagccttcactctgagtcatgctgggcagaggcaatccaggggcaacactaggcagggagtgggccttggagacaggcaggtctgtggaattcctgctcctgtatctaccaggcttccagactgggttactctggcccgactaaagggccagcctgaaggcaaattcctacctcctttccccttccaactttgttagaagttaacaaatcaaagagaaagagccttagaggcatttctgctccactcttctcagcttcccctgtcagagccaaacatcaggagcctgaagttattccttaagttcaaccacaatccctactatttgaagggtgggacccacagcctgttaagccccccagattacacgctccaggagccacatcttaggtgacccctctcaacttctcctctcaatataccatctggatgctctgttacgtttggggtgaggcagtgaaagcaggggtgctaaaaggcagcttggggcttcctgatattgtagactcacggaggggccaggagaatgtaacgaacaggtgctcaggacaccgcatggcccatgcagaacaaacagccactgtcccctgggcacctgctctgccatggcttgcacatgttttctctaatcttctcttccccccgaaggggaggggcttcactcccttcttatgggtggggttcttgaggcactgagggggtcaggaacctgctagcgttctgagccatgatttggctccctttgggtcatatgtcaggtcgactgttgcctgcaggtcaagacacctctttttccttccagttcatggtgtacgaagtccctggacaggacctggaggtagacctgtatgatgaggataccgacagggatgacttcctgggcaggtgaggaggagggcgcacagctgggcctggaggcagccttccctccctgcggggtgctgggctagataccctgctccta

SEQ ID NO: 108534 - DNA, 1506 bp, Homo sapiens
ccagcagcttgcttcagcccagctattcctatgctgtggtccccctctgtgctaggctccatcctcagggcaagagctgggtgaggcacagatggctccagggtattctccagggccccagctggaagaagtttccctgggaaatacccacagattaaggaccccagcaggggacagtcacattataggggagggcaggctgggcctgggttttttttaatcccacagtgtagcacttctgtcttcctataaccacatctcccagtccctctgagcccagagcataccctgtctgggctggtccaccttttcccatactaggacaggtttccctgtccctactaggatgccaggtctcaggactgggctgcccagagagcatcagtagcatctccctggcccttttccctgagctttctgcccctaccccacagtggtttgtcctgaatgacacaaccagcgggcggctgcacctgcggctggagtggctttcattgcttactgaccaagaagttctgactgaggtgagtgtggggtgtcaagggctcccttgcagaaaggtggaggagcacacgtgccaggtgtgtgcaggtggaggaagggtgggagatgatgcccccttcttgctcacctcctgaagaacatgtcactcagcccgtctccacacagggcagctcctgatagctctcagcaaatgtcctctgagcatctccatcatctttagatgatggggtccttagaactctgtgtcaatgcctgtcctcccagttcatagggaaatccactcagtgtctaacttgaatctgtcatgcaccagttatagtcttaacctcaacaaaatgctaggttgtgagaggtcctccggcagctagtctggagtgtgaaggctagctggctttcttctgccatgagtaggcttctccaaaatcagtctttgtgtcctgctgctgggagtacccagtgagggtctgtgtctgtttgcaggaccatggtggcctttccactgccattctcgtggtcttcttggagagtgcctgcaacttgccggtgagtggcgacatgtccagagtgtcacacaaacgcaacaaagtgcccatcactttcaaattgtcctgtgttgctttaaccccgttattcctgtgctgcagagaaacccttttgactacctgaatggtgaatatcgagccaaaaaactctccaggtttgccagagtgagtgagtatgtggctaaaaactccagggagggcaaatcacagcttctctccccagagtaaccacaaccccatgtcttctgggccacagtctgtgcacacacagcctggggataacaagaggtgctgattgtggagtctactgtgtgccaggcactaggcttggcaactcatcccccacatttgttatccctgagtctcatgatgactgtgtcattcatttttattaccattttctgggtcacacagctaagaggaggagccagattccacactgttttcatagccccaggga

SEQ ID NO: 108535 - DNA, 1038 bp, Homo sapiens
ctcaaccagagtacaggctgtggcaaacacatgttcttgtcatcagtctttgctggtaggccgaataatttttatcctaaactacttttttaactaaagagatcccaccttcatgggtcttcccttcagctcctagcctcacagcctcttctaactccctgaattccaaggttgatatacaaccctaggaaagcttaacttatttttcagattttttctttttttaacagaattatccttattttcttgtgaatttggctatgcatttcaaaggatgtttgcttcattttatttggcatttctaacaagtttttcagaatatttggaacaccatatgtattactggaaatggaagttccctaggaagggtctttataattcacaactgaggggaaagggggaacgggaaacaatggctgaggttgtggaagtggtgactcagctcataagccaccctcttatctgcttgcagttcctgcaagtggaggaacgagagctggggagcccatacacaggacctgaagccctaaagaaaggccctctgctcatcaagaaagtggctaccaaccagggtcccaaagcccaacctcaggaagaaggccctacagatttgccatgtcccccagaccctgcttctgatactaaggacgtatccaggagtaccacaaccaccaccagtgctaccaccgttgccactgagcccacatcccaagagacaggcccagagcctaaaggcaaggacagtgccaaaaggttctgtgagcccatcggggagaagaagagtccagccaccatcttcctgactgtcccaggtccccactctccagggcccatcaagtcacccagacccatgaaatgccctgcctccccattcgcatggccgcccaagaggctggctcccagcatgtcctcgctcaactccttggcctcttcttgctttgacctggcagatatcagcctcaacattgagtatgcacctctctgcttaatcttttctaaaatcgcctgtatgaaaaatacctcgctggatggaaaagt

SEQ ID NO: 108536 - DNA, 1068 bp, Homo sapiens
ttatcactcacctttatattaaaatgtatatatatgtatatattttttcctttggatcacttacatccaatatatgtatattttgtcatttaaatcagaacaaccacttgaaattatatacatacaattcttgtgtggaatttaactccatgactgaatagcataaggaagaggttatttaaaagcaagaactactttttttggttggatttttttgttcaagtccagaaagaaatgttatatttgtgcctactaaattatccaaacctcagtgtttatatacttaaacaagtgccactttttagtaggtaattatataccatctgatttaggacttacctgaatgtatgtaccagaaagtgtcctgcctctggcataggggctgggggaggtctgtttctggagccactaccagcattcctgggcagtgactggccaaagggaagtcacttttttatggaaatagaaagtgacccaactcaaaactgccaagagctaacactgccaaagcccttctggctgccacctgtggtacttgtatgcctggatatttgttcttttatttgacctggagctaaaaatgtatttccctactggcaaaaatgttatactgatatacttaaataccttgagttaaatactcttgtgtagtctaagggccaaactccagcgtgtagcattatttccataggaaaatgcaaaccaagttccaagcccaggtctatgtctgactctcatagcaaagcactggagactgctgaagagtgtcaccatcagagaaaaggaagctttcagataagtttaggctattcaacttttctaaagagatggttggttcacctaaataacatgttaaaagcaaagtattaaattatatgcttaaacaagcgcctcttttacatttcagactttacaagaccaaatatacttctcatcccctccaacattcctggacctcctcttctctcttaccaacaccaacactacctgccgtcagttttctgtctctgcctctgccttcactgccacttttctgaagcagggcaacattcgagaacaaagttttgt

SEQ ID NO: 108537 - DNA, 1081 bp, Homo sapiens
ccactgctgaaaaccaattcttgtcctcagtggcagccaaggtattaacaacttttcaggctccctgcccctcacacagcgcctatataaccttgcctcctgtctgctgtgtactaaaattctggttcccttcaacattttaactcctcttcagaccatcaccaggtatttacctgtgttgcctgacacaggtaaaaacggttcaattgaccacgtttaaaataaatgtttgtggtttaagtttggaagaagaggggtaggttttcacttatctgccattttgattagctgttttagggttgctaatgtttcgatgtacatatgatacattcccttatttctctggtgcttctccattttcaaggcacttgtctatttagggggcaattagaatgccatcataaggtagacagggtaggcatcaatgctccattttattatgagaatttgccatttaaaatagaaacctcagcagaaacgaatttcaccatgcatcttctatgtacttaacacggtcttggatggtgagggtgaaaaacaattcaagtagcttgaattgttccctactgttcaactggagaataaacaaaattaaataccaaatacaatataagtagctgcttagcatgtaaccttagcagatgcctaatcaacatttcttaaaacttagtgttataaaggctgggaactattaaaatggaaaatactcagtatcaacagtaaatgctacaggcggtaggaagagtccatttcactatggattgactgacttacttaatagaggaaataggtttgagacatgacttgagtcagcagagcatagtatttggactactctggaatagaacatctgcatgtgaatcagatggcaggaaactggaataagagtaacatgacaaaactttgttctcgaatgttgccctgcttcagaaaagtggcagtgaaggcagaggcagagacagaaaactgacggcaggtagtgttggtgttggtaagagagaagaggaggtccaggaatgttggaggggatgagaagtatatttggtcttgtaaagtctgaaatgtaaaagaggcgcttgtt

SEQ ID NO: 108538 - DNA, 1683 bp, Homo sapiens
tgcagggtggcatactgagtaacagacatggagagtacctttagtgagtaaaaaaacaatccattctttttctcatgtaaatggtgtgattgactgaggaaattcccatatcggccaaggtcctttgctgtgaggttcatttgtaaggcaggtttctcacttaatgagaaaacaggtgtaatttcagaatgggcagggggcggagtcagggaataccttgatcttgtaccttaccacaatgtaagggaattgtaaacaaattctctgttgtaggtttgcttatattgtttctgttcccatatcttgatgctttgttagtgggttcagacaagtattctgactgaagtcgggagcttaaaagaactaaatgaatagtaggagagcatgggctatgtgtgtaggctaagtgaagagcaaccaagatccagctacacaatggagagagttggaatccaagaaagcatgctttatgtaagggaacgcgtttattaatgatggcttaacagaataagctagaaaaaagtgtgggtatctagagaacctgccattgtggcttaccttaagtagggctgggatctggataatgagaaaaaggattttgctcctttggtggccaggagcttcagagagtgaattctaacttaggctggttggaataagatagtcttaggaagaaaaatcaaattcagaaagagcctgtcaaaaaagagcctggattggtttatctggtaagctggaccaggctaagctctataatatattgtacttgaggtttgtacactcgatgaggctatctttttgattaggcagataattgttttttttgagacatagtcttgctctctgtcacccaggccagagtgcagtgacgcaatctcagctcactgcaacctctgcctctggggttcaagcaattctcctgcctcaacttcccaagtagctgggattacaggtgcccactaccacacccagctaatttttgtatttttagtagaggtgggttttcaccgtgttggccaggctggtcttaaactcctgacctcagatgatcttcccgtctcggcctcccaaagtgctgggattataggcatgagccactgcacccagctggcagatacctttcatcttagagtgatccactactaagaaatcttcccaagaaaattaaagaggacaagactgttctatgagaagaaattcctaagtcctcacgtggagacctagggaggagacgcctctacctgggatttcatcatgtagatgcacccgtgtagtgatacagatctaatgagacactaacatatcacacatgtgggcagttggatctgttaataaggacatgctgctaatgaagttaatactagaatcagagggtacttgtgggtatgtggtaacttatataaacagagcccctgtgaagcatctgtatccgaatcagtgataatctatcatcactatcggagaaaaacttcatgtgcacaaaagcaccagtattattgcctttatgtttggggtttgcctttgcatataggttcttgtttcatgtgagtttaccactagaaaaagttactctcttttattattactgtttttgtattacagaaattgatgacttggatgccattgtacctgcagtaaagaaattaaaagtactttcatactgaaaacaaatcaaatcatttt

SEQ ID NO: 108539 - DNA, 1050 bp, Homo sapiens
tgaattgtatacttagggtaaattttatggtatatgaattacatctcaataaagctgttatataacatattcaaaaccaaaattcaagggcaagtttattctttgtgtatcaacaattcaaaataatgaaatattatggaacaataataaataacataaaattacttagagcactcagattcagaataatcaatatataatgttttctgtaaagcctgtgtttacctggagaaacctaattttaactgacttgttctaaattggtagtagtatttttatttaaaaaaaatgatggttacatatatatttttttaacctgtgtaattatgttttattaattttataaaacatataatatataaaacttataattttactaattatgttctattatgttactatagaaattatttaaatcaataataccatatagtttcttttgttataaaggatttgtataagtccttgaaaacactatctgcagaactggtaccttggcttaatttgaagaagcaggatgaaaatgaaggtatcaaagttgaagatttgttgtttatagtagatactatgctggaagaagttgaaaataaggaaaaggtaatacctacatgaacggtcaccttctaatgtttcttatctcaaaaactgataaattgtggatattgatatttgttctactagagttctatttgtcttttaaaagtttttatttgggattattttaagataatgaactctttcttttttacctcttttttggacaggacagcaatatgccacactttcaaactttgcaagctattgtttctcacttccaaaagttatttgatgtgccttctttaaatggagtctatccccgaatgaatgaagtttatactaggcttggagaaatgaacaatgctgtgagaaacctccaagaactcttagaattaggtgatgacctaatttgtcattttgggcccccatttaagaatttttaataaattaacaaaaagtagattaaaaaatgtttaagtgaaaaattgaggataactgaagcataaaatgttt

SEQ ID NO: 108540 - DNA, 1055 bp, Homo sapiens
gtgggcctcatccaatgattcaaagccctgagtagaacaaaaggctgaataagagggagctcctcctccctgactgctttcaagatgggacactggtttttttcttgccttcagactcaaactgaaacattagcacttgcaggggtctcagtctgcctgcatttggactgcaaatacccattaccttttctgggtcttcgcttactcactgcagatcttgggacttgtcagtcttcataattgcatgagccaattccttatgataattttctttgtatatttaatgaaatatgtgtatataatatatatagacataaagcactcctttaaaatatataactttgtaggcataggataaatattttgactatatacactatgtttttttaaaggtgctgtgtagcatcaattcaattatccacaatccaagagctccagtaataatttataaacagaccaaagggggagtccaaaattttaataaagatcttgttcaagattgtggatttgagcatcttgttcctgtaatagaaatgtgggcagatcaactgacatccttaaaggtaaggggttgactatgattatatgctttgaacatctattggactctatgtgctttattaataggacttaattcagggctaaaaattaaatagggtttaatttttttgtttgtgtgttaactctaaagctaaaaaagcttattatctaaaaccgaaatcttcctacttacatatctattttaggtactgtctatttgatgttgtcattactgtaagctttacctcctctaagattctaccaaacaagaaattttggggttagtttccttattgaaaatctatagtggatccactttgtacttctaggcccttccctgttctaccttcatctgcctccttttcatatctccatgctgcgattttcctggcccttatccctcttcagatataatgtcttatccttcattttattataattggggatattttctctctcttcacactttattttctgtctctcagaactgagcttatctccatttctgcttattc

SEQ ID NO: 108541 - DNA, 1428 bp, Homo sapiens
aaccagcctggccaacttggtgaaaccctgtctttaccaaaaaaaatacaaaaatcagcccggtgtggtggtacgcatcggtagtcccagctattcaagaggccaaggtgagagaatagcttgaacctgggaggtggaggttgcagtaagctgaacttgtgccactgcactccagcctaggtgacagtgtgagaccctttctcaaaaaaaacaaaaaacaacaagaaaaaacttataccttaatggagagaaggacctgatacctagcataagccatttatataaaatgtgaaaaccttgaacacaataatatgtaaatttatgattatataaatatgtagtaaaaatttaaaaacatacatgggaataatgaacaatgaattgaggatagtggttctctatggtatgggaaggagaagaatgacattaatgagggaattttaagtatatgtataaagtttgagttaagatttgaatcaaatctgttaatattcaaatttgataaagctaggtggtggatacaccaggatttgttataatgttctctgtttttgtctgtatacttgaaatatttcactataaaaacaagtaacagattagcagcaaaaaacgactaaaaggctttgaataagggattacagagaagaagaaatctaaatggccagtaaactccaaattagcagtcatgaaatattttcagaagcttaataagtatatttgtgacaagtaacaaagttttgtatgtcgttaatatttaagtacctttatgcttttattcagtaaattgaattaatttatcattatttattttccacaggcctacgcagcatgaattaagactttataaacagcaggtgaagaagctggaaaaagcccttaagaaaaacgtcaagtaattatatttttaccaaaattgcctcttttattaggattttttattttatttatttatttttatttttatttttattttattatactttaagggtacatctgcacaacgtgcaggttagttacatatgtatacatgtgccatgttggtgtgctacacccagtaactcgtcatttaacattaggtatatctcctaatgctatccctccccactccccccaccccataacaggccccagtgtatggtgttccccttcctgtgtccatgtgttctcattgttcaactcccacctatgagtgagaacatgcggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttctaagtctttgctattgtgaatagtgccacaataaacatacgtgtgcatgtg

SEQ ID NO: 108542 - DNA, 1401 bp, Homo sapiens
tatttgctagcactttgcatttcacagagtccttcagtatctttcatttgctttttacaccagtcctgtaaagtagatgtgacagatactattttacagatgagaaaataaattctgagagattgacttattcaaataatacaactagttagtggtgttatcaaggcttgaaccaagactattaaatctgttgctttttccacttatgatctacattttcttcatataggttttttggtgacctaaatgtactagaaggaaaaaatagtatgtggagaatgcattttttaaaagaacatggatgttccacctatgtttcgtttgtttattcagcagtgctttttcacctcctcttatattccatactttttctaggcagtgagatacagtggtgaataagacaaagttctggtcctcatggatcatatattctaagtaaaaagagagtaaatggatactgtatgtactataatattagatagtagtagtgttctaataccattctctatgagaacaagtaggaaatgtggattaattttaattcatgtttagattattaaaccctcattacattggtttaattagtttttttctttgaagatagatttttcataagtatactgcatacatattttcataggcaatataaagaagatgaaagtcagtcagaagaagaaaacgactacagaaatctggatgcctcaccaacttataaaggccttttaatggtatggggactgcataactaataaatactttttaataaactaagtaatctaagaaagttaattatttttctatgaaatgtgttgcagtcattacagaatcaactcaaggaatcaaaatctaagattgatgcactttcaagtgaaaagctgaacctccaaaaagatttggaaaccaggtgagagaaacttaattttttttttttttttcctgagacagggtctcactctgtcactcaggccaagtgcagtggtgtgatcacgtctcaccgcagccttgacctccagggctcaagcaatctttccacttcagcctcttaagtagctggggctataggtgcaagccaccacacccagctaattttaaaaattatttatttttaactgagacagagtcttactctgtcacccaggctggagtgcagtggcgcgatctcagctcactgcaacctctgtctcccaggttcaagcgattcttctgcctcagcctcccgagtagctgggattacaggtgcacaccacgacggctggctattttgtgtatttttagtaggatgaggttttgccatgtttgtcaggctggtctcagacttctgacctcaagtgatcctttctccttggcctccccaaagtgctgggattacaggtatgagccaccatcctcagcctctaattt

SEQ ID NO: 108543 - DNA, 1009 bp, Homo sapiens
ttatattttttcaggtttatgatatattaatgttcctggagcttatactcatttaaaaacagcctcaatactgaagttcttgaatgaaacagctcagtagaaactatgaagatgcctttgtgtacaatactgttaggatagcatgtcctagatgtacatatcataatcatgtttttaaaaaatatcttataggtgaagtgccagcattataagaaaaaacgaacggagcaagaagaaactattgcttctttgcaaatggaagtctgtagattaaaaaaggaggaagaagatcgcattgtcactcaaaacagagtgtttgcctatctgtgcaaaagagttcctcataccgtcttggatagacagtaattttgctacataaattgatatgtagctagattcattgttgtgtttgtttgtttgttttacctgatattatcttgggggtggttataactcttataaactagaaaagcctctctctcctcctcttctgcattgtttttccctgctcatcctgttcttttttttttttttttttgttctagaggtcctttgaagaatggaattgaacatttactaaaaataacactaaacttttaaataaattcataattaatcagacatttctcaaaataactgatccttttagtgaagaatactattgagagatcgctgtatgggttttggggttgcttagttttattatgttattgattttaggagtttttagtggaaagaaccagggactatatattttggagggaaaaaaaaatcatcattgatttttttttttaacctagctgaagttaagatagtatttttatttaaattctgattttacatttgtaactgttgtctttcctactgaaaatcattcttaagaacaatattataattatttgctatatcctataatacataaaaatagtttcaaaataataaaactagaattactaacaataagcctactgaatgagatttaaatttctgggcagctttctttgatatt

SEQ ID NO: 108544 - DNA, 1012 bp, Homo sapiens
aaaaaatatttttgtaggtaaaattttaataggtaaatcttttggtaatagcttagcatagatgtttaatggtaccctatatttcttctattagtttctgttgcaggatgagcatctcaaatctgaaaatctgaaaggctccaaaaattgaaactttttgagcaccaacatgatgcttaaaggaaatgcttattggagcattttggattttggattttcagatttgagatgcttaactagtaagtatgatgcaaatattccaaaatctgaaaaaatctgaaatatgaatcacttctggttccaagcattttggataaagagaatgcaaagaaactttagaaaggcaatacattcttatatggatatgcttggtaattcgatttatttttaatactaagggaagaaattgtatgtctattaacttagaaatgaacttcagctagagcaaagccgagcagccaatcaagaacaacgagctaatgacttggaacaaattatggaaagtgtgaaatccaaaattggtgaattggaggatgaatcactaagtagggcttgccaccaacagaataaaataaaagatcttcaaaaggagcagaaaactttacaggtactgagttatgaattcttagatgatggttagttagtactaaaacagctcattatggtcccaggtgacttccatgttgtttgattcagtggtttttaccttttttggcttatcactgctaccttgaaattctcttcacttggtttctagaatgtcctttatttccctctgacctcactgatcattctctaatttcttttgctgtttttttttctcatctccctaacctcttagtgttggaattccccagtgctcagtccttagatcttttctctttcttacatactctgatgcccttggtgatgtcaatctaacataggatccaaaatttatatccgtagcccagtcctctccccgaattccagactcatatccagctgcctacttgatatctctactggatat

SEQ ID NO: 108545 - DNA, 1064 bp, Homo sapiens
attttagataagcaattattttctttcagcacattgaagatattagtgtctaggtatgactgactttttttttcttttttcttttttttttttactgtatcccagttgcaatatgttgggtttctagaatgtgtggatttatgtctttcattgattctcaaatttttcttagccattagctcttcaaatgctccttctactccattctttcctctgttcttgggtaccagttatgcattctgtggtggggggttagacaggacagagtgtatgtgtgtgtgtggtatatgtgtaaaatcccagaatgctttatttccagaggagaacattataagatagggtttattcaaatgagtcttacaatcagctatctaagaagtcacaaagttttgacgcaggaatgacctgaattgccctgcaagagtagtggattcttttaaatatacttttctttaactccttttgcactttttgtcttttttcatttaggcaactcaaattttttaattgccaatttctgtttcttttgattctacaaaagtaactatgtttccggtagcccctaaaccccaggattccagtcaaccatcagacagactcatgactgaaaaacaggtaaacttaaaatattttaagacactgcttctcaaaatatgtgccaaagaatgctacatctacaaacaggaaaatttgactttaaaaggattctttctcaaataattttaggaaatgctgggttaaagactatgaaatggtttaattactctaagacttcacaatattagtctccaaagggaggatttagtatacagcatttcatacatacttaacactagtttgatgaacatttcattagactagtgttctgtagcatgtactttggaaaatgccattcccaactattttcagaatttacaattactttatcttaaaatgtaagaggtatcaggaaacaatatgtataagttaatcattcaaaatatgtgactttattatgtatagagcattttgtttttatgagttacagtagaagttctgagacactaactcagagcttttggctc

SEQ ID NO: 108546 - DNA, 1007 bp, Homo sapiens
tcacagcctgtagtggggaaaaggctgctgcaaactattggcccgtttatttcacagaatggtcctctgaaaaggagggcttggtcacaggtgcaaatgaggagtagttttgttcctgtgtttgcttttgtgatcagtggtagtttgtctgaggatgcttcattttagtatccttgcaaatgagaatatcctacctgtggagccagaagtcagaattgatgatagatgatgatagatttggatacccagctaaatgtcttaacaaggtagggagaggaaagataagaaggagagagaagagaagggaagaggcatatgatggtgagctgggaaggccattagcagttatttcagttgtgcctgctttatctgtgattaccagtaccttggatgcctgctctgggagtaacacaagaccattcttactaggaggttgaacatttcaagattttgttctttttatctttttgaaacctagatgaagatccagtttcagacatgagactcgttgggtgatcatttcattgagatcaacctgaatgaccaggtgtaaagtgcaagagtaatatgctatgactgaggtatgtctaatgtaacggatgactccagatgttgggaggccatggaaaaaaatctaatatttattgagtactatactaggttcattacatatatttccttttgacttcctgataatcctatcaggtagatattttacaactcagcaaagaagctgaagctcagagaggttaaatacctacttaagataacacagaaagctgatcaccaactctaatcacagtctccatcctgctgtgtgccagacaatgctttatgttctttctatattaactcttctaatctttaactcgtgagctgagtacttttattatccttattttatgatgaggaaattgaagcacacagagattagtactgtactctcctggctgtgtggcagaatccatgatttgaacccaggcagtctggctacagagctctgcagg

SEQ ID NO: 108547 - DNA, 1422 bp, Homo sapiens
atttggtgggcatttaactatttgttgagttaatggattacatttgctcattctgatattactttgtatagaccatccagagaatcaccagttacgaagaagtaagttgacttttgtgtgaggatattctcaaaatgaaaaatcagctgatgggccaaagtatcttaaagtctgttttaagtaaacattgatctctgtgctttagtgccttttagaataattattcatgtttacttcctttcagacctctaacctaaatctctattttatttcatgtttccctaaagactcactagtgggcatatttttacgtgcatttgatgagttgactagtggtttttaatgattttccctgatatgaatggccaaaaaacagatgtcagtctgttaacctgttgcatttgtggctattaagagtgttttctatgtgtgctctcctgcttttgagccagaagagcaatttcaattaaattttaaagtggtgaaattggaatggaatgtgtaaactgacagaggtcataagactagtgaaactgctgggataggtgatagagaagcccaaaagcaggaggcagagttgattttggacatttttcttaaacattagatgggatttgttgatgggaattattgtttgtggtaagatcatttgaaaagttttctttgctctgtgtgcattattggcaccctctacagctttgttagaaagttggataggtaataagaacccaggactggcagtggagatggcacttggagggatatgtgttactgatttccccgtaatgaaggagagaggctagaccaggtgattttattgttttttgttttccagtgctgaaaattgtatgactctctcatattttggttaaggctgttgttataagatactggtcactttaatccttgcatagaaagcagtttttaaagttaatctctgccttttaaaatggtacaaaatttgaagtatttcagccttttataagctgaatatacttttaatgttccaaagaataatttcgtttgttttgttgttgttgttttttgcttttggaacagggtcttgctctgttggccaggttagagtgcagtggcatggtcatggctcactgcagtctcaaacccctagaatcgagcgatcctccctcctcccatgtagctgggactataggcacgtgccaccacacccagctaattttttttggtgttactctgttgaccaggctggtctcgagttcctggcttcaaatgattctcctgtctcagcctctcaaagtgcggggattacagggatgagccaccatgcacactccaaggagtaattataacagtattttataattattaaccatttataaaaagatttttttagtgttttgcttaaaataatggatagcatgaacaagaaaattgaaatattac

SEQ ID NO: 108548 - DNA, 1047 bp, Homo sapiens
aaattagaacctttttgttaaaacaaatccctagtgcgagtttaagtatgggaggtttggagagttcttgttttagagtgattagacctgaaaaagagaaataaaattaattaccatggtttttacatgggagctggtgggagaagaataaagactttttactgacctttccatgcactatactgtagcctaacctagaatactgaccaggataaactgatgcattcttaatcctattaatattaaggtggcttttttttagaagtaatcggactatgtacccatatatagtagttgtatcttaaaggaagagtgaataagagggagaaaatagttacatgtactgtgagtagaatttcttaggtactgtcactttaatattttgacattttagaggttttaatctaatattttcatcttggaaggattaattggttatttaattagtattttggcctactataattgctttattttattcctttagccctccttacagcctagaaaaaatgacagatctcgtagctgtttgggatgttgctttaagtgacggagtccacaagatcgaatttgaacatgggactacatcaggcaaacgagtagtatatgtagatggaaaggtaggaagaaaatatgttactttgtaaaatatgatatatagagaaacttgattttgttaaagtagcatcttcatatgtgaattcagggcttttttttcttgtagtcatgtttttgatctgtatcattttgctgtgtaaagcaaacatagttatagaattcatggaatatagcgtgtaatatttaaacttaaaatgcttttattttctaaaaccttggcatcataaattaataaaattacatcttttttttttcttttttttgagacggagtctcgctgtgtcacccaggctggagtgcagtggcgcagtctcagctcaccacaacctccaccttctgtgtttaagctattctcctgcctcagcctctcaagtagctgggattacaggcacctgccattacgccctgctgattttttgtatttttagt

SEQ ID NO: 108549 - DNA, 1038 bp, Homo sapiens
attttatatataagatatcttaagccaggttttatagtgatggatttgaggattataaatttaggttttaaaaaaatgtaatattgccaggcgcagtgactcatgcttgtaatcccagcactttggtaggctgaggcgggtggatcacctgaggtcaggagtttgagaccagcctggccaacatggtgaaaccccgtccctactaaaaatacaaaaattagcaggacatagtggcacatgcctgtaatcccagctactcgggaggctgaggcaggggaaatcacttgaatccaggaggcggagattgcaatgagccgagatcgcaccactgcattccagtctcaaaaaaagcaagactccatctcaaaaaaaaaaaaaaaagtaatattgatgtagattttggtattatttggtatttctctttataaatatatcttaaaggcagttggaaatttaggatttatcagtaagaaagcaatattttcctagataacaataggcttaggactgcatcagatcaaaattatcaaagtctaggactttttgaagagttttttttgtttgtttttctaggcttttctgtttgggtttctcttttcttatgggaagcagatatatatcttttctttgcccatattcctatgtcttttagcagttttactcgtgttctctattgcttggaattcttttcattcttttatgtttttgagacagagtctcactttgtcgcccaggctggaatgcagtggtgtgcatgaacatggctcactgcagccttgtcctcctgggctcaagtgatcctccagcctcagcctcccgagtagctgggaccacaggtccatgtcaccatgccaggctaactttaaaaaaattttttgtagagacagggtcttgccatgttggccaggctaatctagagctcctgggctcaagtgatcctcctgcctcagcctccaaaagtgctgggattacaggtgtgagcagctgtgcccacccttcttttcattcttaacaacaatattcttggaagtctgttgc

SEQ ID NO: 108550 - DNA, 1030 bp, Homo sapiens
tttaatttatctagtatccatatttgaaaaaattttaggtgaagttaaatattatatttgatttaaatcaatataccaaaaatagtatttaacatgtaatcagtataaaaagttattttatacatttttttgtttcatactaggtcttctaaatccagtgtctattttatatttaaacagcatatctattttcagactagtcaatttgaagtgcccaatagccacatgtggccagtggctactgtattgaacagaacaggtatagatttagtggtgtttggttttgttatatgtatattttactgtaagccaccttatacccagaggaatcagattttcagagtggctaagaacactccatccctggctggatgcagtggctcacacctgtaatcccagcactgtgggaggctaaggtgggtagatcacttgaggtatattataaataactaataaatgtcatatttatcatttttatttttgaaaacatagacacatagtcatgaggtttatattcctcccccaagaatttaagattcttaaggattgtaggggttatgaaaaggaaactttcaattcataacagaaatgtaaaagcatctaagtacaagctttagactttgtttttcaaagcttattgtttaactaatacattattttattgcactactagtacttttagatggtgtgaatgctctagacagagataaaagtttctgcaccactaattccttcttcttttgttgctccagggtgagtttgtagatgatgggactgaaactcacttcagtatcgggaaccatgactgttacataaaggctgtcagtagtgggaagcggaaagaagggattattcatactctcattgtggataatagagaaatcccagagattgcaagttaatgaattttcatcttaagaagtaaagatcaggactttttaattactgtggtaattaaatgtgttcagtatgtacttatcagtacatttagtctgcaatgttttaattttttaaaaagttacatgaaact

SEQ ID NO: 108551 - DNA, 1051 bp, Homo sapiens
tgcacgccaaggaatgctactagggattgtttccgtttttgtttgttttttctaatatttggtacttcccagaatggtgtaaatacttcttttcaatgttgtgaccaagtattgtcactcagccaacaacttttccacacctgggggttggtggctgttcttactgtccaaatgaagctaaaaagaaaggcatctttcttcccttttaaaattgtgtaaactgcaaattataatataatttgaatttatgattattttccagaagaaatcttgtaaacctgtggatactcattaattcttttgttaatatttatttccatgatagcatcattccagccagacttgctgaaaatctactggtgaggcaaatataatatatataaatatgctacatatatatttataaaatttctagtgggagttctatataaatgtttctttggtattcttcagcctgtgatttaaagttttacaaaaagcagagctttttcctaagttacttttcagttaggtaactgtgtgatccagttcttccagctgcttctataatgaggcacatattaatacagtttttatatggtatctatgaaagagttcacttcatagagaataatacttgagcaaatgtatccaagaaagcaagcaaatgaaaagaaacctatttatggaataaactccagatctgaaattcagtattttagaaaaatgccagctcttcttactgtatttattaaaacttgtaataatgtgatttttttcaaggatattagttcaaattgaaatggtttcacgccacacggaaatctttaagttatttgttgaggtaccatatatttagggtgctaggggcaagtaatgttaatatgtgcaataggaactactggtttgaatgtgtaaatgggtgatctctctgagtcctggcaacatccagcaaaactactgcttattctccaaagaatattgggagctctcaatcctcggtgatatgggaaagagaactgagtatttgccctatgactgagctttctataggaattttattaaagaatgt

SEQ ID NO: 108552 - DNA, 1042 bp, Homo sapiens
gaactcactcactgtcatgagactagcatggagggccacattgattcagtcacctcccaccaggatgctcctttgacatgtgggaattatagggattataatttgaggtgagatttgagtagggacaaaagccagaccatatcacaatctaattcatttgattaaaatatctctagtatctgttctttgaccctcttgactcccttttccccatctgaaatcttcagctttttttgtgatattgtaacagtggtacagtgaaggaaagcatgtaacaagcctggcccaaaagaaccattgtgtttcaacaagttcacatttgatagtttgataccaagggatctttttctggcacaggttgtttggttactcactgtgtcttttgtttctttcagtgatgaagaactttctcaatatcttttacaactggtgcaagtgttaaaatatgagccttttcttgattgtgccctctctagattcctattagaaagagcacttggtaatcggaggatagggcagtttctattttggcatcttaggtaagtcttttatattttactttgagcccaccaggtgctttagtaactataaacaagcataatatatttaatagaaaaatagctgctttagtttttttctgaaccgtttataacatttatatggttttggtgccttctcctgtttcttgataccagcactcttgatttttatgatttgagatttgacaaagtaattcagttatccaagacccttatgtgtccctccatgcctgcttgatttcttcatttcttccttcctttcttttttttttttttgtgtgtgttttctacctgcttgatttttaactgaaattaataatgtattgctattttccagtaaagtgtacttattgtcttaatatatttgggctcaatgcagacctatttatttcatctagaaagttgtgggtggtactgtcattactagtgttattgagtgaaggtaaaggtatactataatgacagcaattttattcaatttctttattaagtaggtaatttcc

SEQ ID NO: 108553 - DNA, 1013 bp, Homo sapiens
tatcgttagatttgataagaagaatgtcattgatgacttaaaataccaatttggttattgtgacaaccatgaaaaccagattacatgtgattaagaagtccatatgtagtgatgagattatagtttctatgggccacctaattttgatggagagagagcagttccaattaaagtcttttcaagattgagaactaaatttgaattaagaggtaaagtagtcattcagttttgttaactttctcatttttaaaacatgtatgcaaactcacactgaaattttgttccaagcattaacagaaaattagaggattactgatagaattgtctgtcacacttctgtagttgacatacttctaaggtgattttcatgggaggagatccattacagcttttttaaagcctagttttaaagacattttttaagaaccaaaattatttgcatgttttagatgaactcgaagaaatgttgaatccaatgggaactgttcaaacaaatccatatactgaaaatgcaacagctttgcatgttaaatttccagagaataaaaaacaaccttattattaccctcccttcgataaggtaagctaattatttaaaggacctctatgcatgaaatgattgaatgatcagttcctctatgtatagtttaagctctatctgtctctttcaaaacttcccatacagtgacagctttgttgagtgggaagaccatggatcagggagccttcttaactctgttagttttggttttatcactgactaagtaagaaaaggtacctccaggccgggcgcagtggttcacgcctgtaatcccagcactttgggagcccgaggtgggtggatcacctgaggtcgggagttcgagaccagcctgacaaacatggagaagccctgtctctactaaaaatacaaaattagctggacatggtggcacatgcctgtaatcccagctactcgggaggctgagcaggagaattgcttgaacccgggaggcggaggttgcagtgagcca

SEQ ID NO: 108554 - DNA, 1005 bp, Homo sapiens
agtagcaagattcctagtaggtatgtgtataatattagatcctgtgtgattaattttttgatgtgggctacatatttgactgtctgcttgccctacacctagtggacaaggcaaagagaaaacatgatcagttataatattcagaatctcataaggtaaaacaaactagttatttatgagtttgtagcatatttcaatactgtaaattgagagagatatgcttagggaatccttatgaatgagacacagtgagtaatgtagtgagcaccaacacctctgacaacatcatattatagtaggcaaaataatgcttctcatctctcttataatgtctttcactaggtagacataaaatacaatattgacagtataatctggaaaaagtcattctagaagagaccaaattaattcagtcttagtactgtattcacccatttgatggtttatctttaattgaataatatttggacttcctaaataaatgttgtgtgtttttcaggaaattctgtatgcatatttttattcaaaactggatttgggaaagattaggcagtggagactttgttgtgttcatttaaagtcaaataagatcaaagtgtatatacatatatatgcacacatggatcatcaactgagcctagagtaacattaaatcatcttggccatgcccagtggctcatgcctgtaatcccagcagtttgggaggcccagacaagtggaacacctgaggtcaggagttagagaccggcatgaccaacatggtgaaacctcatctctaataaaaatacaaaaaaattagccaggtgtggtggcaggtgcttataatcccagctactcgggaggctgaggcaggagaattgcttgaacccagaaggcggatgttgcagtgagccgagatcatgccattgcactccagcgtgggcaatgagagcaaaactctgtctcaaaaaaaaaaaacttaaggatatgaagtttctaagcagaaatcatgtgtgaatagatggc

SEQ ID NO: 108555 - DNA, 1136 bp, Homo sapiens
agagatagggtcttgctatgttgccaatgctggtcttgaactcctagcctcaagcagtcctcctgctttggcctctcaaagcactgggattacaggcacaagccaccatgccagaccagatttcatttttaaaggcaaaaatcacatggagtcaaatctacccacaagtcatatggaatattatatatatatatggttttgtttagtaatttataggtatcgatatagaatctacgtagtaacaaatgggaatttctgcttgttcttcccatttgcaggttatcatatttgtcttctgtagataatttatcagttctttgatttgtttatggttggtatttctctgcagccctttacttaatttcttcctaaagaatatccaagaagccttcattcgtgttttattttttctcaagcattatgcgttattcctttgtcagtggtcagaaacccaataaagtcattgacattttatgtccatatgttttgccacttctatcaggtatcaagcttgattgattctattgtttgccgttgttatgttcatggagaggattaatgggcttaatgacaggtagtatttaatgtatgtacctcaccccaccgtacctagcactgtagttctctttttctttcttctccccagcaggattatatagttgaatttgagtacattaaatgtaattatgacatgattttcctgtagatataccttgctacacaggtgaggagctccagtagaatgttaaagcaaaatctgaaaaaaggtggcagctttacatctttctttccaaacttttttctttcctgtatgcactggctaagaatcccagtacaatttcaaatagaagtgataagggtaaatggattactcagggttctccagagaaacagagccaataggatacaatatgtatagctatatctatattatcacatataaataagcaaaaaatatagaagatttattataagaaattgacttaaatgattatggaggtgggcaactggagacccaagagagccagtggttgagttccagtctgaatctgaaagcctgagaaccaggaatgccagtgggtgtagttcctatctgaaggctggtaggcttgactcaaacccaggaagagccaatg

SEQ ID NO: 108556 - DNA, 1948 bp, Homo sapiens
agtagatttctgtttctttaatttaacatttctttttaccttaagaggtgtaaaggagaatgtatattttaccagcattatcctctattattataaagaaaaacagaagcatgtatgtgtttttgtgcagggttagacaggagagaccctgtacaaaagagagagagagagagaatatacagtgtaggcaaaggaatgtgagagaaatggatctttcatagtgaaaagtttttggatgaatatatttatcataatatcatatataacttctgagagacattctggaagttttttttctctgacaaaaatgtatttttaatggttctgaattgaattacgatacattgaatcacactctggatctgtataggaaattcattcttctgaggaatacattggattcctattcactttgttaggaatctttggtaatatgaataatcaccccttttcttatatgcctctggagagtcattctagttttgtgaaaatagaacatcaaactgggatgatcggtaggtttttgatgggaagacggctggtaatacttgcctagagctctgtgatggaaaggggccatctcagggatccatagaaagtgtgaatctgccacatgcgaaccacgtattcagcttttctagccaagctgaaagtatggctgaagtatgactttagtgttagacaaatgggtttaaatctaggttttacagatactaggtgtgcaacttaacccttctgagtttcatttctttaatatgttaaatgagtgtaatgagattagctgtaacatacaataatcatctaactcatttctttaggtacttaggtgttcagttaatgatagctattttttgtattgtgatttaaaattctcatatgcttaggctgggcttggtggctcacacctgtaatcctagcactttgggaggtcaaggtaggcagatcacttcagctcaggagttcaagaccagcctgggtaacatggcaaaaccctgtctctacaaaaaatataaaaattggctgggcatggtggtgtgtgcctgtagtcccaggtactccagaggctgaggtgggaggattgctttagcccaggagattgaggctgcagtgagctgtgatcgtgtcactgcattccagcctgggcaacatagaccctgtctcaaaaaaaaaaaaaaaaaattttttttttttaatttcttgatattctgctgtggtttaagacatactttcacagtgcatttgatatagtgttgttcagcttcattttattctattgatttaggtgttggcatgaaaatcaataccttcccctttcttgcccctatagtatatccggaactgtgtgatgaacagagccctgccccattttatacttgtggaatgctgcaagatcaagaaaatgtatgaacaagaaatgattgccatagaggctgccataaatcgaaattcatctaatcttcctcttccattaccaccaaagaaaacacgaattatttctgtaagttttatttctgaacctttagtaaccccaaaagccatgtgattgtgttagtttacataagtttcacacatatttcctttgctcacttctccttctgtgaaaaccaatacatatttgccaaaaatcgatcaccatttatttaaaaattatctttctagatactattatttttactcaagccacaattaaatgtaaatatgccgtttatatttttgatgtctttttctgccgaagaaaaatgccatcaaattagagattttgatttaaatataggacttcaatgagtaattggagacatcctagtagaaaagttagatgtgcagaaataattgaattaaccagtatatttcatttctatcagcttaactatggtagtatttttggtataatttgcctgccttcttaatactgaattcttttagtactaaacatatatgaagggcacta

SEQ ID NO: 108557 - DNA, 1054 bp, Homo sapiens
attaatacttggtttgtaaataaaaacaatgaatcttttatgtgtggctttaaaatatgtattgtgaattactttgtaaaactggtaggcaaactacatttctttatgaggttttgagttgtattttttaaaaaaatataattgtatgtttgtcttctgtacatgagatttattgttttatctgggttttttgatctttaatggtattttcctccctagtttcatctgcttgataaaagccaagcatccaacatccaagttagtttttgttgaatatactttgtattctttctatattcttttattattgttagttactgaaaatgacacctttaaaaaatgtgtttaggtctgcatgaatttgattccttgaaggatcctgaagtaaatgaatttcgaagaaaaatgcgcaaattcagcgaggaaaaaatcctgtcacttgtgggattgtcttggatggactggctaaaacaaacatatccaccagagcatgaaccatccatccctgaaaacttagaagataaactttatgggggaaagctcatcgtagctgttcattttgaaaactgccaggtaggattatatttttttaagaaatattttgtaataaatttctcatttttacccgaatacaactgcatttttagaagtgtctgtcgcttgcctagcaaacactattagaaagaacaattttatatttcagatagaaatgtatttaggattatatataatagtctaaagtgatattctgtacacgtatctgttttgatacagtggaatggtgatttagaatgggattggcaaactggactgtttaattggtttttacagttttaaagggatgttaaaaagagaaaaaaacctcaaagatttgtaaagggatgtttaaaagaagaagaagtaaaaagaatatgcaacagagaccactgtgttgtatgttgtttgccaaacctggtcctttacagagaaagtttgccagttgctggtctagatagtgttccttattggaaatatttttttctcatgtgacttttctcccccatcggtagaaatg

SEQ ID NO: 108558 - DNA, 1004 bp, Homo sapiens
ggctgaggcaggagaatcaggcagggaggttgcagtgagccgagatggtggtagtacagtccagcctccgctcggcatcagagggagaccgtgcaaagtgggagacggagacggagacgagagggagagggggagggggagggagagggagagcctttttttgttttttgatacagagtctctctctgttgcccaggctggagtgcagtggcgtgatcttagctcattgcaacctctgcttcccgggttcaagtgattccactcagcttcccaagtagctggaattacaggtgcatgccactgcacccagctaatttttgcagttttagtagagatggggtttcaccatgttggtcaggctggtctcaaactcctgacctcaggtgatccacttgtcttccaaagtgttgggattacaggcgtgagccactgtgcctggcccggataagcattttcgtagaatattatacctagtaatgcaatttttgatgctaaactccctttggaagaggttaaatcagtttattctcccataagcaacgatctatgaaatggcatctcagtgtggttttaatttacattttcttggtgaccaatgaggttgaacattttcccccatatgtttatgggttatttgggcttttgggaaactaattattatcccaattttttttgttggattcatgttctttatatgttctttttcacactgtaactttcaaaagttgtttattttatcattttttatttatctgtttgacattcttcattgaatctcttgttcttttgcatgaagaacagcaccttaatttgacctaccagcctccccagtaccattctgcccctgtactctgcttgttgaattccataaatgcttaaggtttctcaggtctttgcatatagtctttctttccttgcctgcctagctaatttcctgtcttacattgtctctgttaaaatatcaccctcatgggccatggtggctcatgcctctattcccagca

SEQ ID NO: 108559 - DNA, 1018 bp, Homo sapiens
atctgcgcaaggataccagaaaatgtgtccagatttctgggcttctttacaaggtcatattcagatcccttcattctccctcgttttgcatcagttgtttctctcaaattccagtctttctccagcatcatactgccactcccgtttctccccaaaccaagaaatcaccagatctcttacgttgttagttaccttgcatttttttcccatgaattttggaagacttagccatggcttttcttggggtttttccaactgctctccaaggaaactgccaaatagtatgcttactatacaagactgtatgttgcttcttcctaggaaccccttatcctgctgaagttttcttctagtcttctaattctaaatgaaaatttgtgttgaattttatcagatgttttcagcatgcattgtgttatgtatttttttttaatttgttaatctggtgatttcacccaatggaaagtgtttgcattcctgctattccacattattttataccttttaaaatctaccctgagttttttctcatgtaaaccaaacttctaacttttaaaatgttagtttattactgtagttgcctcatatttttatataggagataaaagattactggtaaagctgatgtcaacaagctggttttattttatttaaaaacatcaataactattcagatctaccactatgccttaccaattatttcctacatttttattcttacattccactccttcactgtagcttcagttttctttttgtgaagaatatcctttaatatttctttccactgtgtcttacgtgtgataaactatcttgcttctgtaagtctgagcatgtttttgtgtgataaactttcttagaattgactgtaaatgttttaattacaccttcattcttaattttaaaatgatatttaactacagtactttaaagatattagcccgttgttttgccattttttgttgttgcaggatgtcttctgtcaatcaagttgttagtccttttatatgtaatttgg

SEQ ID NO: 108560 - DNA, 1109 bp, Homo sapiens
atcaatcagctcatcctccaactgaaatagacacagaatttctgaaaacacagtgcattggaagcacatgtttttgttttttgaaattatcaagtatcttgagagattattttctgctctgtcttcaaaaactggaagggaagggctagacaaaagatagtaggttgtgtgcatggcagtcacctctcatcacagttcagttccaaggaaaattttcagtgttttccaagttggctgttgcctcctctgaaatcagcacatgccatgaaggaaggagtcttgctttgcctcatcttctaccctagggtttaatgttggtgaataaataactcaaggacccctttctacaaggacccctaaaactcctgcagcagtggaccaagcccaggggcatacttacaactgggaagtcctagggccttattttgaaaagacttgaaatacaattaggaagacaagcacaaaagcaagtgttcacttctctctgctgtgagtccaagttccaacttttcagtcatggctttgagagctctcagacttgcctggctctaagtctatatggtggctttttaatcctagcctgcaactggcttagtcctttttgctggctcaggatttgagaatgaagggtcccttcaccaggaaaacatgcatatactcaaaatgttgcttgcagttttaggatgttcataaccccttctcctcagggaccttatataagggagtcctgctcttatcaggattggtcacccaggctttgatgttgctagcatctggttaccaagatagctttttcccttcacagtggcatgttgtgttgccctctgcaccatctatgatactgggaaatgcccaccattattccccctgggcttcaggatggaattttggtttccctgatgattatacttctccttaaaacacagatctggatggaatgaatcattttcttggtttgcatagatgaaattagctttatttggcttcctaggccccaggcaggcagcttaattgaccttctccttgcatattctggactccagaagcattgccctctgtcttgctggtaatgatgtagtagtccagcaacagagcttccagggatttta

SEQ ID NO: 108561 - DNA, 1098 bp, Homo sapiens
caggtgcagggagagaggtagagctgacaggactaggtatgctggcccccaagtgagaggtgggattggagttgctgggagagcttgcttatgggccagaggatgtctggctcatctcagtactgctcatggggcggaatgaatgcgaagtccccccagatggggacaccatgtggcagagtgggaccactctggctttgatgcagtctcgccatacctctctcagctgtgtgacttcaggagcaatccttaacctttctgagcctatatcagctataccatctccctccacctgaccttgagatggcaattacagtggctgtagtccagtttatcaatagaaaggagccatggctggacagacgtggggacatggggcagtcccatttcacaggctggaaaacagaggccctaaaacaacacagctcccttacacagctggcctttggggctgcttggtcctagctctggatcctccacaaggatcctcacactgtggtgctggaagtgcctggtggccttgtggtggccgctcccacctccctatcagctgttaacctacaaatgccctagtaaggaaaatattttcattcttttataacaccattctcaggactgcttaatcatatttttctttgtctttgaaaacaagctcctgtgtggttttctattttcttgctgctcttctaaggatattctagaactgaaccttgctgtctggcacttcatgcctttttaattgcgtcaccatcctctggctactttagatggggttagggtgggcaggcgctaagcccctccaagtgcctcacaccacacttgacctcacttctattctgggacaaaggtgtcacctcattttgcagaagaaactgatgttcagagaggttaagtatcctgctcaaggtcacacagcctttttgatgagaattcaagccattttgatctccaagccagggataagtctgttaataaacccactctgccctgatctctggcaccagcctgctgtggtgacctcaagcaagtccgttaaagtctctctgccccacgttctctgggtgtgacagcctattgtgaaaacaggagaatgaggat

SEQ ID NO: 108562 - DNA, 1046 bp, Homo sapiens
tacacagggataggtctggtcttgcatctgtaggggctgggctggcctggcatcagggtccattggggtaggcctgcaacctgtgtctgtctgcaggcctggactggaatggtcccggagcatgagcctatgggtattggcctgtatcctgggtccatgatagtgggcctggatcttaggcccatggagatgagggtgaatcctgagtctgtgtggccagtgtgccactggggcaagcctggagcatgagtccatagttctactttatttttttctctagggcatcttagttttgctcataaagtctttctcatttcctatgttttattctagtatcttcatagttttatttatttccatgtttaattctttaactggaatttatttttgtgtgggtatgacaaaattttaagaatctttaatgaaaaacctttcactttcaaatctgtaagtaatatcgatgttataaaaagatgaaccaggtttatccagtggtgccctctgagtacactttcaggggcacaagtgaggaaccaaaagacacatttaaacttcctaatagtgccttgaaagctctccataatctgtctccaaacatttttttccaatttcttcctaacctgccacctccttcagaaagccttttgagatttctcagcttgcatggatgctttttaatcactcagagcactttaataagttatgcctcctggtggttttgctttattattattattgttattattattagtagcagtatattttaaggaagcttttttatctaatcagtcaaccagcttcttggaggcagtttttatgtgtcccaattcagtgtccctgtacacaataggtattcaaaagcatttctctaaaataaatgagaatatgctgccattttcagagtctggggttaagatacatgagaagatggcagaacatctgtgtgtgttgggcaggaatggggaactgggatccctttgctgctcctttgacggaaggaggggctggcaagagggtagggaaggagctatagccagttttgtcac

SEQ ID NO: 108563 - DNA, 1048 bp, Homo sapiens
gtttgagcctattccatgcatgcaaggttcagcaattagccagagtttagccagagtttttacatagaattcatggctctttgtctttggctctctactttctaggattactcctttactttttggcagctgaggtttctctgagctttgttctctggttctctaagtcagaaaaactataggttttcaataagagtgtgagtcaccctacaggctactcactactcagtgtgtattcaagatgattttgaactatctacaagctgaaagccgtaaaaatgggaaatatcctgggccccattccttcttccagatgtcagcttccctccaacatctgcctgctttctagttcctttggatagttgcattttttattttgtctagagttaatagttacaattgctgggaagtttggtccagtgggtctgttgaccatatcataagcagaactcctcctactatttttctattttaccatttttagaaggtggcttcatttttcaagacagtctcatggtcgcaagatggctactgcagcttcagccattatgccaacattccaggctggaagaagaatgaaggaggaagagtaagatgtgtttttcagctacagcagccatcctttagaaggttttttcattattctcacctaacaacttttatctatatcccattgatcagaatttaattgcaaggttataaataaaatgtaattattaacctgggcacattcctattcccaataggatcagagttaagttattatggtaagaaataagggaggattactctcagaaaggcaattagaagatctctcatttcatagacataatatgaagtttaaaaatgttaatacctattaaatgcttagtgtcattcatggaacttcataaatcttgcttttagtattgataggaatttcataatagacataataagcctaggccatgatgaaaatcccaaagagagatagagcccaatttggagtagaggggtgtcagggaagacttcctggaggcagtgactactgaatctaaaagacaaataa

SEQ ID NO: 108564 - DNA, 1046 bp, Homo sapiens
ggataaataaaataattgtgtgccacatatatcaatcattttctgtgggtttgtaaagaaaatatctaatattctgtttgtgccttgcctatatttgtgtcatccattcgaggcaccgagtataaaatagaaaatggaagctgatgttactttagctcttgacatggtcaaatatttctattgatggtgactctgggtcttttctttctagtcatttttttttaagtgagaaaaacatccactttgtaatttataatgctggataaccaattttaaaaaagaaagaaaaactcaacaaaaaataaatactcaaggctgttgtttgtcactggattttgtttctaagcatcccacttagactgctcctgaccctttcttggtacagtccgtctggaagggctggtttccctgggtccctaaatgggtcggatgtcagtggtgaacagtccgtctggggtgagaggcggaagggctggtttccctgggtccctaaatgggtcggatgtcagtggtgtctgtggggtctgcttccttgacattgtctcccaaatgagaagtgaccattaagacttccgggggcttaatctttcagacctagatcagccctgctcagcaatttcaaacaaacccaacaatgtggctgaaactggcacaagatagggtaccctgggatgaaagcgcgtgttagagcagcaactgaaatccagaaagctagagctgtgtagctttcatgacacaagcatttgagccagcatgtttgaccaacgctcacaacccccgcttgcgcccccttccaccctccaatccctcttggattgattaaattggctcaagatgacaccaataattggctcaagatggggcttcgacaggcccaatgatccatatcttcacattccctaaaatcagtcctttcagctctgtgttggatttaggatggtttacattggctccgtcacaaacattttaataaagtcccagagaaaccgcaaacgggtgacatcattggatggtgttaaaaaaaaaaaaaaaagagtcccattttg

SEQ ID NO: 108565 - DNA, 1011 bp, Homo sapiens
tttcttggcatcatcaaggaatttataagacagaaacattctatcttctcaaaaagcttcagctaaagaaatccatctaacttaggcgaaaagagtctcctgcttccattgccttgtagatttttgtccatttgtggtttgggatgggtttctgtctgtatctgtgtactccttgttctgcctcagcacatctggaatctggaaaatactgtgcctattatctgctgagaaatggtaacaccatgatgtggggctggtctgcatttctcatccctcatatagtatatcttccagaagggtctcacccagtcagaggaaatctggtttggacgcatcagagacagccaggtcacatcatctctcaagcccttctccacatagtatttcaaagaaagatcattttgcgattagacatatactcacccggtgtggtatgctatatgatatatcagtaaacacatatttggttgtttctgttccttccaaaatcttatcttcagctaacacatcatttattggtactcgctcttccagaactggtggcatttttaatcgtactttagctgcctcaactgcctgtcttgtagcctaatgaaagaaaatatttattaaggaaagccacaaggttacataatataaggatcatctgacaaaagcacatactaataaaaaatgcaaaaacctgcatagaaaagaaggtgtagccacaaatcagtgagtaaaaagccaaacctggacttgtgagccctggcctttgcctctgcgatgtggctgagaccaccagctatagactcaaccgttatcaaaaccacaaaggcatgctctgagacaaagccaggctacaaaagctgcttgaaacagaataaaagaatgcagttttggggtgcttactatgtgccagatagtgttcaaacagtctaaatgtatttggctgatttaatggcctcaattaccttatgagttaggtgcaattgttatcatctccattttacagaagaaaaaacagaggca

SEQ ID NO: 108566 - DNA, 1199 bp, Homo sapiens
gcacagagtggccagtatgtgggtgggcaggcctgtcatgacatcaggacaggtgctgaacttcagtgttctcatgtgatgctaactctgctgtgtggttttagactatgtatagccaggacaggcatgttgatgtcctcaatctctgctttgcccagtttgagccagattccacagagtatatcaaggtgagtagattttagtttctaaaatataggcttaagtatggttatgagtaagatttttaatctagctcaatgaatttcgttgtaagttttgatacaggggaaagggaagagaaatacctgaaaatctattgagtacagttgtgtgccagatatatattttataatcacaacaacccttgattaaagatgagggaatttaagcttgtagaattaagtagcttgctgaaagttgcatagctactaagtggtagggttaggacccaagtttgatgacaaagcctattctcttttcagtttaccgtataggaatcaaattatttactaaaattttgctgaagtacagtgtgtttgtcttacagctcagtaagtattcattagtaccttctatgtgtaaggtattatcttgggtagtataggtgatgccacgaactaggatagagtatgctgtgccaaagccagcagtccggatatggctgtggggaaaggtgctagtaagtatacaaataattatctcctcaggcctaaaatgctagacactaagagaagattacaaattctttgaagaaagccttcataggggtgtaaaggagggttctagaagtgcaggaaatgttgtggcaggtggagctgggtgaggtgtttcaggtagagagaacagtataagcaacaggcaggaaaaaaggaggcttgagaaacggccagtgatctggtttgcttatatatgccatgtatatgtaggggagtgattaaagattaagttaggaaggtggatgtagccacatcataggtgacctcagatgctaggctgaggaatctggaattcagtcagcagacctttgaaagccttttgaacagaggaatgcccccatcagaaccttcatttaggaagatcaatctggaaggaggactgaaggacctttagttaataagatggaatgggctagctggtagaatagggtagttgatggggggagggataggggaaagggagagtagtgaaaaaatacttga

SEQ ID NO: 108567 - DNA, 1055 bp, Homo sapiens
tctgtctaagttaacgtttgccctatttggtaacacaaaaacacaccagactttttaaccgtacgctcatctaacatgatttgagaaattcataaccaggcactcaaatatccttgtagcctacgaaaagtgagtagggtaataatttttgctttgtagggagaactacaaattgatatcttttaatctggccattttttaacatttagctcaatattaacagagaaatgtagtcagtatttagtaaaataaatgtatttttaaaatatttttaggaagctgcagaatggcgactgagtgcttcttgataagtctgcagtgttagttctatataggctcccttctgtgcttctgtttttgcaaagacctgtttaaattaaaaagaaaattttaaaacaataggacatatgctatttataaagtttttcagttttaagacatcattagcatttctgtagtagcaaagagtcctacttaaaaagggctttcagatttcacaatttttcccccgattatacaataattaataaacacacatggacagaaaaacaatacccaacacatttcaagcaatactaattctaaacaccagaagtatccaattaagaccctgacattgtattaatattaatacttccttcgagatcaaaacaaaaaccattaggttagagagaaatctggaggctaagagttaccaaactaacttttgactttaaagaatattttctccaaaaacattgcgctttatcaggttcataaagaaaatcagtactgtagtttctctctactcttcctaggatgtcatcacaggtcattgtttccttagctttgcagcatgcaaacagtattactaggatagaagccagttccacaaaaccatgtatattctgagcattagaagagatgaaattaattatacaatctcctccccttcccttcctgaaaatatcatctcaactctcagcacttacagataaatgtacataagcccatggttttgagaggtatgcagctccaaaatgacaatacagctaaggcttgatgatatacaagca

SEQ ID NO: 108568 - DNA, 1125 bp, Homo sapiens
cctgcttcggcctcccaaagtgctgggattacaggcgtgagccactgtgcctggctgagatggttcacttttaaacatcatctcccacttcctaattctgatcatccttttcttgggggaaaactttaaattcccgagtaaattcccttgtcttcatatatatcttcacttgtggtttcaggaacttgatgggaaacctgcttctcctactccggttattgtggcctcccacacagccaacaaagaagaaaaggtaggtcagacatcatactcaaacctccctctaccccatcttcctccccatcaatatctggaggatacgtaggcctctgtggtttaagtgacatcagtttcagagcaggggctttgaaatgggaagatgctctttttgactattaagaaaatcttagttctcactttgaatcatgaacccacggataactttcctttaacagtactgtaaaacttaattaccctcttccttttgtctgcagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaatgaaggtacttgtttcctttctcaataatgaaaataggcttctagttttagaaggctgagccgaaactacaccttgcctagggatcagccccactgtcttttctttgtataactaaatctgcattttcaaatgttgtcaatcacatttttcttagagctgaatatccaggctgtaattctctaaaccctttttcttgacctcattgcatcattccacaggtcttgccccgattttgtctagcagctacccatttctggagtca

SEQ ID NO: 108569 - DNA, 2031 bp, Homo sapiens
ttgaagttattgtctctctcttatctttttaaaagatgtattatgttaaactttgcataagttaaattgattacattggagatattcttagcactctaatttgttttaagaaaaattgttttcatatcttatgtgagctctattttgcaagataagaaaagatgtaaaatagtatgtaaactagtctggaaagcctaagagtacagacatagcagttatttgccaatgtctgaaactaactaaaaatatgttggttttgaaagacagcccaaccccctcatcttttggtgttgaatagagcaggcagtcagagaaggacagtgctgccttggtggcactcaccttcagcagcagatgctcttagcacatctggtctaaatgtttgagctaaatgagctgttcagggaggctcaagtgggagaaatgttaataccatttttgtaatgatatttttatagatctttgtatattgaggctcccaattgtttcagactggcatttactggtaaattaatttcagatgtgcaaaataaattttagctacgttaagatcatctaaacatgcagcattttgagttctgaaaagctacaagtgagacataatattattgtgaaatatttaaagacgtagttttgtatgctttcaaaaaagtgatattaaatcacttgttaaaataattgcagtctaattgccttaaaactccagtgagatggttttactttccctgtgtaattataagataaaagtataatgggttgacgataattatttgcacatcattaaaattgatttgtgtttaaattcattttgtatacattaataatttccatttcctcactgtacattttgcaatgccattcttattttgatagagccaacttaacaaacacagctctttttataaacattgtctgcacagttaacagaataatgttggaaatgtaaatgcttatttctaaagatattttaacttggaaactcttttcttacagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaagtgagtattaatttaaaagattaattaattctacactgaggatggtttttggagagggaagtgaagaatgaaccctggagagaactgatgaatggccaaatggtgttgaatagacggggcagtcagaacaggacagtgctgccttggtggcactcaccttcagcaagggatgcccttagcacatctatctaaatgtttgagctaaatgagctgttcagggaggctcaagtgggagaaatgttaaacaccttcttcaacagccctgccagttaatggtggaagcattttattttatgattgcaggaggctattgagctgctctagtaggtacctgaagggcaggtgattttacccaaattggataactttgatccatttatggcaagaacaaaaggggataagtatgccacttacttgtagatttgagcccactataaagcataaagatgtctcatatttttaagtctaaccgagttagcataaaccaaatcatttggacattagttggcagtattatgaaataaaacacaaaagtattctttcctttttttttttttttttttgagatggaatctcactctgttgcccaggctggagtgcagtggcatgatctcggctaattgcagcctctgtctccctcgttcaagcccttctcctgccttagcctcccaagtagctgggattacaggcatgcgccaccacacccggcttgtgtttttaatagagatggggtctcaccatgttggccaggctggtctcaaactcctgacctcaaatgatccgcctgcctcgtcctcccaaagtgctgggattataggtgtga

SEQ ID NO: 108570 - DNA, 1027 bp, Homo sapiens
aatctcctggtctggagactctttagtttgtcctctccaaagaataaacctgtcttctttgtcatgaggtgggagaggggaggtgagagaggggaggtgggagaggggagcggatctagagtttctgaatgcttttagggcagtttgtttgtttttagccctaccattcatgagacacactgggtgtaaatcacattgtttctatgctgttctcactcctgatttaggatctgttttctctactgttttaacaaaatgtttatattcctccaccagctttccagcttccaaacttttgttactgtttcctctccctttctgtgtgtcgttgggagcttatgcctttaaaaaaaaatccttttagtgtgattttattagtagtagggaattagcagaaaacaaaagtatatattttagtccgcctcatttcatgtgttttgcccttggctgtatctgactagttccagagatcttccatcctccactcttgggttttatgttatctatatcaatgctagtggaaaaaaagtaactccggttatttagaatgccttatttacatcgtattcatggatggatcggggcgggttggcagcctgtataagctgagaagttaaaacatttcaaacttgatgataaagccatcctgaagatatagccagacagaaccctaaagctgtccagcttctcaatcttgactatcccataaatgagcattctccctcagtctggtgaagaggtaaactatccctgagctttttgtgtaacacattacatccctagagctaaaaatgaccccatcagtagtgtttgtcttgaaggagaagctaatttaataattacaatagttgatttaaaacagtggtccccaacctttttggcaccagggaccagtttcgtggcagatagacaatttttccacagatgggaagggggtacatttcaggatgaaactgttccacctcagatcgtcaggcattaagagtctcataaagagcacagaacctagatccatcacatgtacagt

SEQ ID NO: 108571 - DNA, 1050 bp, Homo sapiens
tgaatatacgataatttgtttaatcattcacctattgtggacatttgggtcattttcagtttctaaagtggtttgtaagccctagtaattcatgtcatacacagtataaaaccctttcatcatttgtccaactgtaaggagttctctgatctcttaggaaaacagtacatcagataatcttcaaatatttattttatatttttgcataattactgaaaaatatttgaagatatttccaacatttggtagaactatgatttagtatataacatgttatgtttgccttcccttttttctcccaggtatgcaataagagagagcaacagcattgtaaagatatttaagaactttaaggaaaaaaaatcatttaaaccagattttggagcagaaagtgagtgtgatctacatatgatacatttttaaattctttgtaatggctcaaaaatgcctaagcaaaactctttttatgttccctttaggtatctacggcggcttcttattgggagtcagatctgtaaatggcttagccttctatgactgggacaatacagaactcatacgaagaattgaaattcagcccaaacatgtgagtttcccctccattgttgtttttggaatatttatttttgtgatgagttctgggtccctaaggccaagaagtgtcttttgtaccctgctctccctcttcgattatcaaaagccatttaaaatataaaacagcacttagaatttaaataacttcttatacttttgaaatacacattgtctacggcctcattaggatacaacaatcctgattttctgagcaattggaggtaagtggcagtgccattttgacaggaaaaaagcatgctttgagaacaagaagtcagagaattcttgacttggaaatgccttcttccacatagttcagaaaaccttttcatacattttgatgatagctgcttgaacttgaggtgaccatctccagtgacaaagtgtttacctttagaactgcccgctgctttgacagttttcactgtcaggagattatctttggaaacaaaccag

SEQ ID NO: 108572 - DNA, 3531 bp, Homo sapiens
cgccatagtgattttgctccctgaaaattcaagtaaaatgagaaagaacaaaaaccaaacaggataaaaaataaaatttgatagctcttctctcctgggctttggcattttacataatgtgtcagaaatatggtggatttgccttttgtaaagcaaggccccatattgactggccgatgctgtttctctctgcaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcaggtacagtttttcataaccttacttccatatgttagatatgtttcttactatttcttataggacagttaagacttgggttgttgaaaactgttcacagcataataacttaaggtatcagtatttgcacctaaactgtgttcccagaattctccataaaaatgaaaacaatgcatatcaagattttaaaaataaaataccaacatgttcatatttcatttcataattgcatttagaaattttaacattttaatgttgaattatcctccataatcttcattgatagacttctattcatttttgtaagctagcagatcaacaattaccaaccattttgccaaatcgtactcttgtaaacctagttatgaattcttgttaacatgcttcctatctctaagattttcttatattttgatatttttgttttccacatcaaaagttcccataagcaattaataaaatgaggtctagaaagtcagtttttccttgaaacattttcagatttgtacttaaatccagaataaaaatattaaaggctaaagcagcactgtctacttagccagtgatggtaggtgtgagttttaagggggaaatctattatcctgagaatttgggggaataatattcagacaaaagccttcttgggtttttttccccttctttaaatgtgatagttacatttacatttattttacaaagtaattagataaaatattcatatatacaacaagatcatcctatttcaaaaatttctatattggatattatttagattttcatgactactatcatttataatgtatctgtacactgagaaaattaagggcgggctggttacatgtttttcattaataaaacatgttttctatgtcttaattacagaataaaacatgtgtgcagacactggaaggacatgcccaaaatgtgtcttgtgccagctttcatcctgagttgccaatcattatcacaggttcagaagatggtaagttagaagggtatgtttattcctgtgctagtaactactcagtgggcatttaaagcaagtaatgtctctgcattataattgtaggtttccaaggattttgatatttttattaaagtaccagacttaagctataaaagagtaaaggggcattattttcatcatcatcatcatcatcatcatcatcatcgtcatcattctcatgtattttgattctgtcacttaaataagaggaccgtcagctgtcctaaagagaaactgaaaaagcatgtgctttggagtcaaacaaacctgggttcaaaatcaggctctgttatgtcatgaatgtgtgtttgggcaaattatgaaatggaaacatatatatctgcttcataaaattatagtgagaagaaattgtgggtagaaagcatctggcacataggaaacactttacccaggaaatcctgttattatttcatgtttaaaatcgtaattcttagtttttgtttcttatatgttatgtgttatgtttatgttgcttttaaaaatcatttaaagacagtaggtcaaaaaattggtcattaagctgccaggaagtgttatctgtttgaatagaaagacttctatgggtctctttcacctgacacagtttattgtcggatgtttgtatcaaaagggagtatttacattgttctttttaggaacagtacgtatttggcattcaagcacctaccggcttgagagcacactgaattatggaatggagagggtatggtgcgtggccagtctaagagggtcaaacaatgtcgctttgggctatgatgaagggagcatcattgttaaggtaattatactatccctctcagtaggtggacataggcaaaaccattttctttgtattttagtactgtcatcttccaagtaaccagttttataaaactggcacttctttcattaagcactagacattaagcaatgaagatttaaagtggaagaaaggaaatggagctctctgttaggtgaaaaaaataatctgttttgttttggttttattcattttccttttcattgctgagagctatttttctttctttcagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtaagccatcaccaaaattgtccctcagcttctgtgtatgttagaacaggtttgcagatccacagtccactcttgccctgtggttggcatctctaatcattcctcaatgtgcttttgccctggcctcacaatcctcaacacagctgcagtcagccatgccacttgatcaagttggcacaaaagatggagcatgtttcccatctggacttgttctataccacacaattttgaatagttaaatagtagtttcctgttatttcgcatgcattgagtttgtgtttttgtgtgctcctttgagggcaaggagtatgtcttatgctgagacttagtaggtgccctctctaaatgcttgctgactcattgctctttcaagaagaaaacctgactctgagatatgtgtcttttgaaaaagttttgggattgataataattctgtttcttatttgtaattcgaactgtcagttgaatttctcccttaagatttgtaagtcaccaaacatcttgtgagagaggagtttctagcacagtgaagtctaaacctgtggagctttaaaattattttacagcaggtctgggcatcttataatgctgtgctgagtattgaaaaagacaaaagatataaaccaagtatgccgcctagttcagtaaatggtatccataattatttgtaatataattgtcttataaaggttaagaatgcattatgcatatttcccttaatatcgtaaaacattcttggctgtaagttttgcctttggcagtcttttgataccagcctttacagtgttataaacaactttaaagatagttgtcttatgtccattgggaaaattttcgttgactctgcagcattctgttttctcattatttaaatgttaaaatatcctctgtattttgctgaatttaagtctttaaaacctggagtgagatattt

SEQ ID NO: 108573 - DNA, 1090 bp, Homo sapiens
aggccaggagttcgagactaccctggccaacatggtgaaaccccgtctgtacgaaaaatacaaaaatttgcttggcatggtggtgcacacctgtaatcccagctacttgggtaactgaagcatgagaatcacttgaacctgggaggcggaggtcgcagtgagccaagattgtgccactgtactgcacttcagcctgggtgacagagtaagactgtctcaaaaaaaaaaaaaaaaaaaaaaagaaaagaaaaaaagaaactaagagctaattcattcaacaaatatttattacacactacttgtgtgccagccactgttctatcctctgcctatacagtgtgaaaaatattcctgcctttggagagcttagcaggaaagattggcactaaacataattatgaggtgctacattatgaaagggaagtacaagtttccatgggtggattttcaagtcagagacaacaagagcagaggtgaggctgggagtagccaaaggtgaggctggaaaagggagggaagggctggagcacagaggatctggaataccatcttgtggatatttgccttctcttatcttttaaaaagtgttttaatttcgaatctattaaaagatagttggtcttttttaaaaatttgaatgttgagcttttatattttagcctgagaatatactaaaatgagaagtgatcttaaaaattggatgtttgaaatataacagagtagattttgtggttattttcttatagctcaatttgtgtattcttgttacattttaaagacactggtgaagacatttgaagtatgtgatcttcctgttcgagctgcaaagtttgttgcaaggaagaattgggttgtgacaggagcggtaagtaattaatatgaatctctattcccattttctgaattggtcaatgattgtgtaaatttgttgcaggattttgattcccgatttgttttgttatttacagcaatgttttgaggcatagactttattccttgagcctgtgatatagtttttttgtataatttacttgataacagggatgatggttttaaaatttctgtttctaggatgacatgcagattagag

SEQ ID NO: 108574 - DNA, 1065 bp, Homo sapiens
agtcaatgacccaaatttgataaaaatccccaaaaaagatgagtaaaagcattgtgaggtgttttgtctcaggaagttgtctctgctagatcttctttttatattcaaaagtaaccttaaatttctgtcccattcatgatcatcatagaagatcacagcaataaagatttgacagtaactcaacttgccaaatgagcttttaggttgtgtttaagacctgttgaaggggaaatatattttaaatcagtcttttctcagcatgcctcctagagagaattaagcccactgccctaaggatcattgtatatattgaattaacttttctcctataatggcattttttggagaatggagaaaatagttattcaaataattatctgttctgtaattcaaaggaagaatttggcttgaaaatgctagtataaactattcatattttctgacttgagagaatgtttttatttttgttttaaatttttccaattttcattgtttctgtaatttaaatccattaaaatatttcagacattcccatttgataccaaaggccatcatgcatagggatataacccttattgatcacacattatgttacctagcatttactagtatttttgacaagataaatctaccatttttctccaaagaactcaatattatgctttatggttactaggacttcatgaataacacttcttcagaatatttcctgatatgacactattgacctgggcacaaaattgtgatttgtgaatatttaaaattcattggccgggtgcgggggttcacgcctgtaatcctagcactttgggaggccgaggcgggcggatcacaaggtcaggagatcgaaaccatcctggctaacacggtgaaaccctgtctctactgaaaatacaaaaaattagctgggcatggtagcatgcgcctgtagtcccagctacttgggaggctgaggcaggagaatcgcttgaacccgggaagcagaggtttcagtgagcagagatcagcgccactgcactccagcctggacgacagagcgagacttcgccactgcactccagcctg

SEQ ID NO: 108575 - DNA, 1063 bp, Homo sapiens
cccagattatcaagtttgggagctgccccctcccccagcctccaggagctccccgcttgctcaggattgacaaatgtgtctctttcttggcagacaacagtgagctgggacggagacaagctccagtgtgtgcagaagggtgagaaggaggggcgtggctggacccagtggatcgagggtgatgagctgcacctggtaggttcctgggctgggtcaggccgggtccccagaggccctggtcattgttgaggtccagatggaccttggaaaaaggcaccatggatgggccttggttctgttctaaagcttctcttccaagggcctggaaaagatgcctgggtgactttaaaaaccaagcaatgtattttcaaggtctaggctgacccaatcatctaatcagagggaagaggtgaggagttatatccattaagcatcagcaatgagctaagcccttttgcattctataactctattctctcagaataggaatatggctcttattttagagatgaggacctgggggctctgaaagattagattacatgtccaaattgcacaactagaaagtgacagaacaaacatttgctcccaaatgatgtatatattcaccatgccaaattgtataggccaaagccaagaaggattctctaagcttctctaagatatgatctcaatctgggtcagcgggaggtgattcgggaggggaagcgtcaaggggtcctgttggtcagctctgagccacatccattcctctcagccagctctgtctgtagggtgctgcagagcactccactatacagtttaactgtctttccaaacaattggttacttaaaccaactcttggggaaaaataacagccaatgagtatttttagagttcttgccgtaagtgtgactctgctctggccaatgaccaacatctgcttttgtttcaggagatgagagtggaaggtgtggtctgcaagcaagtattcaagaaggtgcagtgaggcccaggcagacaaccttgtcccaaggaatcagcaggatgtgtgggccaggatccccctctttgcacagcatg

SEQ ID NO: 108576 - DNA, 1048 bp, Homo sapiens
ctaattttttgtatttttagtagagacgggggttcaccatgttggccaggctggtctccaactccgacctcaggcgatccacctacctcagcctcccaaagtgctgggattacaggcatgagtcaccacaccaggcctctttttaattttttttaaataactcctttattcttgtgttgctcagtgttagtttgcacacgggaatcacccagggagcttttaaaagtacccatgtcattggtctgggttggggcatcaggatttttaaaagctacctggtgattctaatatatggctagctcacagcttcagctgccaagtatatgaattaagcttatgatcagtaccaagatgcatccaaaccagtggtctcaactctggctgcagaaatcacttaataagcttttttaaatgctcacctcctcccacccaccccagagattttgatttgtcaggggtgggctctaaacattgctattttcataaaggttcccatatgtattttgtgcaaccaaaattgagaatcactgttacagtcaacacagttttatcaaatgctgattaagatttttaaaattattatttggagtaagtttcatctccaaaatgtaccaactgcatttgtgtttgattactaacactttccgaaaattatcaaaatcaaagttttttaagactgaaaatccagttataattgtaaagtcaggtggttttagaagcatggtagaaatccaccccatcttttgctccatttagtgtcctcttgataaagtccgtagtgaatctgcatcatagtgacatagtaacaaacatctctatgatgtaaattcactgtagagcttactgaggattccttctttccctataagatagtttgttctttgcagacatgatcttgtgttgtcctcattttacagataaagaaactgaggctcagagaggctacgttaatcacggtcacacacaaataggacgtggagctcccatctgtggagctctgaagccatgcttatggccatcttcaaaacagggatctgcaggctgggaa

SEQ ID NO: 108577 - DNA, 1043 bp, Homo sapiens
atcttgcattccatcacacttggggagtctctactctagaactgtgctttttgatcttctatcacaaaggtgataaaatgcactatttatgttcttcatacactctcgtgggccagagggctatgctaactttgagcacctctgatctccccagcaagacaaacaggtcctaatgctagtgagtgcaactgtgttacagaatagcctcgattcagtgataatccttattcacaaaaaaggtgcttcatcaataggagaacagataaactgtggtatagccaaataatggaacaccattcagcaatgaaaaggaacaagctgctgacacacagaacaatgtgagtgaacctcagaaacattgtgctgagtaaaacggacacagaagaccagacagtgtgattctatttatatttaaagttctaaaagaggtaaaatgtgtctgtggtggaaaaacttagaatagtggctgcttgagggaggggtgcagggggattgagagggaagggacacaaggggacgttcagggtaagggagatgttctatatgttgagaggggttggagttacacggtgcatgatttgttaaaatttattacatgatgccctcaagatttgtgcatttcattgtaagttcaaagaaacgaaaaaaaatgctaaacaaatactgaattctggttaataacatgcatgctgaagtgtatagaaataagtatgctgctgtctgcgacttcttttgaaaggcatcaaaaacagtaagcgagattgccaaatggatagaggagtaggtatatgataaaacaaacagtaaaaaattaatggtagaatctaggtggtgaatatccagatgttcactttaaaattcttttgactttgctgcatgtttgaaaatctttcacaataaagtttgggaagaaattgcatacattcaaaacaaacaagtacttcatctgcatgtctgcacttttgagtttttgccaccccagagggtcttgataggggatggctcctcacagaagtcaaatgggcagaaggcttggagcaatg

SEQ ID NO: 108578 - DNA, 1051 bp, Homo sapiens
gactggtttagttgttcattcttgaaacatttaactggcgcccactttaccctggctctgaggattcagagagaaatcagacaggggccctgccctcctggagcccatgtccggtgggccaggtgaaataaagtgacagttccaccctggcacaacccagagaaagggttcttacccactggccttgcaggggaaagcttctctgtttttctcagaaagccacccaggagcccctgaaggtatggttcacacagctccactgagcatcagttacttcttgaatttcattggtggttctcagcttttggtgtcacctcttaaaactggacagaagacttcccagaagcagcaactatgctgggaccttgctaaggacgtgtcagaccttgagaccccatggatttgggagagcattttaggtttcaggaaacatctgtcagctgctcactgtattttattggctcaaatgatcccaatttcttatttggctctgttcacaacattgttgtagacaaagaaagtgctccatgaaaaccaactgagaggcccagagagtaggggaacccagatgaggcaggagtctggcaccatttgtggggagtggtaaaaaagaacaggtatgatgttaacagagggtgttggagggaagaggagagagagcagccattgtgcagcctctcttttcccctctcagaccactgcaggatgccagcccatgagaagggaagctccaggcttggtggtcacagacctggcacttctcagctctgtgactgaccctgggcagctcactcaccttgtgagtcgtgaggattgctcaggcttaacaggtgcttagcatatcgttggccctgaagaaatattaactcccaccctctccttctcctgaatgaactaaaatatacatagttgtagtgtctacctcagaaggttattatggggatttaatgaggacctaaaatacatagagcagtacctgacatgtgggaggatactactactataactattgatatcgttccttagtctggacaaaaattgatgaaacaag

SEQ ID NO: 108579 - DNA, 1048 bp, Homo sapiens
ctggaagccagaattaaccagaattccagagttccaaggactttgttcccttggaacagtgcaatacttgttaatagaattctggggataattgaggattggtcttcaaacctgttctcttctgcaagtccctctcctgtgtcctcagtttcaataaatataattgattgaagacccctgtcataaacatgatgatcctcatggctaccaccttcagaggtgaacccctcatgagttgattaatgccactatcaaaagggcttgtgggagtagatttactctcttctactcttttgtcatgtgagaatacaatgctgctccccgttttgctcttccacctttcaccatatgaagacagagtgagaaggccctcaccagaaagcagatgtcagcaccttgatcttggacatcctagtctccacagatatgagaaataaactattctttatacattacccagtttgtggtattctgttacagaagcacaaatgcaacgaggcaatgacttcgtggtttggttagtttggattctgaagtattccagaaactcaataggtagaatatattgctgcataaaatatggaaaaactataaaaaagaaattaaatatattttaagaaactcaaatgaaaagttattgacattttaattcaaattcatattgctaagtcggttcgccagcaacagtagaagacataaactctttttatttgttcataactttaagctataaaagacatcattattaacacttttttctcatatagtagtgcagccttcaagtttaagagcttggaaaagtaaagagaacatgcagagtattaataacattatggagttgtctaggacttggtatgtatatgcttttttattcctctgacttgttcacatgcattatctcatttgagactcagagccagcctgcgagatggataggaagggtcttattcccattcaccagagctgtatactaaggcatggaggtttaagtgacttgcccaaggtcacctaactagtaaatgtcagggctgctaccaaaagtaaagcc

SEQ ID NO: 108580 - DNA, 1027 bp, Homo sapiens
cccaggccagagtacagtggtacaatcacggctcattgcagccttgactacctgagttcaagcaatcctcctgccccagcctcccgagtagctgcaactacagatgtgtgccaccatgcccagctaaatttttaatatatttgtagagatggggtctctctttgttgcctaggctggtcccaaactcttgggattcaattttcccgcctcggcctcccaaagtattgggattacaggcatgagccaccactcctggccagaaatggtactttcaagaagctgatattgcccaccctggcacagttctagggaaggatgggcagggtctgtggttttatcaggaagaagaatttagtttagcattgtgaagcctggccctggaacttagggtggaaactgctgaattatttagaacaactcaatctttattgttctttttccaagttgtgaattttgcagttcgacccaagcccaaagtgcttgtaagcctgagagaaagtgattttgatgtaaacatttgtgggaaactgcaatgacagggtgaagacgcaggctttggggcctcaaaatgacactgcctgtcctttgagaaccagtttggaaactggagccatagggcaaggactaaaatctctggtttcctggactcaaccaagacatgttcacaccttcctccataagaatctctctctgtactcctgcccacatctagaagtggtccaagatatgctgtcagttgtcctgctccaggggagtgatataccagggctaatttggaccacctttccctgcttccccagagggcatcatgtgatctccccagggcccagcaaaggggagatggggtgtctggaagaaaagcaacgtttccagggagctgcattgactgaatttacactcttgctaaatgttttacagcatatgttgcactgagtaaattgaaattgggcaggaaggtttttaactaattcatcagtccaagtaaatccctgttaagaggtagaaatgagcttttatggggataata

SEQ ID NO: 108581 - DNA, 1216 bp, Homo sapiens
agctagcatagccagctcattatataaaattttatttttaaaataaaattatttaaatgaacaaagtgagtctatttaaagaaatatttaaagtaaataatagtacaggtggcacatagctatagcagaaatcatgaaagtatcatgcaaatgatgatggaattatggaaaatgttggttttatcttatttgggtaaatacaggtgctgtgttgatggaaattgtgatgagcacatattgttcttttggggcaatatattgcatacttgaatgcagtgctattttatacgtggctaatttcagaagctaaaacaaccgtatctattaaatgctatttgatttgattaataaaaatgctagattgttttaggattgaataaatataaaatgctaattggatataaaatgcttatttatgtgaccatgggcattgccataaaactataagacagttattactgtttaatattgctttaattagaagtgctcttccaaaagttagaagacaataagcttctccttatagcagttcccgagaaaccaaagtgatattgcaatgagatcagcagtcaaaatagaacagggagattttctttgtcccaagaagacatagagtgatgttaaattgcacttttaaaggccagagtttcaataggctgctaccgagttgctgaatttaattaaatatttatttaatgtgcagtatgcaccatgctctgttagatccctcgggatatggtgatatttatattagccaaggttgtttcagatgcaagggatagaaaacttgactcaaactggctcgaacacacaaacagagaaagaatttgtaggtttacacaatgaaaagtctaagtgtgaacttctggcatggctgaatccaggtgcttgggcaacatggttgttatatagcctctgtctctcaggtttgctttcttccttaccctcccatacagcccctgacaacttgaggtcatcctgttgattttgggtctaataaggagagggatttactccacagcagctttgacatcagtcttataattgagacccattgtccaggtctgcttgttctgttatgtggggtggggatgcaatcacttgtgtggactgaaggtggtttccaaagaaaaataggatacctgctactagaggaatggaaatcgacaagtattctgtcttcaaggggctcactagcaactgggaagaaggtatc

SEQ ID NO: 108582 - DNA, 1002 bp, Homo sapiens
caagaactgcagtaacccatggaaatgaatgtttatatttctaacaaatggctaaggcaagagatgattttctgaggcttatgtctggtgaaattttccagaagttcacgctctgcaaggccttattagtagaacatggatgatgaacggtccatttcattagtaacctgaaaccttctatttggagataaagatgactgcttccatttaaaaaaaaaaatttcaaaaactaaacactcaggcatgctgtctacagagttctatgctaggtgaagtgaacggttgtgagatgactaagccagtatccctgccctcaaggggtcaaatcaggtaggtggaaataagatgtgttcctaaatcccaggcagtagagcactgaaattctgtgtgggtagctgtgggtgaaattctcaagggaaagccctcatctggcctagtaatattggaactgggctttgataggtcaccaggatctcattaggattttattaatgatggaggaagcatcatggatggaagacatggcatgagatgttgaaagggaggtggacagatgcattgtatgttaaaggaatttaggaacagtaatagaatttgcatgcctggagcggagatcttcatggtgaaagcttgagctggttaagtctaggaagggggtgatatctttgggaagagctctcaattgtttgttttcctgggaaggaaaggtctataacttttgtcatctattcaaaagggccaatgattaccccaaaagtttagacctactctcctggtgaacagtttttgtcaactaagcattgtagaacagagggagatatgcaaaattttgtgctggactgactctggggggccttgaaggccagggttaaatgtctagacactattgggacccatgacaaaaaaaaaaaaaggtcaggtggggtccaagacagaatgaaggtgagagggggtaggtgggaattggatggtgtcctgcgaaaggcaggaaagccagaggga

SEQ ID NO: 108583 - DNA, 1081 bp, Homo sapiens
cctttgcatgtgctgctttctatgcttggaattctttttacttccacacttcttcaagagttagctaaaaggtcaattcttctaggtgctacagaagcctgtgctcgcttctcctgacactgatcacacagtatttaaaatggctgtttttgcagaagcttccttttatagactgaaagctcctgtctgccaatagtctgcaagctgcaggagtggctaaccaattattattatagttagtattaatattaatagtggtagtggtagagtactgtagagaagtaatttcaggtgagaactcagcatgagtgaaatgcatcaggtatgcagggaaggccaggagagtggtgggtccatgccgtagagccccgggtactcagtttgcaaactactggtcatgatgacgtcagtcctccctaaacatgtgaacatcctcttctgagaagcacctctttctggttccaagttttcaatctcagcaagtctcaggtagcagcaaaaagaaccatactccacattgaggggtccctattctacaggcaggcatgcccaccctcatgagatattatattgaagtattctattatctttctgagctgctcaatacaattatgaagtatacacgtgtgtgatgtgggttttaagtgcaaagagaaatcaagcctcctcacccttttgtgtggctactaaagaatcatttaatctattacccagttccatgtgagcagacttcagcaaaacaaataataaatgtttgtaaccagctccctggctgagcaggcagagctgcagactgcatagatagctttttattttccttttccttgccctgccctggctgagccaaagtccctctcccagagctgccatgactcattatgtgactactgtacccctgtgtttccccactttttgtaagctcatggtatgctagtagggtgggaaaacttgggttcttgtcccagctctgctgtgtgaccttgagtgaatcacatctctcctctgggcccatttccttgtctgaaccagggttcttaaacaccctggtttttatatgaggggtctctgtagcagtctgatg

SEQ ID NO: 108584 - DNA, 1043 bp, Homo sapiens
agatgcacagccagcggatgattggaatggatggatagaaggggtcctgatggaatatcaggccgcagcaagcaggggaaagaggccgttttggcatggttgctgatgtatgggacattacatactgattgcagtgttgtgaggcaagtgtacttgttgggaaggttttctatggcagtgttgtgtggtcaaatggatagcatcataagagcaaaggcatatgtcaaaccagtgggtattttagacctacctataatttactcaatgactaaagctagtctagtgcttgaagcaagcttcaaatagtaaatatggcctgtatgttctgaatatttgtttttccaaaatttatatgttgaaactgtaaaacccaaataccccagtattaggaggtggggcttttgggaggtaattaggccataagggcagagccctcataaatgggattagtgcctttataaaacagaccccagagagactcccatcctttccaccttgtcagacatattgaaaagagaccatccatgaaacagaaagctagctctctgcagacacaaaatctgccggtgctttaatcttaggcttcccagactctgaaactgtaagaaataaattgatgctgtttataagccacccagttcatggtattttgttataccagcctgaaccaactggcacagcaatttaagacaccacctttggacatcatatgaaccctacagatgatgctaagctggtatccgtgcagggaatcactcccaaagcactccttcattatatttaggtttccctggagtcttggataacactgtaagggcaaagaaccttgtaggctctcaggaggcttcactggcagcgtgaggtcagcctggcagtttctgaaggcaataaaaggtctcaaacttggtttttaagcaagaaaataattatctgattataagtcaactatttcttcacaatgaaacatcttttatagatcttcccccacttctaacctttctcaccaccataacagtcaaagtgcatggtgagaaaagtattat

SEQ ID NO: 108585 - DNA, 1012 bp, Homo sapiens
aagttcatgcctggcacatacataatagctgcttaataacagtttattgatgtaaacttaactgcagtaagaaaatggcctctctccaagaccaaggcctcacttaaccaaaggagaggtcatcctattgaacaccttcccaaacagattccctttttatttgtgttaataccctatttgtgttatactgcatttgtgttaatatcttattaagtttgtagttccagtttgatgtttattgcagtttattctctgtaacactccagcaaaatgttaattttaccttatatatatttttaaagttctatagcttattaaagtttgaaatgtcaaggtttgaaaacgccatggcatatcatgccgtggactattcagaccttagctgtgctaacatgcaggtgcccctgtgggaagtggaggtgtgcacagtactccaaacttgcctccctcataccacagagcctcttcttcagagagtcttgatttctcagaaggtacttcgggagaccctgatctagttattctggtatgtgtggcatctgtcttctaacttgataaccacgtgttccagggctggcaatgtgttttacactcggctgttattcctcagggcttagtaggtattgaaggaatgcctactgaatgaataactaaatctaagtaggtctgtgaaaaagacaaatagatataagttccagggtggaataaattttatttaattctaatttaactcaatgactatgttcaggtgactgcttctgtgccaggctgtgtgctgagcatggtgaatacagaaatgaagaagaccaagcaccatccccaagaaatacaaggacttgaaagagagacagataaaggcacttcccaactgtggacaaatggaacagataatgaatttacaaggcttggaaggtgcaaagaaaaaggagtgtgcaatccttaacctagatgatgactaaaacaaattgtggaaggataactgaattcactgtggtgacaagaatggggcagg

SEQ ID NO: 108586 - DNA, 1064 bp, Homo sapiens
tcatcttgggtaaaatgctcaacctcttctcctcaagtaggaaattattttttacttacctattgttgtaagtccgaagtaaaataacctacagcgattgtccaatgccctgaatgttgcattagaggcgagctatgcatgatagtttgcttctccctggaggacatagctgtcacacacacacagagacacacacacacacacacacacacacacacactctctctctctctctctgtctctctttctctctctctctctatggtgatactctctctcttcctcctgttccctctttagtactaatcactgtgtagcctccactccgtgctgaggatcctgtacgtggattcaagctgtcaccacacaagacagggccagaaagggctccatttgtatattattatttatctaatatatattatataatagcctgttcatgctcatttccaacaaggagcaaaattagaaatcacatctcttaatactttcagaaactgaatacaggtccctttaaactccattcccattagatagtgtcttcgaaacaccttaagttgctgtgtgtatagtgtggtgggggtaaaggcatttcaaatcccttatctccaaaaggaaagcaagctcttccttcttttccctttacatcacctcagcaaggtcagacacatcgtgagaggaagcagaacgtgctcaggcagaaatgagaagctcaccagggactttggtaccaagaagaaccctgggatgccttgttgagctcacctttccatcctggacagccatagtccttaccttccagcacagaatgacacatttacaggacaaagaagaacttggggggcccttaatagagcaatgtgcagccatggaaattcagactcttgaaaaatattttaaagagacaaaatacgcccaatattttgttaaataaaaaaagtgaggcacgggattgtatgtacagtctgatcatgaatatgggttttttttttcaaagtgcacaaaatgaagcctggcaggactgacactaaaaactgatagataactttttaattatttcatta

SEQ ID NO: 108587 - DNA, 1018 bp, Homo sapiens
ctgagctgtcttaacactgggtaaagagggaggggaggagatgtggaggacaaaccaagagagaacagcaggttcaaatatacgaggacaagaaatgcacacagaagactctgagctgtttaatgttcttgcgttatcaaactggaggcaggaaaaaagagatgaagctgggggaggggtgagcaaggtcctatcctggaggaaaagcctattaagatgcttatactcaatgctgcaagcagcaggaagacatgccagctgttcagcaagggctttgttcttgcttatcattggcaaatggtagaaatttcaataattttttcaacatttacctgtttttttatatggattgctatttgttttattgggcttggatgtacacttgtctgtaatgagtggacgagaaatgttgtgaatatacttagtcttttaaacctggaaggtgctgagcaaatgaggaagttcagagcctatgaataactctgtctacccccttcctgtcacacagtgtatgcttgttttttcttttcttttctggcaaaaaaaaaaaaaaaattataggaaggatccctttgcccttccgacagagataggtaggagacaaggaggagtaagaataggagagtcagttaatgacttggcagtaggctgggtggaggacctcatcccctgttcatttcctctagatcttagcagaacctttgaaaattaaagaaggctcagctgagcagaaagagtttgggtcttagtgtcttactgacctgtattcaaagccaggtttaggcttaggcaagttttcaaattactctgaatctcaaatctcctttgcaagggagtccatgatcctgcactggggtgttaaggccattaaaagagacagtacagctgtaagtacctggcccagagcttgactgagtaggaccccaggtggagctcaccgaatgttggattgctcctctcctgcctctcctttcggcgtcacttctctctgcctctctttctgtaagtgcacgagctt

SEQ ID NO: 108588 - DNA, 1029 bp, Homo sapiens
gcagatgtggggtggggacagacccacagaggccctctgggagaggttgccatgacctggagtgctcactttagcactcgccctgttgacccaagatggtcccttttgtgagggaggcaagcagaggcaggaacactgagcccaggcagaaaagaggccgccaggaaagagagagcagggcagagactccactatctgtctcattttgtgtttttctcaacatgcctttagaatgagattcagagacagggttagtcctatgcagagtgcagaggagtatggtttagatgctatcatcttcagcatggcccagggtcaccaatatgttctagtcagctccaatgctgagctgaccaacctcaatgactttatgcttaggaaaaatttgagtttctggattacatgtcaggaatgcagatgcttttatggattctaacagcccatagcaaggggttaatgtaaagtgccctggcaagaatgtctctccctgttatagcatgagccaggctgacactgagggaggctactcatgtcacatgggggttaagctgtctttgatcctccatcagagctgatggctggtgagtgcttgctgggcagggtaggactccccaggctctgtgttagaaggtggccaaccaatgggtctcctcgacttggaattctgtgaatcctgcctctccagtctctcaaagtgttagggagacatggccaagccccccctccatctgtccttgggaaaactttctggaagcttcctggctttaggaagcatttaaagctcccagaggtggctctgggctggggtcagcagcttcacagggctctggtcccggtgtgtggctaaacagctggtgaccttgggaaagactctgaactgtccttttgggggaatttttaatctataaaatttttcatccataaaatgcctgaaagacctaccacactgtagtattagtaatttaaagatcattcccttaatgaatactaaagcacttagaaaaacataaggcattatcaaaggcaagg

SEQ ID NO: 108589 - DNA, 2120 bp, Homo sapiens
ggcgccggagactcctttagccctcgctccttgcagcgctcgcttgggcctctgcacgtcactcacgccccacctcggacctcgggccgctcatttccgggctcggctttgcaaggtgggtggtaagggggctacgggatcgagcggggaaggctttggtattctcccgtggttgctgtagggtgtttctagcccttggaaaatttcttgcccgaggttttccaggtggtgaatggggtgcaaagctttccagtacctttggggtcagattcctttcgagaaaaccacccctcttgaacaccgcttgcttttctgctgcttaggagaaagtaggagtggagagaggtcagattttttgaagatagtgttaatagttactatgtgtgtgcaagattaggactaagcctaaagtcttagttccctgattgccaaaatgagtgttagagcttccagtttagcctcctgtttagatttgctccttctaaatcatttggagaatcatagcaattttaagagttacttatttggaggattataaagagttttcttatcaaaaatgccttcggtgaattatgctgagactcttaccggcatcttcttaaatcctgcagtttttagatcgacttttaagaatatgaaagaaatacacacgcagttctattcacggtgccttgctttgagttggacatatggactctattgagccagtgatggcaatactttctttaggttggcacactttcatcaacaaatatttgttgtacaccaattatgggccggccactgttctggcataaaaacaatatttttctattgatctgtgagacccagtttaggcagtttgctttccatatttctgaaatgtttactgccaataatcaggcaaattaaatctttttaaaaaaattctgtagctatgtagatgctcttgaaaagatctcatgcaaataattgagctccctcttgtaattagatctataaccctgaagtgaggagaccgcagatgtagtctagcactattttaatttgggtgaaaaatggacacttttatttcaattgcttcatctataaaattaggaggttgtattatatgatctctaaagcccttctctagctcctaacatttctattattctgcgttcaggattcatgtatcaagtttagttaaaaatggggcatacttatatttgaaataaatgttagcttgattgcactaatttcccactttggattaggatcatcattttgttataaaaacatgtaaatataggttttctggtttaagaacaggaatgggaggtgtttgtagcatctaaacacacagattaggagctccatcccctcccccccagtctagcatatgtagttagagtattaaatgagatatggtatgtaggatttgatacaagataggtgctcagccgtataatttctcttcctttgcatctcatcttgattttatttttatatgtggttacataagtgagttcagtaaaacacaccttatctttttaaaggaagcccagtatattttaaaagaaccaagagtaacctttcacagagtatttaatcttaggcaagggttttccgaatatggagcctttaagttgtttttctgataagtagaattgtaatattcaaatatgtttatcggaatcccacatttctaatagcctagtagctgtattgttaaacaccagcactggaccttggttctgggtgaaatactcacatgcataactcgtgctttctttaagacaccctttgatcccattatgcttttgccagagttaatattcagagtttgtaaggtcagtagttaggttaattgagttaaggaacgatatcatgacagcctgtaaaaaaggtgtaaatgtgatttaattttagctgtacctctaatgtatgtatatagagatgaaagcactattaaatgtatttttaaagactgatagaattgtacattgtctagttattgtatcagctgcatatatctacagaggcagctcattttttttctatttgagggagatattgtctcaaataggagctatataccttaagattttaagtggatgaagtattttctttgcagctcttatgacagataatttaatata

SEQ ID NO: 108590 - DNA, 1119 bp, Homo sapiens
ctagggaggctgaagcaggaggactgtttgaacccaggagttcaaggctacagtgagctatgatcgtgccactgcactccagccttggtgacagagcaagacactatctcaaaagaaaaaaagaaaagggatattgaacagtttttgttattccaagaattcccccacaccccttgaagtcactttcttccctctcctctaccccttggaaaccactgatctcatttctgttcctctcattttgccttttctagaatatcataaaagtgtttgcttaacgagggggataatttttttaacgtcaaaaataaaagccttttgtgcttagctttttcaattagcataatgcttttgagatttacccaggtggtggctttttactgcagaatagtattctattatatagttgtaccacagtttgcttccactagttgatggacatttgggttgttcccagtttttagctatgaataagtatagctattataaacattcatgaacaagtctttctgtggacatgtctgttcatttctcttgggtcagtacctacaagtgagatagggctgtgtggcagtgttatgtttaactctgtaagaaactgacaaactgctttctaaaatgcctgtaccatttttaattcccaccagcagtgtaagagatttccagttcagcggttggctgtttgttggtcagtctttttaattctagccatttaatagatgggcagtagtatcttataatggatctactttgcatttccctgatgacaaatgatttgcagaattctgtgtgtttatttgcgtctatgtatcactatctgttaaatctcttactgaattacttgattttattcctgactgtaagcacttttgcaggtaatgatttgtaaatatttgttctcagtctatggctttcattttcttctcagtttctttcattgtgttagcagtttctttcagagtagaagtttttagttttgataaggtccagtttttcagtttttttctttaatgatttgtgcttcttttgatgtccatataagaagtctgtgcctaacgcaaagttaaaagatttttttccagatgtttttttcctagatgttttatagtttcatcattt

SEQ ID NO: 108591 - DNA, 2156 bp, Homo sapiens
ctacctacattgtacagttttccacgtgtaggcctgacaggtattaattgtgagactcaaatgccaattttttttcttttttgagacagggtctcactctgttgcccaggctagagtgcagtggcctgatcatattcactgtagccctgaactcctatgctcacacagttttcccacctcagcctcccgagtagccaggactacatgcatgccccaccacacctggctaattttttaaacaaattttttgtaaagtggtgtctggctatgttgcccaggctgatgtcaaactggcctcaaaccatcctcttgtctcctcccaaagctctgggattacatgtgtgagccatgcgcccagccctcaaatgctgtatttttttgtaggtgaaatacttctgaatatttggggatttaaaataagagaactatgtatggttaactatcagtgagttcttccttattgttcagaagaccatttcttcagtttgaaaggacaggagtttgaaagataggatatacttcaaagaatggcctagattttaacagagccacaagttatatatatacatgagtactaaatcaaaccttaggacagtatttaaagccattatgtgacttaccagtacaattttagtaacagcacctatcagttgaagtgtttagcagttattcttgccagatagttactaagctgtgttcattttagttactgaagaagtttgtatgaaatcaaataatggaatctcttaaaaatcagtttagtcatctaacattaaaaattataaattttagtatgttggcaaagctccaggtacccatgtggattacagctctgggcatatatactaacttatgaattaagtagataagctgtgttcttttttttttttttttttagatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaagtgagagcatagtattcaggagtgttttttagtttgtttgcgttagtgagttccagatgtttgtttacttatattctgccacattgaaaatgattttttataaacctatttacagaagttactctgaattgtactcataaggaatgataatccctaatggagaagaacagttagacagataagataaagtgtaattttacttccaaatcatgtgtatttagaatatttctacatttatccagtggagttttttctaaagctattataagtattttattttggattattcatttacttttgaaatgtgataatgtttaatgctaactcctttcgtgtatatttttaatgttccaagtaagtacatccaattaatgataatctgtgatttttatgtaacctaagtacaactgagacagcagagttctaatgctgttcagtatttgtttaacatttcctgatggtttggaaaagatttgtttttacagtttgccatacttcattatgttgcaattggatttgaaatttcaaaactattaaaattaggtttcgtatgtttatacttgtaaataatggaatgccttcgtgtctgccttatcagctcagtgtttgaacttagttcagtagtgtttattttgtaatagcaaataaactcattctgtgtatttacctttgttactaaaaggtttcatcagccttttcttttttcaaacttgtttacataagtacatgaataggtagaataaaattgataacagttttgaattaaaatgccataagtggtggctcacgcccataatcccagcactttgggaggctgaggtgggtggatcatctgaggtcaggagttcgagaccagcctggccaacatggtgaaaccccgtctgtactaaaaatacaaaattagccaggtgtggtggtgcgcacctgtaatcccagctactcaggaggctgaggcaggagaatcacttgaacctgggaggcagaggttgcagtgagccgagattgcgccactgtattccagtctgggtgatacagtgagactctgtctcagaaaaaaaatgctatagttatacataaatacttctatctgatt

SEQ ID NO: 108592 - DNA, 2200 bp, Homo sapiens
agtctggctactcagttcaggccttaaattaaccattagacccaactacctttaaaaagatccctcttaagcagatagatgtttgagaactacttggcctagtctgttaactctgaattaaaatacctactcttcagtttctattccttctcactgccaaaacttcatttcataacttactccaggaaagtcttctgtgacttacacatggctctgttcctttctctgctgggcatatatgtatctaggttgtatagtatttgcttgttaatatggtctgttaatttatttgttttgttacaattctttttaccaaaacaaaacagcaaatttcccaatgtcaggggcctcgccttcttttttctatctacttactttttctagttataaacagctaattatacagttaaatactcagtatagcaacggttaactgagtggcaggagaaataacaggccaaccattctggtaccttaaaggacattagggtgatagattctgctacagcatttcaatggaatggggatgagataatactgtagtagtaagaagtattgtccaatgttgagtaaaagacctgaaaactaggaaggaactacatttctaattggcgggtagttattaagctttcaatttgctggtaaagatagtaaaattaaggaaatcgaagataagagtagcatgatcatatgaaaataatgtagaactctttatcattgtgtcttaatctttcaggaaagaatctgaacagattttttaatcattactagtaaatctattatcagtcttcaacaatttatgctatgtcatgaaaaaacaatgttttgtgtgtgtgtgtgtgtgtgtgtgtgtgtgtgtgtgtgtgtgtgtgtgttttctttttcttttttttttttttggagacagagtttcgctctgtctccaggctggagtgcagtggcgcaatcttggctcactgcaatctccgccttccaaattcaagcgattctcctacctcagcctcctgagtagctgtgattacaggcatgcaccaccatgcccagctaatttctttatttttattagcaacgaggttttaccaggttggccaggctggtcttgaacttctgacctcaaggaatctgcctgcctcagtgtccaaagtgctgaaattacaggcatgagccaccatgcctggccacaaatttttaataagtaaggaaaactcaccagagaagcacaacataatacaaatgtactggatttagactctaactttatatacaaagtaaataaagtaccagactttgaaagatatttctgatagaattttttttctctctttcagggtgatcttggaaaaagaagggcctcgttccttgtttagaggactaggccccaatttagtgggggtagccccttccaggtaaaaaaaaaaaaaaattgtttaaagcaagttatggcaatctcttttgtttcagcacacctggatttaatcatttatagatacagttaaatttataaatgtagtattcaatgtttatgggaagttaaaatacttaattttctttttaagaatttcagattctagccagaacaaatttatataataaagtaatgtttggtggtaggaaatgatactggatattttgaagacttaacagtatttcattgctgttagaaattaacagtagtaatatgaatacaaaggctatgtttcataatgtgagggagaaggtatagtatttgcattaaattattgatagtcttatactgggggaaaataataaagtatcgcatattatacctagaagtttaaggaacagtgtatttatagataagagttttaaatgttaaaattctataaatggacctgagatttttttgggggagatgttgtaatcaaagttgaaaataatgaatatattatatatctttatattgcatagactaggagatataaaattactaatatttgcaggataaatggaaatactctcgtagctagtggcagtgtattgagtcttctggggagatgcttatcctctcatctgaccataggagttagaagaatttgggggtgcagaattgaaaatctacacagggctaaggctgcaaaatactcctgatattttgagataagtgtttgctagatttgtgagtttaactaaaccagctcttgcatcttgaaaaattttgactctaagaaaggtaagcatt

SEQ ID NO: 108593 - DNA, 1033 bp, Homo sapiens
aacctcttccatgatagaacactgtataaagttcatatttagagtgaaaatgctttctgtatccaaaccatgtaccagatccatgtcttgttatttattacgtttcaactttttatgggttcttttctctctttaagaaaatatccaaaattgcatcctaattataaaacaagttaaaagaaaaaaaacaccattaatagacagttcatgtatattcttccagtaatttttctcggttatcatatacataaaaacatgtatactttattgtgctttacataaactgaataatactaaatgtttaacctaatctaactgaagtttttccatgataatatgtggggtgatttttttaaaattgtatagcattctagcactaataaacatttccttattatacatttagattatttttagattttcattgtataaacaatggttcagtaaacatacctcaacctttatctttgaatactttaggaagtatatttttttaggatggtcacctaaaattagaatttctggataaaagggcatatgcatatttaagactagtgaatattgaccgggcagagtggctcacacctgtaatcccagcactttgggaggccaaggcgggtggatcacaaggtcaggagatcgagaccatcctggctaacacagtgaaaccccatctctactaaaaatataaaaaaattagccgggtgtggtggcggtcgcctgtagtcccagctgctcaggaggctgaggcaggagaatggcgtgaacccgggaggcggagcttgcagtgagccaatatagggccactgcactccggcctgggcaaaagagcgaggctccgtctcaaaaaaaaaaaaaaaaaaaaaaaaaaaaaaggcatactggatttttatcccttatccatagccttaccaatgctggctactgtccatcttttttaaatacttaccaaatggactaagagggatttttcactgttttaatatgatttatttaatttttggtgcagtcatactttcttgtaatttgtcat

SEQ ID NO: 108594 - DNA, 7557 bp, Homo sapiens
tcttaaatactttttgtttaaattagttattattttgtttttatttttttttaatttcattttttctttttatcttcttggttaccaagttttagtgagttaagtggctgtcagagtattggaagggggtctgtttgaggatgaatggtaggaattttacatttgatgttgtcttattttaatgagtcaatacagaaagtacttcagagtatttatgaaaagtgtaaatctaatgttacatgagaatgtggctaggactttatggtttttaaatttctccattctaaaattatgaagatcaatttatatgtaaatcttacgcattaagaacatgcttattgataaatctaaatctctattttagagcaatatactttgctgcttattcaaactgcaaggaaaagttgaatgatgtatttgatcctgattctacccaagtacatatgatttcagctgcaatggcaggtatgaatgtataatattaaaaaaaaaaaaaactttctgaaacctagaggcttaatattgaattataagtttgtagtgaaaagttgatgattaatgtgcttttcattgattagatgatttttacgtttatcgatataaaccaaattaggtatatgtaaaatctgtcatcagttgacatttttgtagtcaggagtttacatgctagggtacaagtaatatatttatattgccttgtgtagtccactgaatgtttagtgatcattgttaacagttttaagaatccaaccataattacactataaataagttatggagctgtaatttactcttctctcctcaatttctgttagtgccttttccctttttgctgcatgttttggcttctgtctgaaatgtgtcggcaattcttggtaaagtattcattttgtcctgtgctcaaatgctgaaatttttgtgagtgatgtattattattgacaattcagttactatgtgtattttttaaaattgtttattattctacataattcacactagacagcacctgaaatttagacactggctatgtgtacatgcttactatagaaatgtttccaggaactctctgtttctgtcatcactgataagtatatatgattctgaattaaaataactagttttaggtctttaccctgccataaagataaacagttggtttgaccaatctggttctggaatcatttgctgctatgcatgttagacaaagccacgaactttgattttccattgaaaattctccctaatatctgagatttattgtatatttactcatatctcacattttcaaattatgctgtaactttataaactgtagctgctttcatcagctattgatcaataaattgaatgtcaattatgtgcttaataatgagtgccttaaactgttaaacacttttggtttagaaataaagtgaatcaatttgacctatatacttcatgaagtaagtaagtttgaaatacaaatttctgaaaggtcaatagcccttatcgtattacaaattgtttttaaggctttttgtatttattaattgtcagttgattcactgaagctttaaaactggaagggacaatccaaaggtcaaaagagtgaaatacaatcatttaccaataaggaaaccttgggcaaattatgtaatttatgtgaacctctcttagcttacccatggaatgagtcaagtggtctacatagatttggattttgagaattagttctttcatttagtgttatagagattatcttgttacaactagaattatttttaatgtaatttttacagatgttgaatattagtagataggatttttcccctacgaatttggatgtaaggtaaaggttggtggccagtgacaaaccttataaccactttatcaggttctttaaaaatatatttctgaattaccagtgattatgtttttggcttataacctcagataattataaagaaatgttaatcttatttgaaagaattggaatctagaaagttagatgagcagtcattttatattgatatttgttatatcagtatagcaaatgcagaggttcagaatatctttatttccactggaacatcttatttcattggagtatctcatcagaatttattactgtatttgtatcacattgcaaagaatttcagtagaattgtcagtttgcacttttttctcaaatgtgtacaaatgttaacatatagttcatttttatctgtacattgatgccatttcccaacttgaattcctcaagttttggtaaacttacaatctcatacttgttcagaggttattgcactgtacacttactgtgtagaaaatactgtttgaatttgtttgcagttacattgttctgagaactgtgctctcagagcttctgtgcactattcatgagcattaacacttagctttgcagttttatacataactatatggttagtaaaactgaatggtccaatgcagactcattaaagtaggcttttgccccctttgttcttgaaataatctagaccagattactcggggttttttttaggattatttttataggtctaaatatgaatgatttgggggtatgaagtacttaaagatagttctgtgaaaaatcattttcagctgtctattcaagggaaaaaatgctaaccttgtcactttactacacaaaaccacactaaaataaaccattaatgatactgcctgcaagattttaacacaccagatagcacacacattaaggatttataaggcactgtacgtaatttttattccaagtgacctctcaattcattttcattttgcattttatccatatgaactcatgtttaatttagataataaaaatttattttattaaaaggacagtttatttaaagtgggtctttttatttgttgtagtgcatactataagaatttgtaagcctctaaagttgagctataaattttcatgcattaaaaatttgtttcagttgtgaggatatttaatcagattaaataatgttgactcttaatattttgcctgccttttttttctcctacacatgacctttgacagactaagtatatctcagctattgagggtatctgttttgttgcctgtatattttgtttaaattaacttgtatattcctttgtatacacctaggcacagatgtatgcaaaaaaaatttgttaaattacttctttctttatactaattctcaatttttaaaagattttatctggcatgtatatacttttatatagaacattataaatgtaaaggaaatgaattctaattttaattggattatgtattcatacagttattctcaatttttaaaatactaataatgtaatcattgaatgtttcctacatacgtagtgggttttatttgctcacagcatacagttatttttcaatttatgtttttctattagacttaaatttcattataataaaggcttttactcattaaatacaggtattgtcttgcatttatgaaatattttttaaaaatattttatttgtccatggcagttaattcagccagatggatggttggacagatgttttgtgtgtttgtgtgtaaacattcttcctgttttttgttttgtagaacacaagaaattaaatacaaaataatgcaaaatatttcataagtatggatgtgcaatattactggccatagtgcaaaaggtgaaaggtactattgtagcaacgtattctttattttattaaaaatttatataaatagctccaaaatgaagttacttgaatattctgttggtttttttttttttaagatttattaagtaggctgattgttaaaggatagaaattgtgttttcatctccttaattataatagataatagtggtaggaaaatgggagatgatgatcccctctaaatattcccttttgacaaggttagcattttttctttaaggcagaattgatcttcttttaggtaagtatttagattctgaaactgctgcagatggcaggattttcagtactcggtacatttttttaaatggcccattttgatattcctttcttttttttaacttaaaattttcaaaaaagttagatctcacagtaaatatttctcaaatccttccaataggattcaatttgtacacatgtttctgatgaggtcactgcttgttgttatgatacagaaaagcctgtgtctattttaggcatttactgtacatttctcccgagaaaagagtgagatcgtgtcatctcatgctccccatccgcaggtcacttcctgtagaaatatggactaacttaaacctcgtgagtactgatctgagcatctcttgcagcctgtagtataagaaacccaccctgggattttatgatagctgtggaattagaaggcgggaaattaacttttatttcctgaatttgtgtgtgcattgctaagtctgattcctttataatattccttctagaaggaagaatgaggtatttttcagtcatcatgtaataaaagcctggggtcttcagcttggccataacagccttgacctccaaagaatgtaataacaatatatatatagctgtaaatggtattatactatcttaaaagttttagataaaatcatagttctctttgcttagcataacatatttaaaagcctaatacaatgctttccattcttttttgtctgttgatacttggctttcttagaactcttttgcaaaaaaaacaaaaattaattactttgcaaataaatgcaggataagaatatatgggatcttagctgttttagttttaattacttttaaaagtggtgttaatacatttaggaggttaggtgggctttgttcttacagaagttgaaataaaaagtactgaaaatgcaacactacaggtatcactcacttaatgaaatcaacattttcagcaagtttaagcagaatttttctgttaatctggtttttaattgctcgacactatcaaatggaatcttacttagataaagcaaaacttttaaagtagcatttttaaaaattttttaagctttctaacatactaaccatcctactaagagtatggccaatatattggcactttgctttaactgactgtggagcaatattagttcttcttaacttacaaatggatccctcatgtcgtcttaagttcattttcatgtttcactaggtgctcagaatcttaatataaattggcaaattatgaaaatgtcacaaaattaaaatgcaaaataaaaagtaataggcaatttctaaatttcaggggcaccattcccagtatctttgtgtgtgtttgtcatataagtagtgggaagatatgtttagcttgggctaacctcaaattgccttaccatatataatgctaagttacgataaatttttgtttttttccattggcttcatttcttagattattagattatatttattagatgtaattagcctagtaatgtctatttagtttgttaaagtgtctttggttaggagaaagtaatagcataaaactcaaggacctgagtttttagcggtaaagggctaatagctaaaactgtggattgtgtctagattctttacctaacccaatggtttgctggcatttaggttagtgtctttataaagagctagctctcattgggagagttgagccagagcaaccatagtaaacatagcttactgataatagcaattacgtagggataagataacattctctcacttacctaaattttaatgtgtcctgttacataggttaatttgtgcttggaaatgaattttagttaagtgagaaatacctgttgtttgctttctgacattatagtaatatgtacagagaataatttaaaattataatttatgggtctttaaaaggttttgttcctaacaacatttataaaaatttattgtactattgtaaagttttttatatatgggtttttttccagcctcaaattcttttgtgacttggaagagtattatggacagaagcttgggtactgcttaaaatttatgtttttagaagtagaacttttatttaaaaaaaaaaaaacttaggtgctcatcttcttttcaaataagtataataagatgaatgagaatttttacctagattggctgttttttaaaaagtttgatgtaaagattcccagttttaagcttttaaaattcaataaaaagcaaatagtttttcttaagatttctataaaatgattaataaaaatcattatagtgatgcagaatattttgttggtttatgctgcttagcagctttttactcataaacccttaattttgctgtacagacatatttagctattacaaatatttaagtttacaaaacaagaatcattaaattggagtttgaccagaatattgatgtctgattgctttaaaatataatttgaatatcctagccttttcatgtagaaaaatgaggttcaaaagaagagaaaaataatactctataactttattctcagttaagctagaaccatgcaagaaaatatttaaactggtctgatagtttcatgtttttcttttcttttcttttaccaagaatatatgcatgaaaagaaccttttatttaaaaagatgttcctggcagcctgctcaacactttaaattttatcagtttagtacctgctgatgcgtctaaaactgttggtcccattctagttttatacttacatatgtagtattaaaagcacttaagagaaatgtagaatatataatctttataaaagtattaaaggaattatttaaattgaatttgtatcccatttatcttgcttgctaaatagatttaattggagcatccatttgtataacgtctggctatttctacaatgttaaaacagtgggttgaggaagtaaaatttgagttactcagttactgacatagaaaagaaccctgtgagaccaaattcagctttggaaacaatttagtgtaattattttgcatatgtagatacacctttgaaagccaagaaaggtttatgattggatctgtactatattaatttaaaaacaaattattcttaagtatattgtagcatttctgttcctgtaagtactttactcatcttaaatgtactgatcattagccacctttataaaaagaatgtgcctgacccactagtatttgatagaaatattaaaacagttaagatccttaaacatttctgcatataattttttattgagtaaatgtaacttaacgtaagtagttctatgaagtctgtgtaaattaaaaccctgttttgtgtagatgaagcaatctttataagtttctgtcatcaagactgtattttgtgtgctatttttccatagctaggaaggtggcaagtaaaacatatgcactatcctagaaacatactgttccaggtagatcttaatttactacctggaatgagccatcttaggtgaccaccattctgcaccaatacctagtacataatactttagttttaaagtaaactagagctgtcttctaccctgagtttattccatgtctataaaagagggaacttccaatttgtgactttttgaacttttgagtttttgtatgtgtttaagtaaatga

SEQ ID NO: 108595 - DNA, 3772 bp, Homo sapiens
tttgacatttgtgtagaattcattttgaatgtagtgatttgggatgctaatcaaaccccaggtaactgttttttttagctggttttaaggatcccaagtgcatgctttttagccgtagaatacacaaaatgtctatgtgtttgtagagatggatttctgaattcagcttagacagtagagagcaccctaaaggatattctaagtaggttgggaaagcaatttatattcattttgcttttaaaagaatctgttagttaaggacagaatttgagaattcatatagattggaagtgaagacaaatgtttgtcgtatgtgaaaagtgtaatatatacataaattagtagtttatttatatacattttcttgaatgtagatttatctaatttttaaaaccttaaagttaatagtgaattcttcatttttaccagagttcattttaaacatgtttgtttaggttttactgcaatcacagcaaccaaccccatttggcttataaagactcggttacagcttgatgcaaggtatgttaattccttaaaataaaattggttaaagtggatttaactaattttttttctacaaagtttttctttcctttgctgctgaatttgtttgttgttgtagtttaattttgaaacttgggtctgccatcagaaaaaagataatgtaagagttgacaatatgaacttttccaggtgaaaaaagtatattattaatatgtgttgttttgttttgttttgttttaaaaagagtggctagaaagataccatagagaaacagaaaggaaagaaagagatagattaacccagcccaaaaggtaatactttccttacatgggtacttataattggcctcgcagaagctaagtaagccacaaggtcagctagtctagactgaatctttgaggatcattgctcaaatttagtgaccttgtgaatagagaaccctaggctgacagacagttctcatatatcgtctgttaccactgaccactttataatagcaagattcattcattcaacaaatctatattagcagatactgctacgtcttagagatgcaccaggaaacagtggggacttattttaaatggaataatcaaggaaaggttttttgaacccattttaagctgaggaaccaatcggtgcaaacctcagaggttctaaagtgtagggcctttggtgttctgggaactgagagtaggccaaaagcagtgctgcgtagggtcttgccatctcaactctcctactggctttagaatagagactcttaagtaacgagatggtcctatcttatatgttacaataataatgttaatggttttaaactattttagactttcagtctggagtaggttctgtgtataacatgtttctactgtttttatattttggtgtttgggaaatagtgttatgtcctataggctttaggtaaaactgatctaataaatcattaacaattatgcctgcttaaatatctgttttccatcttctgttatgttgaactatatactatttggaaacttgaaaagaaatatctaattgtttcatctgaaatagatcttttaatgaaatcttaagtgttgtagcaaaactccaagtttatttcttaaagccacatatctgaaaagtagtggtagctaagacttattccaaagattagaaagtacaagatgctagtccacattattctattgtaaactaccagagttaggtttcactatgtttagcgttgctctatgaggaatccaggaaaagcatgacttaaaactctttaatattatttttttccacttataattgtaacacaagctggcacaattcttaggcttgtggggttggggaattggataggggtggggtaataatgaaaggttgacttgaggattctggtttataaggctgagggctgagcgcagtggatcatgcctgtaatcccagagctttgagaggccagggcaggaggattgcttgaggccaggagtttaagaacagcctgggcaacattgcaagacttaatctctataaaaaatgcatgcctataatcctagctacctgggaggctgaggtgggaggattgcttgagcccaggagtttgaggctgcagtgagccatgattgcaccatggagactccatctgttaaaaaagaaaaaaaagaaaaagaaaaaaattaataaaaaaataaaaatagggctgatatgtcacctttcaggatttgtatctcttttaactttcttgtgaggaaggatctttaatgaaactagttacagttggtttgtggatcatttatctaataggtattcaatatctaaagacaatccattcataaaactggtggaatctgtaggtaattaagtgggtgttgtagttgtgattttattttatgtcagaaacaagttaggtataatttataaataggtaaattttctgtttttttagtaggtagcatttaaacctgtctcttatagataaggacctgttgggggaatcagtgtaaggtaacaaatattgttaaaactcaaaattacatgtgtaggagatgttgtattctataagagtaggtgctgcccccttaagtagaactaaggaaattgtattaggaagagtactgaataaatataacactacagtttctcatttactagtcaccagggagactgatatgaccattgcctttaaatgatcatagggaatttgacttacattcaccctatcacttcttgggagaatatgagtggggttgaaagagaatccctcaggtgcacagaattttagttaatcatactgcctggtttatgatattctatcatcattggtgtctcagtcattctatttatgttactaaatgcaaaggaaattcagcttacttagaactggaattaatacagtgtgaggatttttgtttactttgttttgtttttgtcttgagctgcagtcagggtgtatagttcctaaaggattttgttgcttatccctgccatgtgaaccccaatgaggacatgagaccgaagattcagtgtagtgcattttgcattcagtaaaataaactatttacatatcacccatttaatatgacaaatttgggacaaaagaataggaaatctaaaatatgaatattgttttaaaattctaattcttcatgagttaaagaaggccattcttttattattagaatgacatattttattatattttacttactttaaaaaacctatcagtaagatgtttctttttgcttttcaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatggtaagaagagttatctattaaatcagaaatattttcccaccccagccaacagctcacttattaaagcatttataattttactgcattctggtataacaaaatacaattattgggagttcataatgagattaaatctggttaagtaatgtaggctgtattaataggtcagtattatgctatcaaatagcatggtggtgattgagcatgagctctgaagtcagtcaaattccagccttac

SEQ ID NO: 108596 - DNA, 4257 bp, Homo sapiens
tttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctttttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgagagagtaggagagaataccatgttaagattaaaaaaaaaaacaaaaacattggtcacgtattaggcagaaacagtgttcataacatttttctgggttttaaatatgttgtttcggatatccttaatataaatgttttaggtattctgtgtaccctgtcgtacccccaacattatagaatattgcagcgtgtcattgcaagctttctctgctgtcaccagtgaaacatagtgccctgttaaattcccccactttaacttccttgtgatcaacagtaactggatgtttttgaggtgctcaattggaataaaaatattccaatctatttggagaccaaaggcaaaatcagttttcttacctttggaattattcgtaccttttatggtaaatttcagctttgacatgtattatgaggaacgtaccaaaaaccggtttgtaacaaatctgtagagaaggtctgaatctatcgtgtttgccttttcaggtgccatttctactgcctaatacagtgccatttgccttgtgaagacccataaacattcattgtgttgaatgtaagatagagactctccctagtcttactgatctcagtaccccacaaatgattaagaatgatatgaaaaccagcagctaaggaacatcttattatttagttgtagcatattcataacaagtgtccttcaaggataaacatatattctctatttgtatttagcaagtaaaacttgtgttgacctttagtgcattatattcagcttttaacagtattatgtatgtactggaaagcaaagaaatcttagagtcttggacattgtttatttgtgcaacaactagaaaggagcaatgaagtttatttcagttgtatttttccctaagcacaatctgcaatagtttatgtatgacagagataattcaaaaaggaaaactatatataaaagttgtatataaagtttgtctctgaaatatttctttgaagtttttaaaaaatcgactcatgtttaaaaacaaaaacacatattcagagcattggacttttttaacttgttttcatctgtttatcatgacttttttatttctggtgtagagtccacattatttagtttgttgtacttttaaatttcaaagttcaaatctgaagaattagcgtttgtgatttcgggataccatgcagtggttttaatcccaggaaaaaaactatcaccaaaagttcgtttgattctcattatgtaactttgtagaaccatcctttctagatgggtccaccacagtgaatttgtaactttgaagtcaggatagaatatcattagattatctgtgagatagcattactatgttaggaccagcagagtttgggttggtaaaaataatgtttgctctattactgggttacagacatttcagcatttttaggttggttttaaatcactaaaaatatttattcggatttgaaggatttaagtgctaaaaatcaatccatttcttgcccttcaataattgtccatgcctgccttttgttgtttacatgctcttctgcccagactgttagtaatctagggaccccctttggagctgataagtacagttcagccttttctcctcaaatatataatgactttaacattcctaagaatataggtatttctgaatgatttaaatttgaggaattttaatacataaaatacaatgtacaaactttctgcccactcagatctcttctccatcatgtacttagtatttcccattaacctacacactgatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctcatgaaaatatggctttttctgtaatatatcaacattttattgagaacataatcacacttttttggattatcctatgtgtggaacaaaaatccattgccattttcaggttaagttttaggctcgcttgattcagtcagcaaaccttatcttgagcactttgtatctgttagatctagtgatgtctgaaggaacccaaaggtcaagtaatccaactccctcatagtgtacaaagaaatcttgcatatcttccacaggtttattgacttttatccaacacttttcatgttttaatttcagcctttgtgaaagttgatattaaaaatacagaggtgagaacttgttagaataaccaaatgaatccacataatgttagatcaaaatacaaatgacaaagataaaatgctatgtagtgcctaccctctttacattttgtctattttatttaagtttttctgtattgtagttaacatcaaacattgtccagtcttgaggaaaccaggacgaaatatattttgtatttcaacattgacataaatctgaaattgttggttctactaatagtactctgcactgaaggcactggcaaaataatggttaaaattgagcacaggtgttccaagttgtgtgtgtgtgtttattactgaacattgggagccgtgatagggaagtaatttgtgagt

SEQ ID NO: 108597 - DNA, 1801 bp, Homo sapiens
acatgcctaggtggcagatgcagcttatggttcaagtgggttcttggcataagtgttcctctctttggggacccagacctctaagtttgcagagcccagagttgcaagaagatgaaactcaccagctagaggtgataggtggaatcacccctttggatgcatgcattcctctttttggggatgcagatccacctaatagttttcagtttgtatacaacatcctggaggatagtgtcccatcttgattcagtgtcacctgtgaactggaacttcagctgtgccttcagcaggccattgcaagcctatgaggtcagaagcttttgggtggtaagtgtgatataaccagtagatcttgtgatcacaggcctgctcctatacctccttccctggaaagtgggccccctggtctgatgtgatgtgcaaatgggtcatattttctgtaagttctcagatggaggtgctgtcaggaaaggcaaacccatatgtaaaatatgtgtccatttctgtccaaacacatttctggcccttccttaatgcaaaaggacagatatagtcaacttcccacttcctggctgcctggtcccctcaaggaatggtgtcatgtctggggcttagcattggtctctgttgctggaaggttggccacttggtggcagcaatagctcgatcagcctctacgggtggaagcccatgctgctgggcccaggcagagccttcatctctgccactgtggtgactttgttattgtgccacttgtcagcactagagtaggcatttaagattttcagaagcatcaactcagatgactctgtcacatgtgccccattctttcccaatcagagctctggcctgggcatagcagacctactttggttgggaattcaatctttggagctggtctgctctgatgattagatcctaggcttggtccttagtctccttgccctcccactgcagagatgagcccttctttgtgtgctgctaaagaagcccccctggctttcacacttggctttcaatgacctgctaatcactcagccatttgttaatttttttctagagctgtgatagagcttatatctctatatactagtttcccctgatttttcaaatgcttgatatgttctaccacttagtgcatttgcctttgcagtttcagctataaaatagaaaccttgcgctagatgtctatctctacttggaccatatctcactccctttacctttttactccctcttgcctggaatgctgtcatcatgcttgaggccaagcaacctgtgacaaggtagtcacaagcacacaggacatgactaagcagcaagacaaagaaatcatcccagatagcaatgtggagcaacggtaccactctagacaaccaacctttgatcttaccattatacaacaaaaatgaaaccagctgaagccactagattttttatttctgtttcaaaaaaatgtaactcatcttaactgtgttgattatcaaaatattatactaagcattttttaaatttagatgaaattaacaagttcatgagaatcacttgccaaattaattagtactggcttatgaagagaaatttaatctgtggtttaaaattttctcatagcacacccagaaatcctagattttaaccatcaagtttcatcaaccacttatggaacagatcattgcaaatgtacgtatatttttccagaaaacagaaaataatggtacactctttaatcattttttgattattatatcttgattgcaaaagcaggaacaagaaggcagtatgaaaaattgcaggccaatct

SEQ ID NO: 108598 - DNA, 1024 bp, Homo sapiens
acctggccctgttttctcttccttcctcccctgtctttcctatcagacaattgatttaagtttcccaaataagtaaggctgttaagcctccaagcacttttccatgctgcactccacctaaagtgtcctcacttaccttctccactcatctggtgaacaagcatcccatctcccagaaagccttctctgcccctgctcctcatcttcccccaccctcaggcctgtgctgggttctgctgatctcatggtagcttgggtattcgctcccttccactctgggctcttgaagagtagggccctgcctccctggtaccaggcccagagccgggcacataaaccactgtcagtgaaactgtgctgactgaatgatgggacattgatacttctgcagcaaagcatatgcgtagtcatagcaagggagtaaatcgaggccataaagagccttatggcagttcaggtggggctttgttgccaaagaagttattttaaaaactcagttttcagagcttttgacctttagaattttagataagggattgtggttgcttgaaatatccagcattattgtaaggcttttttaagttagactttttattttgtgaaaaacatttaaacccacaaaaagcttctagtgtattgcacttaatttccatatatccttcatttcttccatttttatttatttattatttgacacataataattgtacatgtttgtggagtacagagtaatattttgatacatgtatgcaatatgtaatgatcaattcagggtaattagcatatccatcacctcaaacacttatcattgtgttaggaacactaaaatcctctcttcaagctgtttgaaaacatgctataaatattgttcactgtaatccccctacagcactgtagaacattataacttattcctcctaactagctgtacttttggatccattagggaacctcttcctctccacccaccccgctacccttcccagcctctagtaaccagtattctacactctacttctatgag

SEQ ID NO: 108599 - DNA, 1051 bp, Homo sapiens
gcctcaagttccgcaaagctaaagtcaaaccataatttgggaggtgagaataaattggtcaatttttggtagaagaaatatagatttttcacattgattcctctcatgccattgctcttaggaactcccataataaattccttcttgcggctgaataccagccgtgtgtgttctgtgggaccatgtgcctaaagggagtccctgcttatccagcttgcattttgggctgagtggttgttagcagaagagtgacacagaggcatttcatctttactcttatgatactagcaaaacatcgttagattataaattcatattatccagggattcgttaccccagcccaagttaattggcatggcaagtgtcttatgagaaaaatctgcagcgttagctaagtgtttctatatgaaacagagacagttgtgtagatggttagatgtccttactctttgttacttctcttagagactgagaattcaattgttgaggtgctcagggtgcaactgtttcagcatcagtaatttccagtgtcttctgcttcttcatctggcaaatggagacaataatacccatcccctagagttgttcctgagatccagaaggagcatgaaagagaaggcactctcgttgtgatgattttgctctcattctggaagctgcagaggagacgtctgcatttcagagagatgcgctgtgccagcgattctcagcaagaacaggactgtgcacgagggggcgctcgggaggcttgagcggtgctttccgccttcaggctgataggagaggaggacacttggtgggtgtggatgggggttgctggcagccctgcaaagtgtgggacaactccatacaacacagctgtcatgaacctcacatgaattcttagtattctaccagaaactgacgtagtgaaccacctgctcataactacttgatcctagaactctgttttataaataaacagaagtatttttgggtggtttcaatatacagtgtttcctagaaatgcatctactgtgtaaatcaaggcaaaattcgtttgattgaaac

SEQ ID NO: 108600 - DNA, 1065 bp, Homo sapiens
tttccatctctcattgtgtcctgtgtacagcacatctgtccctgcacacaggccaagcagaggctgcttgatgggtcaggcatgtcaatgcaggatcctgacattcagaaactgccccctaccctttgtttgaaaggaacagtctctcagttgagaaaaggcctcgatcagatgctgtggcccttctttgaaggaggttttcatattaacatagtcataattcggttcatggaagtctggcttgcagaaaggtggctttgaaatgcaggtgacagcatttgaaatcaggcttaatcaggacaagcatcaccgtgggccacagcatggtcttgtgggaagagcagggttcaggggtcttccagcactggcttggcttcagtcctgacttggtttctaattagctgtgaccctgaacaagtcatttcatgcccaagccttcattttctcatctgaaaaacaaacttactttgctacgaggtgtcaggatcatggattaatatatagaaagtgactgatctagtgcctagaacgtagctactgaaaaagcggtaggtttaaaaatggctaattatgactattactgctctcataaattggtaaaattacagttattaaatatagaaataattatggttattaaattttggtccacactgtgaaactgaaggatttcacacgagggaatctgtggtggtttggatggtcttggactcgtttctctctaagatacatgatggaaatgccacctgaggttcacaggccattgtgagtttgttgcaaatgagctgggagtgtttagccttccctgtgagcggtttccggctgcatgtcttattcaagtgtttctctaaaaggccgcagctccccgtggtgacttgcctggtggacatgcattcacaaggatacccaaatgagcagcaccttcaccagctgtgtgcaggcagacattcagcagggatgagctgccgaggtggcggccctgagggccggcgtccacctctgcgaaaatagtgacttggtctagttgtgggctggccattattggacctttgggaaaaagggaag

SEQ ID NO: 108601 - DNA, 1035 bp, Homo sapiens
gacatatgtcccccgccttgtccatcatgctgcagcctctccacattcttggctggaccctgggaagggcagcaccagggcagggctctgcttgggtaagctctggcttccccttttgtcacctggggtggtggagctcaagctggcctgggcccttgtcaccaccatgctgcgcaagccacccaggagagaagtggtgaattgtgggcttgtatttcctttttggctgacacaggcaacctcccttggatatttaaggtgttctgccacagtggactgttcagatatgtgaaagttaaaaaagcatactcaacctgaactgagttgtacccagagtctggtgtgggattataaaaggcaggaggcggacaggtcctggaaagagcacttgtctgggagccaggaaacctggcccagtgggctccagcttgcccacttgctctgtgacctcggggaagtcagctcctctctttgtgcctcagtttctccactgcaaggaggggattggataagatgacctcaagtggtctccatcattctgcagtctctgagatggagggactgggcatctggattttttggatgacaaacactttacactgtggtgctacatcagctccacatctgccctatccaatgtgggagccactagccctaaccatatgtggtcgtttaattaaaatcaaataaagttaaatgttcagttacttggttgtgctagccgcatccaaatgctccacagacacggctcgtggctgccctattggatgagcccatgtaaaccattccgaccgcggctcaaagttctactggatggggctgctttagagccactggagagggctgaggagccccagagagagagcacaggcctctgtttctgccatgggacttcttctgggccagtggtcagcagagtggctccagggcccagggagtgagttcaagtgggggtgggggtaggagaaagatttagcccagataccagccaatgagtgtcaggctgcaggaccagaaaaccttaggcgaatgtca

SEQ ID NO: 108602 - DNA, 1055 bp, Homo sapiens
ggagtgtaccgttcctccaggtatagactgtcacagcttcccttggctagaaaagggaaatcctccaacccttgtgcttctctggtgaggcgacgccccgtcctgcttccgcttgccctccatgggctgcacgcactgtccaaccagtccaaatgagatgaaccaggtacctcagttggaaatgcagaaatcacccatcttctgcatcagtcttgctgggagctgcagaccagagctgttcctatttggccatcttggaagccagacctaaatcctctctctctttttgtttttaactgaacttctgatatacagaattggattaaacataatccttagttgtaatacactgtcatctttggtcccatgcatagccctctttaattctaatttccttatttatgtatttacccctttataatttaatgcatacccatgaatctaccaccctacccagtgcctagaacattgataatcaagcacctctgtgccccttgtgttgtctccgccaatctgcacccttgctgaaaggcaaccactctcagaattttgtgcttattattcctttgctcttttccttatagattttttgtacacagatgtgtgcctcaataatgccttgtttcattttagttgttctgcaacttcctaaattacttactcctatgccagtaccactcaatgtcattgctacagtgttaagtaacctgatatctggtagacaagtcctgctgtccccaaattcctcattcctttttagaaggagatgccacggggaattggggacccattcctgaggacttcaccctgccctggatgaaattagcaccaactgtctctgcaagcacccttctgcttcccctgcctggtctctgatattggatgtgtttctttcagtacccataggggcagctgggttgttccagtgctgcagtgacagggaacactgcagaggttgggaagatccgtggagcagggtgcatgccaacccagaggcacccccacctgacactctccccatgtgacaagggctgtcccatccaaggccagcatgt

SEQ ID NO: 108603 - DNA, 1003 bp, Homo sapiens
tcgggagttcgagactagcctgaccaacataaaaaccccgtctctactaaaaatacaaaattagccaggcgtggtggtgcatacctgtaatcccagctactcaggaggctgagacaggagaatcgcttgcacctgggaggcagaggttgcagtgagctgagattgcgccattgcactccagcttgggcaataagagcaaaaccctgtcaaaaaaaaaaaaaaaaaaaaaaccctcgtggtccctggagagaggtgaagatgcacgggacagcctgaaagccagtgtatgaatctgccccatcccttctcctggctttcattaagtcttggattaaattaattgcttatctcagagaaaggatgtgtagggggaacttctctgttagggattggctcctggccagcccatcctcactgatgccttgggaggctgcgtttgggcaccaggaacagcgtgggccacctggcctttggagcacagcactccgagtgtttgtggaactgcagtatctgtaactcttttttctattgatcagcttgaatagttagctcaatattacttcactattgattagataagtagcccaaggacatactggggctcagtagggtctctctgtccagaaattcccgtgggcttctccttggccctccctacaccgctctgtgatgagtcgctgtcagatgccccactgtgcaggagcatcttcagggatgggtggaaggaaccacctctgtggccccaggtccctgcctggtcccccctgtctaccacataggggtactcagtgtttgtgaggaaaaaaaatggatgccccggtgaattagtctgagttcacaaccaatgttttctacactttgctacactgttcaaaatgttacccttaaattcaacagttttttttttttaatgtgtcatatcaccagagacaaactcatttttgtgtgtgtttggagcagtgagtgcaatctacggatcagtctctgatggtgggtcgttaac

SEQ ID NO: 108604 - DNA, 1051 bp, Homo sapiens
cgattcaaaaatcagattgcttaaataagtatgtcttcctctggatacagaaagtatgtagtgaacctacatatatttattaagtgcttatgtgtgtttgacgtttttctacactgtggaagtggaggtagtaaggaaatacagaaaagattaagatactgttcacagtttctcaaaatatgttcatcttaaatggtgctaatgacttgctatatgctaattgtctttaataaaaataagtctatgttttcaagtctttaatgttttgtgtttggaaggtgaaacattctgaaattcctgatgtttgaattgtagaagggaacaggcaaggcatagatatttttggttattgtagttaaaatacatacaagtggaaaaataacttcaaattaaaggactcctttagtgcagcaaggaaagactgtcaggatgtgaagacttaggaatcatgagttatgtttccactttttgtgctcatttgtaatcattcacttccctccttggcccttgcattttcttaatgctgattttatgctcatttctccatgttctgaccaccattcccaaaatggtgttgtgacaggagcacgcaggctctagaatcataatttgaatgtcagcttccctgctaagtggctgtgtgtcctattccttcttctgtaaaatagagttaattattgctgttttgcaaggttgctgtgagaacggagatacgggaaaacccttggctcatggaagcatagccaacataaaccttttaagcaaaccagcgcagagttccgtcatagtgcaccatcatcagaaaccagggctcctggtgttccagaagttgccagagtttatgttacttcagccacttggtggggaaagcttttgaaatagatcacgcatgcatttgtttttaatcagagtgcgttggccatgatggggttaatttatactgagcacatggcacccatatctggggtttccctcttggtcagggccccgattggccagagcagagtcgaaggaaatgctgaaggtgaactggagattcagattcccagtg

SEQ ID NO: 108605 - DNA, 1047 bp, Homo sapiens
tggtggagaaggcaagattattagaggggcatgcttaatcagcaagaagaccaataaagagcccattgccagccagacaaaagctgcctgaggccagaacctaggtagtagctgtgaggatgaaggagaaggggatggagaagcaccaggagaaagaatctgcaagacatggggagcagacagcatgtgcaggggcagggaatggagagagtgggacgatgcccagcctaggcgtgactgctgggtgggtgttggcggcctcccggagagcgagcccggaaggcagcacaggttggggagccggaagatagacggcgaagctgaatcccacagtactgagttcagcagaggttaggaactctggccaacctcacagaggggatttcatgtgtcagtgtcagtggtcgagaaataatgaaattggaactgaaaagtgattgagccggtacctgttactgtgggtgcaaaaggctgcgatacacgtgggatttggctcgctgaagctggaaactgtttggattcttgtggagcactctgacctctaactctctctatcatctctctaggaaaccgtatcacccaaaactggaagctttcattagtcacatgtcaaaaggatccggagcctctttcgaaagccccttgaactccttgcctctttacccaaatcacccattgtgtgagatgggagagctcacacagacaggtatgtgtgacccccatgcgctcaggggttcccccacccgctcttctgcttgcataccttccgagcagttctcctgggcggggtgctgtgcagctcagagggggtaagcaaggactggctctgcaaggagctcggtcaccagggcctctaaataaacatcagagttctcaaaactaaatagaacctttctccttcttacaaaaacaatacgtgttcatgaaaataatttaggaaagacaagtaaaaagaagaaaaagtttaagcaaccgtaattccaccacagaaatagacccttaagagtaacccttcttcctgtgcttatgcacacacacacatcttac

SEQ ID NO: 108606 - DNA, 1041 bp, Homo sapiens
tctgaagcaggaaagccaccacagacagtacataaaggaatatgtgtagctgggttcccaggccggacaaaacagatggtgaccagatttggcccctgggctgtagtttgctgacccctcatctaaaaaataggctatactacaattgcacttccagcactttgagaacgagttgaataccaagaattattcaatggttcctccagtaacttctgctagaaacacagaatttggtctgtatctgacactagaacaaaacttgagggtaaataaacattgaattagaatgaatcatagaaaactgattagaagaatacttgatgtttatgatgattgtggtacaagatagttttaagtatgttctaaatatttgtctgctgtagtctatttgctgtatatgctgaaatttttgtatgccatttagtatttttatagtttaggaaaatattttctaagaccagttttagatgactcttattcctgtagtaatattcaatttgctgtacctgcttggtggttagaaggaggctagaagatgaattcaggcactttcttccaataaaactaattatggctcattccctttgacaagctgtagaactggattcatttttaaaccattttcatcagtttcaaatggtaaattctgattgatttttaaatgcgtttttggaagaactttgctattagatagtttacagatctttataaggtgttttatatattagaagcaattataattacatctgtgatttctgaactaatggtgctaattcagagaaatggaaagtgaaagtgagattctctgttgtcatcggcattccaactttttctctttgtttttgtccagtgttgcatttgaatatgtctgtttctataaataaattttttaagaatacctatactatacaactaatggtttgtacctataagtcactcgagttattttcaagtgagagccagtattttatttttcccccttcattcaaatgtcatgcagagaaccagtattttaaaattttattttaactgctttactaa

SEQ ID NO: 108607 - DNA, 1669 bp, Homo sapiens
tacttgtgccatcgtatctgggatgatattaagcacaaagacacaatgtgtctgttttaactttgtctaaaaactcatagttctttacaaagcctataatttcacgacctctggaagttcctacccaagaaagttaagttcccaagagaaaagttttgacacatacatgagaacagcacgtaggcatagaaatcataccctgattttcccggcttctaagtcatcccctgagtcagcatctagtcttcgtatagctgacgtaccaggggagatctgttcttcagaaattctatgttaaaatgactgggagcggggaggcgtaagtctcattttaaaggcagtaaggaagcttgtcatttactggaaaacagtggcatattcctttgtaaatggacaactccctttggaaattaactatcacacactaaaatatctgttttataggccttatgttttactttttgttttactttaatatattaggttgtcttgaagtgaggctctgctgtagtcctgttcttctggctctaagatctgaatgttgtgaccactaatttggtaagtgtcatttgtccccaacagctacttaaatttaagtctcccaattctccttttttagtttgtggtaagattcaaagaaaaggggaaagggcacagagatttctgtacacaatgattacagctatattaaaaaggatattaggataggctaattgttataatagaaccccaaatctataatggctcaaacacaatagtttatttcttgctcatgtaacagtacaggtcagtggggcaactgtctttcatgcattcattcagagacacaggtagagaggggctttgccttctgcagcatgtggttttcaaggtcgcctaggggtgtctccactcctcagtgcagtaagaaaagagcatgaaaaagtgcacatgggagttttttatgggctctgcctagaagtggtgcgtgttacttctactcacattccattggctaaaactccatcacatgaccacagctaaccacagaggagtctgggaaatgtagtccttggtggagcagccacttagcagtgacagctctggaggggtttctgaagaagaggtagttctctctggcacagcacataaaagaaacttggagatactcaaggataaagttgcatagaaacagtgggagaagtaaacaattatccacatttaggttttcctgactgacactcttaggtaacatctggccatgagggcaagatgcaatggatgagatttctcaacacctctgtccattatgaccctaagcatcatgttgcccatggccagtgaaccatgaaggacattttccttatttccttttacttatttttcctctcaggatcctcttggtctaggactatactggctttctcttcttcctggatctagtcatattagttggaattgtgacagaattctgctcccccaactatgagccccagtggtctataggaaagctcttgacttccttagctcgtagttttctctgctactggaggctttggaaatgtatcctacaggatctgctccaggtcttgggacatttgatcagggtgaaaattcccgaaggttagacctttaaaccaagttattaaactgttttttcttttcttttctttctttctttttttttttt

SEQ ID NO: 108608 - DNA, 1034 bp, Homo sapiens
ctccctcctacctccaaaatagtattgttagaaaatgtaatgctgagactctgtcagaataagtaggtgatatatgcaaaatgatatgggcaacttagaaaagtgcatgtcaaggtaaactgctgataaaggccgggagtggtggctcacaccggaaatcccagcactttgggaggctgaggtgcgcagattgcttgaggccaggagttcaagaccagcccagccaaaatcgtgaagccctgcctctactaaaaatacaaaaattagctgggcttggtggcacatgcctgtaatcccagcttcttgggaggctgaggtatgagaattggttgaacccaggaggcggaggttgtggtgagccacgactgggccactgtactccagcctaggcaacagaggaaaaaaaaaaaaaagtgttgataaaaaataatcatcataattatggtcagtattggtgctttgacttttgatattgttattatcattattttaaagatttttttgtctttctaaattgactttcatctgggagccttagcatcacttctaactagccaaagcatgtttgattgtaggccagactccccatggagaggcttctgatcttattcacagggacatttaacctggggttcactgaaacctttgaggaatgatggatgagtcatctctctgccaaaagaagatgattcctggcattctatggggctcccagtgcattgggataaggaggcttggaaactcctccacggaggcattgaccttgggtagtgccttccaagccagagtggagagagtggacccctcatctttgtccaaaagagcattagtataacccctcaccccaaccccaccccattctctcctttttaaaaagagagaagaatatatacaagaaaaaaattggaaaaaatacatcaaaatgttaaaaattgttgagatggtattttatgtggtgttttgcccccatttaacattatgttgtaaacattttaccaaatcactagatggtctttgaaaacatgatttttaat

SEQ ID NO: 108609 - DNA, 1046 bp, Homo sapiens
tatcagttttttgttgttggacattttgattcactttagtgttctactatttttaaagtttctaatgcatattggtgaattggcccctagaaaggtacgaatgtctatttcaaaaccttggtcttttttagtttctcacattaaaatgcatgctgctaggccccagtggtattggaagctctgaggaggagcctggggatatgcattttaacctgccctcccaattcttctgcattaatgcctgagaactattgacatgctgcattcagttcaacaaatattcagttggcaaacatttattagacaaaaaaaattaggaaactctgagctagtatgtctatgccagaatttaacttaaagtctttttttggcttctgatttttagattttcctttaactgtaatatgatgtagtaaaaagattattagctagggaatcaagaaaccatattgtacacatgaaatcactgaggcccataatggttcatttacttcctggtggtcactcagagatttaatggcaaaggttgaactagacaaagggcccagagtcacccaacctttaggtaagagacaaaaggcgccaatgagaagattcactcctgaggcaacgccctgcctcagccaaggagctcttacctgccctcagataggcatgcccgtacttcaagacactcttgggcagcctagacctagcaaggggcccacgtgcccatcttggtcacctaatggggccagactgtggtgtgccctgatccctgaggtggtagcactgaagaagctggacccaggaggacagagggcagccgtgcaggcagcatccatgtgatcagcatcacaagagcagagtaggaggtgggatctggggtcagaaaccaagacagcggagcagggtcagggcaagtgccagactaaaatatgtgggcaaatttgaggtcaaggcagggatgagttgaaaggaagacaagcaagagctagaggggaactgctgaggatttggcctcaaggatggagtcccactgtgtgacctcacagtcaggggaggta

SEQ ID NO: 108610 - DNA, 1404 bp, Homo sapiens
tctccattatctcaaggttatccctgttcaggatcactactctcctgattcttggcctcctagtccaaactcatggctccagggtcatgatgagtaagagttctggaaaagtctacaacctcccttgaaccagaggtaccttgaatcagatggagggtgactttccaagaatgcctgggccggttcaagtcttcactataatgtttgccttatgtaaaacccatcaccttgttgtcctgcacaactttcttgagtgaagcacctctgatactcagatgacattctaattgctcacgagacctggacccctgggccaggaaagcccatgtggtggtgacagcagtgcttccaaatctcacccacaggagacaaaaataggagttccatggcatccagacaaggtgtccacatgctgctggagagtcttgggtggtcacagagtacaaagttcaagggcaaagattgttcagtgggtcccaagatttgacaagtgctactggtggtcccacccttgcctctctacattgattccatgtcccacttcctctcacactatgctgataacgatctaacctgagaaattaaaagtattcacacagcctctggccaaagctacaggaagaccctggcccaggcaaactctgttcctgccccacagctgtcatttcacctgccctaccccatgggagcatgtaccactggtatcaagtcttcctgctgggccaagaggcactgcctcaaagaggcccagcatccccagatagcaatgtcccaccactgcagtcaggagcaactgggcaaacccaaagactcagcccccccatccagaaagaccatcccattttccatcgcctaagtgccagacagcccaaactgctgtgtagacagctaccaggaaaactggagcaatgagagacatctgaggtcaccccagctaagctcagaaggccacagagcttaactgccttcttgactgtggcccatcaaaaggagcccgacacatctagtagatggcttaaataaaaaatactgaggttaccaaatgctggcaaacatgtggggacactggatctctcctacattgcctgtaggaatgtaaaatggtacagccactctaggaaactgtttggcagtttcttataaaagttaaacatatacttaccacgtgatccagcaatcctactcatgggtatttacacaagagaaatgaaaacttatgttcacgcaataaactttacatgaacatttatagcagctttatttgtaatacctaaaaactggaaaatagccaaatgtttttcagcaagttagtgggtaacacactggtacatccacaccttgaaatactattcagcaataaaaaggcatgtgctctttacatacaattcaaatggatcacaaggg

SEQ ID NO: 108611 - DNA, 1031 bp, Homo sapiens
tcagcctccagcttccaactgtgccttagttattagagggactcaactcaagagaccatgatgagagggacagcggtgctcatttctcgggcctggctgtgagttggcaaccaggatcgtgtgctagaaaggtgacaattttaatcgctgactttccgtagtcgttggtgaatctcgtagttttgcaccttttagtttcaaaaccatactgaacaacggaaaatgaaacctgcagcttatttttagccgttcatgctaaatcatgagatttttctttgcaaaccaaagaggataaaggctacttcagcaggctaaacttagtcaattgacttaatatagcaatcaagtctggttctctgacaagtctcaagtgacattgagaagtttcaggtgatattttggccaacattgactattttgcttaaaattatatttagttgagttttgtttttagttaaacaaatgtagtatgatattttcatctgagaggaattggaaaacatattataaaccctccattctgtcatttagtcattaattcaattaacctataactatttttaagtatctgacagcttagaattttttttaattgagtcagtgtgttgaattacaaagagcagaatgctagaaattaaggaatatggcttctatgctcattgatgaggcatttatgtaaatatgacacttactctctttgaacctaattttcttctccctcaaagaaatggtttagatggcattttctaaagcgtcttccttgtcctttaattctgtgaaacacgctctgccactgagggcctgaggaaatgttgaggtattctttgggggctgtggcagtgttgtcaggccactcttatttctgtctcctctttccctgttctaggagagacaggtttacacaaagcactgtggtctgcttgccagacaacttgtggctccccttggtaaacaagtgattaagtgcttgaaagattttcatagagattttcagcccccaagcccattccttaactcctgaagcaagtact

SEQ ID NO: 108612 - DNA, 1084 bp, Homo sapiens
ctggtagtggtagagaaaggactccggagtttgatgttggtgagtccaaaacatcctcagtgagcctctccatggtgttaggaaatgctctagtgccctggaagatacaaagatcttgcaggaagcaagccagagacgtgggcttaggtagataattcaatacaaccaaaatgcattgtgtttttttctttagtcgaaaggagttaaagactcactgaggtttgttaagcttctctgactgagaagaggtgcattgttgtggccctttctgagctgcaatgtcatgtatctgagagaagagaaagcaagtaaatttattcccaggtttaagtcttgaaatatttgttgcccagggtgtgaagaaagatataaagagaagattatgctctcacatgaggtggatttttatggatctgtaagaattcttacttttttaccttcatttatatccccaccttcccttttcagcctagttgccagtctctccaaaaagatgaaactctacttccttgctgaatgtgttttgccaattcagaatctagaaggccctgttgtttcacttgctctccatctggtgcgtgacaagcagtcatggcagaaaatgagcatgtgattgggtagtaggaatgggcactcaaggtcattactcatgccatgtttcaaatgcactgatgcactgagaaatgaaagcagcaactattcagttgctaaagccgaggtagtgatttccataatggtggtgacacctgttgaggatgctcccaccagaggatttgagttgggttaggatgggttgagatgttgtctaccacagtctgccttgcagcctatgtcatttgccacttttcctttgttaaaaaacacatggtttacagttcccttttccttccagctctttcctggagagtaaccccagtttggtccacaaggcttgctgcccaatctttgccaacaggtatgtactcctttctcatgtcctacacagatgctaatggatggacgtgaggatgctcatgtctaagaactggagaaggtttcctggagttcagaatcctcaagcatatcattcacccaacccttcatt

SEQ ID NO: 108613 - DNA, 1016 bp, Homo sapiens
ccccagaaaatattaattcatttttgcaagcgttaaaattaacaacagcatattcagtgatgcaataggcaattaaagacttttggagagataagaagaagaaaactataaatattatatattcaaaatcagtctcagcattttataaaaatgttggcttatgtccaggatctaagggtgggggtgggtatggtttctttgtagctatagagtggaaaagaatctgttctatttccttaaaaataaaagacttcttgttttatacagcatggcaaataaaatgcttttttgtttttttacctgccggcaggatctggaggaaattttgctagcaagctatgctgttttcctctttggggacctggtgacactggttttgcagcaaaaccgtatttgcttattaggcatttcttaaaaatcctgaataagcagctctttcaacagtttttgttccacatgttaaacatttcattgcaattcgagctttgagtgtgtgtgtgtgtgtgtgtgtgtgtgtgtgcgcgtgtgttgataggaaggaatgaaagggggtgcataagaattcttgaatgttttttatttaaaaaattaattcctcaccattacatattgaactatctgcagaaggtgattccaatttattacataccaccaaactagatcccatcaatcttgagcagtgggggtagggaggtggttttgaagatgacatgaaatttggtgtttgagtagatgagatttaattttcggaaaacatttcactcataaaacggatatcaacccagtgtcagcactgacctcctgatgtcaatgtcatcatgcaagcatagctaaaataagcctcaaagtaaaacaaagaaacattgcatctcagcacaacacgatttcttctcttacagtatgtactatctatagccttttggtattcctattaatggcttgttactttaaaatttagcttttggagggggagggagaagataaatcattttgcattttctgtgttctgaacgcat

SEQ ID NO: 108614 - DNA, 1081 bp, Homo sapiens
gcttggagtctttctctggttcaattattttggaacgtgattcatctcatactgattttgttctccaggcttgccatgaaatacccttcctgcaacaccttttttttttttttttttggctgttgggagccattttccttcttgcctgtgactttaaatgactaagtacattttgaatatagtatcaatcagaagattgtaaactgaagggaaatatcagaaacctgattcaatattgcctattttttttagtaccaacagcattaacagttgcaataggatcaagctaattgtcattcgctcttgagcaaataatgagccaggcatttataattaaaacactactgctagtcagaaagcttataactacaatgtcttctattttgataggccagtacaaagtaatcattttgcacctatttgaatcttaattacaagattagatggatgcaatgcaattgttttaccattaaaatgaatgcctgatagattcaacagtgtatttcttctttatagaatgtcgattcttttgtttgtgactcaagcatggttgcgtcatcttgtagattttcatacttaatggcgtttttttgtggcattattcacttatgttgctcttagtcttgcctaaaagaattttaaacccaattcaaggatctagaaagccaaataagattgttgggaagtgtatcgtaccatcgtcattctaataaataaaccagtgaatagaataataattactatatattacttcgttgtgtttcaccttaatactttgccttcatatttcacagcaatcttgacaaggcacaaagctttcctaaacttacccatttacaattattattgaatttccaagattagctgaaaatgcttcttgatgattgtagaggatggcacttaccccatctcattgtttgaaaagctatcctgaacccatttacactttttggctccggtatttttactgggcaggccagagcaggtgtgacagcaagactgtgcaaacaattgcactgttctcaccaaaacaaaatgggcaaatatgtggttttctgttggaatgatttataatataaaa

SEQ ID NO: 108615 - DNA, 1024 bp, Homo sapiens
tcttaaaaagccctacaaggtaggcactaatattaaaattagtcccattttatagatgaagaaggcacgggagttgagctaacttgcctaaagtggccttgtaagcaacaaagctgggctttaaacccaggcaggctgaatccaaagcggaattgccttgccctaccacctcccaccttccagtcacagggaaacacagagagcaatactgcatactagcacttcccaaccctggttcctaatccatgtgcctcagttttcttggaggtctttgagtaattttcagagtttccaaaagtttcagtggaaacatacaaacatgcaattattaatagatcacaaattttttaggttggaatccactattaacaacaggttagctcaggttttgagaaagctctgattggtaattgcatatacaaaaacattgcaggtttttgtttttgttttttttaagtgggaagatgaatcattacttaataaatgcagtttagttgagtagatctttctgaacacatggcatatggaggaagaataaagggtgcttggctttgaggaggttgggaaatgctaatatacatgtgtatgcatgttgcccaaactgtcggccttcaaaactcttccttttatttttaaataacatgattatttaatttgacctggagtcaatatatttttccctcattatttaaaatgttttgttggctttatatttaatattggaatctattcatcaagtgatcacattcttaaaacatggtcaggaactgggatgcagaattgcaagtactgtagattcctggctgaaaacgtaaagaattgactttttaatccttttaagctgtggccttgaattttttttttttttaagaaaatttaagaataagactctactgtcaaaacacagggaacatggacgatttaaaaaaaaaaacacctgtccattattcgtgcattagctccacatggccagcttgtggcaggccctctctgaatactttttcaatgagcagcccctggatct

SEQ ID NO: 108616 - DNA, 1470 bp, Homo sapiens
tcaacaaatgtttattgagcttctacaaggcacttgggtactcaagaccagacagatttgtttttacaatcatattagtcatttccagtctcttagcaaagaatttgttgttcaactgttagcaattttctattgttaatatgctagaatgtcagctccacggatgttggagattgacccatacgtagaattccaaatggatatataggaaagccatttaaaatgtcttaatatcttcagaaaggaatttcacacttctctttaaaattttgattttgtcattctcgttacctgcttatagaggccttttcatttgtacatttaactcataatccaagaaaaagcagtttggcaagggggctttgtttggtttgaaatgttctctttttttagctttgtaggccacagaagactgtgggtattcaaaagtaaagtaatttaagaaatatgtttgtttaatttataaggtagaaaattagagatagctctaagaattgcagtaagccacagaaatcaaatcgcaagacttgaatactacctgtaataacttaatccccaaataaaacgaatgagatgttgaatgtgaacatgctttgtaaacttgaaggtgttctgtgaatgctgtacagcatactagaagtatgactgtgctagagagaatggagaattcagctgccacaaaaatctggtctcttcgctctcagactctgttgaggaaagaagatatgcagaaataaccacgtgataaatgcaaaaagaagatattttggtaatttgaggaggaaggggtcccttttatccctggcagtcaagagactcttgagaaaaagcatctaagcaagtccttgaatgatgtggcatttcaataaaagagatggagaggaggcatttgagataggaggactagtaggagatggagaaacttggagcatattcagggaaaagcatcaagtccaactgagttagaactggtctatatacaggcatcaaaactggagaacattcagtgccaaatgatacagtcttgaatgccaactaggaattgtgaatgcattaaccaataggtgtcattaaaggtacttgaacaggggagtgttgtggctgtgcttcaggaccaggctcttgtgagtagcttggggggagatcgggaggagaggcagggcagaaactagaggccagaaagccagttaagctactacaacccaccaaggaaaaagaggggcagaaaaggcctgaaatggatgataacaatgaaatgggaaaggaatagatgcaaagggaagaactgacagaatctgatgtctcagtgaaggaacagctaaagctgacactgcgatttccagagcagtggtacccatggaggaaactcagaaggaggtaaggagctacattttagaggtgctgtgtttgcagtgttgaagcatgctgtctcccaggcagaagggggctttgcgctccacaagaaggcca

SEQ ID NO: 108617 - DNA, 1110 bp, Homo sapiens
gaaaattcctaagctgtattataacttaatattgaaagaaattaaaacatttacgcagggagagaggaagacccagcttgcgcacccctatttttctggccactactgtgagtgttcataccaggatgcattttcatgaaaaatccagtggctgtttaagtcctggaagggtatcttgggattatttcagcaacccgtgaaggcaggctttgtgcaaggtgagacagatatgagctgtcacttcctgctttgtgagttggatattgtttctaggccctgttttatttatgttatttttcctgttcatgtgttagaacaactgactgtttgtagagttgatgacaattagataataagaccaccaattcagtccaaacaaagatgaattcattatcttgccaggcaagggagacccacatattcagatcagtctccccatacttttgtgcgttttcatgtaagcatggagatttccgattagttttaatagcacagtgattggctcctagacacctaaatgaggatttcctttttgaaaaacctactcagcattctgatctgtccctgcttaaacctatttagtctggtcttatagtccctgacttgagcccaaagagcaaggtttctcaaggtctctgtgcaggtctttgatgctctttcgtggaagagatttacagtggttacagccataaccggtgcctgtggctgaaccatgccttctgtagtgtgttcagcccttcccttgaattaatgcaagttccacctttgctttaatgggaggggacagaaggaccactttgaggaagcggaggcaagaagatagtctgcaaaagccatgacgtggcactgaaatgaagccctgtgtagggttttactcagacgttagagaactggctgcccctgagtgctgtgctaactagggaaagaaaaaaaaccctgacctttaaaatttttcctgtgaaggtctagcaattctggagtgtcttcagcgactacacagtgtaaagcaactttttgcacagaagcaccataaattacctaaatggaaatttgcttctaagtgaagttcttaccctgtctgttggatatttagtattgtcaatatttgtt

SEQ ID NO: 108618 - DNA, 1047 bp, Homo sapiens
actcaagctattctacagaacagtctgttcttttgatttttttttttttagatcagtatatttaaagcataatttttctaaacaacatattgcgagtgtttacctgcagtggtttggagtttgtttggggagttttaattattttttaatgtagacaacttatttaccaacatcattgctccttctgctcagataattctaccctaaaccaggtgaataggggaactatgtaggcacctgactactgccagaaactttccttctgtttctattacctttcttttggggtgaaattggcaacagctcactggaacttagctcccttaatattctttctccctcccacaattttttccactcggttttttttttttatctgaaccattgttcatccatttgaaacactggccagagtttttgtcgcttttccatagtaggaaagcctttgtgcctctctttgtacctcagacctactggtgggcttgccggacagctctgccaagcgcctgcgtctcctgagcctatgaagaggcgactttcacaatcctgtgctgccttcgagctctgtgctgccaggcctggcctccctccagaggtcgtagtgttgccagcagtggcttcaaactggaaacatgggaggaggaattgtgggaaatggggaagaagaaaatgtttgtgcagggaaagtgtgtacgtggacttaaataaatatctgagggcccaggcccatacagatgatctctgtacgctggtattttgcgcctggagccaggtgtctgttgacagtggggaggaggtggggaagacccagccggccgagagcctcagccaccttcctgcaggaggtcctcacaccccagacggtcagaatgctccccagactgaggaatcagctgcacatccccctgatgtctctaaagctgaaatctgcttcctgggtttagccaccattttcattgagcagttctgaggattccttgtgggtacttgtgatcttggtggagatgcttcatggtgttgaccctattgttttgaatacctgacagc

SEQ ID NO: 108619 - DNA, 1035 bp, Homo sapiens
tcccccgttacacacctgctcatgatgacttgtgggatgcttgttttaaaggagagctgagtgcctctgatagaaaatctgatttcatgaaatgcttattaggagttaagtacccctttttcttgaagcttgaacagactttatcattaatgtgactgactggagcaaagtgaagagtttgatacctgccactctgtctctgaagatttacgtagagaaattttccccataggaatggacaaactaaagggatccttaagaaatagtatgtcacccaaatatattctgtggtaaggcttctcaacacctgttcttcattaggacggagcactctgagagttttgaaaacttgaatactgacatctcatcatttaaattttagaaggacaatgactcacagtacagagattaaaatttcacaggcagaacaaaacctacatgtgatttatacttacgtttttatagactaagatctaaaactcacatacatacaggaacaggaaagtaatatgaacatcaaatgtgggcttggtataagaaggtaagcaagtggttagattgtggcaaactggaggtttgaaactttttcacacagataggggcctgatgagagcgtctgcaggccgaatggagcctatggactgcttcttgcatgccagttgcacgccatttgactcagtccgctgatccgaattccctcagtggcaacctgcccagtcttctcctgcagagcgttgggcttgaagctgtctaaggcccagcccagggaaaagtaaagaccattgaaccttctccatgtcaccacaaataagtcagccacttcagatataactatgtccatttcatacaggcaaagtaattatgtcagtggggtcagtagcagagcatagtatttgtgtccagggacatctggaaggcatcagacagagcagccctgactaagttgcccagtgctcggtgtactgatcccagggtgagacaggaagaacatcagaggaagcccctctgtgtccaggcatgtccgtcttaaggcag

SEQ ID NO: 108620 - DNA, 1389 bp, Homo sapiens
tgaccttctggccttggaaaccctgttgccaagcagggaaggtcctattttaggggacagaaaacctttgtgtatcagggaactgacataaataattataatgtaggattttaatggtggaacgtgtatcagtataaaaacgaggggtggtctgctctcagtgaatttttatgggacccttgtaggtggtgaaaagggaggtgtagctgaacttctttaatgttcatggctgagggcattgcctgctcctgagaaaacaacgggaaagacagaaataattaatcccatgctgccatggtgacctgtctggactggaaactactagggtggtgagaaaagggctgcagaatcttagagaggaaattccagcttcatattacattaatctagtttaaaaatgaattaaaagccttttcagcccttccaagttcttgcctacattttgagggcagcatggcctggctttttgtgaatttatggttgttgtgatttttttccattccgtggagtactctcaggtggtcctttgccctggactcacagtggcctggggtcccttgagcagaacacaacttgggagtgcagctggatatcttaggagtctctgagctggctcgctctcccttcctctcttcttcctcttcctaccactgtcaggaagcttagcgtggagttctggatcccagctccctctcacattcattcatgtgagctactgccatggtgtcagtaatgggttgaatggctgcaccccaaaagatgtgtccatgtcccagaacccgtgagtgtgacctaatttgggaaaagggtcttcacagatgtaattaaggattctgagatgagaggtggactctaaagccaatgacaggtgtccttataagagacacacagtagagacacttgtagaaaggagaaggccatgtgcagatgaaggcagaggataagcgttacgcagccacaggccaaggagagactggagccaccagaaactagaaggggcaaggaaggattctccccctgcagccctcacagagagcacggccctgctgactccttgattttggacatctggcttccagaattgtgagataatgaatttctgttgttttaagtcaccaagtttgaggtaatttgttacagcggccccaggaaacaagtacagtgtccaaacctaaccttgatccagcagcacaagggagcttgttagaaatgagattctggggccttaccagattcagtcagtctggagtggcacgaagaaatgaaatcgcagtaagggtctgcaggtggttctgatgcaccagcatccattgttcatgctccccttttagccctattttcttttcatccaatttacttcaacttgggcaaaatgcatgctcacgtttg

SEQ ID NO: 108621 - DNA, 1433 bp, Homo sapiens
ttgtacacctggccagccatgaaggatcccaggcccaaggcccaccacccagcaatgctcagatcatcctggcaactgccacccgggatcaaggggctgcatgccttaactgccatcctcggctgccctgcttggagacctctctggcacattccttgttctctctgtgatttcttggcatatgactcaggctggttgcccccaactgcccaacctcttgaatcccattctgggtcttttccagctgccagcttcttccatggggatcttgtataacaagcctgcagtttggactcactgctgggcccttttgtgccatatagaacaagtcacctgctctgacttaattactgctgtatgtgtacacattcatgtgaggcaagtcacttctccaggctcagttaccacatctgtactatgagcatgttaataatactagcttccatattgagcactaactgttaattcattgaatcctgtgagtacatactagtatttgcattttttttttagacggagttttgctctgttgtcgcccaggctggagtacagtggcacaatctcagctcactgcaaccttcacctccggggttcaagcgattctcctgtcccagcctcccgagtagctgggattacaggcgcctgctaatattttgtatttttagtagagacggggtttcaccatgttggtcaggcttgtctcaaactcctgacctcagatgatcctcctgcctcggcctcccaaagtgctgggattacagacgtgagccaaggcgcccggccagtatttccattttttatgtgccggcctccacaggattgtggaagtgattaaattaattaatatgcaaagtgctttgcaacttgaaatttatctgataaaagcaattttattcaatattggggaattcagacagatgaaaattgtaattggcaatatttatggtgaccatcctcatgtaatgttgatttataaacatatatctttttatagtatagattgttccttttgtaaatgaatactgagggcctgttctgtgtcaggcactgttccaggtgcttaagatatgtcagtgaagaaaatcaaagattggtactcttatggggcttacatttttgcaagcagacagacaataagtaagtccattttgtatgcagtatattggaatgttgagggccgtggaaaagtcaaaaagcagagcagggcaagggggatcgtgagtacaggggaaggcggcaggttgccttttgggggatggtgagtgcagaggacagaggcatattgctttttgcggggattgtgagtgcgggggacggcggcaggttgccttttgggggatcgtgagtgcaggggatggcggcaggttgccttttgggggatcgtgagtgcagggaatggtggcagcttgcttttttggggatcgtgagtgcag

SEQ ID NO: 108622 - DNA, 2647 bp, Homo sapiens
gaaaaaggatcctaatatctactttgggttttagcattaactttatgcaaagtgcacaaaaacaaaatagctgactcctccaatatcccaagtttcttgtgaaagttaataaaattcttagctgtggtatttctaccagtgaaaaaaggagtttaattttagcctagtttaaaactttctaataattgctaataagaactggctgctgaactgtctttagtcactggagaaaataagggtcagatatcctgaagatggcatcttcgtaaatatgttacgtggtaataagctgtgtgacggtctttattcccatctggcttctgcactattaaaatttgtttaaattaatggatacacatgaaatacttaaacaatataactgaaattatgtgcataatgagtaacctaaagtaggacattcatacattatgtagaactacttttctgcaacacaaaccttgtaaaatacatatataaatcactataacttttaactgtccatatcccctgtagagaattatgaggagcaatagatctgcaaataatgaggactgatgtaaaaatcaatagaaagcattttgaatatgatttaagagcatgtgaatgcttttagatggaatgctgttcccttgaagttatggctgagctgttcttagaactggtctactcaattcacagaaaacataggtcatgccttatctatgggggaacaccctcccagaatttacctgtgattacctgtgctgcatattactttgcaatggcctcatctcagagaatgaaagagggtcacattgttctgaaactctctgcagtcttccaaccaccacaaggccatggatgtgggggtctattccagacagacttaagggctcaagtggaacctgccatctcccattccactgaaggactgtccaagagatttagtgcaaggtacactgcagtagtgaattcccaggcacttgaaagtgactgcctaatccctacaattactagccttgttggagattatgcagcccacaagtacagactagtataaagcaaaaggacaaaggaacccccaccctccaccccacccattaatgacttgagtgggcaagaagaagtgatggccttccttgcctaaaacagtagctttgtttttagggggtgggaaggtaggatgtggagtgacatggttctatcctttacttatgagactcagaaatatatctacaaagccagatgctctgtcttcatatttgcagacatctagaccccttgctaaaaacccactgaagttttttttttatgttctttgacccacaccatcaacactaccctcaaatctaattgccctacagcatattctatcatgtggactaggttcctggaaagccggaactcatgattctttttcaaactgccagaatagaagggagagagaaaacatttctaccctttgatcaccagtgtgaacagaatccggaatgcagtttcagcgtgacctgcagtcattcatgttcattggatttgacagatggaaacccaaggttatcgaagattggaaggttatcattgtgaagaagtagctcaaaggactccggtttctgtctacaagtgtgatgtctccatgaagaagacttagtatggatttgggtgggtaagaaagcatttaaacgcccaggaaaggacatgattaaagttgaccttttaatactgtagtaccttgctgttaagtaaccccactattgtatctgcatttatcttttgttcatctactttcacttacatacagtattatataagtagagaaaaatgggaaaatgcaagcaaattcaactttattttatacattgtatatatgtacaccctacactattcatttgggttttattaaagagatagtcacaaagggcttacgaaaatcatttttgaattgataattagaatattgaataagcaatcctatgatccactaatttgttttatcagttaataatattaatcaaagacatttactgtatattctagtcattttgatttgagttaaccccaaatataaaattacctgtagtgatgtctctctcccagcccttatatgtggatattttttaagtggacttgtatgctgataattctagaccaaagtaaatatggcagaatatttatacatgaaaaaataattttgcaaatattttctataattgtattcatttaaaatgttgatagcttgtgttagtttcagggaggggtgtatattttgataaaaaaatacttgactttgtaattctgtatattctatacaatttatagcagagccgttttaagacagccttgtcacatttttttgttaattgtgaaaattttattgagtgatgtttaagtatgcattgagtacatgaccaactagaattaaagtaagtgtaaacagtgaacatactgtatgctgtacaagatataatgtaacttgctgttttagcatctgtattttggttagaagatattattaaatgcagatgttaaggattggaaaagtctaattttatttttagaaataatggatataaatttgtttttgcttgattaaaatagcttattcctacattaagtctctttttaaatgttttcatgttatttcttttgtgcagctatttcatctgtgtga

SEQ ID NO: 108623 - DNA, 1090 bp, Homo sapiens
cctcgctgcggccgggacttgaatcgagggacggcgtgacaggcgggactaaaggcaggatgtagtggcttcctgtgagcaggtctcaaaacacaatcacccagcccgcactcagcccgcttaattcccttccttctcatgcgtgtaattgctactttagtgagcgagcctaccagttgactaaatacgaaattttgctcagagttgtccgagcattactgtggacagattatttgagttctgtcatttgaacattttagttttaaaaacgaccctttggtgtcaggttgccattttttttttcacagtggtttatttagatgaagtgctttttgttttctgtttgtaagagagatcaataacatttatttttgcatttgtcgaaaattagcattattttcttcatgcagtattctcagattggaaacatgcttcatgtttcttataaataaccctcaattatgagggcgtacttttcactttgaagaaaattgacttgcattaaagtggctaacaattctttcctgggcaggatgtaaaattttcctctcctctaataccagtactgttgagctcacattctcccacttttcctcttttcaggtggttcacgtatttgggattttatgaaacctcagaagcagacatgttaacttttcttatctttttattccctgaggtagtcctggggctcttaagagattacagttcttaaaacctggaaagtgacaccagagaggtagatcttagttcccaaaattaaagttactttctagggcataaaaccttttcagaattcagattaaattttatttattttttcttttttctgtaaccttatatttgaggggaaaattttgttttcaacttttgcatatatctaatttaacatttgggaaaactgtaaatgggccaaagtttctccctttatatgattttccagatttttaccactttcttagtgccacttgatgctaggcattgtctattggagactcactggtacgtaactgcaggttttaccatggaactacatatacacatgtcttggaattgagggttagggtttccagaaggacttagttgtcct

SEQ ID NO: 108624 - DNA, 1039 bp, Homo sapiens
tgttcaagagataatagtccataaccttctttagggatttcattcctgtaattatttccccttatacttcacaaggtgaaatatctgtcagttggacagatatttgtctattggacaagaggaaacttaacaaaaagtggtaaccaaaaaggtggaggtcacaaaataacaacatgagacctcaatatatataaaggatgaagccccaataccccttttttgcttgagtgtacttttttttttttttttgccggggggctggggaggagggaagaagggacatgcaaatatgtttcaggtgttttatatgcgctcaaacgaacccagggaattcgagatccatctataagacaaaatattgtcagcaaccctggatttgctgcagtttgcgctaggaaaccatgacagttctgaattgtctgcttccttaaactttttcaagaggtgagtttggttgtttgatatcctaaggttgtcatatgaacccttgataaaggaaattaggggtgtactcgactccattcttcggtctgcactcctgtgtagcgagtagcaagtatgctagaacacctgaaacacatttgcatgctccctcctcccctcaaaaaaaaaaaaaaaaaaaaaaccgtattcaaacagaaaagagggattggggcttcctcctttatgtatcttcaggcttcatgctgttatttggtgacctcctttttgattagcacttgttaagtttcctcttatccaattacattagattgtaaaaatgttgcggagagcacccatgccaccatatgtgtgggcttatctactcaaggaataccagatcaataagagagccaaatgggaaaattttgtgtgaattttcagatgtgtggtacagtgcgagatctgtgggactatgtgttccaaaactcacttagtttctctggtgtcttcagaccaagaatagcctagggttatttgacagagtagggaagatctatagggtatggttaagtgcttgagcttagaggctgggtgaaaaagttagttacctgggttt

SEQ ID NO: 108625 - DNA, 1024 bp, Homo sapiens
atgccttgtgcctttcttaatattcatgaaatctgtgactgaatactaggacttcaacaaatactgctgtgaacatgaacatctccatgacaatgtttgctagtaaaacaacccaaactcaacctcccttctcttctgtccttgaaatttctagtgagtgcatctggttggtggaacttaaatcacatttacaactgtagccacaagagaggctgggaaatgtattttttaactttctcttctctgcagcacaggaagacatacactgaaggaggttgaaatggatgtgaacagtaatctaccatatttactgcaggtttagaacctggttctccttaaggctggctgtcattaaacgggctatagataagttgagaaagtttataaataataccgtcaaacaatgttgagaaactcatttgtttctttgtatatttttattgttttataatgactacattaaaaaaaaaactagaatttgtccttcacctctatgatgaattaagtggtctgtggataccgaaagtttcctcacgtttaagatgtggttagtggataaaaagaccaaaagagggagtataagaaaaaccctcatacaaggttacctgagctgaggaaaggttagtgttgtcaaataatgaagagtggtcaaataaggtgggactgaaaagcagtgttacgatttgggcacttaatattagtggttttttgggttttttttttctttctttactattgagacagggtcttgctcttttgtcccaggctggagtgcagtggcagctcactgcaactcccatcccctgggctcaagccatcctcacacctcagcctcccaagtagctgggaccacaggcatgcaccaccacgcctggctaattttttgtatttttagtagagatgagatctcaccatgttgccaaggctggtttcaaaatcctgttctcaagcagtttgcccaccttggcctcccaaagtgttgggattacaggcatgaccactgcgcccagcctgttagtgttct

SEQ ID NO: 108626 - DNA, 2057 bp, Homo sapiens
gcattccagacaaaagccctaaacttgaacatggtgtggcacagttgatgaatgaaaaaaactaaacactgaccggggttgggggaatggaaggagaagagatcagagagaccattaagtagggctttgtagactgtggtatagaaagataattttattctaagtgaaatggtgtggtattggaggaggagagtgagtgagtaacctaaagaatatgtttcaaatatcacactgcttgatggagaatggattgtaggagggccaaaagtggaagcaggggcaccagttaggcaactctcatgtttgttcgaataaaagattgtggtggcttggactcggtgattctggtcaaggcaaagagaactggttggatttgggatttattttggaggtctgctggatttgctaagagactgggtatgggagtttggggaaatagaggatggtgagagtaagagagaaaaatggtagactggggaaagggcacatcttggggaaagaaatcagatggtttttctgggacttgttaaatttgaaatgcctactggatatccaaggagacagttaaatagtcacatctagtgtttgttgaggagaggttagacctggtgttgcagatctgggaggcgttcgcattaacaccatatactgcagagttggcaaagagaaggaagagaaggtggtttggaattgaggcattgcatgtttagaggtagccagggggagaagtcagcagagagccagtgacgtaggagaaaagtcagaaatactgtgttgtggaagccaagagaagagagcattttaaagagggatatttatgttcacttgggttaaatcatgctgccaggccgggtatgatgaaaacagagaagtgaccgttgatttggcaatgtggaaggcattagtgtcctcagctagagcagttttagtggcatggtggggtcagaagctgattggagagggttgaagaatgaatggaaggtaagaagagacaacgactagagatgatgcttttaagaagttttttttccttttctttttgtgtgtttttttaagttgagaaattcccatcatcgtttatatgctgatgggaatgatcgctagagaggaaaattaatggtgatttgggaaagaaagattaattgtggagtaaagtccttgaggtagcactggtggaatgggatagagagcacaagtagagggattaccctttcataggagtggggatgcaattacgtaatataaaaaagggacctcaagccactttacacacagcccctcccttcagtcttaacaatctcctttagaccagcttgatctttctgtaatcactagtgtttttttttttttctgtgccacattaatatgttctttcagattgaagtcatcctatataaggcttagtatgaagcagttgatgatatttaataacaattttaaattttatgccaacaggtgaagcaaaaaatttattgccatatcttggaccccacaaaatgagagattgtttctgtaccataaatttggaccaggaagaagtttatcgtacccaagttgtggaaaaatctttaaggttggtagaaaaaattggtaaattataatttttactatatagattggtaaatattatgcattttccagattataataatcaagaagacaagacagaaacagtgcttgctttcatgtggcttttcattgcctcaaaatgtatcttcctcttaattgttcctaattttatctttgttttctggagaaaagttttttcacatgacaggctaaatattgcctattcgtttgaactttcctcaaagtacatctttattttatttatctaaagaataagttacttaaagttcatagaagttgcttaacttagtagtgcattatcagggaatgaattctcagatagatgtctcatctttgaaagtgtaattgccctttgagagtatcatattaaattctaattcataaaactggaatataccacctctgcaccgtagcaatgtgaacataattctagtgcagagttgtgctgagaatcttgttcagagaca

SEQ ID NO: 108627 - DNA, 1050 bp, Homo sapiens
ttttttttttttgagatggagttctgctggagtgcaatggtgtgatctcagttcaccacaacctctgcctcctgggttcaagtgattctcctgcctcagcctcccgaatagctgggattacaggcatgcgctgccacacccggctaattttgtatttttagtagagacggggtttctccgtgttggtcaggctggtctcaaactgctgacctcaggtgatctgcctgccttggcctcccaaagtgctgggattacaggcatgagccactgcgcccagcctccttgttggattcttaatgttacttcttcgtaggttctttatttttcttatttgtccctaggagttcttgaatctgtggcttgtcttctatcagttttggaaaattccaggcaattatcttatctcctttttttttctgccctgttctttttttctcttctctgctgtgactccagttacatgaataataggccatttcaccatgtctcatatgtctcctatgctttttccctctctgtgcttcattgtggatattttctactgacctgtctcccatttcaccagtcctcttttcagctgtggctactctgctactaaatacattttcattttggtttattgcttagttctaacttttttatttcattcattttatagtttccaggtatctgctggatttttcattttgttttatgtcttttaaaaaatagctattttaggctggatgcagtggctcacacctgtaatcccagcactttgggaggccaaggcgggaaaattacttgaggtcagaagttcaagaccagcctggccaacatggtgaaaccgtgtctctactaaaaatacaaaaattagccgggcgtggtggcacatgcctgtagtcccagctactcgggaggctgaggcaggagaatcgcttgaacccgggaggcagaggttgcagtgagctgagatcacgccactgcactctggcctgcgtgacagagctagactctgtctcaaagaaaaaaaaagcaattttaaattctgtcaattccaatatctgcgtc

SEQ ID NO: 108628 - DNA, 1050 bp, Homo sapiens
ggaaatgtgttgactgttacacatcccttatctacagtgcttgagactgttttgaatttcttattcttattttttttttgagtatttgcattatatatacttgcccattaagcatcccaaatccaaaaagcccaaatttgaaatgctgcagtgagcatttccttggagcatcatgtcagtgctcagaaagttttgaattttggaggactttggatttttgaatttggaatgctcagtctgtgtttgatagtttcattagtgattgtggcattcctgtttagtctcattttgaaaatacagcataaatttaaaaatgcatacatacatatgtccatacatattactacctattccatataggtagtatatagccatacaactgcagacacatggaaaacaattcttaaccttttgaatgtattagtttgtgtttaaagataatgttttatcttgtttaactggaatctaatatgttaaatctcttttattctaccttagcatcaaggcatgccatgggttgcctctcataaatggccaaagctgtgacccttatgcaacagtttctctagtgggcccttctaggtaatatttattgaattattattaggttttaaagttttgatgtttgatttaaaaatttaaaaagtaagattctacgagcaaatgataaatagctatttataacacacagtaataaatgctttgaaagaaaaatctttagtgagttctattatacacttgtcaataacaaagccctctttttacagacagaaattggtaccccattttaaatctgccatgctcttaggctttaaggaacaacttcagttttatactagtacaatgtagtactttaaaacataaacttgacttttcatgcatcagcattcctacttttcaaatatcctgaattttatgcatgtaaaatcctgttttaatgaatgccagttcagaataacaagacaatttatatatttttatctggaaggcagctcaggactgaaaattgccttttctactcatgaaatctgtcctctacagagagaattc

SEQ ID NO: 108629 - DNA, 1134 bp, Homo sapiens
ggctgggcacggtggctcacacctgtaattccagcactttggtaggctgagtcaggcagatcacttgaggccaggagttcaagaccagcctggccaacatagcgtaaccctgtctctactaaaaataaaaaaaaatagctgcccatggtggcacatgcctgtaatcccagctacttgggaagctgaggcatgagaatcacttgaacccaggaaggagaggttgcagtgagctgagattgcaccactgcactccagcctgggcaacagagtgagcctctgtctccacataaataaataaataaataaataatacttttataatacttgtcatttgtaaattagggatttcctctctaattaaatatgtgttttgttttataaattactattatgtgtattcattaataatgaagaacttcccattataattaatgacatgtaagataaactgaattttttataatgtaccttatcacacagtgtaatatttgcccatttccccatttagttcttggatgaaatttcatctactgaaactaaagagtccagtggtacgagtgagcctgtgcacctgaaagaagggtaatttaatcaaattagacgtgaaagtcatatatcagtatagatattaagtaagtacaaagagcgtgggtctaagagtgaggagatctggctttgtgtgctgtgttagaactgccaaaattagcagtcaggtaagtcgcctttactgtcctacaaactttatggcaaaaaagcatgatttcctgtgcatacagtcctagagttgttttgcaattatagtgagatgatgggtatttagagtacttttaaaaagtaacagcactattagtcttaatgtaaagtgtttattataagttaagggggggaaccactcatttgacccttttttgttctgtatagtacaattaaaaatattaaattaattaaagaccttattcctttagtgtggccaaaataaatgcaacagtcatggatagcaaaaacatttttatatatttaatataatcttacactactattcatgtcatttaaagttaaaggatacttctttgttttggattaacttttaatttttatagctaaatgtttacatctgttatgttggcagtgaga

SEQ ID NO: 108630 - DNA, 1059 bp, Homo sapiens
tagccttcaagttctaatgtttttctgcctagtatttaggaggttttcttttttcttccatcctgcttagtacttggtggataactttctatttgaagatttctgactttatcttggggacatttttatgtgtaattttctcctgaatactcttatttgtcagatattaaaacttctaaatccatccacgatggtacttaactattctatttttgcttctttttcttcttgtactgtatttttggaaagacctcagtaaaatctttcattttcactaactcacattgcagttcactccagttaacactgttaactgtgaaattaaccctaatgatatcatgacagtatatgtgcctgggagcaatgccctttctccacatatgctgtgttacaatttgtccagaaatgaataaatatagcaattttcagggtatgtgcattctttgtgtattcaacaaatctaaagatagaaactccttgaaaaattttaaaattctctgactataatgccccctgtaaattagtacccaaagacataggtctcttcccccccaatttcttaaactcctgatttcctcagatgttatcctcctttgttgcacatatgtctcttcttcagagtgatgagtttccttaactggtgattttttttttttttggtgttttactcatctttgtgttttgcagtccatttacctacttgagtgttgagtagcttactgccaatgattatgagggagggacaggacaagctgctgaggggcaggagtgctgttgcttgtcttctggtgtgggtattctctccttcccttctgagagttagcagctacctgtgacattgcactgctctgcagcccagtatgcatccttgctgctttagcctgtgaatatatgcctctgttgactgctgcttagcacaaacctgggaatggggagggcctgattgacccagctgttccacatgcaactcaccgattaatcatcctgatgtatgtctgagtgcccccaaccttcagctgtctgtgtccactggctctggcttgaaactcttccttaacc

SEQ ID NO: 108631 - DNA, 1048 bp, Homo sapiens
caacatgtttcctgctctgatagagttttacatttgggagggaagagacaaacgaataaattaacaagataatttctgagagcagtaggtttaatgaagccgtaaagcaggacacatatccctgcacaatctgtgcgcctgctcagacgtaacaccccgcagcgcagcaggcagattcagcggcgtcgccccataagggcccgagccctctcagttggcctaggacggcgagggcggggcctgcccgcccccctggcgctggcgtcaggtgacgtcactgtgccgcgccagccaatcgtgggcagccggggtctaggcaccacggtggctggcggcctgcgggcggcgctgtggcccgtcgggcggctccacagagccgccctagccttccgccttccccaagccaacgtctccgccgtcggctccgcggcgccgccatggccgacgtggaagacggagaggaaacctgcgccctggcctctcactccgggagctcaggctccaagtcgggaggcgacaagatgttctccctcaagaagtggaacgcggtggccatgtggagctgggacgtggagtgcgatacgtgcgccatctgcagggtccaggtgatgggtaagcgctgcacgcgagtccagggccgccctgcggcctccgggagccgacctcggggttgggaagggacgggcgtccgtcagaagcctcggaaagtgccctgcctgggagagtgggtggaggtcgccctgccccggcgccggaggaacgcggagccacgctcctgctgcggctcctgagggctgcggccgccgcctggggctgcggggttgtgcaacaggcgccctgcgccgggtggttggtgttctagggagagagacgggcaataaacggagttaaacaaggtaatttcaggtagtgatgggtgtgaccaagaaagtaaaaccgggtgattgttgggaactagcaggaaacacttcggtttgtgtgtccagccccagccccacctctaaaagctcaacacaaggtggtcagggtaaaggccgtgattcagcag

SEQ ID NO: 108632 - DNA, 1046 bp, Homo sapiens
ccattccaaaccctcccagtaaactttattattggttccttgggtatcctagtgtttcttgatgtatgtataaacaaatgctaacatatatatatggtttatttaaagggtgtcttgaaaataaactgtccatgagcatgcccagtaagcgtatggtaactttgaatatagtggagtatggcatatttttctctagtagttttctctcttggcaccgtcaggacatcttttcatcagagcttataaaaatagaggatttgttaacccttgtgaaattgctcctggttataattagtagaatgccttgtactttattcctctttaagtagttatgttcagatgagaaattaatagtatgagtctttattgccatccctaacccttagggcttttgactttgaagtgtctggtttttaaaaattgcattctgagcatcagaatgagaatcgctatttgtttacttttagatgcctgtcttagatgtcaagctgaaaacaaacaagaggactgtgttggtatgttgtaattttgttctcttgctttttcaactgaaggttttctctcagtagggatgtttgaatttgaaattaagattgactttatcaatacacaaaaataaactgtaaagcagtgatccattgttaatataaaatatgttggttctcaaaagagtttaatggaatgaacctgcaagtccttttattgccataattaagaagaattggttatatattccagacatggtcataataaacattttggtaatcaaaaattaaatattttctattaagaaaattataaaatcagaaatttgtcaaaacattatttgaattttggctatgttataggtcacttttggttctaataaggcatttcacttttcaatactcttataatacagtatttaactttaaaaccagagtagaaaaattctaagtctcaagtatatttttggaatgtggtttgtgtatcaaattttctttagagtcttagactacaaaagttgtcgtaggctaaatattttaggcagttcaaagatttttatg

SEQ ID NO: 108633 - DNA, 1045 bp, Homo sapiens
gaccctaacccgggcggcggcggcgcagtgcggccccattcattgctccccgggccggccggactggccgcagctcgctcccgaagcagcggggcccgcgggcagcccggccgggccgcgctggttcctccctccctgctgggagcggggcgcacgtgctgcccgggcctcccgcccggcgcggcgccggaagccggggacccctgcccgaagccgggccccgagagtgcaggagccgagcccccgggcctcctttgtacggagcgctccggcccgagaggccctggcggaggcgcccggcccgctgagcggttcggagaagccagaccctgccccactccaggggagaggaaatttccactcccgccgctatcttgtgactcgtccacgctgccaccccgaccggtcggaagagtgcgactgagtgttaagtgtgggtgtgggttgcttaaacgtgtagcggtgagttaatcacagaagtacattgtacaagaaaatgcacttgaatttggacagtgaaaaggcccttaaaaaggttggttcctcccggattcctttttaattacagaggttttcttccttacaaatttgcttctttggggaaagtaaatcctgtctgaacaacacaggttttttttttttttcccgtgtcttcaaaacaggagagtgatggttgtatgttagcagattttttctatgcgtgagctctttgttttaatatatttaaaccatctaccgtgtagagtagctttaggatgcctttttttcctaaaattgtatcaatctctgaatgcaggctagagcttttttttttttttgcctttatacttaagtaaactaattttacctttttaaatccttttgaaacattttgttagtgggtcttgaaagaccatttctttctgagtgggaataaatctcgagagcttagaactatttgggcacaacatttttaggataagcatggagaaataagctgtgactcagaaaataaactgttggtgcagactgaaatggactccttcagggtgaaaaggcgacttga

SEQ ID NO: 108634 - DNA, 1021 bp, Homo sapiens
gactcccaaagctgcatatctaatcatacaattttgttttgttttgttttttgagatagagtttcgctcttgttgcccaggctggagtgcaatggtgcgatatcggctcaccgcaacctctgcctcccggattcaagcgattctcctgcctcagcctcccaagtagctgggattacaggcatgcgctaccatgcctagctaatttttgtatttttagctgagatagggtttttttccatgttggtcaggctgatctcaaactcctgacctcaggtgatccacatgccttggcctcccaaagtactgggattacaggcgtgagccaccgcgcccggcctcatgagtttttaatgttcttataaccacctgcctatcagaaatctccagttggatgtttcataggttatctgttcatataaatctgtgttgttctcaagggctccttagcacgacatacaaactctttaaaatctcagtggcttacttctctcctgtcatctctctctaccattccacatagttatttcctactccttctgggctgtttcctagcttctgggcctctcatccccttattccatgttggtctggctgatcagatgtcagctttgatagtctgatacccagaaaacatctttgaactcctctttgcattaaggccaggtgcagtggctcttgcctgtaatcccagcactttgggaagccgaagtgggcggatcacttgtggccaggagttagaaatcagcctgggcaacatggtgaaaccctgtcactactaaaaatacaaaaaattagccaggtgtggtggcgtagtgaatttttgcaatcagactttgataatgacctgtagttgcaactattcgggaggctgaggtgggaggatcacctgagtccaggaggtcgaggctacaatgagctgtaattgtgccactgcattccagcctaggtgatagagttagcctatctaaaaaaaagttaagactcaacaaaataaaataaaacctttttctatcatagcatt

SEQ ID NO: 108635 - DNA, 1987 bp, Homo sapiens
agtatactgagaagatgaccagataggactcatagacctaaattctagttccacatctctgttaaagcttagataactcaagatctcttagccttgtttcctctataaaagaaaaaagttcagccagatgtgatggctcatgccttttagcccagcactttgggaggccaagatgggaggactactttaggccaggaattcaataccagcctcgatgacataaggagaccccatctctacaaaaaataattttaaaaaattagctggctgtgttagcacacatctttggttccagctactcaggaggttgaggctggacaatcacttgagcctgggaggtcaaggctgcagtgagccatgattgtgccactgcactccagcctggttgaccgagtgagaccatacctcaaaaaaaagaaaaaagacattgtatgagatagtttcaaatgtaactttgaaattacaaacaaagcctacctatataaatgctttagaatgggaggcagcaagattcaaaggaccacgttattgttggctttgctgaccacacggtgtttgttgcaactacctaactccattactgtagcttgaaattggccatagaactaacgggcatggctagcattttatttacaaaaatagcagcagccgtggtttgctttagaagttagagttggtgagtggtcagtgtagtctgactcaagaaatctgaactggtcttaaatgggatgtggactcttggctttgttcttttcttataacaaaagtaacaccattatttttacagtacagatgtgaatatcagtaagtccaacatcatcctcagcttcttccctgggtaacccccgttaagtgtgtaaatgctttttaaaaggtaatatgtggcatatccataaaggtccggcagtgtcttataaaggtaaatatatacccaccccctgagccagcagttctactcttaggtgtgtttatccaagagaaatgaaaacatacgttcacaaaatgctcttgtacaaaaatattcatagtagccctattcataatagttccaaactgggaacagttcaggtttttatcagctaggcgatagataaacttgcatgtctacacaatggaatactactcaatggtaaaaaggaatgaactacagatgtacaaaatgtgatgaatctcacaggttgactgcgaacgaaagccttaccaaagagagtacatactatatggttttatttatgtgaaattctaaaataagcaattcttacctatgctggaaaaaaaaacccagaacggtggttgcctttagggcagtggacagggagaatgactaggaagggacgtgacggaactttcagggtgatgataagtgttctgtatcttgaatagggctttggatcataagtgaatgcatttgtcaaaactcattaagtggtatattggagatttgtgtatttcactgaatatgcattttttctcaattttagttaatacgcatgctgaattgttctctgatgtttgcaacttgaatctttaaaatgagataaatacagtaaaatgttaattgtagaatcttgatgggtttatgggtgttcacttttaggtttcactcaacttttctgtgcatgggtaaacattcctaattgagtgttggagaatatgaatacattcgtgtgtttctctctacctccttcaccagtctcagagtgtttcctacagatgactatcaggtttcctgtcagtccttttttcagcaccatttttatatatgtatataaacatgtttctgtatatatgtggagtatatagaaataagtaggttcttgtctacctttacctgagtaataggaaactcatatgttctggaacttgattttttttcacttaatatgttttggctgtatatataggtttgtgtcattccttttcatagcataatgtattcgtctattttcacactgctataaagaactacctgagactgggtaattta

SEQ ID NO: 108636 - DNA, 2887 bp, Homo sapiens
ctacatctgagtaactaatttaactgccattttacacctgggtaagagcagcaatttacaacttctgtttttattttctgttgttttttcttttagggggaagaggtggttgataaagtatatttatatgtgagactgactagtttaagtttttaaaaattagatttggttcttggcagaaggatcttgttcaagtaaggaaaactcacttcactgctggaaataacttatttacttgtttctaatggccactagtatatggcatcagatttgggacatagctgttgatttgtgtatatattgtatgaatgtaattctttatactcattattttcattgtgtaatagttccttagaaagcagatttggatatagtttgttcatatctgctatatatttatttgctttataactattttgtaaatttaatttacattattttcctagaaatttaaaatcaaaatgttcaaaacagtattgtaacaagaatattttaagatgacttaaaaacactgctaaataattaaactcttagcaattttgtttcagacatctccactttaatgtcaactgcatgggtcaacaaactactgtggccccagtctgcctatttttataagcaaaaccttattggaatacagccacactcattacatttaagtttctgtcagccctggtgtagaggattttatcccttcgttcctgcagacacctagatctcaaagaatttctcttctgtatcttattaaactggcctgtgggctttctgtgtgtttcatttccctctatagcaaactgtttacttctttgagattggtcttttctttttctgcaacaggatcgcagtatgtggtagggaagtgatgctgtctgaaggtgacatcctgttctcctctcttctgtcctctccatccttattttggccacctggtaattgggggggaggggtagaatgctagtctaaattataaaatgaaattgctttaactatttcccctttacttgaaaaagggggttgggggtgattcctgccttgcagttgagaaataaaagttatctagctttcagcacaatctgttttggggtcatgggatcttttgagaatcagaagaaagttgtggagccactccctggggggaaaatatattcagaaatatattattacagaaatgaatctttgatcagtttttaaaccttgaaatacaagtgactttaccaatgtattctaatatacttgttggcagccacttctgatgttagaactttgaatatagacatttgagaaaaataattgattttaagtgttcccaaagtaaatcactggttcaggatagatctatcttagtgttcccaaattgtgaaaggaaagagattaagcccttaatgttgaaacgtgtgtctcccaaatcttgctttgtgcttagcagtagagctatgaaattccattgatcagagggcttgtttctgaccttgtccttttttcacttttgcacgagccctgccatttgaccagtgtgtcctaaactttattcattgagtgctgtcttcataagttggccttatctgcacatttcctgatattctttcaatgaactcagtttttaaaatatatatttttttaattttttaaatatggaacgactcacaaatttgcatgtcatccttgcacaagggccatgctaatcttctctgtatcgttccactgttagtatatgtgctgccaaagtgagcacctaatttttttgtaaagacaaagtgtttcctgggctagtcccaactcctgggctcaggcgatcctcccatctcagcctctcaaagtgctggcattacaggtgggagccattaactcactttttaaaacttaaatttaagcaaataattactgtctgtgaaatatgcgtttcatgtactaattcttttatattcgccacttaaaggatcatgtaaatattgggggttttgtttacctaaaaccatcttgtatctttttagagggcatcaagttcattttgggaaacattcccctatgtactggaattttaaagctttgattttgaaccagagtatgaatggtggaagctgctttaacttggaaataccagggaaaaggaggggtcatgggatgggtgggtgctgtctgctgaaataccccttgcttgggcaaatttatgtgtcctgaatatgaggatatttggctatgtgcatggcaaagcttgggatcgtacccttgcaagaacagttggtttgttttttaacctggccaaacatgcatacacacacacacgcacgtgcacatttcataagttttattttcttttacaggtttgatcttgctcttctacctagttttttatgggttcctggctgcactcttctcattcacgatgtgggttatgcttcagactctcaacgatgaggttccaaaataccgtgaccagattcctagcccaggtaattatcttgcagttatgactttgttttttgttttttgttttttttttgagacagagtttcactcttgttgcccaggctggaatgcagtggcatgatcttgggtcactgcaacctctgcctcccaggttcaagcgattctcctgcctcctcagcctgctaagtagctgggattacaggcatgcgccaccacgcccggctaattttgtatttttagtagagacagggtttttccatgttggtcaggctggtctcgaactcccgacctcaggtgatctgccccgccttggcctcccaaagtgctgggattacaggcgtgagccactgtgcctggcagtggttacggcttttaacaaaattgagttatagtttatcttcaccataaatctgttttatatagcagatagaagatagctaaaccttggagctgagtaatg

SEQ ID NO: 108637 - DNA, 2343 bp, Homo sapiens
gcaggtttctctctagagcagtggttttcaaccactgagtcatatggcagcgtctggaaatatttttggttgttacagctagagaggtggtactgtgaatagaggccagggatgttgctaaacatcctacagtgcatagggcaacccccacaacaaagaattattcagcccaaaatgccaataatgctgagatggaagtgcccttatctagatccttgctcactgtatagacttctgagctatatcaccagccaaactgaactaattgtctcaaccattttttttcctagaacaatttttttctaatgatttcttttgtttacagctaatcttagtctaaatgtcttgaataactcttttaaaactcttagtgtattggagcaagtgtcagagattagttccatgctacttttccttcatctctcattgtagcactgtttttttctacctcagactaattctaagattattctttacttgctatttaagtgatgtgacttaccattgaacatagtctgatctattcaaaaacactgaactctgtttataattgcatgaaatatataagcatatgtgttaaatatttttaagtacacagtttttaaactgagtttcttaaaattatttgtcgattattttagtacttaaagtatcattagtttaaataaatatacatgcatacacatgtacatataatacatatatattacatatgggacatattaaacatttccttatttaatatatcacatgtacatgtaatacatatataatatgtatttatgtgttgtatattatatacatataatatgtattatatgtacatgtgtgatatattaaatatgggaatgtttgaaggctagagaaaattttaggattgttttaaagcctatgtgcaaggttgaattaatctagatctaatgcttttttttttttttgagacgaagtctcgctctgtcgcccaggctggagtgcaatggcacgatctcggctcactgcaacctctgtctcccaggttcaagcagttctcctgcctcagtctcccaagtaactgggactacaggcatgcaccaccacacccacctaatttttgtatttttagaagaaatggggtttcactatattggccaggctggtctcgacctcctgacctcaagtgatccgccagcctcggcctcccaaagtgccaggattacaggtgtgaaccactgcacgcagctgatctaatgctttttaaacaaggaaaacttacattaaagttggaagcctgattgcttgccttatcttcattagtaagcttaagcaacatggtctgtattacatgggtgtcaacttctgataggaaattgttggtggttatactccaaattcagtatgtgaaaaccacattttaattacagagcaatatctgctattgaaggaagaatatttgccataaagtttaaaatgcatagacctttttcattgaaaaggagttagctgtcttatgaatgtttccatacaatttaaatgacaaaagtacgtaggctttgatttgctcaaatttttttccttgtattaatggcacattgacaaaacctaaaaatgttatttgattttttaaaaatgcatatagaaagttcaaagtaaaattgcatcttttaaaaaggaagattataattaactgtagataaccaaatttagggacagtttctaatcggtaatgtctgagatggttttgaaggtttgagttatttttaattttagatgtctatgccttcataattagaattgggaagttcttgatagtttcagcatactgtcaacacaattttccatgtaatttgctgagatctgctttttagagataagaggaaggaaaagaagagaaggaaatttgataatctctcccttttatgtctttataggactcatggtttttccaaaaccagtgaccgcattggaatatacattcagtaggtctgatccaacttcgtatgcagggtacattgaagaccttaagaagtttctaaaacgtgagtatgttttcttagagtaaggtcagagattttagttatagaaattagtaccaaattgtgggccgggcacggtagctcacgcctgtaatcccagcactttgggaggccgaagcgggcagatcacctgaggttaggagccaggtcttggacctggccaacatggtgaaacccctggccaacatggtgaaaccccatctctaccaaaaatataaaattagctgggcgtggtagcacgcgcctgtaattccagctactcgggaggctgaggcagaataatcgcttgagcctgggaggcaaaggttgcagtgagccaagtttgcgccat

SEQ ID NO: 108638 - DNA, 1062 bp, Homo sapiens
gtcttcatgtcacaccctgtgggagtaccccactcctggataaagccatataattactggatgtagctcatccttctgtgcccctgcccctgagcagatactgagcaggactaattagcactgtgagtacttgagcacctccctcaaatggacttgcttaactgcctggtaatcctatggaatttctctggataattctctgaaaggattatttccaactttcactcaagcctctaaccccttacctttttccttacaactcactctcttcatataacctgatttcttgcttcaagagataatagaagaactcagatgggagctcctccagtttccccattaccagtaaaacaaatctacaatggcagccattttgtctgtcacattcttcctgctctgactgggggctgcccttcctttcacctgaggccacctgtgtcactcctgctttggatctcatcctctctcagtgtctcagaaacatactgtgtactctctcttcttgtgtgtatttagcctttctgtctgtattggatccttcctgtcaacttgaaaaaatcttcaactctctcctatcttaaaccaaaagctgcttctgatcccacattatctactagctgtcttcctaagtctcttttccttgacagttaaatatgtactcattatttaaaaaagacttttgtgaaagtattatccgtggtttaatagctttaaaaggtctgcaatgaagtgttccctgccctcctcccttccagcagaagtcctattaatttattgacatattttttgagggcctgctttgtggcaggcactcatttgggttccagcaatgaacagaagaaaaattcctgtctttctggagcttagactcatggtgaattagaagatagtacatcctgagggggaaaataaaacagaaaaaggagatagggtaagttgggaaggattgtggtttttacatgcagagtggtctgggaaagccttatggaaagggaaccttgagggaagagctgaaggaggtgaaagaactagccctggaaatgtccagcacaggaagcagta

SEQ ID NO: 108639 - DNA, 2662 bp, Homo sapiens
ttctatgagctagtctctcacctgggcggctttaatagtctcctaacttgttttccggatcctttctttttcccttctggactgactccacagaaaagtcagagttaatttcctaagtatgttcatactatccacttgccctggtttaaaacattttagtggattgttaattgatgtttggcaaaacacccacccacacccctcaaaattctttaacatagtttacaagactctatatggtctggcttctaccttccttcattggaagtgcttctcctagcttcattaactcccacatacccttctgcattcagctcagttgctttttttttttttagtgtaggttgtcataacactacatcttcatacctctgcaattctgattttatactcacttaatgactctcttccccacaaaaccgtaagctccatgagggcagcagcagtgcctttttacatcctctccattgtatcaccaagcatgcagaaggcattcagataatgctttagccatggctggtactgccacctaatggtgacagaagagatggatctataatccagtttgtatgattattgaaatgcagtaactttagagaactagttagctgttaaaaggtaaaggggcaaacttaacattctttccctaaagttatctggtaatttacattgctgtttttgtctttgaagaacattttccaaaggttaatatattcctggttgtttttagtaccttttttggctgatctagcacacatatatgtttcctttttagcatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagagtacgtacatattttacctctgctgctgcttttttctaatattctcttttaaggaggcaactatttttagattgttgtggttgggttaatgccttccttattaaaagttatcatttggggggtagcttgctttaaagactagcagtaatgtttattgatcactggaagaaagtttatatggcaaaaaaaagaggttcatagattaatcatggagtaaggagttaaagtaacttttaaacttttcttctttggaaatagctacatgcattccagcacacattaatgctccaaggggcaaatgttctccttgtcataaccaaagcagagacttgttagggtgcagtgctcatctgtgaatcctgtgttgtaaaataatttaaaattccacagactccataaagtttaaacttattaactttttcgaaatagtagcaaagcatagttttatagtatcagtatatatatatgtaattagataacagaaatacaaataaaatcccattctaacgagttcagtgggatgttgcagttgtatccaaagtagcagcattttgctgttttacagaagggtgcctaaattgtatagtaatgagcaaaggaagaagctaatgttctctgtgtgacaggagtaatgaattagggtcattgtgcaaaggaagatgatacggcttttcttgagtcatgaagtgatccctagcccccgtgccttgctgctctgtaaatgtacttcagagttgtgttctgatgcgcttactgttttgaggcctgcaaggtctcccttgaagagtgaagtcattcatggtcatttaaaacaggtgtagacttctcaaaatcatgagtttatgaatcactaaagtcatcattggtgagcaaattgccaccatccctaataaaagtaaaatttggatcttttgaagttggcactgctaaataagaagcttccctgtagggagaaccagctaggccctgaggtgcccagactgacacccctccaacctctgcttcatccctttgggaggccttggacaactgacagcttccagattgtcccatagcattctaggtgctcagtaaatgattagtggaatgtttcaaccagaccttattcagaattaagaattgaagttaacaaagtaagctgaaagtaatgtgaaactagatgatctagtttataaaatgaattaagtttgttttaacagagatgccttttgtaatcccagtctactagaagtatcctcacgacatctagattgctgaacatttgttcccagtagaaagccaggagaggatcaaccttctgggtttgttttctttctcaagatggtctccttgaatgataatggcctgagaccatgcttgctgatgactcagggcatggctttgtcaggaggacagcatcagacacacaggaatcattgatgagatgagcttacgtagtgtagcaggaggtttcataccagtatagttcccagttaggacgcaacaatacttgtcttttgagaggaatatttagattttacgtgcattcacgtggaaactgtgtataaattcagaatgccaaaaaattatctcacaaaatgtataaatatgtgagtttattcagttctgtcagctacatacacgaaaggagtcttaaaatagggctctcccagtgtgtgccttttggggagcagatgggttgtgagatacagtgaggctcagt

SEQ ID NO: 108640 - DNA, 1050 bp, Homo sapiens
aagggtacttttgtttcatttaattctttggtaatttatttattttctaaattgccccagtacagtaataagatatctgattgctgaagttattttatttaaaagttcattttaataccctcaaataagattaaagtaaaaggcagatgtatacagacttggtgttaatctcaaagtcttcaccccttgttcccagcaacagagggaggaagttccattgcatacttacgtgaagtttaaatttatcactatttcttaaccttagataattggattaaagcctgaaggagtgccaaggatagattgtgtttcaaaggttagtattcaaaaagtaactcctgttaaatctttgatgtttcttaaaatactttaaaagtctaatgatttagtcatcttttttttcttccctgtcacattttaaagtcctttgtagtgccttagaataaaattccaccaaccgtagtctttctcttccttaatgataattcagaaagacattttccatgtgtatttgattttgcacacattgcctttattttcacatataccgtatttcatcaattctaagattcactttttttctgccagctcagtaacactgaaattgggattacccttgtaattgatggtgtcttaatactgtatcatgacatttttctctttcttaatagttagttggcgtgctagtcatcagtgctatctgagatttaatgaaatatggtgcattttccttaaggtagaagcattatttatctcccctatccctacttacttttttttccagaatactgtgcagttttcatctcataactttcttttgttttctctccatgctgcaaatgccactaagacaaataatgtaaaagatgggtaagagttctgaggagacattaagttctaaatttatcattgtgctaaatattaacatttcaactctgattgtatggcagaaatattttacttagaatgttacattgaaatcacttttaaagttgtgaaaaaaaattctttttactgttaatggacttcttatttgggcagaaacttctt

SEQ ID NO: 108641 - DNA, 1035 bp, Homo sapiens
gggactctcatgaaagagagtatagagtgtatctggaagtgtaagtatcaggatagttcatgtggaaggggttagttagataatatttgcaatcaagatgagcaagcttcttctcagaaatacacttgtaatgataatatagttggagcagcattgtagtttctgcaaactgttcatgattgatattcctttaattataaacatagtttttacaaattctttttgtgacctaaagaggatttcttttgttttcaacttcagaatgaagatataccaaatgtagcagtttatcctcataatggaatgatagacttaaaatatttcccatattatgggaaaaaactgcatgtaagtattgagaagttcttatgtggtgattactcttttgggaagctggagcatgtgttgacgtaccacttgtctggggtaggtagacgccagccctgtttaatttgtgcgtcatctattcaggttttgttttattttaatggtgatggtaaatggagttcccacatttacaattcagaacacagaacccaagcagatacgttaaagttagatgattatttctaaaatatcattttctttttcattatagaggtagtagtaggtgcttatgtagagaaagtagaaaagtacttaaaaagaaaatcaaggccgggtgcggtggcttactcctgtaatcacagcactttgagaggccaaggcgggcgcattacctgaggtcaggagtttgagaccagcctggccaacttggcgaaaccccctctctactaaaaatacaaaaattagctgggcgtggtgacatgtgcctgtagtcccagctactcgggaggctgaggcaggagaatcgcttgaacccaggaggtggaggttgcagtgagccaagattgtaccaccacactccaggttgggtgacagaatgggattctgtttcccccaccaaaaaaataaatgaaaagaaaatcaaggccaggcgcagtggctcacctgtaatcccagcactttgggaggccgagtcgggcagatcacgag

SEQ ID NO: 108642 - DNA, 1928 bp, Homo sapiens
acaggtatggacttacagctccaaaaaattaaaaagaatgcagagaacagaaaataatagagctaaattttttttttaatttacaagccacgtatggtggctcacacctgtaatcccagcactttgggagggtgaggtggaagggccatttgaagcgaggagtttgagattagcctgggcagggagaccctgtctctacaaaaaaatttaaaaattagtgggctgtggcggcatgtgcctatagtcccagctacttaggaaactgaggtgggaggattggttgaggcttcaatgagccataattgcaccactgcactgcagcctgggcaacagtctcaaaaagaaaatttacagaataagccaattcctggtagagagaagtattaagtttccatagagtttgaattaatatattttccttttattgccaggttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctgttgtttattgttacttttctccttttttaaaaaaaaaaaaaggcagccgggcgcagtggctcacgcctgtagtcccagcactttgggaggccgaggcgggcggatcacaaggtcaagagatcgagaccatcctggccaacatggtggaatcccgtctctactaaaaatataaaaattagctgggcgtagtggtgcgtgcctgtagtcccagttactcgggaggctgaggcagaagaatcgcttgaacccaagaggcggaggttgcagtgagtcgagatcacaccactgcactccagcctggtgacagagcgagactctgtctgcaaaaaaaaaaaa

SEQ ID NO: 108643 - DNA, 1084 bp, Homo sapiens
accaaatgtcattacttttgtcttaaagaaaagtctatttcaagaatatgaacagcagtgtttccttgtacatgtcaccttttttcacattttcattaatcagaatgaccttattgagcctactcctggggtcaattgcatttcaaactaatccaatatttagtgtttcacagaaacactagaaaacgttgaacactcctactgcctggatatatggtagtgcagttatgttgtttatggctcaagatgtcattagaaatactgcagtggtgtattcacagctgctccttctctgaatgaaagagtgtagggacacctgccaccatggccagaccctgactgaatttcacattaaggctttggaaaggagcaaataataatgggagaattaactccaaaactttgacctgaatcatgtggatttgtcccaagattatgctagatgcaccaagcatggcccaaattggttcttttttaaatcccatgggggaagtgcaggctccttcctgtggtgcctctttatagcctcaccaccatgctaacactgagcatggtgaggaggaggaagctttggctagctaaacatgtttaataaggccataaaaactgagaaagaaaaacattcaactttagctgaagctcctttgatacaaaagtttcattctgtcagaaataagccatagtacagactcagagatagaggcagtttctagagaactcggtcttatcgtgggttctggagcacacctctcagaccagtcaggaacactggggaggtgacagcaggtccccaggggcctgcagggaatctttcagctgcacggattgggatttccctccaaaccaaactgtcctttaaggggcagcctcctcttttactaactccaccctttctcatctctgggacccagcagggacctggagaggccaacagccactgctacctttgtagtcttcaaaatattgaactgcaggtcccaagatgcatttcaggatttaagacaggtgcactaatgataaccattccttcaccaagtagcaacattcttgccagagttcttgggaaacctgtttttttctctac

SEQ ID NO: 108644 - DNA, 1035 bp, Homo sapiens
tgcaagggccccccgcctctccttgcccctcagcccacctgttccgtctccccacccagctttcctctctccacgctctccagcctgggtcctgctgtgtcattggaaggccagcagaatctgaataaagggcttactcaataaatcaccagaactttattttagcttactcccagtgaaaaggctcagggcgattaggcaggctctgtggttttgatctcttcgtgacctcatttgcagactgggatacagactttctggttagttcaaaggaagaaacatgtgcctctcgtgtgtaaaggggcagaatggcctgggtgggagtgtgagaaccattgtgtggatcctgtgataataggaaagaaatgtaggcttttccaattcattgtaaaaagagaatgtaatgtgttatgctcacaaacaagtaaatagctgtgttctgacagaaggtttctatagttctatatactaattaatattcagcacaagattctggctttaattttattttcttgtacagacttgtcgttatttaatgtatttaaagtctgctattcttcttagacttgaagtctcttttttttcccagctgtctcaaagaaaaaggttcataagacggttctaaaattagcatagtcatttagtttacttttttcctacgtgggaatggcctcttgtttggataccagagtttccaatctaaatcatatagtttcatttttttgtatagtaattgcaaaaagattttgattcaattaaatcatagctcattttggcagattacattttctgagtatgtgtttgggcttatagaatttctttttaggaattacttttaatgtatctaccacttattttgtaaagtggcagctgacagagactatactcattcattcagtaacttttttgtttttttgtttttttttgttttttttgagacagtcactcaggctggagtgcagtggcacgatctcagctcactgcaacctccgcctcctgggttcaagtgattctcctgcctcagtctctctagta

SEQ ID NO: 108645 - DNA, 1962 bp, Homo sapiens
gtggagggaaggaggctctgagtagcttgtacaagcttgttatccgacgtaggtccaaaaaccctttcagttactttggtgatgcagtctttccccataattagccaagaggctttccacaatgaggattacatttacaaaacgatctgcttttaacagatgcctgaaatcatccctgtggcaggcacccacttcagatttttttttttaagttgttattgtactttaatcaaattcatatactttagattacttaaattggtattttgcttcaaattataatttttgcttctaagataatctgttattcaaattatcttagatagggtataaagttttaccctcacatgattttaatagaatttcatgaccaggtgaaacctaccattgtccccaaaccctgtccctgcagggctgaggcccatgatgaaggtgctccaggcctagcctaggagtcggaaggactgtgtcttccttcttttgcctcttgattaacgtgtgttgggctgctgggaagctgggaatccaatttgggtactttccaaacatatttggaaacgtgcttgtattacatgtgacattttttcttaaaacattttactccttagcctctcaggacaggatttggggttgttttcacttgttgaaagtcttctatttattgcttatctgaagtaggctgtagctaacatttgactcatgaaaatgaagtaagcattcaaaatgtttttttcctcaaagctaacaggccaactcggaatagggatatcgtaatattaaagtagaaaggcttttcttttgtggcaaagctgtaggcaactttgagaagtactggatttagaataaaatttctatcctctgtttgtaacagagttagggctaaagtttgtgggtttctatcatctgtcagaggaatgttgttttaattgggaaagtgttttatttgagatgtcattcccctgacagagcagaatgactcatggctctctaaatggtagcaatttctagcactatagctggatttaggcccccattctgttacttaaactatagaatacaaaactattcagacctctccagcaccaccaaaaaccctttactttgtttcctgatgcaggtttgagtatcttttcaattttgacaacacctttgagatccatgatgacatagaagtactaaagcggatgggaatgtcgtttggcctggagtcaggcaaatgctctctggaggatctgaaacttgcgaaatccctggtgccaaaggctttagaaggttatatcacaggtatgttaactgatgctttcatgtgttgtccctgattaaatgttgaatccaaacttgttaaaacctttcttatagaaaattgcaaaattttagaacatctgtgcttgtgtcgacaaactgaaacctttaacactttaggaccattttttcaaaaattagattaaatagtttgtttcataacattatgaacttacatctatacaccacacattatatactattacatctaaattggctcactcagcactgaatttggctcttcagagagatcttgtaattcccagtacctagcttagagcctagttagagtaagctagtaaaagctcaatgagggagttttaaaaaatcttctcttagtgccctgtggatacttcaagggaaactttgggcaatttacaaaagaaagtaggtacatcctggccgggcgctgcagctcacacctgtaatcccagcactttgggaagccaagacgggtggatcacctgaggtcgggagttcgagaccagcctggccaacatggtgaaaccctgtctctactaaaaaaatacaaaaaattagccgggcgtgatggcacatatctgtaatcccagctactcaggaggctgaggcaggagaatcacttgaacctgggaggtggaggttgcaatgagctgagatcgccattgcactctagcctgg

SEQ ID NO: 108646 - DNA, 1928 bp, Homo sapiens
tgaaataaacaatactgatcataagattgctaaaatgtaaaaaataaatttatcactactgggtgacaagattataacaagctaatgaaggggaatgaatggctctgacttgaggaacttttaaaacgttatctgtttcttgagcagatgaaaaacttgaactgcatacagtctttctagctgtgaaattctatcgtacatttaccttattaaaaaaagggagatcacttgtttgtttgttggttggtttttctcagacagagttttgctcttgttgcccaggctggagtgcagtggtgcaatctcggcttactgcagcctccgtctaaaagggagatcactttctttggcttttgagtaatggttataactaaaagtagcggcaagatccagtaaaaaaatttaggccttgatgtatcttataattagtgctgagcctcagttacctcatctggaaatgtctggttggggaaggctggggctggattccaaactgtgcccagaggctgctgagaagttctgtggaggtgccttagaaaccatgtggctgtgcttgagggcagagatggcagagcttaggacctggcctcactgcagccagcctcaacagcaccacttccatctgttttacatgagtttttttttgttttgttttgagacagggtctcattctgtcacccaggctggaatggagtggtatgatctctgctcacagcaaattctgcctcctggattcaaacaatcctcccacctcagcctcctgggtagctgggactataggcacataccaccatgcccagctagtttttgtattttttgtagagatagggttttgccatgttgcccaggttggccttaaactcctggactcaagcaatcaacctgctttggcctcccaaagtgttgggattacaggcgtgagccactgtgcccagcctccctcgagattttatttgaagaaacaattttgtgcctttaaaatgtttgcatatccctgggctacacatcctaaagtttgggggcatatttgaccccaaactgtcaggagtctatgttagataaatggtatcacccttgctgtgtcatttgctgaagagttccaggtgcctactggttctttcccagattgtgaggtcctgtttctatggatgatggaaaaatgtatttattgagttggatcattctttcttaaatgtttaattttttaaattaattcattagtgcaggcgggatgtctctttaaactctaattttaaactatatttaaaggtattatcttaattcttttaaattccaactcacttatgcacaattgaccatattgtttttattgatcattacagcaaatcgctttcaaaaacctggtacagagaaatcgacaaaatgagcagcaaaaccagggcccgccggctctgaactctaccattcagctgccattcataatcatcaatacaagcagaaaaacagtcatagattgcagcatctccagtgacaagtgagtggagaactagggatgggtgcagggctggccttctgttaacattttcatatcatttgcaaactcaagaaggatgcactttattagttgcacccctcaaaggctggcttccttggggcacatgaaacacctcctgaaccatgggtgcaatcttccactagtgtgcgctccaaccctcaccctctgtggtcccctgtcttgtgccaggcactgtgctgtctgtattatatgtgtgtggcagtgtctgggcccaacctatgacgtgctgcatgtatgtggtaactctgagcaagtaactgtgataagttagcccagcactgtgggtctgggacaaggtagattcattggtgattcaccgtcatagtttattacggaaatattttaggtcaacatgtggcattaaaccaattatttctttgttttgctatat

SEQ ID NO: 108647 - DNA, 1013 bp, Homo sapiens
cacaggttatacaaggcaaatctctgaccccaaggtactgtcattctcaccggggagaagagaaatgtaaaagagttaccgaaaatgtgattactcctaagaaagaaatgtacagattctctgcaaagagggctgagggagggctttaccaaggagataatcccagagctcaggcatgaggtgggagtagtctgccaagtggataagggtggggagggccttcaaggcagaggtgccacatgggctgagacaggcatgagaaagcttgcctggagctgggtgtggctagggaacaggcatggagaaaggaggatagatatctaagtgttaagcagtggagacctgatcctgtaaacaaagggaagcagttgataaattacaaagagaagggttgataggatgttttttaaaggatcactctgccagtgggttggaaataaaattaacaggtagggaaggaaatggaatgggggaggcggattagagatggtctgagttacggcagcggccatgagattggagaggtgttttagaggtacaatcagtgcagcttgacctggttggatgagggacaggtaaggggcctggcttgtcagagcttctgataaagggatgctcctacaacatcttttcaaatgcagaacgccacacagattttacagtgaatcttaagtaatttaaaagtaaaacgtggtggatagaggaaccatgaatggaaactgctagtatagactagactggatgtggagcaagtaagagataatctgctggagcagacaagaaaaatgtcttatttgatgattgaaagacaaaattgtaacaaatttagtttaaagatcttaattgccttttatttgtgattctagaatctggcaacacctcactagtaagtagaatgagtattcctataagctgagcagaagaggttgaacattcttcagtgttttaaagatagagaagcagcaaaggcggatagaggcagaaacagaacaaaaagcagactggacatatca

SEQ ID NO: 108648 - DNA, 1194 bp, Homo sapiens
gtatattttatatacgtgtgtatgtgtgtatttctttgactaatatatgtcttactggaagaatgcttatatcagaaatctggcccactggcttggtgcagtggctcacacctgtaatcccagcactttgggaggccgaggcagaaggatcacttgagcccaggagtttgagaccagcctgggtaacatagtgagactctgtctttacaaaaacttagccgggcatggtgatgtgtacctgtagtcccagctattcaggaggccagtgtaggaggattgcttgagcctggaaggttgaggctgcagtgagccataatcatgccactgtactccagcctgggtgacagaatgagaccttgtctcaaaagaaaaaaaagtattctgacccaccagtacaagaacttacacaggaaccagcagtatctttcaatatgtctctttgaacaatatcttgtggtatatagagatacatgctgaaatgtctacggatgaaattatatgatgtctggaattggcttcaaaataatccactaggagaaggagggtaaagtgggtggtattatagataaaacaatattgtcttaagttgattatttgtttaagttaggtaatatttctgtggggtttcattattcctttcctttctcttttgtgtgtatttgaaatttttcattataaactgtaggaaaaagatctattacaatacaaatagctatgagagaaacatcagcttccttaaagggtttatgtctaaggtgggagacgtactctagagcagaggtccccaattcccaggctgtgagctcatggcctgttaggaaccaggctgcatagcagaaggtgagcggccagcaagtgagcattagattctcataggagggcgaaccctattgtgaactgcacatgggagggatctgggttgtgcagtcctttagagaatttaatgcctgattatctgaggtggaacagtttcatcctgaaaccatccatctctctccacccccatccatggaaaaattgtcttccacgaaactggtccctggtaccaaaaaaggttggggaccactgttctagagagcaggctagagacatctatattccaatataaaaatgtctagcttattttatttattttttttttggtggcagagtctcactctgttgcccaggctggagtgcagtggcatgatcttg

SEQ ID NO: 108649 - DNA, 2909 bp, Homo sapiens
ttgaggtttttgaggtttagttgaggttgtataataacaaaaaggtataaactgatccttttgaagttattataatacatgtatttaaatggttatattgtatcaagcatggaatttattaaaggctgtctttgccttctttgctttctttttaaagtagaacaccaacaagttttgcctctgtcatcttcctatagcagaagagtttaaaaaggaggggggagttattagtaatggcacaataaactcttcaacaaatcaacaagttggatatttaacattatttgtgagcaactgaagagccataacatatagttatttgttgcaaattttgttggaaagtattgtctttatttctaactgaaaagtgataagaagctggacaaagttaagtatctgcactattatctacatagaattaagaggccattttctagatgacttagtctcagctactgtcataaaaatttgatgatgatagattctagagatttgcatcaaaatcacttgttaggatatgaaaaatatgtaaaaatattactgctaacatacttcttgacagaaagaaacagctattagtagagcatttgaattcttagtagagcattgaattatcaaataatgaaataattagctcttacattgatattataaactatcaaataattgcttatgaaaaatataaatacagccaggcgtggtggctcacgcctgtaatcccagtactttgggaggccaagacgggtggatcacttgaggacaggagtttgagaccagcctgaccaacatggtgaaaccctgtctctactgaaaatacataattagctgggcgtggtggtggacgcctgtaatcccagctacttgggaggttgaggcaggagaattgcttgaacccgggacgcagaggttacagtaagccgagattgtgccactgcactccagcctgagcaacaaaaacgaaactccatctgaaaaaaaaaagaagaagaaaaatataagtagtcagtgtttagaacaataagtggatagttataaagttataaagctttgtgtgctttaaaatcttttcagattgctggagatctgatgtgctgcacagtgatgataattaatagtactgtattgtgtgcttgtaatttgctaaaaggatagatcttaaattgaatcttcgcaacacacatatacacaataatagctatatagaggtaatggatatgtcagcttgactgtggtgatcattttacaatgtatacatatatcaaaacatcaagatgtacaccttaagtgtatgccatttttatatatcaatgatatctcagtaaaggggttaaaaaatcctttccatgtggtagtgtcttgaaagtatagtttgagggctgggcgtggtgactgatgcctgtaatcccagcactttgggaagctacggtgggcagatcacttgaggtcaggagttcgagaccagcctggccaacatggtgaaaccccttctctactaaaaatacaaaaattagctgggcgtggtggcaggtgcctgtaatcccagctacctgggaggctgaggcaggagaatcacttgaacccgggaggcggaggttgcagtgagccaagatggtgccattgcactccagcctgggccacaagagtgaaacgccatctcaaaaaaaaaaaaaaaagtacagtttgaggtatcataccacaaacttgtgatgttacaagttagtgtaatgtaacaaaattgtaatgtttcaaggttacaaatcttcaatgcttacaaaaagtatttgatagtaataatagagccaatttttggatgtttgcgttctgccaagttttcaaaaattgagggttttttttcctccaggctttgtaatatatttctgatattctgtttgatgatattcctgtattcagctctgtgatgccaagtagtgtagtggatattaccttaaatgaaataaattatctaaaagtgaattcataaatacttgctgtgggtagtccctcaagtataatactgacagtaacgtatgctgacatggattgagcagtatgtgccaaatcctgtgctatatgctttacatgaattatctcatttagtctttataacaacctgaattgctaagtactggtatcaccctccaatttacagatgaggaaatgcatgacttgaccaaggccaaacccctagtaggcttgatggtccagaatatgaatccaagcagttggacttaaggccaatgtattttacttctgcattgtggtattaatggtctttatttgattcctcacatgtcatagtattgaaagcattttagatagtgattaagaatagtacaaattaagggcaacagtggggatggaattttgaaatatctattggcaacttcatggctgccacattacttacttgctttcaaagaactgtcagtaaaatctgtaaaatctcagttctgctcataagtaatagtatttcattaatttttatcttaagctggacaattcatattcccctcaccttttttttttttgagacagggtctcactctgtcatccaggctggagtgcagtggcatgatctcagctcactgcaacacctctgcctcccaggctcaagcaatcctccgacctcagcctcccaagtagttgggactacaggcaatattcttccccttttaaataatatgtcaacatttcattttaaaataatactcctgtggttaatataattaattcatttgatgtggctatatatatttgatatggatgtctgatggaagatataaaatagcttgttaagtgaacacatactacttaatattctatttttaactttttaaacggttttattcaggttggtttgacttccacaaatgcagaagtaagaggatttatagatcagaatctcagtc

SEQ ID NO: 108650 - DNA, 1640 bp, Homo sapiens
aaatggggattaagatggtacaaacctcatagtgttgttgtgaagattaatttagacagttcacttagataacaatgcatgtcacatagtaaatatgacataaatgttgcctattattattattacattactattccctctgttttcctttaacaggttgttcttttaaagaattattgaagacgaaggtttttttctttttatttttttaatggctttacagaatcttaaatagaatacagtttgacatgacggcaaaaaatgtaagtatttgtaaattttttaatgtaagtattgtttaaagtgagctgtgctttttcctacatattttctcaccattctggttaaccagatttaatttacttgcatggatttataattgtatttgtttatgtttatgcagaatatgagataagctttaatgcgattgaatatggtgccctaatggagatagtagcattcttgcaaattggcaccaagttacttctcaacagctgcaaattgctatctccagaaggtttcccaccctgccctcctcttttggatattgtaataaatttgttttggtacttgctggagggttacttggcctttttgagcaaatcactgttttctttggcttattttttttttttttttttggttactcagggaaatgtatgtgctcagatattgtctgaaagtagcttgctaccttccatgagatggttcctgaagaaacattagattttagatgttttggagaagttattcaagtttttccctctacttgaggtgatcatttctgaatatacctcctttcaagttgtatgtcactctttatttatttatttgtcactgtttattaatgagtttgtttccagttatggtaaagaattgtgccttaaagagtacaacatataggggaattatttgtaaattgctttactgttccaatgttatatgtattaaagtctaattgctttactgttcctatattattatgtaggaatctttgactgggaattaaacaaaaagggaatttgttataaagatgcagggatatctcaaggaatttaagagtgggaattttatgggccctcagaaagatccaggcccagaaactagaaatccagcaggaattgaagcagtatttggttttcatttctcatctctctcagcttgttactgtgtacctgcttcatttctccctctgtctgtctgtccaaatcatctttctcagttccccagccaggatggtggaacatggccccactcagcatttccatctatatgttaggggaccagcctgttcagagagaggtgtgaagaaagggaaggaggcaggccaggcatggtggctcacgcctgtaatcccagcactttgggaggccaaggtgggcagatcacctgaggtcaggagttcgagaccagcctggccaacatggtgaaaccccgtctctactaaaaatacaaaaagtagccaggcgcggtgacagacgcctgtaattccagctactcgggaggctgaggcaggagaatcccttgaacccgggaggcggaggttgcagtaagctgagattaccccattgcactccagcctgggggacaagagcgagacttcgtctcaagaaaaaaaaagggaaggaggtagcttgatg

SEQ ID NO: 108651 - DNA, 1092 bp, Homo sapiens
ttcagtgtcctgaccaagatcacaggttgaattcagttttcatatgtttttagtctttttttaaattttttatttatttaattttttttgagaaggagtctctttctgtttcccaggctggagtgcaatggcgcgttctcggctcactacaacctccacctcctgagttcaagcaattctcctgcctcaacctcccaagtagccaggactacagacacgcaccaccacacccagctaatttttttgtatttttagtagagaaggggtttcaccatgttggccaggctggtctcgaactcctgacctcaggtgatccactcgcctcagcctcccaaagtgctgggattacaggcgtgagccgctgcgcccagcagtttttagtctttttaaatctggaaagtttctcagcctttctttgccattcatgacactaacattttttgaagaattcaggccattattttgtagaatgcctctcaatttggatttctctgatatttcctcatgattaaatttagattttgcatattgggcaaacgtacctcagaattcatgctgtatccatctcagtgcgcttgaagagacacatgttggcttgccccattattggtaatcatttggtaactttgatcacttggctaaagtgatttatgccatatttctttcactagaaaatttgaattagtaggtattttgtagggagatatttcaacgctatggaaatatcctatttttcaccatattttcactgactagttttactgtgtattaattattcttttcttattagttatgatggttccaaaatggaagttttactaactgtatcactcatttatatttattagttggcgttctactgcaaagaatttctcatctccccctttagccccagtaatcctggattattattttattcaatgggtttataatctgttactatcattatgtactttggtgttcagttgttgaaaattgtccagctgtaggctctattcaatgggtttataatctgttactatcagtatgtactttggtgttcagttgttgaaaattgtccagctgtaggctctttaagctgatttctgtgta

SEQ ID NO: 108652 - DNA, 1020 bp, Homo sapiens
ggaggctgaggcaggaggattgcttgaatccaggaggtagaggttgcagtgagctgagattgagcaactgcactccagcctgggtgacagagcaagactccgtctcgaaaaaaaaaaaaagaaaagaaaaaaaagaaaatatcttctaattaataccacatctcaaaagtttgaatgcacagagagaatactgaaaggatttatgccaataagttattgtagttgcttctgacaagtaggattatggctgatatttgtttcttgctttttgttttgtgtattttctaaattatgagtcatgagcatgtatttaaaattagtaacatctgccatttaaatatgctacctttcctattaatttttagtagcagcttttttggcagtgttagaaagtctacacatcctgattcaaattatgttactgcttgattctacaaatttatccataactttgtgctttcttccttgtattttgattaattttaaaaggctttgtggctggagctgctaaattgtgattggaatgggaaagggcttgcattttgagaccatctgtgggagttgcattgtctgaaactgacgagatcatggcagatggcgaggtcaaaagattgactttttgagcttgacataatgtgttcatgaagctggaagaagaaatccaacttatttttttaactaacagaagagcttggtgacaggaagaagtgtgcaattgttgagtctggataaaacataatgcatcagtgcacatgactggtttatctctgagaatcatccatactgccaaagatggcaacttcttgaacctttctgtgccaaatttatttaatttctagacactttggaaagtttaagtcatacaatgcaaataatttatagattaaagacaatgtcaaaaaagacaaaaactttaaaactatttagaaatgtgtatttttaaattaaaatgctataaagtatcactcaaagccaatacagcatacttaatttttaattgaatgaagaaagtctctatca

SEQ ID NO: 108653 - DNA, 1183 bp, Homo sapiens
gtgaaacaccatctctactaaaaatacaaaattagccaggggtgctggcgcatgcctttaaccccagctacttgggaggctgaggcaggaggatcgcttgaacccaggggccagaggtttcactgagccgagatcgcaccgttgccctctagcctgggtgacagcgagactccatctcaaaaaaaaaaaaaaatgtagcttactgacatttcagatgtgtgatgtgttaaatgtctgcatggcctttcattttctgctgccaagtcatactgaatgggattctcgtacatttttaaaggatggaaataaataaaatactgagtctataattcatttaacaaatatttcttgagcttcaaccatatgccaggcatttgatatgtaagggtgaacaaaatgcacagggttcctgtgctcaaggaatttatactttagttggcagagacagaccacaatctgattatcacagaaataaatagacaatggcaacccagtgtgtactattaaaggagaaagtaggagagcaataggttgataccccttacctagactgggtagtagaaaacggatgtttttcccggaggaagtgacacttgagaaaggatctaaaggaagatgagtttgtcaggtaaaggttccagacagaaggaacagcatgtacagaggcccttgaggcaggaggagcacggttttgaacttacagaagccaatggaactggatcagaaaagaggtgtgggaaaggagtttaatagagctggagaggtaggcatataccacatcagcatcctagacaacattaaagatttgagtcattaaaatgtcattactgtcaccagtttagattatgaaatctaaatatctgtcagtagaggctagtcaaataaatcacagtataacgatgtaaaggaatactgtgtagctgtgaaaaaagtgaatgaggaaatttacaactgtcaagttgaaatatagagacaaatctctgagattaaaatattttatttgagaagaaaattgcaggccaggcatggtggctcatgcctgtaatcctagcactttgggaggccgaggtgggcgggtcacttgaggtcaggagtttgaaaccagcctggccaacatggtgaaaccccgtctctactaaaaataagaaaattagccatgcgtggtggcaggctcctgtaatcc

SEQ ID NO: 108654 - DNA, 1117 bp, Homo sapiens
agttgatgggtgcagcaaagcaacatggcacatgtatacctgtgtaacaaacctgcatgttgtgcacatgtaccctagaacttaaagtataataataataaaaaagaaaaaagaaattaaacatatgtaggctaaaaggaaatatggacgtcaagaaatgacatatagttttaaggttttgatgacagaagagaaaaatgctagaagttttcccaaaggtaggaaaaataaaaacataatagttctgggcacagtggcacagcctatagtcccagctacttgtgaggctgaagtgagaggattgcttgagcccagggattcaaggctgtagtatgctatgatcctgcctatgtatagctactgctttctagcctgggcgatgtagtaagaccccatatcttcaaaacaaaacaaaaactgtaatagcgataatagtgacaatgtctgttgttagtcacagagcaggagtaccatgtctggaaaaacgattgtacttcatggaaatgctgtggctaatgatgctgttatgaacaagggatattggtatgtctggtaaattgaatatggagccagaaaagttactgtgtttgagaataaaagtgatagtacatgtctctgtcatcaaactaggaaatgtagcacagacagattttttttctttttgcttaactgtaggtatataataaagtgttctgacaaactgttaaacagagccttgatagactatgtatctaggtttgtctgttgtctttctatctacctatctatgtgttaatattaggagcttctgacttatttaatacttcttcctgtttgtataaaattaactgcagtaattaactcagattggctgtgagcaaaaacagaactattacagtaatttgacttactaatttatgtaaaacattttctgccttttaaaaatcatcttaattaatgcaagggtagagtaattatcagcccaccaactatttatttattaggattcccattgctgtaggcagaataaagcaatttttcatattgtgactaatggcaattttgattaattttgcgcaattagcttacatctatcttaagtaaccagtctgcttttggtaaaattttcatgtctgaa

SEQ ID NO: 108655 - DNA, 1034 bp, Homo sapiens
ttgacttgcacaacctacttttttttttttctgggccatgtgttttctcttcatggcttgaatttatcttcacctaataaataatttacctgttttttttttcagctcgtgaatatatattcatctattttctatatggcataatcatgtccctgtctctctttaaaagtagatataaaaatagtttaattgatctatattgcagcttccttttccatttcattgtttagcctgttatttagctaaactttatcactatcagattactgtaattaatctttaatggcagtgtccattctcagacagcaccaggagaaaaatcaaatgcctagaccccagattctgtcacacttgtgtactggctctggatgtgtttgttatttattagaacatcttgtgcctgtaactagtctagtctaagagtagacatggtgtctgtagcgttgttctggctgtgcagttgcagtttgagcactgtggcccttacatttgttaataaaaggttcaagacttactaaactcttacttttcagttctcttcatttctaggtgtttaaaaaggaaagctgaatttttgcagtgtgtaatacttcatattctcattttgtgatcatgtaattcctcccaccctgactcttgtgaatgtgtagtccaagtggcacatggaagtttttctctggcagctaaaattcttaactgtctgagccgtgtgccctcaatataactgatgaagtgggatgtacttccttgtcatcatcttttaaactcttattgcaatatgtgttataatggatctcagaagaaactagaaggcatagattgagagttcttttagatcatagaattttaaattgtagtggattttaaagagaatcaaatacactcacctcttcatacttaaatcctttccgttttaatctgggatacatgactctaggtgtgcggcatgaatagatatgaaagtaggcttgtgaactcttggaaatattatgcaaaattatgcatatttgtatattttttggagagactattta

SEQ ID NO: 108656 - DNA, 1401 bp, Homo sapiens
ttggtggttttttctttttaaatcccctttccaagtaaaaggaatcttttttttttttttaagttttgaagcctcatagccataaatattttggcaccagcatctattggcacctaagtcattggctgtatcatattcccatgggacccttgttcctagaggaatgcaggaatgatcttggagtgggaaggacagaaacaggtgcttgcaaaatcagatatttctgaaattctctgttattctatttctactgtctttccccactttactataaatttgatctgttataaaatggctgtgtttagatagatacccgtgatgtttaggaaacaaatgatatagagactcccatttaaatgaatcttatctttataagaaacagccaaactgttttccagactggctataccatcttacattcccaccaggaatgtatgagtgatccagtttctctgcatgctcgccagcatttggtgttgtcactatttcttatttcaaccattctgtttatccttttcagtgaaatatctgttcatatcttttgcccatttgccaattgaggcaggaggatcacttgagcccaggagttcgaggctgcagtgagatatgatcactaaatgtttgcttaatgagccatatctttaaatatcttttttaaagtttttaaaagtcagtccagtggtttatgtgattatgtgggattttttaaatctttccaggcaaaatgtgtatagcattttgaacatatttacactgtactgagcccaagagttctcatattctttctttgctcattatagagtatggtactaatactgtataatagtaaattttcaaagatacctttatttagaatgttagagtatacagatatatactttgtacatagttatcataatgtttctaacctttttatttaaagcaggctgatttgtgtaaaggtttcagaatgattttgttaataagttattagaaactttcctatttgtacaagatggtaaatgtagattccaatttgtatgcctcagtaaattcataatcttatttctctgatgtgagccactgtgcctggccttctgtgatgctcttaatgaattttgcagttttattaaattgtcattgagaacctcataaatcattgttaagatctatacaaaaaatcaaggatccacagtaatagaatatttttcatctgcatatgaatttttcccttccctttttgtctacttttagatttaaaaaaaattaccaggacattcttattaaatactattacctgttttggtttctgcacattaagaaagtcacagagaagccagacacagtggcatgctcttctattcccagctactcaggaggctgaggctggagaatcacttgagcccaggagtttgaggatat

SEQ ID NO: 108657 - DNA, 1765 bp, Homo sapiens
tctcctgggctcaagcagtcctcctgcctcagcctcccaagtagctgggatttcaggtatacgtcactacgcccagctgatttttgtatttttagtagagacagggttttaccatgttggccaggctggtctcaaactcctgaccttgtgacccacccacctcggcctcccaaagtgctaggattacaggcgtgagccaccatgcctggcttgtcctttctgtcttccaagtttgtttttcatttgtatgctaatatttgaagtttagaaaaatttgtgctacttctcagcatgttttattttcccattatagatctatcagatatttttagaaggtctgcaactgtctgataaaggaagagaatgttcctgttcaatctatcttaaagtgctactaattgcttttatactatagacatactgattttttcatcttttttatccaaccatggcatggtttcctaatctcagcattgacattttggactggataaatctttattttgggatgctatgctgtactttataggatgtttagcaatatccctgacctctgccctctagctacaagtaccatccccctagttgttatggccaaaaatgtcttcaaacattgccattctgagaggcaaaattgcccccagttgagagccactgatacaggctgttagaagaaaatcgaagactcagtgaatatagtgtcatactccttttctttctgcctcattttaccttaggaaatggttgttagcaaaaaaattagttaatcgtatcttgaaataaatagggtatctattttgctgattaataaagaaaaaataaatctcagctgggcacagtggctcacacctgtaatcctagcactttgggaggccaaggcaggcggatcacttcagctcaggagtttgagaccagcctgggcaacctggcgaatccctatctctacaaaaaatacacaaattagctgggtgtggtgacacacacatatagtcccagctaattagggggctgaggtgggaagatcacttgagctccaggaggtggaggctgcagtgagccaagttggtgtcactgtactctagcctgggtggcaaagtgagaccctgtctcaatcaatcaatcaatcaatcaatcaatatctcatgctgtaattgtcttctgatgttttcatccacccagccccacctctgcagccttaattactggagtaggtccatgatttcagtgtagggttaatgtattctgcagatcatctttgatttgacctgcttttttgcttcctttttatctctgaacaaaggagatcatcattctctttaatctgccttctgtgtaaatctctaccagactggaagctccctgaaagcagaaactgtctgcttccccagaacttagcactgtgctttcatgtatgtgggataaatttttactttgttagtgcaactttgtttgtacacgttatccttgatattacatacatttgttgatgggggcaatttatatttgttgtgagtaaaatacttttttgttggattaagaagaactatactcttcccagcactttgggaggccaaggaggacggattacctgaggttagtagcttgagaccagcctgaccaacatggagaaaccccatctctattaaaactacaaaaaaattagctgtgcgttgtggcacatgcctgtaatcccagctagtcaggaggctgaggcaggagaaccgcttgaacccctgaggcagaggttgcggttgagccgagatcg

SEQ ID NO: 108658 - DNA, 1028 bp, Homo sapiens
taagtggtagctgctatgagctaccactcatttcttttttagatcctgaataattcatctttatgattattgaggatttcaaaaataatttctgcttagctccttcacaacaaaattcttttttttttaatttgtatttttatcgagacagagtcttgctgtgtcactcaggctggagtgcagtggcatgatctcggctcactgcaacctctactgcctgggttcaagtgattctcatgcctcactatcccgagtagttgtgactacagacatgcaccaccacgcccagctaatttttttgtatttttagtaatgatggggtttcgccatgttggccagggtggtattgaactcctgacctcaggtgatccgccctcttcagcctcccacagtgctgggattacaggtgtgagccaacgcgcccagctacaacaaaattcttggtcataggaattcagagaggaaaggagagctaattgtggatttatggagaatataatacaatatcaaatttgggtgcatcttggcacccatatgtgtagtatatcaatttttaaaatctcttttttgggtgtatatcctttgggcatgtaagcatcaaacttctcgactttcttttctgtaatatctaagtgaatttttatgttgccttagtttattatacctggcttgttttgaactagtcctaagacaaacaaggacaggtgagaaaattggtggcagaaataaggaaaatgtttaaagattacccagtaaggttctctgtcattaggttaatgctaagtgatttaattttagaattaaaaagtaaaatttataaaataaaatcaaggatttcaggaaaaaaatgtggcccactgaaaaagaatgatacttttgttgtagtaattcatcttacatattttgttccccacagggcagatggaggagtttgtaagaatggttttgtcatgcagatgacttcagacctgattaatgagaatatagacagacctgccgacattgacatgtcatgcctgggtgcagct

SEQ ID NO: 108659 - DNA, 1036 bp, Homo sapiens
gacccttttaagtgagcaatcttttacattatattcataataaatgttgatgcaggtaaatactatcatgtaacataattctgtttgtgcctctctaacctcttcattttgttttagggttttttgttgtttgtttgtttttgcagaccttttcacagatgctgctgagactgaaaaaatggccaaaagtttggaggattctgaaggagtttgttttgttccatcttttagtggattacaggtatgtattttttaaagttaatggcaatcacaaatatttttctcctcctgccacatccaaacttatatatctaccattctgttaccttaaaatttgagcactgaacagaactaagatgaaaggtagattttagggctgagaagttatgctctgaccaagcatgaattccatgaggaagcagagcatcctgaatgtggccctgctggcttggcttgtgctggtagaattcagctgacttctgcttagaactgtgtggaacctaagagttggcaggtttatcatagaacttttacataagacttagcattactttatcatgaccaaaaatagccatttcacagtggggggaatgtatcagtaaatttgcattctttacttagaggaaataagccattgagaattaagataaataatgtcaaggtacatacatcacacacatatgcacacacatgtatatgtatgtgtatattttgcacttgtacatttgtaagttttaaactttttttaaaaatcaaaatcttggctgggcgcggtggctcacgcctataatcccagcactttgggaggccgaggcgggtggatcacaaggtcaggagatcgagaccatcttggctaacaaggtgaaaccccatctctactaaaaatgcaaaaaattagccatgcatagtggcacgtgcctgtagtccaagctactcaggaggctgaagcaggagaattgcttgaacctgggaggtggaggttgcagtgagccgagatgccactgcactccagcctgggtgacagagcgagagtccg

SEQ ID NO: 108660 - DNA, 1037 bp, Homo sapiens
tggatcaagagatcgagaccacctggctaacatggtgaaactccatgtctactaaaaatacaaaaattagcttggcgtggtggcgcgcatctgtagtcccagttacttgggaggctgaggcaggagaatggcatgaacccaggaggtggaggttgcagtgagcccagatcacgccactgcactccagcctggcgacagagtaagactccgtctcaatgaaaaagaattagctggatgtggtggtgtgcgcctgtagtcctagctgccttgtagtcctagctacttgggaggctgaggtgggaggatcacttgagtccagaagtttgaggctgcagtgagctgtgatcttactgcactctagcctgggtgacagagcaagaccctgtctctaaaaaacaaaacaaaacaacaacaaaccaaaataaaaacaattcctgaggcatgtcagttatctgcagagtattagtcctagggagactcctatcctatggttgttgctccctattctctttgggatttttttttttaattttaaggaaaaggaaaaagaaacgaagatgtttaatcatgagagtacaataagtgagacaatgctctataataaaattggccactgttaagggcaatgggtttacatttgaacatttttggtaggttgctgaccagcaatcagccatgtttggagagtgctgcttccagacaggtgatgtgaaattaaccatgggaactgggacatttttggatattaacactggaaatagccttcaacagactactggaggtaagtagttaggatttatcctatttattaataaaatatcacttctgttcatatttaacttctgtgatacttatactattttcccattttgtgatattctctaacatattttattattcttaaagacagttaattatcatttccctttcttttccctttaagtgaaaagcataaaaaacaagaatgatattgttgaaaaattcaggatatatggtcagctttctgggtatttttctataacacatgttgtatttgt

SEQ ID NO: 108661 - DNA, 1671 bp, Homo sapiens
tagttctgtcacgcttcttcccattatttagagcacagttttttaaagcaactgtacaatttctcagccttatgagcttgctgtatttcttggtatcatgttgcttccaaattttgtttttactgtagaagacaattaatttattgtagagaagtggctgtgaaagtcgttctctgtctttaaaaatcaattgcagaagttcatttgtcatttttctagagataaattatagtactcaaactggcagtgctcagtatatacattttgtaagctttgtcagtgaaaccatcagttttgcaggagcttcctttcctagtcaagataaagcttaaaattccagaaattaatgtcgttcggactgactttattcatatttccatcaaacttctccaatacagtaagagatagtgttgaaccagcatcaagtctccagaaacatggcagagcagacaggccgttaagtttcacagacatcatagatccttttcttaaagaagaaaaacatgtataaaatagttttagtagtccaaaatgtcaactatctgtagctgcttttgtgtgtgtgtcagtgaacaaataataatgccttgctcaatcaatgcattcagccatctcaagtgcaatttgtgaaggagactatggtttccaaaagatacatttttttacaaagttaaacctgtaaaaagtctttttttttttccctccagccgtacaccaactgcacttggttgtttcagcagttggtatactattaaattgtccaggccaaataggtttctgtagctgttttagtaatttgaagccaaattctcatgctgtttctcattaaaaagaatgagaatttggtccatagttagctttaagttctctcttcctttctttcccttacagttaagggtttggtgggggatggggaggttgttttcgttttttggatttttttgtcttttggctttaagtatcatattttcttttgcctgtatccaactgcttctttgagtattttcatctagtttaatgtgagtaatagatgctgtgctgtcattgaagtgttcaacattttgttcatttaaacaaaagtgtaattcatacatatatagatacatatcttaattgatttctcaactattttataagtaactggaatttttcattagatcttatacagagaagtattttattaaaaattcaaaagggaagacttttatgtgctcattttgtaatttttgattttaaatatctttacattgtctgccaattaaagtgttttaaacttgcattggaatggactccgaatgtatttttgtggtgttacgttatccgtagatttctagcatgaagttagcctcacgatgctgtgcaaaggattttaaaatatgagagtcactgaaagagtttaaacatctgttcatgttaaatgctctatggattttaattaaagacttgagaatgattttataagctgtttgttcttttattactatgctgatatcaaaagtagaaacattagtctttttgtttgtttgtttttgagacagaatcttgctctgtcgcccaggctggagatctcggctccctgcagccttcacctcccaggttcaagcgattctcttgcctcagcctcctgagtacctgggactacaggcacatgccaccatgcctggccaattt

SEQ ID NO: 108662 - DNA, 1235 bp, Homo sapiens
ttttacactatcattgaggaataattacatggagcatgaaatttgggcctccagtataacttactgaatgtggattttatttctctttttaatgatgtaagaaaattgtcaggagaatggctcttatttatgtgtgttttaacttatgctttgttgcctctgagggtctttagacctgctgtgaaaggatcacatttgttgtggtgctgccagttttgctttattctaaattttgtaccaaagcaactttagaataatcagaatatttcatctaactgcttagaactataaatagcattctaaatttgagtaaatacaattttttaggttactcaagaaccagcattagtaatttctagtaaaattgtttcaaaatctacagggtacaatgattacaaattaatcttctaacaaaataaaatatgaaatattagtcatgttaattaataaactgtattattttgtatagctttttatttgcttacctgacattttatgagagcttcatagttggtcggtatgtagtgcttcttgggactgaagaaattctaattgttgtttaagttccaaggtgtgctacaatataggaggcacagtcatcagtttgtgacatacattatttactgcctatttcattctgattctatatttttagctttatgctgaactgttcaatgatgctgggattctctctttgcatgtcatatgtgaatgtgtggttcaagctgtaactgttgaaattattttagaatttatgacgatttctcagcagggcctatgtttatatatatatatatatttattctttagtttttgtgatatgcttatatttttaaggaagtaagttatagcatacttttttaaaagtaggaaccacaatctttatatggagcagcttgttatatctgattttcatgtaactcattggaaactctgccatgactcttaaagtagtcttacttgttttttaaaatgctggtattaaactaaatggactcctttcactaactgctgatttcagagtttaaatgttagcaggatatttgtgtattagcagtgccttcagtataagagagaaatattcattatctgtcatttatcatagtcgtataagtttccatgattttattttctgttattttcataagttcagatgtttatcagttcccaacattgtttctttatctgtagtgggatcttgagtaatgaggctcaagtaaatcctcaatgtgtat

SEQ ID NO: 108663 - DNA, 1049 bp, Homo sapiens
atttttttggagaaggatctcactctgtagcccaggctggaacgcagcccatgcacaatctcgactccctgcagccttgacttcctgggctcaagtgatcctcccatcttagactcccgagtacctgaggctacaggcatgtgccaccatgcctgtctagtttttgtaatttttttgtagagatggggttttgccatggtctcgaaccctaggtctctaccgatccacctgcctcggcctcccaaagtgctgatattacagttgtgagccactgcacacagcccaagaattttaaatattttgtttgtaactaagtcctttgaattactaaagtcttacttggcaattataagtggaagtcacagatcagctgtgattgacaaatattaacagcatgcatggtttatggtaatttccaacactagctaattttttgcctacattattaattagtgatgcttttattcctaacaggttactaaaaaaagggttgcaaacaaaaagaactttgagaataaggaagcccagagttctcaagccactccagttcagactagccagccagattcttccaacattgtcaaagtaagtccacgggagagctcatcagcttctttgaagtcctctccgattgctcaacctgcatcttcttttcaagttgaaactgcctctcaaggccatagtatatctcaccataagtcaacaccaatctcttcttcaagaagaaaatcaagaaaactggctgttaattttggtgtttctaaaccttctgagtaaatttggctcttagaattaagttaatttcttctctttccatctacctttttataaatacatatctatgtctcataaaaattagaatgtactattttaaaataatatgtgtaaattgaaatttttttcatttttaagttatcaggcacttttcatgctgtttaaaagactgtgtatcaaattgtgcactttaagtatgtgcagtttgttgtatgtcaattatacctcaataaatctgtaataaaaaactaaattaaaccttgcattaaaataat

SEQ ID NO: 108664 - DNA, 1028 bp, Homo sapiens
tgccatggttcgtattttgtaggaactttcttactgtggtaatttctcgactgttgaccatgcagacatatcccatgcaagtgttcaaacacttccatcatggaggctggtatgttacatcattattgtcatcttgtgaggaaaccaggctgccctgggcaatttagccatactttttctctttagaccacagttcccctgcttttcaaacattgctactaggtaactgggatgaaagttaagcaggaggataagtatcgtttctgtatcagaaatgtgggtgttgggtttttttttttcagtttctatctgaatgtagttaatgtcttaattgttaacaatggaattctttccaagaaagatcaataagttctacagatgtaatgttgactttgttctcttcaccctcaccatctccatgtgaatcattttcaaaaagaagggaacacggatgcttaaagaaattctaaaaattgatggctctaacactgtggaccataagaatgaaatcaaacagattgctaatgaaatccctgtttcctctaacagaagagatgaatatggattaccctctcagcctaaacaaaataagaaattaggtaagtaaactaaatactattaccaataatatcattttaaaaattcaattcatttggttctttttaatcatgtacttttaaagataaaactgcttttattttaatgtatttatttattttagagatggtgtcttgctgtgttggccaggctggtctcaaacttctgacctcaagcaatcctctcacttcagcctcccaaagtgctgggattacaggtatatgccaccacacctggcccaaaactacttttattcttaaaactataatttttatatttgtttcagttatataataatataactggccaggtgtggctcatgcctgtaatctcagaactttgggaagctgaggcaggcggatctcttaagctcaggagttcaagaccagcctgggcaacatggcggaaactctgtctctctaaaaaataca

SEQ ID NO: 108665 - DNA, 1088 bp, Homo sapiens
tttgtacccagtgtccatttgtctgtgctgataagaaagtaaatagagcctaccaaaagcaaaacggtgaaataattcatttgtattgaccttctctagcctccacttctgctgcttcttgttgcttcaactgtgggaaattgtctatctctttttgcattcaggctttctctccctatccaaaaatgaaaggatctgatagaatcttcatatgaaatttatgccattttgctaattctgtctatgaactgtctcaatcactgtaactttatcatcagtctggctatttaatattgaaggcttccaacatttaaaaaccttgacaatataaatattaataaaaatcaggtattgggattgttattaatcccaataaaacatgggattaataaaaattaacatggaagggaatgtaagtgtgctaacatcctcaattttcataatgtagagccagaaatgataaattttttaaaactttttaatggaaaagtttaaccataatgacatcaagtaaatagaatgaatgaacccaccagtattcattccctgccatgctctagtccagtactatttcttctataacccctactcatttcccacctccacctacccaagggatgggattattttgaagcaaatctagggggatctttagagactgatatttctctaaaggtgaagaaacatttacctaaagtttagtattttgtttggtttctgcatttgttaacatcaagcaaaattagatttaattcttttattgaaaggaggatttttggctgggtgcagtggctcatgcctgtaatccaaggactttgggaggccgaggtgggagaattgcttaaggccaggagtttgagaccaccgtgaccaacatggtgaaaccccgtctctactgaaaatacaaaaactagccaggcacgatggtactcacgtgtagtcccagctactcagaaggctgagtcatgagagtcacatgaacccgggaggcagaggttgcagtgagccgagattgtgccactgcacttccagccttggtaacagagcaagaatctgtctcaaaaaaaaaaaaagtagcatttttataa

SEQ ID NO: 108666 - DNA, 1165 bp, Homo sapiens
atgaaagaccgattagggtgggtttaagagagaaggggggagagaggtgccagtatagacaattttttcaagttttgttctaaaaggaagcaattcttgcctttatctatttgttcaactttttaattaactccctcccgctctcttaatcttttactgaggaacgttcctccaaatccaacaacagttttcttttcattttttgccttactgcttgactaatgactttgactgtaacctctctgctaagtattactaatctatatctctgatttgaacctcagtcaagatttaatccagtatctgcaactttctaggacagatatcacagctggatactccaccatcacctcaacctcaaggtgtcccatcttagacaaggcagcatgagagaagaagaacatttttttttaagttaaaaaaaaaaaaaaggtcccagaatcggcctcacctaaagttactcctcttacccttatttctaacaccaccattcctcaggcatataatctaaaatgcttagagtcaaaaatttttgctttctaacattatttttacaatgatattataaatcattctatcattctactcctcctcagttcctgcaactggactttagatcgtcatccttggcctaaattaaccttctaactacgattcttgtttcctatctttttcacatatagtccttcttacatactgctgcctgattaatctttcttaaagaccctgtcatctgttttggccccaaggcataattgggcaaagtatctcttgggtttgaacccagtttataccctgaagcagtgtggtgcagtaagtacagtactggactcagaatcaggaaatcaggttttgtgattcaaatagtttaaaacaaaataatttatagataacctaaagaaagcttataatagcatattggctgaggagaactacgtatcttgtcaccttaatttttttctttattctttaagttatgacatatacactaattttttatgtttattttattatttatatttattttaccatttatgtttatattccctttgtaattttctcttttatctctgataatgccaccattactgcaggacattagaataaatgagggtctgaaggtacaggctactggtttataaacttgaacattcctttttttatt

SEQ ID NO: 108667 - DNA, 1042 bp, Homo sapiens
acttatctgttgatttttcatcatatgattttttagtgtctctttttctctccctattgtaacagctaatagagaagccgatgtactatttgaagtattatttgatgaagaatttcctggagggttaacaataaggtttgtatttcccaatgataattgccctttgtgaatatgttcatgtggccagtgactttacattactttttatttgtttacaatttcagtttgtgggatgtgtaagacgtacttgctactagggatgtaacactgaataaggcagacatgctttctaccctcagagagctttcattttagtgagggaggtaattaagcaaccgattacattattaattatttaattaaagcatggcaagtgctaggaagaagtgcaggtttttataaagagtatgacccatcctgagagtaacagaaaggcctctttgaggaagtggtatttaagatagaacttgaagaatgaataatagctaaccagggagaaaaggggggaataatgacatttgcacaggaagagggaatagcatatgtaaacaatgctattagggttaaataacttgaggaatagaaatgtcctttgaaattagtgacatgtatgtctttgtcaccaattttagtggagttgtaggtactcacgacagattggcatgatttgacaagtgaatggcaggtgtagtaatggagacaggaaattgaggcaacacttgggaagtttgactataaaggaaaggagaaagttaactggaggttaggaggtttaaaggaagagggttaaattgtttttaatttaacacagataagacaagtgttttgggggaaagtgccaatagaaagtttaaagttataggaacaagtatcatgataaaatgagaggcaccatggtgtaaacttgcagttaaacgttgtatttccttgggtaggttaattaagtgtctgaccctcaatttcctcatctataatgaagatatatacatacttccctaggttattgtgaggatgagatgaaatcctttccagttttctgctt

SEQ ID NO: 108668 - DNA, 1007 bp, Homo sapiens
tcctccccatgctgtcttatacttcagcaaaaaattttactttaaaaaatttttaaataatgatttaggctataggcattttatatgtgtttatttcttcttgctgcagctgcagaactttaaatattttaaaaattaatctcttcatttggctttttaaaattcagacatgtggaagtagtgagtaggtagtgattttataattttatattttaaaaatatttaacaatttttctttttcctcagcaaagaaagaataataagaaggtgcgagtaacagtgaaaccccatttgctatacagagtaagtttcctatcaaagaattcagagttgttgctttcactttgaatgcatggaaggagcaaagatgttttcagtatattagtatgaaaatttttttgtttattataattaatagctttcttctcttcagcctttagaacagcaacatggagtcattcctgatcgggatgcagaattttgtctttttgaccgtgttgtaaatgtgagagaaaacttctcagttccagttggccttcgaggcaccatcataggaataaaaggaggtaatatcctaatacttgaaatgtcttcaacgtaatttatattgtaaagtaataaacaggcttgtctgttttttatatctaaccagaaagtgactataaatcaggaacaaacaatctttttatgttttagttaaattttttttaggttatacttttcagagaaaaaaaaatctcttctgttttttattgtataatctggaaagagattaaaaggagaaactgagaaggggctgctgagaatttagtagttttatatcacattaaaattatgcaagatcttggtgagcatacatatgttttcatgaaactgataattttcattgcttctcctgagtttcattgctcagagctttattttcattgtaatcacttattttctgagattaaatttcattgtaatcacttagtttctgagattaaatatatattacgttagttaca

SEQ ID NO: 108669 - DNA, 2550 bp, Homo sapiens
gtgtgtccttattctctggctatatatagcatcttgttcttacagtgaatggaatatcttcatttatttctctgaagataattctaggatttatccttctattttttgtgttttctgttttctctaattgctttttttcctcctgtttgatttagtctctcttgcagtgttaaagttttgttgttgttgttcttgtctgatgatctttgatatccaattatatttaagaatgaggcactaaatagctgattggaaatttagtgtacttaggtggggtttatcaggtggatcaggagggactttcctgtttctacagaggacctcctagtatcactacctgcatgtttatcttttctttcccggagaggtggcctccacccttttccttgacagtggatatgaatgtagtggattaaactgattgccagtattctggaagttaaccagggaaagaaggtttcattaccaagtggatactgtgatacacctcccagaccacttttcaagactgaaagacctatccccttgcagcaggaatgctgctttccggcagccctcagctgtgagccctctttagtaattgcctggatgaggagaactgcctcaactaaggttactttcccttcccacaacagccgcaaatcaatgcccaatctataaggaggtatagaaacccagacattctgattgtcccaattcatggcaagtctgaagggccatcccagtttgagatctttgtggggctgttcaaggaattcattgagaattggtcacagcccatcctcttcctgtgcccaattctgctttcttcctctcccttcccttccacgggtgttgatcaaacaagcactccctacctgcatgcttatctccatcccagagtccatttctagagaccttatgcttcctagtgacacattgtatagtatttatgctttcattaattcactgttttcagtataacacctgtcctctcctccttatgccttcctcacccctaagtccgtgactggtatacacaaggctagagtatctatttgacctctctaaaatatacgctacaggtcatatgctggggtggtaggcaggcaaccacatgacagtataactgcttgttatacaaactttaaatcttactaaacctcaccccacactttcaaatgtacctggaacctataattcctgagctttttcagagtgttctgtgttttaaatcaacttgcttcttattgacttcccccactggtagttcaagattcaacttattcctgtctgtcaaatcagataatattcattcatccagtttccagtttctaaaattttaacaggttatatatgccaccagataccgtgcttcatttttcatctgtctctctaggtctgtgctcttttttatactatattgtcattttaatggattggagagggatggaagataagcatatacgttcagtttgctatatgtatcgaaaagtcctgcactcttcagaaagaaatggagttttgaaaattatcagaagatgcttttaatctattttaatttgttgtattgtggagtgctctagttttgttgtgaaaattagaaaactaacctatagataccatttttgtctatcagctgtcattttaatgaaagagagtagagtcagtaattgaagtttattataagtttatgacttgaaccttagccagtgggagttttttgagggtctaggagtactctgacttaccagtcttacactttctatcacttttaataatatcccttattaatattatagtagtcctcaataagctttatatgtttctttaggatctgaaattattatgtaggaagtttatccgaaattaaccatatatattttaagacaatatttttgtttgtttgaccagagctccagaactatttagttatatagccaaaaatagccaagaggatgtgttctatgaagatgacatttggcctggagaaaatgagaatgggtaagcaagatttatgatatttattacctcatagttcaattcagtgttttcaatgacaactgcagctggtttctcaagaatttcatattacttttttttttttttttttgagacaggttcttactctcttgcccgaatgcagtggctcaaatgtggctcactttagccttggttccctggactcaaacaatcctcctacctcagcctcctgagtagctgggcctattaggcgtacgcctccacatttgactaatttttttttttgactcctaggctcaggccatgctccttggcctcccaaagtgctgggattacaggcgtgtcttgttacttctttttgttttgttttgttttgttttgtttttttgcattgtttcatttttgctttaagagcttaacaaattttctttcatttatatcaacaaatacttttaaactaatctttttgtgtgtcttttaattactaagaggtaacatgtccatatttatattagatttagaattagtcccgattaagttcagtgactaattattagttatataagttttatgtcttttataatttat

SEQ ID NO: 108670 - DNA, 1853 bp, Homo sapiens
tgttctggaaagcatacttgatttgtattacattattgctaaatctgattatgttcttaagtatgttttattgttatgtacatgatgttaagagtatatggtagtttatcctagttagtattggattcatgaatcatttgcttcctggttaaatattatatgatctgttacttctttttttttttttaatgtgacaatatgttttcttcccttaagtatataaattaaggttacatttcattgactgtattaattatgggtctatacatgcttgtatgttttcatatgatagtaaatattaggggaaaagaatattacttatatccatatatgaaggacacttttagtttttctcagtagcaacgattttgatgatgtacctattttttaattcaatgtaataattactgaggcctcattttgtcccaagtactttgctaggccctgcttggaatatgaaaattagtagaaacgaaaacaaaaacaaacaaaaaacttgcctgtggagtttgccatttagtacttacagtagagtttatttcttaagacagtttcacaaactgtatatttcctccccccttttatccatccttgggaattctgtcctttaaggagaaagagagaggagcagaaaaattctgcctacagatcctttcaaaaaaaaggggaaatggatctaagtgaaaatccttatattgccacaatccaatggttagtgatgtcttgattatctccagattttaaaggtaaagaaataacatttaatgtaaacttgtgtttccataattgacctttttgtttttatatttaaagaaatattctataaagtacaacccaggatatgtgttggccagtcgccttggagtgagtggataccttgtttcaaggtttacaggaagtatttttattggaagaggatctaggagaaagtaagtttatgttagagaaatttacttaaagtggcagaaaaattaaatgataaagattaaatgcttaatatttcagtatttattttcttattaattgctctggattgtcttaaaattgtgcataaatttctctgatggtaatctttcatctgaatggcacatgttttaggtggttggaaaagacagttcttattttttagcagctaataaattgaaccttgaaaaaaggtatcagagggtgtgtgtgaacctcagtagtatatttccttgcatcttgttatttcattttcctctataattacataatttatttacatgctttgttaacttgggttttgaagcttttcttctagtttttcaattactgctactttggaaataaccataataactaaaatatagaagaataatcaaaactgagcttttctaagaattgaaagcaaaactttttgttccttgaacgacattttaaaactcgtgtgtgtgtgtgtgtgtgtgtgtgtgcacgtgtgcgcatgtgtggtttaaattcagccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagaggtaagtacataataagatactagtagtcattccaaaatcttaggaaaatactgtttattttgccttcctgatattagttttagaggacaaatatttccattagtaaaatctggcatatgttacatgtaaacttaattttgcatcatggaatatcataggcactagctaaaattgagtagaaaaataccatattattaaaaagaaaatatataatgaaaattgccctctttagttaaaattttt

SEQ ID NO: 108671 - DNA, 1068 bp, Homo sapiens
tcctctgagaagtatggtctttatgctgggaactccctattatggctgcactggagaagttagtttccattattgttactgatacatttttctctagtttaaagcagttacttaacttctcttcatttaggtttaaattaaaatataataatgaagggaaaaaataaagaatttatccatgtaacttatgaacacagtgtttgacttatatatctaaatactatatatctaagactaaagaccatatacttttagtcttgagcagattaggatcaagaggtggtgtgttcaaatcctgatctctttttttttagcagttttgtttattgtagtggtatggatgaaacgattttgtaactattttagacatgtaataggcttgagtgaatttgtaaatgcgttcatatttgaggaactttggttcttaaatggaaaaaggtacatgcaaatatggaaggagagaaagcaagaaagaacctatagggacagatttggaagtattagtgtgaactcttggtttctaaaatatgtatatatgtttgtatatctgtgtatataggcacatatatatgtgtatatatatatacacgtatgcatatgtttctagctctatttgctgaaaggaataagaagcaaagacaccttagcacaatgagcacatgtaccacccagatcttgacgtctaatttcataactcactaaaaggaacagggcttctcagagaaattgctgattctggatctggggcagggaagatacaagatgaacctggaacatcttgttatgtcagaaagtaaggaggtgctcagaagaatggtgggagtatgtcatgtaaacacaggaaccaggttgagggtactaccactgcccaaatcttggatactttgagtgacaaaataattaaattcagtagttaattataaaccactggggggaaaacaggaattcatgattccgtagtgacagtaaaaagataaatagggaaaggaaggtctcttgtctgtagtagcatgtaagaagtaaatttggagagagtgctgcagttgaaaaaccattgtgcaaccatta

SEQ ID NO: 108672 - DNA, 1069 bp, Homo sapiens
gtagaatacatgtgatattttgatccatgtatatgacatgtaattttcaaattatctgttacctcaaacacttatcatttctttgtgttgggaacattttcaatctcttctggctattttcaaatatacactaaattgttaactgtggtcaacctactgttgctatagaacactggaacttattccttctatctaactttgtattaaccaacttatcttcttcttcctctgtacttcccatgcttttaaaatttgaatgaaattaacaagccttgttctgtaatttatattagtttataaaaagacctgtaattattatagttttgtaatttacattacagttgtggggttttttgctagtataccatgtgaaaaaaatatttcatttggaagactcacactgctagaactctatattaaaccagaacattttggttatataatttttattttaactcttaaggttttacttggaagaacctccaggaacacagaagctttattcaggaagaactgccccaccatctaaagtggttcatcttggagataaagaacaatctaactgggcaaaagaagtacaaggaatttcagaacagtgagtatcgttaaaagtatttaatatcatggaactaaaatccgttttaatgtactcattctctaacttattttccatttaacatagtagttactctgaatactaattacaccttcatcctgttttagaaagtaatgagttctagtttaaaatgatacctgattagcagtagttacagccttgcccagtttgtcactaaaatacctaatgaagtatagaaaaaaaatgacaaattaatgtaatactaggaataacacttaatacattgactgattttgagagctattttcactaactgtataaggccattgaattttttggccacatgtaagtcatgaaaattggaagaaaaatcctgttttgttcctcatcttctcccgttccccattccctttactctcttccacccaagccatattccccagggcttagaatgcagccaaactgaaatgctaacccacctgggaatgttgg

SEQ ID NO: 108673 - DNA, 1061 bp, Homo sapiens
tagttcttttctagatatttctgctgttctttttatttttctcagttaccataaaaaaataaggaagataattagaatgatagagttttacacctggatggaagatggaattttgtaaagcaactaattcaacttgttcattttatttatttatttatttatttttgagacggagtcttgctctgttgcctaggctggagtgcagtggtgcaatctcacctcactgcaacctccgcctcctgggttcaagcgattctgctgcctcagcctccgggtagctgggactactgcgtgtgccaccacacctggctaatttttgtaattttagtagagatggggtttcatcatgtttgccaagctggtcttgacctctggactttaagttttgggattacaggtgtgagtcactgcacccggccccaacttgtttattttagaatttaaaaaacttaaatggagattggaaaattttgcctgtgtaaagttttctcttagacctgaaatcatgaatgaacttttttgcttttactttaagaccgtagaaaatgtagcttcatcagtgcttggaaaatctgtctttgttaattggcctcaccttgaggaagctagagtcgtggctgtatcagatggagaaactaagtaagtaagatttgatttataatttttctaacatatatttgctttgtgactttgatggcttttattgattcatttttttaactgacaaaattatattaagaacatttacactctgtaccaaaaatgaaagtcgtctaatgacaccacttgaagttcaaacactattgacagtttattgtacctctcttgagatattttagatgcatatgttattttttcccttttaatttcttggaagttctatatcctaattcttttctagaagtggttatcattatattacttagcaaatacatttctctttctaacaagaattaatagcatatgtaaccttcccttttccctgccccatctggatttcatttaaattgtacattaattttttagggcacatatcttttgttttaagaaaaatatcttaa

SEQ ID NO: 108674 - DNA, 1757 bp, Homo sapiens
ttctattaaaagtgtttgaattttttctctctaatgtatatccctgcattttgtctccctcgaatggatatgtgaatttttgtttccattgtcagtgtttctgctcccagcattatttgatacgctgtgatattgattataccccccagccacccaactagaaagaaggaaataagaaataaagagctccatttttttctcttcatgaaaatatcttccttttttttctcttctctcaccttccctgcaaataatctacccagatggcaattgagttgcaaataaagtaaacatctctcagttacaacttttccttttgttaaaggaaagagaaagataaaacaggcattataaaatgtttattttccatcctgggttttggaacatggaggatatagagatttgtgttatgtgtcatattttatcttaaaatttatatatatagttttgttttagattaatggggaaaatctcaacttagtaatctacaggcatgattgtgtctagaccagtaacaatagagaggctggttatctgcttgtgttttctttgtctggaactaattgtcattctcttctttaaaagcaaggatgactcttacgaaatatacaagggaaagttaaaaaactgtaattgtttgtaatgtattaattttaaattaaatgccttgatttattttctaggtataaaataatatccttagatgcttggcgtgtagacataaacaaaaacaaaataaccagaattgaccagaaagcattatatttctgtggatttcctactctgaaacacatcagacacaaagtcagtggctatttagttcagaattttttcactttattaagtgtgaagtgattatggagaaagaattaaaattaaattatttgaattcttttaaagttttttttgaagaaaagtggtgttcaagtattccagcaaagcagtcgtggagaaaacatgatgttggaaatcttagtggatgcagaatcagatgaacttgtaagtattttatttatcattcatttattagatgcctataatgtattaaactgtagctgctgggatgtttaccagggaggtattatatgttgtaactctagaaatttggagcctaaataaggatgaagcaaagaaacattcatacaaattagataatagttcaagaacctgtatcactgtgacacaatgaatatacaaattttctagaaattttaaaaaggagaagagctatgtaaaccaaaagttaagtatagacttgtaaatgagaataggcttgagctgaggactgaaaaacaggttaggacacagaaaaggaggggaaaggcattctagtcaaaagaaatatcatgagccagtcatttcagtcaaaaatgtcatatattattgtttttaacctttttgtgtatctgaactatttcttaacacttagtcttttctttagaataaatgtgatatatttgaggagaaggaataaataagccttattgaagcagaggatttgtgtttggaaatagtagaagataagtttgaaaaatcagattgaggccagattatgtcgaaccttgagtaccaggctgagtttggacttattttcccatgaccattattttggaattgatattttcataaagattaatttggtggcagtataataaactaaattgcacaaaagagaaatcaaagaaagcgggaaagcttgcgagtgtagcatcaggtgatagagacataaacttcagaagtagcaatagatctagatg

SEQ ID NO: 108675 - DNA, 1056 bp, Homo sapiens
gggagtaggaagaactaaagagagtcattggcagtagacaggaaatcagagaatagaggagagaaaggattgagatcacaagggaggaaaaacagatgggcaggatatgaaggatgttataacatggaagaactatagaaaagcaaatgggtgcatggaagagaaatgacatctcattttgaaatgtatcttgccattcattttatgttgatttacaatttacagggccaggaaaattctctgtgttggactgctttagacaaaaatgaaggcgaaatgataacttctaagggtaagtatgaagtatgtgttttgatatgttactactttgacaggataattgttataccttttatttattattactaattttgggtggaacagatttctgtgatagcatataagcatcaacttggatatgcatttatcaaatcattaggtggaaaaacaggctattcataattgtcagtcactatctttctgacttttttccccagataatttagaagatgagactgaagatgatgacctatttgaaactgagtttagacaatataaaagaacatattacatgacgaagatgggggttgacgtagtatctgagtacgtttttgccaatgcttttattttaaaatagaaaaaattagattttgcagttattcagaaaatatgattttgatgaagtagtgggagaaaaaggattttttggtttcatgaattattgtgtatgtttcaactagtctggttttggagaagatggtattaattctgacttgtattatattcctgtgataaaaattgctgaagagaaaatgatccttatgtataaggatttttgttacaaagttgtttataatagtaaaaaaattagaaataatctaaatgtccaataagaaggttcatcataattggccactgcttcttcattacagtcaccatctctgtcacctcttccatctccggaatctgcagaactgctaaactggtacttgcagaaagttcataacaatttggaaggatgcttatagtacattattaagtacaaattgtaaaggc

SEQ ID NO: 108676 - DNA, 1040 bp, Homo sapiens
aaaccaattgttttgaactttaacatgtattatctattattgcaattgtatttttatctttgttaccctgcaaccttcatataaattgtatgccttaattacaagaccttactatcttctgatgatacttttgatttaagctttgttacatttttaagctgggaccttaaaaataaaattcactgtatcttgatcatctgactaattccagggtatgtgctccagaagaaactacatttcaccttctacacttgtctttaatgagagagtatattgactatgagttttcagtattaaaagtaagtattaataaagccatggaccaaggatttccattgcagaaattttcactggatttgactttgttctctattttactgtaggaaaagatcacatttaaatatgatattgaaaggataatagatgattggattttgatggggtttcttgttggtaatgattttatccctcatctacctcatttacatattaatcatgatgcactgcctcttctttatggaacatatgttaccatcctgccagaacttgggggtaagaagaatttaataatctctcgaggatactttaatttagtgccaccttaccctaaaaatgtgacttagtttagtagattattgcatgcacgctaaagcagaaaaacattgaggatttattttggtctaaggtgctaacctctgaggttgtcattttcagtgattcacaaggaaagaaagtgaacagagttaacgaacctcaattattgatatctaactaatctttgccttttttttattatttatttattttttgagacggggtcttgctctgttgcccaggctggagtgcagtggcgacagtgcaacgtttgccttctggattcaagctatgcccatgcctctgcctcctgagtagctgggattacaggcatgtgtcaccatgcccagctaagttctatatttttagtggagatggggttttaccatattgaccaggctggtctcaaacttcggcctcaagtgatctggcttcccaaagtgctg

SEQ ID NO: 108677 - DNA, 1026 bp, Homo sapiens
tgtaatcattgtagactcaggttccaaattaataataatttttcagaataataatttcagtagtaatattattattattattgacaatctgatttaagctgcaagccttaaaaaaaaaaaccttcagaattcagcagaagaaatagaaggttgaggttcattagagatctcaaactctgcccttacatgaaaattcctgaagcacagtgctgagacactagtaaaattccttgactttccctgtgtgacactgattctatttagggggactagtgacattagaaacagttgtgatatttgcaagggaaaagtacattacttgtttttcaggataagcaagagagcttttgaccttctttggagatcctatacctacctagctattcccggcgtactcagattcagttatgtgttgtcactgagaacttaatgtttttatgtctttcttagattaacctttttaaaacattatttttaggaactgaatttatggccaggttacatgaacatctgaagtattttgtaaatatgaaaatttccacagacaagtcatggcaaggagttaccatctacttctcaggccatgaggttattatctttttttatttaaagagtttaaaaaaagtatttaatattctcaagcatataccatattactgcatttttaaaaacaattttatttagactcctggagaaggagagcataaaatcatggaatttatcagatccgagaaagcaaagccagatcatgatccaaacaccagacactgtctttatggtttagatgctgacttggtaggtataatttttattattataaacttatgcattgatagttaaatatctaagagatttcattttgtacaggaagcttactggctgtggcaacaaatattggagacacaataatgattgctacttctatcattaccaaatttctaaaaatcattggaaaatgagctttttaaccatagtttattgaccaacagatctctataattagtctacaggtgtgactaatcctag

SEQ ID NO: 108678 - DNA, 1036 bp, Homo sapiens
aacaagttgatatcctcagagtttttgttatgttaaagaggttggtgagagagaagttaaacttgaagaagagtttgttcatcacagaaatagaattgtgtggggcacagtagatgaagctagtagcaaggctgtagaaactatactcaaagcagagcttcctaacttgtatgccatgtggcatgctggtacgctgcaaaggggtggcagtagaagtcaggcaggtagtaggacacccatattcaaatccaggtttgcctgactgtaaaactcaggttctttctagtaaattctgttgcctcaaaaatgtgatgattttgcagttgatttcattaatgtcattaggctttcattttaaatgtttttaggaaacacaaagatagatatttcaattttataattgcatttttatataatcttagggataattttaatgatcttaaatgtatacattaaatgatgattaagatcattaaatgtcattatcattagatgtagtatatataatgaacatttaaagctatacttttgatcttatttttagaatgaatttgccatatatttgtgacaataattattttatgtttttaacattctgttaaaatgttctacttctgtattcctaatccgaaaaattcaatttttttttttttaaatgagacagagactcactgtgtcacacagcctggagtgcagtgggtacaatcatcactcattgcaatcttgagctcctgggctcaagggatccttttgcctcagcctcccaactagctgagactataggcacatgcccctgtacctggctaataattttttttatttttgtagagatgggatcttgctttgttgcccaagctggtcttgaactcctagactcaattgttcttcccaccttggcctcccaaaatattgagattacaggcatgagccactgcacctggcctgaaaaattcaattctttaaataaacaaaacagacaagtctggggctcatttttatcaatcataatcatttcaaaacttgtatgttttgaacg

SEQ ID NO: 108679 - DNA, 1007 bp, Homo sapiens
aagctccaatagtagtctgccctgggatggtaactagaaagtgaactaagaggttcttctaatgagaacattattgacacttaattcaacaaacgtgtattgaatgcccagactctgggttagatgctgatttttgactgagcataagtccagattgggcagaaaggcaagtgagatcagaatgcaattgatggactgtgagaagtgagctaagttaggaaattcagggtattatcagcaccactgtgtgacttaggcggtaggagaagtaaaaggatgagaagaggttacacactaggattttaaagttcattcctggacatgtggaatatttctgtgtaacagtgagatcaggctgtgtcccggttcatgggtaacagaagtaaaggttagaattgaaggcaagaaatccctagtggagagtgtttgacgggtcattagcataatgagtccttcaatcataatggcaagtaaaggagtggaaagaccatctgcacatccaatgtggaagtcatcaaagaaggtgggacggtgctttgaagaaggctgccggtgagaggaagaggatggcaaaaagtactgatttcaatatcaaaagaaaaaagatactgaaatttttagaaagactgtgagatctttgaaggcaagggccatctctgagtaatatttaaattctcaaataccacccaagacttactctatcagaatctctagtagttgagaaactcctgggaactattttttaccatactcccctggtatttgttaaagtagtttttgggagccactagcctagaagatctagtgttaaggagggattttataaacctactacatcagtctgggttcagttgcaggtgatagaaagcactctagctatttcagacaaaaaggggtgtaattcagggaattgggtgtttataaaaatcactgtaaagccaaaagggcgggaatctaggtgagccgtaagggataacttcccaaacagcactacagaactgactcac

SEQ ID NO: 108680 - DNA, 1180 bp, Homo sapiens
ggacactaaggataggttttgtgaaagctttatatagaaactgggaggagaattatttttaaatttcactgtaaataaattttaaaatttggttcattgttgtgatacctttcaaaaatgtttgattaaaaagagaccaaaggttatcagcttctctgttaagtagaacttaaagatggtaatgcctaaataagtcacaggcattcaaaagctagtcctgggcgggaaggatagggagaagaagtaagttacgggaagtcagtggtgtggcctcagtagcataggttttcagtttctctgaatcatcttgtaaaaacagaaagagaaactagaaaccaaagtttaaaatccataaaacaattacaacaaaccatgtgacatgctatccccatgaaactcaaaacataactaggtgaggcaaactatcaatagtctctagacaccgttgatattgccatctgtgcaaaagcgagaaggaagcaatggggcaacatctgatgaaccttagaacagaattccagaatagccagcggtatccactaaaagactgtgctggccaattagatagcggtagctgaaacagaggagttttattcactccattattgactgggtgaaggtctaccataagaaagaccaaacaggcaggagtagtctacctcctgtgaacactcaaaactgacttgccaaggtgccattctagaccagagccctaaggaaaagggagtggaataaagtcttacggaaatgttatgctggaagtggaataaaattttatgaaagggacaatagagacaagaagagaaggagatagaccatataaaagtgaggcaaagtcatagaatcaagaaatcttagaaaacaaaccacaaagcaaaccactgtattttttaacactacccagaaacagctttgtgaacttatattccctgaacctctactcattctaaaagttcaagaaaattaaattcacataaaaatgagctacagaaaggtattgagatcaaattacatacaaagttattatacgagaaaaagggacagagtatctctccagacataaaaacttgcaatgaaaaaaatgcacacaaaatagaccaaaattataaccaaaactattatctatttcacaatgagttaaaaggcattaagaaaatgaggtaagacatgaaagaacaac

SEQ ID NO: 108681 - DNA, 1024 bp, Homo sapiens
tttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgaggtaatcacctatactttgtaaataatttaacagtaacctcgaatataattattggcccctacatatgtttgtttttatgtagaaaccactttgtactgactgaaatagtttttttaaataatagctttatgcagatataatttatataccataaattcacccctttaaaagtacataattcagtggtttttagtatattcacaagattgtgcatccattaccactatctaattttaaaacattttcatcagcccaaaaagaaattccgtaggcattagcagtcactcctgatcccttccccctcccacccctgctatctacttgtaaccactcatttataatattttctgtctctatggatttacctattcaggacatttcatataaatggaatcatctaatatgtggccttttgtgtttgtcttctttcacttaatgtaatattttcagtgttcatcatgtatcagtacttcattgttttttattgccaaatggtatcctgttatatggatatactacattttctttttctgttcatcagttaagagacatttggattgtttccaccttttgtgtattataaatagtgtggctgtgaacattgtgcacaagttttatgtggacatatgttttcagttctcttgtgtatacctgggagtggaattgctgggtcatatgttaaatgctgtacttaacattttgaagaactctcaaatcattttccaaagcagttgtaacactttataatcccactagtaatgtatgtgggtttcaacttctctgcatcttttctatctttagataacatctttatctatcctggttattgtctgccttttttattttagccattctagggatgtgaagttgtatctcattgt

SEQ ID NO: 108682 - DNA, 1074 bp, Homo sapiens
ggacagttggagcctcttattccaatctaaaacgtcagacttcattctagccttctctccttcctttctccaatagtgagaaaactggctctcattatacaacatatttacttacttgctgaagactagtactgtatatacatagtttcagaattgttaaccaatatctgtgaaaaacaaatattcatatatagttttgtaagctacctcaaatcctgttgggatgaagacagggaaggaatcaaaatggaaggaaggaaggaaggaagaaaggaaggaagggatggaaacacttaagtgtttctgtatataaaatctagaaatttcactatagcttatatcaaaaaacatatgctagcatatattaataccaattatacccatattatataacttagtacccacactgtatatgtataagaattaattttagtacccttttctttatatagtttggtcagaataggtctcaaaccagcagtgttgttcacccattcaataatcccacattcatcatttagtggaataactgcatatgttcgaatatgaagttctcttctacgagactctgcatcttttcttaagcactgttaaaaaatacacataaatttaaaaacaagatagaactcaaaatttctaaatgttatatcaaatatatttaaagattgttcatttcataaccaaagaatgtcattgaaggcttactatgtggtatacatgaataattcttctgaatggtaggaaggaagctactgggacagtatctctaatctatttacagattattaaaaatgtcctgggtaggtccttctttttaattattcactattaatgtgacaagaatattgtatttaaaatatttaagttgtatatttaacaatgacaaaatgctgctgttttattttctattgctttataggtattactgaaacattaagtctttaggcacagagactgctatttaatttttcttttttttttttgagatggagtcttgctctgtcgcccaagctggagtgcagtggctcaatctcggctcactgcaaactctgcctctcgggttcttgccattct

SEQ ID NO: 108683 - DNA, 1050 bp, Homo sapiens
caggagaatggcaagaacccgagaggcagagtttgcagtgagccgagattgagccactgcactccagcttgggcgacagagcaagactccatctcaaaaaaaaaaaagaaaaattaaatagcagtctctgtgcctaaagacttaatgtttcagtaatacctataaagcaatagaaaataaaacagcagcattttgtcattgttaaatatacaacttaaatattttaaatacaatattcttgtcacattaatagtgaataattaaaaagaaggacctacccaggacatttttaataatctgtaaatagattagagatactgtcccagtagcttccttcctaccattcagaagaattattcatgtataccacatagtaagccttcaatgacattctttggttatgaaatgaacaatctttaaatatatttgatataacatttagaaattttgagttctatcttgtttttaaatttatgtgtattttttaacagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggtactaaaattaattcttatacatatacagtgtgggtactaagttatataatatgggtataattggtattaatatatgctagcatatgttttttgatataagctatagtgaaatttctagattttatatacagaaacacttaagtgtttccatcccttccttcctttcttccttccttccttccttccattttgattccttccctgtcttcatcccaacaggatttgaggtagcttacaaaactatatatgaatatttgtttttcacagatattggttaacaattctgaaactatgtatatacagtactagtcttcagcaagtaagtaaatatgttgtataatgagagccagttttctcactattggagaaaggaaggagagaaggctagaatgaagtctgacgtttt

SEQ ID NO: 108684 - DNA, 1011 bp, Homo sapiens
ctacttttaattgataaagcttgaaaaacagagtctcaggctccgcagaaagatcctgaaaagatgtttcaaaaatcttttaaacattttgactgctttgaaggggggtgtctaaatttgaatatgtaagtacttgtattggcgatgaagtaatctttttatgtcatagctatttttaatgggtgaaaatgtttctgttcatagacagtcattcttttcataggtcatagataattaaaataaaagatttttaaaatacaaattcactacataatatagctggtaatattctttttttttttttacataactcaaggtttataatatatagacatttacacagaaatttttggccctaattcatatataactcatcatcttttaggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataaggttgggagatagtttgcttttattttatttatttattttttattttaaaaaaatttttgactattataaaaccagattgcttttatttcagagttgctataattactatcaatctgatataggcattttagtatacaaacagatcactcttaaaaagcaggaatgaaatataaagtctttttcattttcacttaatttttttattgagataaaatgtacatacataaaacttaacatttgacagtttttgaagtatattgttcagtggcattaagtacattcacattgttgtacaaccatcaccaccatccctctccaaaacttttttcatcttcccaaattggaactctgtgtctatgaaacaattaacttcctatttcccttctcctcagcctccagcagccaccatttactttgtctccattaatttaaccatttgaggtacctcatataagtgcagtatttctccttttatgactggc

SEQ ID NO: 108685 - DNA, 1050 bp, Homo sapiens
agcatgataaagccagaatttcaggaatgttagtctggaatttactgaagggtagaaatatggatttagggtgaccaagttattataatttcccagaaatagaatgattggacctaacctaggcttatggccaaagaatgcaaatgaaggcacagagatcctaaggaaaaattgaaagaagtattgatagactttgattagagcagaatttgtataatgtacaaattctgtatactgtaagtggaaacatacagtatgtacatgtttttggtacagggaatgtagaactaagtgagctaaaaaggagacagaggagtcaaaaataacttctaggaagaaatattgataccataatttttgtgaaaacggtatgtggtagtttgaatctttaaattttaattcgtataatataaaaatgacagctatgctaatagtgtttcttgtctatataattgcagatctctacaatatggaaatcagttcatatatcagtcaatgccacgaatgttaactctatggcttgattatggtacaaaggcatatgaatgggaaaaaggtataactcttcacgtaaaagttttaaaggactaggaattataactttggtataaagtcagatttggctggacagtctaatttcctagaagcttggaatgaatttgataattaagatattatgtaagtgtgagtaagatactaaatgttaaaaaggaaagacaaatcatagacttttaaagtagttttaattcagggccacaaatacaaatctgattatttcttaatgaatctaacacatattaaaatgtgttagttttagccaaataatttaccctaaaaattaaaatggatagtgaaaattaatgtcccttgggtttttgaatggctctaaatattttttctggttggacagagacaactatcttttcacaaattggcaagtgacctaaccttgggcatgggaataacatactttaaagctatttttaaagcaaaatttttcttctgtgaaatgaactgatatactgatttttctctttcctttattgtttt

SEQ ID NO: 108686 - DNA, 1256 bp, Homo sapiens
tattttttatttttatttatttatttatttatttattttgaaccggagtctcactctgttgcccaggctggagtgcagtggcacgatctccgctcactacaacctctgcctcccgagttcaagtgattctcctgcctcagcctcctgagtagctgggactacgggtgtgtgccaccacacctggctaattttttgtatttttagtagagatggggtttcaccgtgttagccagggtggtctcgatctcctgacctcatgatccacctgcctcagccacccaaagtgctgggattacaggcgtgagccaccgcgcctggccaataacccagatttaatggctattacttaaatttctcctcaggctagtcaccagtttagaattagtaataggcattactaataataatagcatgttctggaattgatacttagcaactattgttggtgccatttgtggttacaccaacttgtggtggctgagaaaggacaggagaggtttcctggatgagaggggaaagcaatttattcagtgtgcattagtcagtacctggtcattttattgagctagtggtagtctatgtattataataccttaaactcaaaatgttcaaaatgcaatttattacctaatactcaatatctgtttctcctctcatgtttcctacttctctgaacaagactttattccatccttccatcaaaaacagaaatctggacatcatcttaaattccttctgcaacctcacttttcacatccagctggagactaaatctttgttcttcaaccttagaaatatctcttgaatcctctccctcttatttatttccactgctttaacttatgactttattatttacttcctctaacaatattaacaaccattttaggatctcaccatttccctgtatacgttattgcagtttgtgatctttctaaaatccacatcgaatcatgttgctccttcaaaaagattaaatcttacaaagtattcttcatacctttaggattaagcctaactctaggaactacacaaatccctttctgatcaagtcctggcctacttcctcagtgtcattcatcaccatctcaaaaaccctttaaacttcagctaaaatcagactatgtgcttttcttccaattaaaattattattccatctacctagaatgcctttcactaaattctctgccaagaagatttctactcattcttgaaaacctaattcaaattttcttcgttgataacttttcctgac

SEQ ID NO: 108687 - DNA, 1159 bp, Homo sapiens
ttatccatcattctccagtttaattaggaatttgggattcactgcaaatccctaaatatttattttaaaagtttaatgtaattaattttatttatttatttatttatttatttattattttaagggacggggtcttgctatgtcacctgagctggagtgcagtggctattcacaggcataatcatagctcactgcaaccttgaactcctgagttcaagtgatccacctgcctcagtctcctgagtagctggagtacaggtgcacgctaccatgcctggctaaagcaccaaatgtataaaccagcataaattggtgtttacattcagtttgaaaagatataaatgtaattatttacttagcaaggatatattaaagttctaccaaagacaactgtgtattttaaattctttatttctgatttaaagtacttgctttatatatgagattaataaggctgaatatgataacattttaacataggctctatctatcttcagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaaggtttctcacactactttttttaaaaatgtcacttatcttgaatttggtatttggatattatttgggggtgtttgtatttcttaattttctgtctgaatctacatttttctatttttaatgatcagggctacactatctggttgaaaggaacctagaacttaagaatcacttttagacaccatttctttctcttttttaagatgttaaaaacatatctgggggatatgttttttactgataaaaatcaagaataaggttcataataggtaaaacagaacactgtaagaaaagttaagtcaaggctttttaaacaaattaataattaattcctttgaaatagtatatgaagaaggttctgtattgggaacagaggctttcaaaacattggaactacttgcaaagtttatgacctagatttaaattgttttaagttaagttgttgtgtacacttaccaatggtctctctcaccaatgtgttgtta

SEQ ID NO: 108688 - DNA, 1066 bp, Homo sapiens
tttatctttagcttgaatatctcctttgagcccagattgctgtcttggttttcttgaagtcatctcaataacaatatattaaaatggttatttacatttttaaaaatttaaaaattcaataaaactcttataagctatactcaacagaatatgttatcatttggatctagacagttttaggatcctgaggttctttataaaccttatgatcaataacagctattgatatagatttgtatttaaaaggagtaagaatgttgagggaatagaatgcctggaaataagtttataattttactgtgactttgccatgaaacaaatgcttactattactttgaggaaaaatttctcaaaaaattgctgtttcaatataaacaggtggttttatagttttatttccagttgtgtttttttcttgtttttgattgttttttaatcattgaacaaagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccaggtaagataataattgaaaggcaactgtaatgaaaatagccctgaataggaactctggaaaccttagttttttttgttttgttttgttttgtttttgagacagagtctcgctctgttggccaggctggagtgcagtggcatgatcttggctcactgcaacctctgtctcccgggctcaagcaattctgcctcagcctcccgagtagctgggattacaggcgtgtgccaccacaccacatccagccgaaaccttagttttaatactgtttctgtcagtgtcactgagtgtctggaaaatatttaaccctctctaagcttgagtttcctaacagataaaattagagactttactagatgattttaaaaattccttccaggccggatgcggcggctcatgcctgtaatcccagcactttgggagaccaagacgggtggattccccgaggtcaggag

SEQ ID NO: 108689 - DNA, 1020 bp, Homo sapiens
ggatttttacaggtctgaagttaatatagtgaatttaataatgaaaattaatgtggccagtcttttatgtttatgttgttcattttattgaatgttttatatgctatgcttagaagcttatagattagtggggagagataaacatcaatttggtataatattttaagtacagtaacacacatgtaccctgaggaaggacacttaactcatccatgtggaatagggtgggagatggaagcggatgagccagaggtcaggaatggcttcttggagatggtgtcttaaaaaatgagcagtatagggaggcaagacattataatcagaggcatctctgtggagtgtttgaaaagagcatggtatatgccaaagagtaaagtgtcggttttggaatggtagaggaaagatcacaaataatagaagactttttaagttgcccaaacttcttggagggtgcgaactagggaagtgttatggtcacaatggaattttagctaaatgcctgtggcagttgtggaggaggagtttggaagggctatgattcaaggaattactcttctccttgtgagagttgtggtcctgaatttgggagtgagttagtgggggcaagtgccggttatgtcaggtatcaagcatgaaaatgctggtgaaataatgatttaggcgatgttatgattgtgtagggaagaaaagaaagtaagagcaggtgaggcgaatacagtggaattaaataagagctcaagattggtgggcttttcaaatcaaaaagcaaagtgtgataaaataactagaaaattagtaacttgcagtcttaagatgaatattagccccttcctatctttgtgttcctccttgtccagctttaagtctatggttcatggttaaaatcgttcccttagagtgatgctcaacttcttgtctttttcccactgtgttgtactccgtttgtcaaactccaaccatgtaagcagctggagaaaaattacacagtgggtgttataactggtttcagtttaagttcat

SEQ ID NO: 108690 - DNA, 1736 bp, Homo sapiens
tgtgtgttttttttgtagagactgggtttcaccatgttggccaggatggtctcgatctcttgacctcgtgatcctcccaccttggcctcccaaagtgctgggattacaggcgtgagccaccatgcccggctgacattttctttttttaatgaatatactgaaaatataatgtgtgaaatgtggaatactgttaactattttcagctctggaatattatgggtttttttttgttttttggctttgtatttgaagaaaaaatctctttaaaattttatgagttcaacagtgttagcaaatcaaaagttaagtcataacaaaatttgactttaaccccaaataatttaattaaaaaattaattaaaaaactttttaaatttaaaaatgaatactcgtttgtgataaattatctcacatgctactctttgacatttaatcaatatgtgaaagtgtgttactgtctacacattttgcatttacaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtgagataaatcatcttacttggtttttgaacatgtgaaacttactttctccaatgtaattagtattagaaaggctacctattagtaggaaatgtagacctatgtatggctatgtatgttcatttacatatctttgcctgtttggtgtgtgtatccctttaattgatagacgttctatgtatattctagctaccaatttgttgccagtcatattttcaaaaattattccaacttagtcattttctttttaaccttttcacattttgccacgcagaaattttaaatgtaaatgcaaaatttatacatcttttatagattattaattttaaaccttttatgtgatgcctcatctaatgtcatgaacttatttgctatattttcttttaatccttctgtttttatatttagtcttcaattactctgaacttaattttgcatatagtgtgaaatattactgtaagtttttttcactgttaacaaagtttcattatcatttattgaataatctagaatattttaaaatttttaaaattttctttagtcgttaacatattttctttttagactaatatttggattgatttaattatagataagaacaatagaggaatgtattattgatcaattgtgttttccttttctttttttgagacagagcctccctttgttgcccaggttggggtgcagtgatgctcttggctcactgcaacctccacctcccaggttcaagtgattctcctgcctcagccttctgagtagctgggattacacacatgtgccaccatgcctggctaatttttttgtatttttagtatagacagggtttcaccatgttgaccaggctggtcttgacctcaggcaattgggctgcctcagcctcccaaagtgctgggattacaggccaacatgcctggccaattgtgttttttcttttgaaaatttttgccttagaatggttagctttagatgtcatataatagttaaatggtattatatagatattattattaattataaatgattctcataggtttatgcagaaattatggcagttctaaagcatgacgatcagcataccataaatacccaagacattgcatctgatctgtgtcaactca

SEQ ID NO: 108691 - DNA, 1067 bp, Homo sapiens
gggtagaggatattaccaagagaatgctagaagtgaaggaccatacagactaagatggttgtggaaagaggcaaagagacaggggtgtcatagatcaggagagcttagcagggtcacggaacagaagatctcaacaagagagaatgggtgtgctggaataactgggtgaaaaaactggaaatttaggaaactatgaccatacaatgagatgtctaaataattgatttcaaagtgaagaaattctttgaattagcatgggagccctgataattcctgagccctgataagtagagaagaaagtcattggaaacttctgagcttgattaagtgctccagctagacactgaagtcacccaggatgataataacactgggaagaaagaaaaccctgagcagtgttctaaagttatcaatgagtttggtaatcagtgtgttgcatagttacccataatgaggagtagaaaatggtagtatacctgggtggcttgaacttcaaaggaacaggtttttcttatataagaagagagttggaaggatctgaggaagaggagggggcagactcaaatccttagaagtactttaggtgtccaagaatgacctacttcacccctaagaaggatactggaaaaaggtaagcagattgcagtaaaggcaaggcagtactgaggtagtcaactgaaggagttgctgtaatttactaaaattctaaacaggtggatttatctttttaataaacaaattttcaaaattacagatacaagagttctcagaagtcaaccgattggtctggagtaaagaagccaatttacttaagtaaattgggtagtaactttgcagaatggtcagcatcttgggcaggttatcttattacaaaggtaagaaaccctgttcagtttgttaactgaatggaaattctaaaggaaaccagaacatctatctgaatgcctagcacacacaataatcattgaagtatttgtgctgataatcatagaaatttttgaagaaaatgttaactaatagagaataataatttctctgtagttactaataatagcttctgagtgaaa

SEQ ID NO: 108692 - DNA, 1033 bp, Homo sapiens
agccacataaaattaagaggttgatagagtgcgttttcaatagcgttgattcccttttgtatgaaaaactaaaataccaggttagcctgtagctcaattttatagcttggactgcttgatatttactccagaggacctagggaaatatggaatttcttaaaagcatattcatatttttgctgcctttaagttatactccctactttatgttttttttttttttaatttgggctctttatatataatcactaaatctggattaaaggatggctgtatttgggagactgaaatttagaaccagatagaacaactgcagttcaaaatcaccatagaaataactttaggagaaaacatcaggttatgactaggcagagcctggcttgtatcccagtatcagtagttttctagctaagtttactataaatttgataaaaatcatccagagaactatacgcgtgatgattcaaaatagggatttgaattttttctcctggtttagtgtgatggttaactgagagattattggatttttcaactgttagaaacttggaatacagtgaaatatgtatatatatatatatatatatattatttgggtataagactttgggtatagggcatttgttatttcctaagcttttattggtgatttgaaagaaacccatgccattcaaaaaaatcctacacacaggtagccgtaagatgagagctgtgtgaacatgtttaaatgttaatgctgaggaacaaatagaaagggtcatgttgaagtaatgtgagagagaagtgatagttggtgtagtaaggaccccaaggagcatccggaatgggagagccgtggcccttatagggaattatacttagaaggaatagatctctttttttgcaatagggaaagataaaataatggatggaacacagctaagtttacagatttcattgcgggaagcaatgattttgtttttactctgtgaagtaggaggtataggagatgacctcattggctgaaagtggcaatggagttggtgtaggtgac

SEQ ID NO: 108693 - DNA, 1016 bp, Homo sapiens
cctttcatatgtatacttagaggccactgtagggtcattaattggcctaatttcaatattcttatgtctttggaaatatgaagtcccaaagagagtgagggggatggaacggctggtcagaacacacaccacatttatcgattaggttcactgtcttatatgggcacagtttgtggagccccaaagcaattacaacagtaacatcaaagatcactgatcatatatcactataacagatatagtaataatgaaaaagtttgaaatattttgagaattaccgaaatgcgacatagagacatgaagtgagcatatgttgttgggaaaatggcactgatagatttactgcatgcatagtggccacaaaccttctatttctaaaaaaacaaacagacaaaaaaaacagcatccatgaagcataaataaagcgaagtgcaataaaatgagttatggctgtatttttataactaagatatgtagaacattgacgaatataaagcgttatctgcttcactgtggacttacaaatgtaaaatatgtatttgtaggagttgctttctatttatgactgtagagagatggagaccaacggcccaggtcaccaattgtggaggagatttcctgagcatgttcgggaaatactagaacctcatctaaataccaggtatgtaggcttatttaatgtattttcataaaattgtttttaattatataaaaataatgcgatttttttggccgggtgcagtggctcacgcctgtaatcccagcactttgggaggctgaggcgggcggatcacgaggtcaggagttcgagatcagcctgaccaacatggtgaaacgccatctctactaaaaatacaaaaattagccgggcgtggtggtgcacatctgtaatcccagctacttgggaggctggggcaggagaatcacttgaacccaggaggcagaggttgcagtgagccgagattgtgccattgcactacagcctgggtgacagagcgagactttgtttggaaaaa

SEQ ID NO: 108694 - DNA, 1026 bp, Homo sapiens
acaaaagagttctctgtcctattgaggtttatatatttcatttacaaagaactattcagcttatccttaataaaagcttcacctagaaccagacaatcagttaacttctgagtttatttcttttactattgcagaaacctttagccaaaagcaataaagtttgaaccccatctagggtgttatattcttgtaaataaagcttcctaatataataatgacaatacttaaagcctaatcaattatttaaatattactttttaaacattattgctagtgtttccatggataactagtttccaggatattacagtagtaatgttttgtagtcaaatgagtttgggaactccatatagaacaaaattaaatgtgaccttttaaaaaaaatgtgacttttaatgtatctgtgtgcattgtgaatctctaagactatatctccaagagttatactatatgcgtatattaaaattattccttagaggttctcagatgactcttgggctctacagaatgcaacgtaggagatgctatgtatacattttgtgtttttttttggacggagtctcgctctgtcacccaggctggagtgcagtggtgcgatcttggcttactgcaacctctgcctcctggattcaagcgattgtcctgcctcagcctcccgagtagctgggattacaggcgtgcaccaccacgcctggctaatttttgtatttttagtagagatgggctttcaccatattggccagtctggtcttgaactcctgacctcatgatccgctctccttggcctcccagaatgctggaattagagccattagccaccatgcctggcctacattttgctttttaagggttaaaaaacaaacaatgcaaattgtcagagatatgcaaaagttgaataattttttgtacaccttagaaatagcctaaaaagctttacattttggctttttagctacagattatattgtagtcttgataccaaacttagtttgaacctcactgtcttttcctttgtctaagttaaat

SEQ ID NO: 108695 - DNA, 1106 bp, Homo sapiens
tccaagaaagctttctggaaataaaagacctaatctacatattgaaaagacttgtatcctggagaaaattgacccaggataattaactctgagacatatcctagactttaataataaaaagtcttcaaagcttcctggccaaaaaattttttttcaaaaaattacttgcaaggagaaaaaaaagtagattggtatcagaattctcagtaggaatgtacagagtgggcctagaaaatagcagcatttttttaaaatgtcaaaaaatgtcataaagtatgagtcaagaaagagtcaagctgtccttagagtatcatgtatgagaacacggttttaaacctacaagaattgaagtaatatggttttcacaagtgatcccttcctaagagatgtattagaggatgagcttcattaagtcaagagatgactgggcagactttggcaaaaggtctgatggttactgtttatgtatttaacgaaatatataagactaaaacaacaatagggcaagtgtgggataattatatgtaaatgttatattctaataaactagaaataatgcaatttttttaaatgagagaagggggagagtaaggagtaagtaagataagctcagtaattgttgcataggcaataactggaagtcaaaatataccattttacaccggcaaactagttatagaaagtcaaataaggaaaagagggagtgtaggtatttcaaaaaattaccttaatttttattttacctttaaggtaaataatatttcacctttaattaatattaaaggtattaatatattggataggctgggcacggtagctcacgcctgtaatcccagcactttgggaggccaaggcaggcagatcacgaggtcaggagttcaagaccagcctgaccaacatggtgaaacgctgtctctactaaaaatacaaaaattaaccaggcatgatggcgcacctgtaatcccagctgctcaggaggctgaagcaggagaatcgcttgaacccgggaggcagaggttgcagtgagccgagattgcgccactgcactccagcctgggtgacacagtgagactctgcctcaaaaaaaaaaaaaaaaaaaaaatata

SEQ ID NO: 108696 - DNA, 1030 bp, Homo sapiens
actaaattcaggacatcttgaatttaatatcattaggacaaaaatttccttaactactgattactaggaagtattccatttactacaaaaattgttatatggtctcaaatttaaatgattttaattcagtttgttttatatatgtgtatggcagtttgggatagatatgaaagaaattaaacaatatgcattatacctttaataaattagaaattgtactgttctagatgaatactgggctaaaataacaaatcaccttcaagggaaaaaacaaaaaagaactcaacttgtatttttcaaatttataattaccacataagacataagcaattggacaaaacaaactggccaacatttattcaatcttttgtattatctgagaatagatgacaccctgatactgggtgggaagcacttgtccttagggctcatctgcttctggcagcatgtttataagctttactctgaagcactacttaactctataggccttgaacagtttgatgtctttgatgaagttaatgggacccaaacatgtcagttctgtgagggtgaagatgatgaccacactgagaactggccttcgattcaaggatgattttcctgaattgtgttgcaggtaaatgactgcctgagtttattaattttttttttttttgcattttccagtagcactaacttgaattcttatctctttgagggaaattgggttcaaataataaataaggtagaaagactatttatttgtatttaaaatagaacatatttacttcttttaaaacattttactatggaagtcttttaacatactgggaaatagaagagttatcaatgaacctacatacctatttcccaactttagcagttatcaacattgctagttttttttaatccacttctacctttttgattgttggttggggtattttagagaagatcccagaatcttatcattgtgcttgtaaatactttagatgtatctaacggatgaggacatttaaaaaataaccttcatgaattattatactta

SEQ ID NO: 108697 - DNA, 1130 bp, Homo sapiens
ccttcattatctgaaggtaattgaatatttctatatattttacttttttatataaattagcattataggaaagatgtaacattcttctaggaaagagggtgagtaaattatagcctatcctagaagaatgtaagtttaaatgttgttatgttaaataatctttgtcctgagagcatattaaatagaattctccttttgttttctttgatcatttcaccataatgggatatgataggcatcctttcatgggagaggttctcagcctatttcattatagtacttttcagttgattggagttataagttgactgatgatacacacttaattatatccataggaagaggcaatcaccttcaaatgtagtataatgtctatattttagttacttggtgttctgattacaatttggtccaggtttttggtagtttttacatttaaaattataacctgtgcttcttttttttggtgtcatattaacaaaatatctctgaggaatatgaaactacatgggaacaggaaaactatgagaaatatgcatataactttactgttttctctgatgttaatttacttaatttgtttcataatatatgccagcagcacatctctttccacgagagttagtgaatatcaaatgtatttattcatcttgagaaagtattattcgactgtatattgtggagatagaatgatagtaataagtatttatggagtatttaatacatgtcagaaattgagctaaacaattgatatggatcatttcatgcaatcctcacagttacccaatgagataaaggtactcttaattttttttttttttttttgtgatgggagttttgctctgtagcccaggctggagtgcagtggcacgatctcggctcactgcaacctccacctcctgggttcaagcgattctcctgccttagcctcctgagtagctgggattacaggtgtctgccaccaggcctggctaatttttgtatttttagtagaggtggggtttcaccatgttggccaggctggtgtccaactcctggctgcaagtgatccacctgccttggcctcccaaagtgctggaattacaggtgtgaaccaacacgcccagccaaaggtactatttttttgtttt

SEQ ID NO: 108698 - DNA, 2197 bp, Homo sapiens
actattttttataaagtggctaagttgccatatttcagttacttctgaacattgttttaattgttttaaatcttagtataaatttcaggctgggcgcggtggctcacgcctgtaatcccagcactttgggaggccgaggcgggcagatcacgaggtcagaagatcgagatcatcctggctaacacggtgaaaccctgtctctactaaaaatacaaaaaattagccaagcgtggtggttggcgcctgtagtcccagctactcgggaggctgaggcaggagaatggcgtgaacccgggaggcggagcttgcagtgagccgagatggcgccactgcactccagcctgggagacagagtgagactctgtctcacaaaaaaaaaaaatttttttgaatagttgatattacatagtatgttttattctaaatatgtttcatgttttaaccaaatttatattgcatatgaatatctctctactatattcataattatagaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactggtaaaacaaacttcttgtttcttggggttgggtttcctgtaatgaacttggatttactgtttactcattattcacttgactcatgtaaccttagaacacaaacttttcactgaagtagttaataaatttattttctattgagtcaaatgctaggtacggtgctaagcactgtatatatcttagttaatatttacaatagtcctgtaaggtaaaggctattatgcctattttaaaaattagaaactgacactcagagaaactgaggctcttttttgtctgaagccaaaactgactttcctggggacacatgattagaaagtaccagaacacatttgtgtacaactcaaaacccagtgtttggctgttgaagacagggtctcgctttgtctcccaggctggtgcacagtggcatgatcatggctcactacagccttgatctctatccggggctcaagtgagcctcccatgtagctggaactataggcatgtgccgccacaccctaatttagaaaaaattttttttgtagagatgggtttccctatattggcccggctggtctcaaactcctgggctcaagtgatcctcccacctcaggctcccaaagtcatttggttcccaaatcctaagggtgatttaagctgacataaatagattcaacttaaaatagtaataacatattacttgatttgcatgtttactttaaattgttatagataaatttcgtactcacaatttcttttggctttactacaattttatgtttgactataacaaaattcatcttaattccaatgtttttaacaaaatgtacttactgcagccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaaggtgagtacaaattagcaacagatcagaataacctttaaagataatcagtatagaaatatgctttcttttttgcctgaagcctaagtgcgtgtttggaatactcagaagttttttcctgatttcagttctattaaatttgtcaataatagaagttctgagttgccaatttatgtgcataatattttgattctttagtcaatagaaattatttataacttcaaagttttttaatttgggagtttgaggaatgccgtgattcttctttaaaacaggcatagataacatgtttttataaagtcacatttaatttctttgggttcacagacctcagaccatcgtttatagatctctgtgttaagaatttctgcttatccaatgatcattatgatagtatttcaaatgtctttatttttatttaaaagagatatgattaaggaaaagttataattaatgacttattttgtgcttctgtagtaaacagttcatttgaagatcatatcc

SEQ ID NO: 108699 - DNA, 2520 bp, Homo sapiens
gtgggtcagaacacatacatttatccattaagtttgccaccttatatcggtgtggttcatgacagctccaaacaattacaatagtaacatcaaacgtcactgatcacagatcaccataacagatacgataataatgaaaatgtttgaaatattttgagaattaccaaaatgtgatacagagacatgaagtgaccacatgctattggaaaaatggcactgatacacttgcttgatgcagagttaccacaaccttcaatttgtgacaaatgcagtatctgcaacgtgcaataaaactgggtatgcctgtgttctaaactattatgtttccattgtgaagagaatgttttacactcttgttagtgaagtttattctttaaaagtcaatcgtcaaggatttagcaaatgaattagcacttcggatatacttgtttatttaatatcttttttgtttatttcaaagaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagaggtaagtaatttttcaggttactagttaagtatgtattttgttcatcatttaattgtatacatatgtgcaaaatgtaataataagaaaatagaatatctttaatagtaatttatatttggaacataatgattttcatagtgtagtctggctcactattatggacttttactttgatttcagaaggatttgttcattaagttggtaatgaactgccaatggagtagaatgtttctaagtagaatctgtgaagtgtaaatgtatttgttgcattattaattaaaagggggcagttaccaacttaattgcagaagctttggtcaatcagattatgtgtctgacaagttataatcaatcacttttagaaaacctatgaatgattaatcatgccaaattatgcgcttttttctatttggactgtgggagtcaggtaatacaataaaatcatcagagatgcagtaacttgattaaatattttagtttattaatcttgctggattaaagttacatgaagaaagttggtaattcccttacagaattttttataagggaattaaaatttatagcattttggtaagaggaaaaacaggatgtagagagaaggatttgtttaaaccttctaagactatagaaccatagtctatatatagacttaaataatatagatcaatttagatgtttattttgctttatgagactctaaaagtagtttcactagaaaacacctaacatctaatacattcttgctgcctatgaataatataaatatattttctaaggaatatttctggaaattattttttattttctcagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggagtatgatgaccttcattcagtttgtatttagccattaaataaaactttgttcacttttaaaaatcagctttagttaagtgctttgatttaaatacacaaagaacatctttctaaatgtagccaagggagtgcttaaaatatttttataattattgtagacggttagtagtataaaacatttcatggttaaata

SEQ ID NO: 108700 - DNA, 1007 bp, Homo sapiens
aaagctaggcctgggatccaggttttctcattttctggggtctttttaccactccctgcagatactcttctttacctccattattaaacttcctttttctcttctacttataccatgaagtctggcttaagcagaaaattagttgtttctcttactaagcttcctagtacctcataaattcctttcaaaaagtgccctttcactgaagccccacctaacaatttgctggtcctgaaaacgccctccttccttccctcagtcacctgggccctttgcccaaaatgcctgtttgcctccctctttccgtattgaagtcctgctcatgctgcaaggtgtagctcaggtgtgacctctttttggaagccttccttgattgccttagcatgaagtagctctccctcttctgaaccctatagcacttactactgttgtttgtgctgttagtatccccattgtatatagtatcctgagtattttagcacctcccaacttcccgaccaggaagttggcaggttgtgtaagctcttggaggttaaagcctatgacttaaacatcccacccagcactaagcacaaagtatattcttagcccctgtttgtgggagggagtgggggaaggaagtgcagtatgtatagttttgtaaagagatttcatgtgtgttctataatatggggaaggccatgttagagctgtatcaagacagcagccaagtccatttctgattcctcatattttgataacagatcacagattagttagggggattacaggagacaggcgtaaaaacacgggtcagttggtccaggccctggattaagcctgtgactcaaagtggagaaaagagggcacagaattaagaaatgtaaaggaagaagcatgtggtgaaagactaaatgcagagaaggaaagacatgttgaaaatgaatttcagggttggggtgttagtaatgggtttataatgttctttttatcttaaaagtacctccaattggctgggtgtggtggct

SEQ ID NO: 108701 - DNA, 1072 bp, Homo sapiens
ttaccatggccctttgtaaaatgacaaatatctttcttaaaataataatagtaatattagtaactagtattacagaatatcttccatgaaccaggcactatactaaatacaagtaatatatcatttcatctttataaaccatcctgtgagataggtgcaacaattactcatttatttttaatttttattttttaaaaacagggtttcagtctgtcacccaatctggagtggaatggcacagtcataactcactgtaaccttgaactcctgggctcaagcagtcctcccgcctcagcctcccaggtgtggaccaacgtgcccggcttattaaaaaaaatttttttatagtgataaggtcttgctatgttgtctaggctgatctcaaacttttagcctcaagcaatcctcccacctcagcttcccgaagccctgagattacaggcatgaaccactgcacctgacctaccctcattttctagatgagaaaattgaggcttagagagatagataaaagcatttatctgaggtcatatagtttacaagtggctgagctgagatttgaccccaggcctatctgactttatacactgagcgctcaaataacttaatcaaatatcttaacaaaaatgcaaagctctttctgaggtaactctaacagatgcttagaatagccacaggtttcagctggtggaaccaccaacattctttgagccacatttaaaaaaaccaaaacaacagtggtaaatcgttccggttttttttttttttcattccacttagtctttatctccttttctcttgaagcattcctagagaaagggacagcagctttttctctgggtacaccattaaagccacttctgatctgctcccaccctcttttggggtggagctgtgattggggagtgagttggtggtcatccagggcgtgtctgtggagttggcaatgggaaactgggaagctcaccttgtgtaggagcctaagaactctggagtgaccaggtataaggatttctttccctggggtgtcaggatccactgctggaagctcctggaatatctatggatcatg

SEQ ID NO: 108702 - DNA, 1848 bp, Homo sapiens
ttaagagaatgttgttttgcttgtaataaaacataaagttaatagaaattcacattaacttttagaattccatagtactatggcagcaagcatccaatgtatattgagtacttccacctacatcaatcccagtaattctcaaaatgctttgtgaagggagtaggaactgaggctcaaagaggctgtgtcatttggtctgagactcacatagcttgtcagtagaagagatgagatttgaactcagggctgtggaagcctatactctgctgcctgccagactccagagtttccagtggttttaaatcatgaatgtatcaaaggacacaggcttgagtccttatcttactggatatttttactgccagccaaaggagatagtatgtctctgtgtttaaggccccactgaaattggttggtccggttaacagcatacctgttgactgctaacaaagggaaactaagccagctttgcctggggcactaattcctgccacatgtcttctgaaaatgcagcctgagggtcataaagcaggcaatgagctatgtgggagaacaacattagctgagtatgtttgccagcagttacattgctcaatgtatgtcttagttacttctcaagttttttcaataagtgagtgtcagagaggatttaattttaaatatttatctttaaattggagtagatgtggtaatactgtgtgaatgcacttgaaatggaataataaagttgcatagatagttgtctgaggaaggtttggaaaatttccctgcttattcagctaatttttgtaaactgcccaagatgattgatcacagattaatacaaagtttctttctatactaccaaaatatcagactttatgtattagtcaggatagagtagtctgtgctgcagtaacaaattaactgtgacatctccattactgtcttgctcatgtaaatgtcagtgtttattggctgttctccagggcagctcacctatatgcaatgactcagaaatccaggctgctgtgatttttgtgactttgctttcctaacatggggctttcaagtggtcccaccagaggaaggggaactggatgatcacgtacagctctgaaatgctttggcctagagtgacaaatatcactttgactcacagcctgttggctagaactaagctcatcaccctgcttaatagcaagggcctagaaataagagggagcacataggtattcagtgaacaataaatgtcttttgcatccctggttttagagcaacagaagcagttaaatcgtttgccaaagtctcttctgtagagatagaaaagtggactgaatatttagtgataattacttgataaaaaattgtaagtgaattttgccgtaaactattaacatttgcaataatttatgtatagctgatttagcaacctgatttccatttgtggatatggttataccttctaagggtataacaataaagttagcttcttttacattataatacttcagctgatggtgctgatgatcaaagcttgtatgtatgtatgtatttattttgagatggagtcttgctctttcgcgcaggctggagtgcagtggtgccatcttgtctcactgcaatctccacctccctggttcaaacgattctcctgcctcagcctcgcgagtagctgggattacaggcacaggccaccatacccagctaatttttgtatttttagtagagctggggtttcaccatgttggccaagctgatctcgaattcctgacctcagttgatccatccgcctcggcctcccacaaagcttgtatttattaagtatctcctatgtgccaggtactctaagtgttttatatgaattac

SEQ ID NO: 108703 - DNA, 1045 bp, Homo sapiens
atgtcagacttcaggaatggaaaaataccttttatttcatctaccaccacccaattacctccagatttattcctttttttctatctaggtttcactggattctttctttctgaaagataagctacgactagcttgaatttctaggtgaattggactttgaattctttgatcatttctttgcagagagtaatccaggttaatgaatgacaatgtaactgaatacactttacacggtatccttattacagagaaaaaaatataaaaatacttccttgtgtataaactgaactctggccttcacatctttgcactaacaataacactttctgacttcatgcagaatatttttaaaatctcagtattgtttttaaatgccatatgtcttattttccttctcccacatgcataatttagaaagtcttagtattgtttttaaaggccgtatgccttatttttcttctttcactttttatagccatttagtgttttgtctttatgacattatcattttgacagttttgtatttttcttccaaaaaattttcctcatactctgttggatctcaattcttctgcaatttgctcttaggaaacccatggtaaacaggagaatataaatacctttttttttttttgctttagtttgcaaatgcatgcaagtgaaaggtgaacccagtgaaaggtgagcacagtgaatagacattgggataatgacaccactatgtttgccccttactcatcaagctcattctctagtgtaatagagccctccatgaaaaacagtcatatggtagatcagggaggagaaaatgatcaccgctggtcttgtgcttagatttctcacaaacctaataacgactaaaattaatgtgagtaaaatatcatgcaacatgagttttattgaccaatacaaagaaaaacgatatgtttaaaaaaaaaaagcactccaaaaaaaaaaaaaaccaaaaaactgtgaaactcaggaagctcatgttttacaaatcattactgtgaaataaagtaaactaaattctacaaatctctgg

SEQ ID NO: 108704 - DNA, 1032 bp, Homo sapiens
aaataaagattatattttctatgtagatacgtaactgagagggaaaatagacaaaaaatgtagatttttcagcgaagagaaatttagggtgagagattagaacttgaaaaaaaataagcaaaagcaacactgttaggttttatcagtctggaaaatttcaaaatccctctgtcagtagaaggcattgtttagagtggcatattaaaaatgatctgctttttatagtcactgaattcttgctaggtatcttttccaacttgctcgctttcttatttttcatgtttgaattctttttgctagtgttcagcatgcttttggaatttttcagtgtgaataggattgctaaatatttccattattatttactgtctattaagataacatgggaaatatttatcagtcatctttattatgtatgtcctcatacatctgccaaaaatgtatttgactttgactgtcattggattattttcctctgtaaatttgtgttttaatatatccttatgaaatttgaagcttgatcatatcacatcccaaattcatatgttagtatgtcctcattggcagagaattttctctctagggaattaaataaaacacaattaaatattaaacgctcacatcaaattgaaccagatatgtgggctacgtacagaaagatcatctcagaattcatttatgattacagaaggtacacaggccataaactatcagactttgttcaaatcatagttccactatttaatctgaatgacctctgtgagccttggtttttttcatatataaaacaagactaataaacttaatttgaagagttacagagcaagctaaatgtgatcatgaatggaagaatacagtatgtgtttattaatggtcagggagggaggaggaaagcacttcatatgtcacagcacatttgagtgttaaatatatgttaactcctcttttccctcttagtaacctacttctaagatatttgttatttttattactattttttattatttgtagacgtcaaattgagcctgcaaa

SEQ ID NO: 108705 - DNA, 1095 bp, Homo sapiens
cagttctatttgcaaaataataataataataataataataataataataataataccatactagacaggaatgagaatgaattcatttaaagtaaaaaagaaaaatacatgaaacataagattccagaacctatagaaatacttcagtgatttttttttatacagaatgtttcatgtgcctaaagataatctattcagatcttaattaccttcatatcagactttctccctctatcacccagtactgggcccagctcccttcactgccatatggtttgtgctcagagaatgcaaagtaatttaatatgaaccttagcgaaacataacttattggacaagctgttggaggagaaaagccatataatatatcacaaagctagcaatttaaaaaatcaattgctattgctttatgtccttagcatacagcattgaaaatagactaaacagccatacgttaaccttctcaggagaacatatttttctgaatccaaagtagtaatatttttactttgagaattcctacttgttcataagttccttcctcttaaccctcattcccgaacacaaacagctgcctactgagtagctattgtgattttcctgtaattatgttttaagttaaaaaataatgtataaataatacaggaacttattcttactgtacaagttttaggaagtatgtaagtatatggaataaaataaaacattccacccttactctctcatactccccttttcctgacctctttctttacctaatagaggtaattgctattaactgtccttagcatatataggtacataaatacatttgactctaaatttttttaaataaatgagatcaaattgtatgaagtgttctgccattttctttttaaaatttgatatgtcttgcaaagcttttcatatcaatacatagagatctaccttatgtccaatggtggccaaggagtttatagtatagtttacttaacagctccctactgccaggcacttaagttgtttccaaatttataaatattgtggcaatgaatgtccttggatgtatacctttgtaaatatttatgtaaacattttggacagattcttagactg

SEQ ID NO: 108706 - DNA, 1015 bp, Homo sapiens
ttcctggaaaaggtgatgagttcagttttaagcttgaatttgaggtaattttaggaaaatgggggtggtgaaaggagatactaaaactggaaagacagacttggtgatcagttgaataaaagggttgagaaatgggagtgcataaaccttttaagggagagcaaccctagagaacagccgacctgagagtttggctctacttagaactgaggtggcagaaacatcgcgaaagtgcttggcattttgcatatgcttaatgataaaatctttaaagagagtgcaaatggttaagaaatgaggcagtgaatgctaaaacatagttgaggtgagggaggtatttttccaactacagaaggcattatgtttgaaggctataataagtggcactagcagaaaaattttaattataaacaaggtagcactataggaatttcagaaaagacaaatttaccctttttagccataaatttcccttgctaagaagacagagaaggtggtagatcagcaaataataatcataattaccatttattgagtccttcgtgtcactatgttaagcactttacacattgtttaattttctaaatactctgagcaaaaaggtgagcattagagaagttaagtaactgtctactgtcatacagcttttaagcagaacagctgggtttcatatccaggtctgtctacacacaaggtgaaagccaagctttggagttgtatggccctgggttgacttttggctgagctactgattagctgtgtagcatactgctcatttattccataaatattcaaagcttgccctgtgtcaggtgccttgctagtcgctgtggctacatagtgccctcaaagagctcactattcagggaaggtggcaaataagaaaacaagaatcacagtatggggtgtcagcaatactatataaatcagctaaggggggagtgtgggaccacatgagaagggcatctgttttacagaaaccttagcggtttaaactaacagcagggctacatct

SEQ ID NO: 108707 - DNA, 1050 bp, Homo sapiens
ttcagttatatgatcagaagagtctgaaaataatgaaaattaaaggtcagatgtttatgaatgttcatctatgctttattttctaggataaatctataagcacaagtttacctgtcctagatttaatagatgccattgcaccaaatgcagttcgtcaagaaatgatcaggagagaaaacttatctgatgaggacaagctgaacaatgctaagtaagcctttatggtttatattacaatacatggccctttaattctctaaaatccttataggaaaagttactatgcccttaaaattcatatttttaaatataacttatatgtgagtcttagatttaagactcacaaacttaaccttttcgtaaaactaatcttgtcaaaatatttcactcttttgttaaaatatgttaagtgaaaacacagtggataacaccaagatatttttcttgtctcttcaagatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcacagtttacaggattctgaaatgtagtgggtgtaaaaccagagattatttgtatgctcaaaatagttatatattcattaatgaattcaatatcctgttcatactagttagagctggtcagcctttttgggtaacacagttaatttaccaactgatacagataatagaatatattcataatcaagctgatacttcatgattaaattatttttgttgcttaaaagtcgtattagacaagactaaatcattcttttttatggttcaaaaaagatgaatacaaacgtttttgcaggttctgctgtgaaatgtggtttgatttttttggtgtgttaattttgatcataaatgcattcatactcataatccagtttaatccttttatttgcttcctccaactatttaaagtggtccaa

SEQ ID NO: 108708 - DNA, 1052 bp, Homo sapiens
atatctgcctgttctgtgaggtcttggagctaaaactggttttttacattttatatttcaaatggttaaaaaaaatttcgtaacacatgaaaagtctataaaattcaaatttcagtgtccataaacaaaattttcttagaacacatccactatcatttgtttacatatggtctgtggctgcttttgtgttgaaagggcagagttgagtagctgtgactgagagtgcatggcccacaaagcttaaaatatttactctctaaccctttttcagaaaactttgttgacccctgtgctacagtataaagtattagtaagtaatataagttgcaatagggaaaagagtaaacaaggaagggggtgagtgtgggctcagtggagtcagggaagtgaaaaattacaaaatacggggcttggggagttggtccatgtgaatcccacctgagtttgctaaaggcacttaaggagttaggctcctaccctccctggaggctgagagataggggccctgtcttcaggtgttggctggaacaaaagtaaatttttatgtcagctttgagttttctcgggcaggcattttaagaggggctagggtcatcctagggatccggccttcagctgttagaaacacttaagtgttttgttcaagtttatatgggccaaggtggaggccttgtggagaagggctcagaaaagcctgactagagtttggttaaggagagaatcttggtcagcagctgtgttagttaagaggctattgcagagtccaggaggaagatcatgggggtttggactgtgggtagcagtatacatggagacaagtagatgattatgggagatattttagagagggggctaagaagacgtgctgttgaattggtatactccctgtggaattgattgaaaatggtttctttttccttgactgaaaaagactaccatctagccaaaaaagtaaacagattatgttgcacttccttctatgtgttatattttaaaagacaaaagatgtaactcttgaaagcaacttcgttataaaatgaatggcatttata

SEQ ID NO: 108709 - DNA, 1047 bp, Homo sapiens
ctttatttaaatacactcaatgacagcaagatcataccttcttttattttattttatttttttgagacttagtttcgctcttgttttgttgtccaggctgcagtgcaatggcgtgatctcaggtcactgcaacctccacttcccgggttcaagtgattctcctgcttcagcctccggagtaactgggattacaggcacgtcccaccatgcccagctaattttgtatttttaatagagatggggtttcaccatgttggccagtctggtctggaactcttgacctaaggtgatctacccttctcggcctcccaaagtgctgggattacaggcccagccaagatcatatcttgatagcccttttacttctagagaggcaatattaaatatttttatatattttaaataactgagggaatataaactggctataagcagaagaaaaatattgtttcttttagcgtttcagtaatggtaatattcttttagcatttcaatgaattcattctgtattcttggcttgccagattgtctttttggcaattgactttcaaatttaggttttttatttaatagtatacagattatattatgaacaatggaattatgaactttaatcttatgcatatctagtgatgtttttcatacagttaagtatgtttcataagaaacatgaggaccacttttctcttaagggattaaatatattttattcttctttataaccagtaatgcaatgataagatggaaaagggctagttttaggtttctctgtaattttaaataaagtcattaatttgaagtcctcaataaataaataagtatataaacaaattagtcataaaagaggaggaaaatcagataagtatatcagaaaatattaaaacttaccagtgatcaaaggaaattaaattacaatttcatgatagtatttttcactataaattgggagtgatcatgcctaagacgggtgagtaaaactttagtgtgaaatgggtacctccttatattattggtaatataaactattaaaaggactttaacaatatg

SEQ ID NO: 108710 - DNA, 1042 bp, Homo sapiens
cttccaaatattgttgatccatggttggtttaatccacagatgtaggacacagagatacagagggccaactctacagtatactagaaattttcttgaaagcacaataaacaacaaaactctgtccaattctttttttcactacagtgttaattctacaaattatattctgttttgggataaatcattttaaaacagaaggttgaccaaatattattgtggattacctgaataatgtcattttataataatttcaaacctgatcacatgagtatatatagaattatcaggacccttaagttatacttcacaacatgagcattatattggaaaaatattgcctatgaaatttgtcaactaagaagatttgtaaactttggtaaattagtttctgtacctgaactaaaatttttctcatatttgggaatatttttcctttcttctcacatgaaattcagttttaatcaggcttaagagtgtctttaataccttttaagaaatccgcagtgctttcttggagcaagaataggtctaatatttagctttttattgtttttgctatcttgacttcttggcttctggtaactaaaatcaatagtttctctagactgaagatgtccaacattagttagtggtatctttttctatggattgtgcatgataactttgaaatttcataaatattattatgagtttttatatattaaacatgaaaaaatggctaagtaagctaataataatagttaatacttatagagtgcatgctatgaaccaggcgctattctgagggctttacctttaatcttcacaactttattagtagatactattattattcccattttacagatggggaagttgaggcttagagaaatttaaaaacttgttaaaggtcatttaccaagtagcagagcccagatttgaatctaggtaatctggctccatagtctatcctcttaacctctacatgcttttattgttagaaaaagggaaaaaacaaaactatgttgaatgtatagaattgatttttaaactcttattcag

SEQ ID NO: 108711 - DNA, 1050 bp, Homo sapiens
taaataatagaaaaaaggaaagccaaatgttggttctttaaaatgactaatataattgacaaaactctgaccaaattaagaaaagctaatttttgtatttttagtagagatggggttttgccatgttgttcaggctgatcttgaactcctgatctcaggtgatccatctgccttggcctcccaaagtgctgggattataggcgtgagccacagcactgggccacgaatagcctctttttgacaaaggctctctggatgtacaagtgtgggattgcccatggatgcatggaatcgggtgttctgggtgagtagctctgggatatacataaaaatttgttctgaagtattctaaagttattattaaaaatcctggttttgatttttttgtcatttgcttctcccttttaaaaacaaaatcaacaattgagtttaaaaggctaaaatttgattagatataaatgaaacatctttgcctgaatgatgtccctgtagcattctaatactaagattgggttagatttcaacgagatgaagcttttaagtatagaaacctatgaagaaaatttacaagctgaaagtaagacttcatatatctgattaattcatctcacaaaaaaactgatattaatagtaacataatgcaggtaagagcctcccagctgaaaaggaaaaagacttggattctcattcacagtgtggcaatgggagaactttagtttccttatctgtaacatgaagttgaattggatactttctgagatcccttatggtcttaagtggtttctggatccttgaatatgtactttttttttttttttgagatggagtttcactctgttgaccaggctggagtgcagtgacgtgattttggctcactacaacctctgcctcccaggttcaaactattctcctgcctcagcttcctgagtagctgggattacagccgcacaccaccatgcccagctaatgtttcactatgttggccaggctggtctcaaactcctgacctcaggtgatccacctgccttggcctcctaaagtgctgagatt

SEQ ID NO: 108712 - DNA, 1021 bp, Homo sapiens
ttgaatttggctttttgccgatgagagtcttaaaacagattttatcatccaggcacaatggcgtgtgcctgtagtcccagctactttggagtctgaggcaggagaatcgcttaagttcagtagtttaagaccagcctggggaacatggcaagacccccatctctaaaaagcaaaaacaagaaacccagattttatcgtggatggaatacatgtataatcttaccatttgcagaagagaacatttatctagaggtaacttacagtctaagttgtttcacacatgatacatagagaaaaagattaatttctgtattctctttctttaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggattacagaacaaccactaaacttctttttatagatagtgggacattgtagaaggaatattcccttttagcaataagaatagtgtgatttatgcataagattgcc

SEQ ID NO: 108713 - DNA, 1003 bp, Homo sapiens
ctgtgttttgtctatttggtatacttttaaatttgtctacttcttagttcttaagattcttatagccagtgccaggctcaaaataaatatttagtgatgggttgcatctaattacagatgtaacacactttacacatgaacagtatttctaaaaacctatgctactcatgtttaggcaattgcatattttaaggatgtcctcaggggaacaccctatgattccttttgtaaagtgagggattaacctacattctgtgagttccaatttgttgttctgggtttttctaaacagggcacacactcagagtacgcctgtattttcttatagtgtttgttttatataaaggaagaagagaacagggctacatttgtgctatctttgaactcaggtttaaaattcaatagagggtattgagttgtcctggtgaaattagagcagtagttggtagcatggagaatttattttgcgtggttttaaattttttctttgtagtgatagattggtggctcagggaaataaatgataattttaaatgggtagattcagaactaaagaccaattatgcttgaattcatttttcgtgaaacttatgtcttctttgaattaaggtttaaaacccaccgtggccttgtgtcaacaaaagtgtagacggacggggactctggagggcaattattgttcaagtgactttggtaagaaataaaagccagtctttttctctttaaccagaaacttgaggctgcatgcttaatctcaaaggaattcctatgaatttatggtgaagggtcaataacgctgctcatttatccaagaaaatacttgcctatacaccagaatggtcaaattgttagatttcaccactgagaaaaatatggatttagaaaatatacttttttcatataagcttaataatttgactcttggtacatgatactgccacattgtgtgttctggctgactattcctgcaaaaaacctatgtacttttttccttatatatttt

SEQ ID NO: 108714 - DNA, 1002 bp, Homo sapiens
ttgtgtactcagttgtctgagggcaggcacaggaaaaacagatttctctgaagattcatacagggctgaagggcagaggggaagggaccttaaggcattgtgtagaaaatgattgaaataatggaccatggaaatgaaatagaattgctaaggaagtaaagacaggccagggctgacgggttgggaaaaatgagagcagccaatatattgaaccatcaaagatggaagaaaacatagtcatagagtgattaaataaataagcttggaggggagaacgctgtcctggttgccagcaggtctaaatttgatagactggcaatgaacagccatagcatgaagacatccgagcctggaactgagtgtctaggaaagtccctggtgaagatgaggccacggggactgcgggatcagacatgggagggtggacccatagaaacgatcgcgggaacacagccagggagggctgagaaccgggaccagctttgtgagtgaagggcaaggagacagatgacagttaagatgaggaggggaaggagagagccagtgacttgcaggccagacagcaggccccaccaaagcaggagaagggcatgttggacacccaccccacttccagactgaccttcggaggctgagaagcagccggttcccaatgggcccgggaaagggcgctcaccatcagacacaccacaactttttgactcagttaactgagtaaatttaattccataaatttacagctgaagtgaggttcccaacttctggaacaatggtatgtctctcccttccaaacatcttctgagctctttctctcccttttttaaaaatgcatatttaagctattatatgtattttaacattaaattacatatgttttaatattgccatctgcttcagattctttctggagttaactagggggtacagattaagagtatataaataggctgggcgcggtggcttacacctgtaatcccagcactttcagaggccgagacaggc

SEQ ID NO: 108715 - DNA, 1015 bp, Homo sapiens
gtgcagaaaatgagaaaacctgtttggggagcttttccctgttaaaaaatgaacaggaggagcactggggataggtagacagcaccccatcatacttggtttgattcagtgtagatcaatgccattgaattctgttcagaaacattgattcctccccggctgtgtgctgggcacctggaatacaaagataaattaaaactgcaaagaaaagtactgggagggaacagaataaggcagataagtaaattggctaatgaatgtcctgggtgggtttttgagttctttggcccagtctggacaagtgatcagggaaagcttttgaaaggagattgtgcctctcgaagatgagtcttgaaggaagagttggagttagagacagcagggaggacaagctcatcccaagcagaggtaactccattaataaagatacgcgggagagatgtgtgttatttctgcagccaaaaccttgagttggggcctctatacagatgaggcaggagggttgagttggcttccgtgtgctgcagagatggtaacgctcaactgaatttaggccaggcgtgacaggaccagaggctctagaacccccgtcctagagaaggtgagcagggagcctagttcagagactgttgcaatggtccaggtaaagtcgaggaggtggagaagggtggtagaaatgaagaggagggtgtggatcaagaaatacttaggaggcaaaaatggcaggacatggtgtttggttggctgtagtgactgaaggacaggaagactatggaatgataactagagacagctaacagtaactggctctataccacatgaaacagcatctcagtccgttcttgggatttgccaatgcagagtggatctaagtgaaatttcctcttgtctgcctagtgatttataacaatttgcagatgtaacatggcccccagtacatttgtggcactgtgattctgtcacatttatcctaaagctcagttgcagcagaacaaaaatatgtctttgttcctaa

SEQ ID NO: 108716 - DNA, 1063 bp, Homo sapiens
aagagtgaaactctgtctcaaaaaaaaaaaaaatttactctcagcaattttgaagtttattatatgttattattaactatagttaccatgctgtacaatagatctccaaaaccaattatagtcttaaagtaggttgctagtgttacataatgttcccatacttttgtagctgtaagtgaacagagttcttaagttgaatatcctaactagagttgatctgagtttgagatgatcttttggaaagattacaattaaaagcaaaagaataccacagttttttttttaactaaataagaaatatgcaacaaaaagcacttaatgcatactttttttacaaaggaaaatcgtagtatcctccaaatctggggagaggaagaattccatttgaggttattcaacaatgctattaatatttgacacttctattgtgctttctctaaagcttatagaattaaagtttgagaagtttgatgtggagcgagataactactgccgatatgattatgtggctgtgtttaatggcggggaagtcaacgatgctagaagaattggaaagtattgtggtgatagtccacctgcgtaagtagcacctatttatgtctttaatagttttatggctctaaacttgtttcttgttcagtttcccaatcacatttgttttctggaagattttatgttgttgttgttttgttaaattattgggtcctctattagttctcgcactgctgtaaagaaatacctgagactgggtaatttatttaaaaaaagaggtttaattggctcagggttctgcatgttgtacaggaagcatgaggcttctgcttctggggaggactcaggaaatgtacaatcatggtggaaaggaaagagggagcacacacatcacatggccagagtagaagcaaggtcgaggggaggtgccacatgcttttaaatgaccagagagcagagagctcactgtcgccaaggtggatggtgtttaaaccatgagaaaccgccctgatgatccagtcatctcccaccacgcttctcctcaacattggggattatattacatttgggc

SEQ ID NO: 108717 - DNA, 1054 bp, Homo sapiens
gaagagatgcacaaatttagtgggaaatggattctatatcatcataggagtgtggtttacacaggtatatccatttttcagatttgtacagctaagatttgtgcatttcagagtatgtgaatttctctccccaaaacctgtaaaataataataataaaaacaatgaagcaggtcgtggggattgggtggcaatatagatagaataatagaatgatgactattattgtaactgggtaatggatatgtaggaggtcattatattattctacttactttgtatatacttgaaatttttcattaaatggagatttagaaattattccaacctccatttttataatacattatcttaaatttagaagtttgatttaagaatggttggatatattctgtgtcaaagaaatattccattgaagtataattattttagtttcagttcagtttttatttgttatttacattcaagtaaaattaaatttagaacttcgtattaaaataattcttacattatttctgccaacctacaggtacatatgcaacttatgagtacagatgcctgaaatgatatttgtcacctattaattttgatgagtttttggtggctaaaactggggatttgggggtatatttttgcttccttccttgtgcctttctgtattgctgaaaatttgtaaatattatttttacaaacaaaatttattcttaaaacatatatatattatatacatattatatatatatcatgggaagttttctagtaatgagagctgtctatatcaactaattcaaattttgtccctgggtgtttactaaataccaatgccttgaggagccttaacatctctatgattttttgagcctgcaagctttctgagtgagtgcatattcaaatgttttgtcttccttgtctaaggaaaaaaaaagaaaagaggccctgagtccacttctcccctctctcgtgttgctatgctatgtcaggtaacaaagatcattcattgtgtgtgttggggggttatgtatgtaaccatatgtttaagagaaaatgtaagcgctt

SEQ ID NO: 108718 - DNA, 2114 bp, Homo sapiens
aggatggtctcgatctcctgaccttgtgatccgcccacctcggcctcccaaagtgctgggattacagatgtgagccactgtgcctggccaagaaatgatatttttaaatgtttctttgctaagcaatatctctaggtattagaatatgcaaatatatgctaaggtccaatcaggactggtattcattctaagcaatgactcatctattaataatactgacctaatattttgcagctttgttgaggtaagttcttaaggaataagattgtgaatcctggagaattgcagaatttgtcaaaagaaaataagtacttaaattttttaggaatgcaatatgctagaaaacttcccttgggttagttcagatatgagagaggaaaaagcattatcttggatattatactttacacacttaagtaagtgactagatgtcaaagcctcagatattgttttcatgacagttttctaattggcgcttttcttggcaggttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggtactgtttccacataatggcaataacaacagtaatgttggttcactgttcttggcacttgatgtttatttactcctttaaagcttaagagtggttctcaaagagctagtgaatgccatcaaaccatgatgagaccaatacaaaaaatcagccttttaatttaagtccacatgcattcttgtaaatcaagtatagaaattcatagagtaaaaatgtggagcttacatacataagcacacatgcaaatatgcaaacacaccccttcaccactccatagtccattctccagaaatagccatggccagtggttcccatacctttctatgtgtgcttgcttttatttgagtacttatacaatagcttttaaaaaataaaagtggagcccaggcatggtggctcatgcctgtaatcccaacactgggggaccaagggcaggtggatctcttgagctcagaaattcaagaccagcctgggcaaaatggtgaaaccccatctctacaaaaaatacaaaaattatctgggtgtggtggcacacacctgttgtcccagctacttgggaggctgaggtaggagaatcacctgagcccagggaggtcactgctgcagtgaccgtgatcatgccactgtgctgcagcctgggtgttgttgagaccctgtctcaaacaacaacaaatatatatatacacacacacagatatatgagatatagtgagctcccaagcgtagaaatctctacttttgaaagatcactgcagtgggcaatatttgtatgttttcagccttttacccaagagcagtccataatctgcttttggattggactgtagtgcaacatttttacttgaaaggtcagaggacagaatctggggctgaaagagcagccagaatgttggggaggaaatccaggcagggagttacagaattgaggcacaaaatattcgtataaaatctactgaaatctttgtctgacagctaaactctacatatgtggaggagagcccagttggcctggcacaaaagcatcagctgaaaaatgaaagaactgaaaagagattacagctgctgcctgctgccagggaaacagactttaagtttgagtctagccaagttaaatgcctgctagaacaaaattatttttatcagaacacaacagaatctagagtataatgtatcatgcataatgtccagtctgtagttatgtaatgaaacaggaaaagtgtgtccctattcaaggacaaaagcagtcaataagaactgatctcaaggtaactcacatgttgcaattagcaaacaagtactttaaagctgctattacatgtttgtttcaggatttataaagggaaatatgtgcataataaataaacaaattg

SEQ ID NO: 108719 - DNA, 1051 bp, Homo sapiens
cgggggttatctccactggtgtcttcaggctgggcccaaggtggatgggagtttccacgccccttctagacatccaggggtaaagtttttttagtgaaatccccaaaaacaaaagaaaatgttcaaaacatctcgttatttctacaatcaaaatatgttttattttttaaacatgtataagatttacctttacaagagtagtattgaaatatacccagaatatagatgaataagatcttgtaagcttctgatttatccccctctagaaagactgccaaatatttttacataatttgtctatagatctttctggactacctttggaggtccatgggagaggtgacactgagtggtcacctcgagctttacgtagatcaactgtgcctcgagctttacgtagatcaactgtggtctgcattttagaatgcacgttcccaaaggtttgtttgtggaagagggaaatcgtagaagattagaatgatggcttaaaaaaaaatcacgtgctgcaaaaacagttctttttgatcaaagtagtaaatgatgtgtttagggaggaaaagctgcagacacaaaggagcattcccatttctgcagaaatgcactcctccacacagaagaagctggcctcctgtttgcattttgctcatagtatcctaaaaatgcaaaccatcagcttaaaatgcagttcctctgtcctctggcaggagccccggcatcgagagctttggcacgtttgcttgtgacagtgaggacatcccaggagctgtggggtgagttgaggtcactgtggaagctctacgctttggcccacacgggactttgctgttgataggaaaaaacacaaacgtcgaattgtttttctgcaggcagataatgaatccccaaatcaatataatctcacaaaacagtagcttcatctatttgccaccaaaaaagcaccttgagtttctgcattaagtgttagcatttacaggagatttgaaatataaagtttccaaaaagatatgcatctgctttttgcaaagaatggcttagaaaagagagtggcctt

SEQ ID NO: 108720 - DNA, 1056 bp, Homo sapiens
caggcactcaataaatggtagtgttgctttatttatttattttttaacctcccttccaggtctgtaataaggaatagaagtgtggtgtttgtgcagaacttgtctacaagccaacttgtttcaagctggttggtaatccatttggagcatggggagttcccattggaaatacccattcctactcactatgtcctttcttcatttaaaatatgatctttcataagatcatggactttgtccacagaattgcttccaaaccctccctacttcaaccagccactgcctaccccatcatcaaccaagggcattccataaccgttaagacttttcaaagtagagaaaagattgtcagttaaaaattgcaaataattttctctgtttatagatggagactttaatttacctttggagtcccaaatcatcagaataggccccactaattacataaattaagtaaagactgtattcatttattcctaatagagacacaacatgatatggtggttaagagtgtattttctaagagtgtaatttctggagccagacagcctggttcaaatgctagttccactgttgtgctggtgagtctccaaagatgacctccccaatcaccacacctcctggtattcatgcctttttctggcatcccccagcattgaatctgggcttgcttttggaacaaattggatggagcagaggtgacattgcatgacttctggggcaagaacataagaagctgccatataaggcccaccatgctgtgaggatgcccaacatagccatgtagagaggctttgtggagagagagaggcccagaaagctcctagtagttccagtcttctcagctgaggtgccaaccatgtgagtgaagtcatgttgaagggctagcccagtgagccttcagatgactcaagcccaagctcctaactggtagtaaatgcatgagagaattcaagctagaaccatccagctgagaccagtgacccacagaaccataacaaataagagtacattattattttaagccactaaatttgggggtggtttgttgtgcag

SEQ ID NO: 108721 - DNA, 1264 bp, Homo sapiens
ttatacaatctaggtttgtataaatgcactctgtgatatttgcacaacagtcacctaatgatgcatttttcagaatatatctccatcattaaacaatgcatgactgtatacttgtgatagaaatcatggaactaaaaataataatagtatatatagtttttggtataccttcaaatatattgaattattttatttgcatctgattctctggggttggggtgacagaccttagtatgaccatttcataaatggggaaattgaagtctaaagaacttgtgtcttaactaatgtcatacttgtaaatggtatacaaagggtagcacacaactttctgactcagggataccattatactctcatgcacttatttatcaaatattcaccaagagtttttgagcacttcctgtgtagtaggcattgcactggactgtgggggtagaaagacaaggcataatttctgtcctcagggagtttataatcttgtggggagcagttagacaagagaattggtaacagttatgtgtgtaaattattataatgcccactgtaagcagttttaagtgttgataatttggagtaaagcttattttcacttttaaaaattattgaagatcttaagattagttaagataaaaataattattgcttcgtgcaaagagtatgacccgttttacttgtgtgctactctaagactggataagttgttactgtatcctttgtaaggatttgtttgacttcccagggttattttacatgtgccttgatatttccaaagatgcctaataaacaattacgtgaagccattcctgtaacattgccttgagggcaattttataacttacatatgttaaagtcatcatacttaatccatcctccagatgcctgatcaattttaaatggcattcctatttagttgaaggaactagtagattaaaaatgtgattgggatttatgtcttcccgataacttttatatggcttcatgagaagaaagtcagcagtggtgagcaaagggtttgtgaaaattgagacatagtgatagtctagtaagatcagtgctgggtgtataatttgagaaaacaaatagtgaatttaggcaggaactcaactttgaagtcacttaattatacctaagggtatggcaaggggttctaaaattactgtaactattatttgcctggtataaccacagcaggacagataggggaatggaattttgactttaaacacatatttcttggctttaaactgcacgtaggatttag

SEQ ID NO: 108722 - DNA, 1048 bp, Homo sapiens
ccaatggcgagtgattttcagaaagggggaggagaactgggcatctctccaaatatgggaacgacaaactttttttatattaaccaattgcttgcctgtctttctttaaaaccatgcttctcattcagcctggctcttaccttctctcccactcccccagttaaattgatgtatttaccattttcctacaagactttgccacaatgccgaggacttgattatacatatatataatcttgtgttattatgatggagacagatggcgctggactgaatgctttgtcaggctataatttaaatattctaggagctagcaaattttcagatcccttatatggtgcaagcattgattaatcaacattaacttttatttatattaataggctacacctttctgaaggtaacatcagattgttagaccatgtttcaaattacattatcttttcttcttttatgttcccagacctgttttcacatgtggtggcattcttactggagagtctggatttattggcagtgaaggttttcctggagtgtaccctccaaatagcaaatgtacttggaaaatcacagtaagcattttttaaaaaggtattctcctggaagtgggtgttggcaacagtgtgaggctgctgcctttttcctctggtgttaggatttgagtaagaggcaaatgcctgaaatagtgaaatgttggatttaccccaactattgggaagatttttattaatataatagatctagtcgtgtcctgcattagtgattacaaagggcacaagataatgcttgaaggaataaattctcagagcagatgtgtttctgaaagcccagtgtgactcagttgagttttatagattcataattaaagctgttttcagtcaaaggcctgttgtaatgaccttcataagttttttgttgctcgtgccttcataaattcccagtgggaaatggaagatcaaagatagtgctttgactactctatgctcattaggaaaggaaaaagaaaaaaaataaaaaaagcccacttaatgttcctgggttgaaacca

SEQ ID NO: 108723 - DNA, 1385 bp, Homo sapiens
aggagaataaatggttgttgattttgcacgcatttcaagaatatgctatctaatagcataagtgtttttagataattgtttatttgaaagtcatagttttaaattataaagggaaatattgctcaattcactttctggtaatgatttgcagtcctcgtaaaccagaaaatacttcattcaggactaagctaagttttcaaaatttaaaataaataacaaagtattaaatgtgcctaaataggaaactatttgaactaaaatacacagccatttcttaatttatagattgatgactgtgttcatatgctcactaaagagttaggattttaacaccaatcattctgttgttgacactcataagacattgattttaccatgtgattttagaatttactaaaacccatattattggctcttaaaaacacatatttgacttggaactacagttctgaccaaaattataaaccttaaatgtcctgagaagttgatgtgttaaaattgagagacttttattagtttgttctcacgccgctatgaagaaatacccgagactgggtaatttataaagaaaagaagtttaattgactcacagtttcacatggctggggagtcctcaggaaacttataatcatggcagaaggcacctcctcacagggtgataggagaaggggaaaagccccttacaaaaccatcagctctcatgagcattcactcaccaccaggagaacagcatgggggaaaccattcccacgattcaattacctccacctggtcccacccttgacacctggggattattacaattcaaggtgagatttgggtggagacacagccaaaccatatcaagactcaagtgcactttgaaggtatatgtaaggtccatctctgtgagaccagtttctggacttgtgtgataacagaattagtataatggacaaggagctacccccacaggcagtagaaaagtggagagagaaaaagaacaaaagccctgtgggtagattctttaaaacaaaaagtggagtggtgggtgaactgatccttattatccagcctctgctgttaccaggttgcacagagaatcagcatcatgggaatatgaaaatattcaccaatgaactgaccacttataaaattaggccccactcaaacattccttgctacacaatgctagtatctagctgggcccaatatgtcaacattgtcagctaatctctgattcactcatcaaccttgtaaacgtctgaaaatgtcgtgtaaatccattgcacatttattccatagtgcggtactcatcttgtaaaaaatccggaatgttcataagttagttcacactgggcacggtggctcaggcctgtaatcccagcactttgggaggcagaggt

SEQ ID NO: 108724 - DNA, 1058 bp, Homo sapiens
ggctggcacttctaaaacaattgctggttttgtttatgcttttaatcacttctctgtaaacagagaagctcagcacaattccctggaggaaccggtatccttgtgtgtgttactttgcacatagaagttaaatttatatatgtctatatttaatttagaatctcttactgagattgtaaatacactttgcacagttgttgacgagtgtcagtgtctcatcctttgtgaagtgcaaggagattcctgttaggttacagaggctaatttgtacttacaacagatgttattcctcagctgtaacttaattcaatagatgcattcaaggacaactgtggaaatcaggatatttccacatgcaaatttatttgcatgtcattgttgttttttctagagccccaaagaacattggtttggaagctagagaaacagggtgaagcgtattatgtagtttctttgtaaaatgggacctcaatttcagaaggaactttcaggaggaagacttctagcaaggattaatgagtttgagaacaataactaaaacaccaaatttgtcattttaattttttgttgttcttccaggtccacagacagaattctcttcttgtcctttgtctttgaccttaaggagaggccacttaaggataaaattatacccatatcatttttcaggtgattatgctgcatgagtacagtgagatgacacactttttgccacacaggtttcagcacccagtatgtcccagagagaatgaggattcactttcctcttccctttgccttttccttcgtccactgttctttcctattccatcttagattttgtagaccacatataataatgacaagaggacattctagttgaaaactggtttggcttcacttcatgtttgcaaataggtaccatatacactagtcaaagccagggatgatttgttaaactatacagtttatttgctgaatttattaaatttcttgatgttttagaagtgaatatttactttgaatctccccatttgcacggaactatccaggtttattacacatttcaaggtaatgtg

SEQ ID NO: 108725 - DNA, 1056 bp, Homo sapiens
ctgtcataatgactgcccagatagctgctttttatttattttatttcttttttttttttttttttttttttgtgaaagagtttcgctctgtcgcccaggctggagtgctggagtgcagtggcacaatctcggctcattgcaacctccgcctcccgggttcaagtgattctcctgcctcagcctccctagtagctgggactacaggcgcccgccagtacgcccggctaattttttgtattttagtagagacggggtttcaccatgttggccaggatggtctcgatctcttgacctcgtgatccacccgcctcagcctcccaaagtgatgggattacaggcgtgagccaccgtgccccgccctgcttccctgctttttatttctaacacataatttattagagaaattgtaagatcattttggctaatactacagtatttagaatttctagcctttgatatctggtttgatttcctttcctctggaaagaacagatgagtggcttatattttacaatacagatggagtgaacagatacttctgtttcatgattcgtcgttttctttggtagttacattcccgttaatatggatagggatgcttattatatttctagacattgggaaaatgttaattttaaatgtacaatatggcaaaattattaacatttcttaattataaaaagattaaattagataacctctacaggtcttctagttggggtgttttttttttttttttttttttttttttgagagggagtcttgccttgtcgcccaggctggagtgcagtggtgcaatctcagctcactgcaacctctgcctcctgggttcaagcaattcttctgcctcagcctcccgagtagctgggactacaggcgcctggccaatttttgtatttttagtagagatggggtttcatctgttggcctcttgaccttgtgaccccccccccccgcctcggcctcccaaagtgcggggattataggcgtgagccaccgtgcctggcttctagttttaaaatgatactttatgtatgtgtatgtacttgaatgact

SEQ ID NO: 108726 - DNA, 2357 bp, Homo sapiens
cacttgtttaaacttttgaagttgaaaccaaagagactgaatgatggcaaaacgattttctttctattttgagaaaatttattttgaatcctctcctgaaacccaatattgacttttaggttataaactgctttatttttctcaaagggattttaatataaatttaaaatagttagcagcaatgttactcttctattctgcatctcccaaaggcaagcctatttaatgactagggaatttaaagtcttgattttgtaattggttagcttctcattttagtaggagagagaaaccttcagatttcagtattttaggttgtatttaataaacatttcctaccttttaagtttataaatcaaatgagtaactgactgaacaaaaaggtctacagacaatgtattcaggctatatttcagaaggaagttgcttctaagttacataaatgaagacttcattaaaatagtgttttcttatatttaaaattgatatagttttacttgagctgaaactttaaatattgtaggtgatattttaatcccagcaaagaatgaaattatgttcataaatatcagtattattgacgaagaatgaggtagtttaccaaattataaaaaataagtgatttataatatgtaaaatgagtgttgtaggtggtaaattcctgccccaggaccatggaaatgtttgcctccatttgcttatttgaggatctgttttctgtcattgcaacttttccccagaaacatctgtactttccccctcaaatgcttttattcttgttctaagcattagtgtcagtctcttctatttttaccttttttttttaacatgacttttgcatgtttttgaccttgagctagtaaatgaagacattctttgatgaatacttaacatcagagtcaagtaagataggcacctgatgtgtagagtagccccaacttttctttacaatgaaatttaaaaaaaaacggcagtctattctgaagacttagttatcagttgatgtgtattaaagttttagatagcattaagaatctatatgtaaaagtatgctttttatttcttagcctcttctggaaaacaaacttaaagcattcagtattggaaaaatgagtacagctaagcgaactttaagtaaaaaggaacaggaagaattaaagaaaaaggtaatgttgaaaatgtattttgaattatccttggaaatgaatgtgtctaaggggttagtaagtgtattagaggaatgtttcccgaagattcttaacctctaggatattctcaggtccgcctctgagtcaagtctgtaatacaacatatattcctaggagttgagcttctatccttgttccctcaccctgtttcttttttctttgttatagttttggctattttctaatctattctttttgtataagtaaagtgtatgtgtgtgtagacacattgtacccattccccttagattaatgatagcatgctttatacagtacacttttttcctacttgcttttttaacttaacattgtatctcagaaattacctcaagtatatagaaatactccttattcatttgctatggctgtgtagatatgcaatcatttattcaactaaaattctatcgagggcatttatgttttgttcttttgccattaaaagtaatgctgttatggataatgttatgcatatgtttggtttttttgctagtgttatctttgggatatattcttataggtgagatttgggatatattcttataagtgagattactgggttgagtgataaatgcataaatgtagtttttctatatttgtcattgtcaaattgctctctgtaggggcagtgacatgttgcacccctgtcagtagtgtatgaatgaatgtttccccatagcactgccagtagaggacttttgccaatctcctacatgaaaaatggtatctcagtgtagttttacatttggatttctctcattatgagtaaagtttaacagtttttcttgtgtttgtttctgtgaactgtctgctcatatctgaaccatttttttctataagttatattaacactttgttatacaaggtacaattttttttctcactttgttgattgtctttttattttgctgctggtgttttgctccatgcagaaactattgtacaatcagatttatcagtctttccctatgatttctggtttttcagttttttccattaccagcttataaagaaatttcctcatgttttcctctactactgaatggtttcttttttaagaatattaaatcagattattttgtagtttattctggtatgtggtgtcaagaatagattaatttttgtcttttttcaaataattattcagttatc

SEQ ID NO: 108727 - DNA, 1017 bp, Homo sapiens
agaataattgaaaatatcaagattcttctgagctttctttatatcaagattcttctgagctttccttaatgccacttgtcagtagatattgctgcttcaacttctaatactcatgtttttggtgatttgaaaaatatttatattcactgaattaaatcatcatgccttggaaacttggtaaacattactagcaaaatatgttttcatatagtcagttgtcatataatttgatgcttgagttgtctctagacaaatttactaattaatctatacttaggggttcttttctagttctgcaaattgccggtagaggagcaaagcctctcttggtttcattaattaatacttaatatcttctaaagattagacgttattacttgttaggactgcttaacctgggaagggagggttttcgtccatattattccttgatgaatttagccttgtgtacattaacaatttttgtattgtgtaatattaatattttcatgtgtatttaggaggatgaaaaggcagctgctgagatttatgaggagtttcttgctgcttttgaaggaagtgatggtaataaagtgaaaacatttgtgcgagggggtgttgttaatgcagctaaaggtaagtttataaagtataactgctaataaagcataactgtattacagtttttgagcgagccccatcttggttgaatgactgcaggtagataattatgaaaggaagtttggttgcttttgaattttacattttctatcagcaccctctagtggttattattaattagcaagataaatggccaagtgtcaattaatgagatgctgaagacagatagcttttaaacatatttagttcctttcaagttttaagacagcagagcacttgtcacaaattttaatatgtgtcatagttttgctatgaaatgattaaattagcattattgaggtgatatttgaatttaatttcatatttgttaatagtgatacatcttaatactaaaagcattttactaatttttacttg

SEQ ID NO: 108728 - DNA, 1870 bp, Homo sapiens
gttattactaaccagtttgctatgagattgttttagatattataatatttggtgggctatctttgaaaataaattagcatttagtccagcacctgggttgcttgcattacgaggattcagttcaattgatttacttaatgtccagagtcctgtttgcagtggaaacagtatactcactgggatgggagtgaggggcagttagacttagcaagaaacaaattcagtggttttagtgtttaatttcctcctcacctttaaagtaggctttgtgttccattggtagtatgatatatcagaaatttgctcgtggttgtattatagctgagggaccctctaatcttggttatcagtaccagtatttaattacagatatttctagttatttgatgatagtaatttgataagcgctattctgaaatgtgaatgaacaaattttggctcattataagtgattgtaaatattttcaacagaattcaagaggaacgtgatgagagacataaaacaaaaggcagattaagtcgatttgaacctcctcagtcagattctgatggtcagcgtcgttctagtaagtggcatttattttaatgtgtatgcttgtgattaattacagtagttcccaccttatccgtggcgggttacattccaaggatcaccagtggatgtctgaaaccatggatatatactatccttttccttacacattcatagctgtggtaaaaattaatttgtaaattaggcacagtaagagattaacaacaataagtaatagaacaattataacaatatactgaaataaaagttatgtgcaatcccaacactttgggaggccgaggcaagtggattacctaaggtcaggagttcgagaccagcctggccaacatgatgaaaccctgtctgtactaaaaatacaaaattagccgggcgtggtggtgcgtgcctgtaatcccagctactcaggaggctgaggcagaaggattgcttgaacctgagaggcagaggttgcagtgagccgagaacgtgccattgcactccagcctgggcgacagagcaagagtctgtctcaaaaaacaacaacaacaacaacagagttgtgtgaagtggtctctctttttgtctctcagaaataccttactgtaacaaactgggggaaacaaaggtgagggtaaggggggactactgtattataaaaactaataattgtcttcttttctcccctttaagtggacgcgccttcaagaagaaatagatcatctggtggtaatacagttttttgctcttttaatcgataaattttccaaactttatgttttgcaggttataattctttttttctttctgccctagttcttgatgattacgcacctggctcacatgatgtaggagatccaagcactactaatttataccttggaaacattaatccacaggtaatattaagtaagatgaatgttgattgatatgctttatgcttttggaagaaagctttgttagtcaaaaaaaatcaagattctgaagctgacaaatctgatggaattggatagtctttagagttgtcttactggtatggcccaggttgtcttgccacatattcttgtttcctctttcagtaactagattgaactctggatttgaaatgttttactaggtgctgattttattattaaatcagggtgtgaccattgatgaataatattattttgagactgtccacttctgatgcatacttgtttccttgtggagtccctttttcttctcatagtagtaaactactctttgtggtttgtcttttatattttaattcttttcctgcattggtgctgttaattatgatatggggaatgtagtaacggtagtatataatatgctatt

SEQ ID NO: 108729 - DNA, 3028 bp, Homo sapiens
tctgcatttgattacatgggtagttgattgttagaacagatgattagatactttttttcttcattgtcaatacatatttcctctttaatttaaatgtactaaccatgcctgcttgaaaaatgttactaaatgcctaaacaaaccatcactataaaacatcttacttagatccaggaccttaaaacaaaggaagatagagagtaaaaatgattttgatttcttcatccactgaacttccccaccctggcatcttaaataaaccagaatatttatagtatgaaatgatttatgaatgccccacgcgggattttacttgtgtggcgttcctggtacttaaatggaaaattgaagcacgttgctatgttgctttttattttgtaaaaactactttgttttctgaaaataattttttcttttcccttttttgcataataaaaatcttttaccctttttaatagatgaatgaagaaatgctgtgccaagaatttggaagatttggaccgttagccagtgtgaaaatcatgtggcctagaactgatgaagaaagagccagagagagaaattgcggctttgtggcctttatgaatagaagagatgctgaaagagctttaaaaaatttgaatggtaagaacatttttattatccatttatacaattcagatatttctttggtttggaaaagtatttataaaaactaggaaggattggacctgaaatggagaggttaaaatgaaaattatttcaactcaccagaaaaattttgtttggaaacttttgagagttaacaaaatgacctttcatttctttcttgtaggaaaaatgattatgtcttttgaaatgaagttaggttggggtaaagctgtacctattcctccacatccaatatacattccgccttctatgatggaacatacgcttcccccacctccatccggactgccttttaatgcgcagcctagagagcggttaaaaaaccctaatgctcctatgttaccgccacctaaaaacaaagaggattttgagaaggtaatttaaaaaatggacataaggccgcatctaatttgtaaatactaaagctgtggtagtatttcttttcaacaattttatagaaaatgtgtgtgtaattctgtttggcaacttttaaagaaataagtagatgtgttccctgccttagcccatggaaaccctatatttgaaatactaggtcatatttttatttgtggctaccattccttttttgaccacttgttaagttttttttcctttgtccagtgttgtatccagatttgcttaagtgtattaactaaatttactttgttctgagaaagtgatactttgtatttggttaagtgacatttcaattagaaagacctcctaagtagttattgtttggatggcagctagatctgaggtattagaatatttgagaagatttatgtggtttgtaaaaaatagttaatctagtaaaagcaaagggtgagtattttctttttagtaaataaaaccaacttaatttcaagttataagaattcgttggttctattatgaattaattacacttaaaatgacagggctggttttaaaggcttgggaacaaagtagcgaactgtatggtcagaggcaaacagttaattatttcacaaattaaaatctttatctgataattctcagtgtagtacctatttcagtgcattgatgtgcattctggcaggaatgttctgattctttgcatttggtgaacgtttattgttcactgaacacatccatttgcatttatgtaattgcttagtgtataatgacttcaaatgcagtgattgcctgcaaaacttgtgattagatatgtagtattttcaatgcatatgtatatttttgcttgttacttgttaacaatactcacatattctatgtttattatctgatgtgacttcatatacagactctgtcgcaagccatagtcaaagtggttatcccaacagaaaggtacatgtttttctttattattactgatctaaatatagacaatatccccttctgaatttaaaaagaaatggtgttgaggaaaaggtagtatcttgactgagcaatggttccttcccagtactttttgcggggggatgtgtgaaatttaactaacttttgtatactttgcaattttatgtcagtatctttttttgtttttattgttatcactgtagggaatgtttatagtttgactagttagagtgtatttattagctctgatttggagtcagacaatagactattgtcatgggaaaatagatgttttaagtgtgtcgtaaatttcagataacgttacagtttgacccaatctgttgttatttttttcttgttttctgaattatctgcatttaatatataaccttggtttgagttctccttactgaaggcatagctttgttttttgttttttcaattgattttaagaagaaattcctattattgtcatgaacactggacatactagaaactttcttttcatggtaacaaaggtatttggaattcttttattttcctttcttcctttttttctctttcaacacactattaaagcagaagaattcatgctgtaggtatgctcttgctcagtcaagctaagccttttcccaaacacaggaacacaacactggttgaataataaatgaacacaaaagaataccaaattctctttgacattggccttggtgagcaacaccagctgaactgtctgcggcagcgggggaccaggaaaacatcatgggatggattgggaaagtatacagtttttgaccagacattggtacgatcgactccaataaatgtggttttattataactgagagacaattttttgtttttgttttttttttggttattgttgcccagaataagataattaccattttaaaattaaataatgcactttaaatatatcatctttttgtactacactgttttattctaatagaaaagtcaccatttttaaaataaacacaatccttaaggaagaagaatgtgattacagttcttt

SEQ ID NO: 108730 - DNA, 2344 bp, Homo sapiens
ttcactcaccattaggatgaatcctttgtttttaaacttgctaaacaattttcctctatcttaaatgctaaagtcaagttgcttttgacttaattcacacaagtttctggatgtataacatttgtccacctagtaattagtcttatacataaaatttcccttagctttaatttggctcctatcagtggggagttttggaattgaatcataactttacattatcgcccttccttcaaaataatgtcattaaccatatgaatgctgaagaactgcatatttgcagagcaattacttctgtgaaagagaaataatttttaaatagaaaattaagcaatgtttttagttttttgttttgacaatttgaggttgaattagtagttttaaatgcatgatttcccctttgtaaagatttaaactgtgatgcaattttttttacttcctttaggcttaaatttttttcactatggagagatttcattttaagtaggtttgtttgaaagctatgagaaaataattatagtcaccttgagatagattattttattgttcatgtactctgaaatagggcattatagagccacaaaagtctgtcttgttctataactatatatttatttacattctagcagttatatgaacgtaatttgagctgggaatgctaaaggtgtaatttagtgtgtgctttgtaccaagagccaatatccttttgcttttcccaattgttatttgccagctgtgtatggatggggactggtgaaatgaggaatcaaaagcagcttataaataacctgagtcatttttgcccgacaccataatcaatgtccaaaattgtgtttggagtctaataaaatatcacatgattttaggacccagcttcagataaagacttcctgtgagttcagtcaataaaatgactgtactaaaaaattactcacatatgtttatttttggtaaaatattggaaaataattgttacagaaaatgggaagggcatctcaccgtgtaccccattttgcaatattttggaaagagtagtactccattcacttaaggctttggcaacataatttcttcattgattgatagtgtacaggcatatcaatctcttgttttggagggaaaaaagatatataaaggcagaattatctatttcatgaattgtgaactagtttgaagtgtggtccaaagggatgttgcctcattaaaggtcagatttaataaaaaatgcatctggtgtgtgtaccagaaaaacacaggagttggatggattttttattaaatcaggccttaaacttgttaaatagttttgcatttttataaattatagtcatggttataacatttcagtagcaccataaaagtgcttggtttaggaattttttttttttaaactgagatagtgtgtaaatttctagatggctgtaataacatgcaggctctaagttactgattttatatatcaatatttgcagctttctaattagttgtgatttataatttaatgttttacttttggaaaataagtgacatttagaaaattaaatattactatgaggctgtattgtggtttcctaccctccctcacctttccatcccctcccacttccctactcccactgccccacaccctcttaatgcacaaggcattaacatatgctccaggttacttttttggtattaaattcggtgttagtcagcagaataatcattttctgcacaattatagtaacttaggtcaagtgtagttttatatagtggtaggtctgaatccattttctttaactgtgttgttgttgtaggaatttgctcgccctgatacatcgaatgatagagtttgttgtacgtgaagggccaatgtttgaagctatgattatgaacagagaaatcaacaatcctatgttcaggtgtgcattttttaaaaattgtgaaatatatgtaacataaaatttcccattttaactatttttaagtatacagttcagtgtcattaagtacattcacattgttgtacaaccatcaccaccatccatctccagaacttttttcatcttccaaaatggaaattctttacctgtgtagcagtaactcctcagtcttctagcccgttagccccggcaactgccattctactttctgtctcttagtaatttcattactcagggtaaactcacatgagtataatcatacaatatttgtccttttgtgactagcttatttcatttagcataatgtcctcaggattcatctgtattatagcatgtatcgggatttccttttttaaggccaaataatattccattatatgtatttactatattttatcttcaggcatgcagtttaaaac

SEQ ID NO: 108731 - DNA, 1416 bp, Homo sapiens
aacgatcataagactcatgatgcatgccttctgagtattaatgtcagtcactaaggcagtctagggctgcagtaaaggaatggggataggtagcgggtggtagtgggtgagattctcttcagggatctttgtttttgttttatttagaactaaataggcaaataatatttctcatttatttatatttaattgaagatagctctttgttaaagaatatgatgtttaatgtttgtttgttttgtgtaggttcttatttgaaaaccagacaccagcccatgtttactataggtggaagctttattctattctgcaggcaagtagaatcaattactttgttaattttgactctgagtaattagacctttataataactctaaatgtttgttagggagattctccaactaaatggcggacggaagattttcgtatgttcaaaaatggatctttttggaggccaccaccattaaatccgtacttgcatggaatgtcagaagagcaagaaacagaagcttttgtagaggaacctagtaaaaagggagcacttaaggaagagtaagatatttttcctttctattatatattcagaaaagtaactgtaatggttgctttaattaatggtcttattaagatgttaaccctaaaataaatttttttcacttgtgaatgtttaaaatagtaacatctttcatcatgtgctttataattttaaacatcctaacaagtataggtgtgtgtcctgttgtccttgagttttctcctggtaaaattagtgatgatctcttaaacatgattgacttatttctttagcattggagtacttcagattcttacagaaattattggaggatccctagaattcttgcttctctgaatgcaacataaagaagaaaaactattgtgtggctagtgggatcagattgtggctatgcaaagccgctacatgataactttcacacttgatttgcagtgtgtggtgagctgtgagatggccaccatggaagtatgtgttgttattagtctcacttaacaattgtacagtgcagctagctggtttaagaagcaaaaacatacttattaaatgttcagaggacatcctgtatacctcatgggaaaacattggctaaaagcatttttagaatatagaattaagtacagacatacttagttttattgcgctttgacttactgtgctctgcagatacagtgtgttttataaattgaaggtttgtggcaaccctaagtcaaacaaatctgttgtcattatttttcgaacagcatgtgcttacttcatgtctgtcacattttcataattctcacaatagctcaaactttttcattattattgtatctgttatggtgatcagtgatctttgattgttttggggcaccacaaactatggtcatataagaagatg

SEQ ID NO: 108732 - DNA, 1395 bp, Homo sapiens
tcttgatctcttgaccttgtgatccgcctaccttggcctcccagagtgctgggattacaggcatgagccaccgcacccagccagtcttttcctttacagaaaaaattagcctgtcgtaatcccaggcagaagtgttaaagtaatagacttccttcaaagaaggggagtaaagaacatgaaagttcttcagtatcatgggatggtaagactggggtgctcttaaagacgcttgaagaaatgcgtatgattttaaatttacttaatttgtaagctgaaaacataattggaatcttattctacagagtattcttatataaattcttcaaaaaattgtaacaattttgggggacacaacacaaatcagactgaatgtattacagtcttcagaattattttatgtgagtaggttttaaagaaattagtttgtgagcaaaagctacaatggcatttgaaattgtatctaaatatttataagttaaaacaatttatgttcagacagagggataaattggaagaaatcttgcggggattaactccaaggaaaaatgatattggagatgcaatggttttctgtcttaataatgctgaagctgctgaagaaatagtggattgcattactgagtcgttgtccatcttaaagacaccccttcctaaaaaggtatgggaatgaattttaagaaaaggggagatagttgacgtcttttgggattagaattggtttcctttttgcacaaagcacttgactgatgagatttttcccatgcagtcttatgttatttctgcttggaaatttaggttcattaacatacaagttaacaaacaagttgaaatgtaaatgggttaacaaatttcatctctgccagagtcatagttgtggtgatactgagcttcatataactcttctaattagtagccataattaaattatagctaaacattagccttatattaacctattttgtgttatcttttgatattatagattgccagattatatttggtttctgatgttttgtacaactcttcagccaaagttgctaatgcttcatattatagaaaattgtaagtataatgatataactgatattcctgaaataaagtatttaagggtaaggagttcagaaaagaggattgttttgttaacatcctgcaagaataagaagtacagtcagccctccatgtctgtgggttccttatccatgaattcaaccaaccatgaattgaaaatatttgagaagaaaaattgtatctgtaccgaacctgtacagacttttttccttgtcattttctaaacaatatagtatgaaaactctacatagcatttacattgtattaggtattgtaagtaacctagagatgatttaacagatgggaggatgaggataggttacaggt

SEQ ID NO: 108733 - DNA, 4333 bp, Homo sapiens
gttttaaaattctgtcgtttttgtttttatcaaatcaaaaatttaaaagatactattttgtcaggtttaattttagttttaaatattgtttaaaaattataaatgttagtcttttttcataaaacatacagaagaatcacttgttttgtaatggtatatactatttggctggattaaagacatacattttaatcatgtttagaaagtctattctgttaccaatttttttataacctcttaagctctagaccagtgttaagaaaagccaagtgtagtacttcacttataattgaataagtaaatatgctttcatgggaagaagacttttttaagaaaaatttttagtttcggaagatgcccagtgacgccaccatttagggcattcagacaactcccattttaaaagtttttgaccttaaattttgaccataagttagaatttaaagacaagtttcaggaagatacagagtaaagtattagccagaattaggaagtactttattggaccataagggattcaggtcaaaacttggctactttggtttccagttttagtaagtttctatgtaagtgtttctggaatgtggctcatgggtagtactaatggtatgggagctgaccttaggtggtaaagagcaaatagttactgtttatttttcattatatttatttttaggggtttttttccttttaattagaaggtgacattgatttttttaaaaaatatggtaatgatatatagttattttctttaaagtttaaaaaaacatcagtttaaaggcaaatttagcaaatcttgatgatcattctcatgaactgaaatttgagacatatagcccaaaataaaagtttgttgtctgtttcctgtttctttagcaacgggtaatgacttgcttcagagcatgggaagattgggcaatttatccagaaccatttttgatcaaactacaaaatattttcttaggacttgtaaatattattgaagaaaaggaaacagaggtaggcagtctgtatttgtctggttgtttttaaaattcgtttctggggtggaggtttcttggagttgttctgtgttacatatgtgaggtacatttctttgtgaaaaatatctattgcttaccattaagtagtggatttttattgctggaacccagaagtcaaaattacatgtaacaggaattctctgtcttgtgtccttatgtgaaaattggtgagtgttttttttatttaatgatataagagttatgatatattgttaatagtagaaaataagcaagtaatagagcaatatgtatagcatgactttattttgttaaagatagctatataagtaaaatatgtgcatgaaaagatgcatcacatgatagcagatatacatcaccattctgttgttttttttcttttttacctcctaaataattactgaatccttaatgtttaattctgccatgctagtcaagctattatgttttcactttcactcctgcaggatcttcctaattggccttactgttgcaacccacgtggtccttgtttcagtttcttaaatgtgtgtttccacctaccattggactttgtacatgtccttccctctttctgggacttatcttcacctgagatccttcagatctcagctcaaacataaccttagccttctctgacctctttaagtgaaacttagtatgctaatagtatgatacgcccttttgctgtagcagttaccatagttacagataagtatatattgttgtgatgatctgatttcctggttcccccacccctgcaaaacaacagcaaaaacctttaccaggctctataacagggggaccaaacttgtttttgctcatcattgcctcacaaggtacctggcaccagtgagcacttggtaaatattagataaatgcacaactgactgcttctttagcaaactggatgatagaatatgttcttacattgtacctcagattgtgggtatccagttatgttggcttgtactggattacaaattaatcttacaagcaatgtgacttcagcaagcaaaggaaaatgttataatagtacacatttccataggatgttccagatgaccttgatggtgcccccatcgaggaagagcttgatggtgcacctctggaagatgtagatggaattcctattgatgctactcccatcgatgatcttgatggagtccctataaaaagtcttgatgatgatcttgatggagtgccttgtaagttcagatttcaaactgattaaatctagctaatacatttggtgaccaaaactctaatttccatacatgctgatatggaaaaaggttatagtttctcatgaacgtatcaagttattaacttttctatttctgatttttttcaaaattcatatacccagtaatacatttatttgtatgctatgtatataaaaggccaagaagaagcatttttttctggtcacatttctttgctgggacaatcagcctcctataatattagcaagtttctctttttgtcttgtcaggaaattataggcaaaatcttgtgctcagttatgcatgatcctaggtacctggttttatcagtttttattagtttttctaacttacaacttcagttttcctagctgcctaaaatcattttgaaaataggaactgtagacagctctttggtacatttgaattatatgtttaaatattgaataatgtatgcagttttatatttcagagattaggtaaagatattaaagatttgttttacttctcaacttcttcacttgcttaatatattactaacctgtattttctgaattgatatatatactgttaaaaatattgccctcagatgcagagaattggtttagtcatagtccttgttcttagtattactatttgtccatctgtgtccttattttactttgctttttaataatatggtgaatacccatgaatgtaatacttcgggtcatccactagtagtcagggttaatggcttatctttccctaatagtggatgcaactgaagactcaaaaaagaatgagcctatatttaaagttgccccatcaaaatgggaagctgtggatgaatctgaattggaagcacagggtgagtaaaagtaaaataaatattttttaaattaagtacttgtacgttaattattggtgtgcttgtatatatgttttccttttatgttttataacacgttttaaccttaatgctcaatgttgtcatattttgtgtctaatgtatgcttttattgtggttggtgttgctgttacaattttcttaggtccttcagtttggaagctttgagagtaatgagatatcactgaaaacctttcaggttaaggcattttagtagcaaatgtagattggaagctgtacctacgtagaaatctacatagaggtcagtttcatagaaaccaagctttgaccctcccataatgctagactgattagatgcaatttagacctgtctttcacacttacttagacctgtatcctagtgctaataatctaattgttgctatttgtaggttctaatgaaataaatcttaatattcaacacagaaataaggatgacattattcgtcacttcatgaatttgaattatattgtaggtgtgaggaaagagatttggcatatagaaataactatttagagaattgataaacatagattaaaaaaacttctgtaatataaacttttcaattctaaagcttgagcttccactgtactactgaaaaaatgctagtttacctcgtggaattacatcctccttttcctttcattcagctgttacaacttctaaatgggaattatttgaccagcatgaagaatcagaagaagaagaaaatcaaaagtaagaatctaagttttgaatatactgtttcttgttcatatacactccccttttcattaagagatatagttgaaataatagtgaagtggaaaacttcactcttaaaaaattttgggagaggatcatttttagttctccattggttttccagtgaataaagagcttttgttttctggtcttgatggatctggtttcattttgcttttgagttttttacgctaggttatattctcactttgtagttactaattggtcaactgcatttttttcaaacctttgccatcaaatactgttttgggctccataaaaagtggtttttaaaatgtgaataggaaaggttatactcctttcttttggattgtacattctaagaaaaagattgcattatggccattgtgttatttaaatataaacctttcagaagaactaagaatgaatacaaaggaaaaaatcttttcttttgaaatatagagaaata

SEQ ID NO: 108734 - DNA, 1010 bp, Homo sapiens
tttagggggaaggaagggtagaaaagccgttgaactgaaaaaagtattgttctattagttttatttctaaaggtattagttttttggcataaaactgatatttgtgttaatgtttggaatatgaatacattttagcattgatgttggaatacgcatacattaatggaagcctggatcactagaagtataattttagatttttcatttttcttaggaatttcaggtaaatcatgataatgtaaaaataacaaagtacaaagcaaggaaaaaaagcttttgtgcagcttgtgatccttgaaatgttctcatgcctcactactactctctagtggctgaatcctaaatgtctttttacttaaggctgattttgtaactagtaattattatattttgtggcaatattgtgattcgtggcagaaatgtgatttttaaagcatgttttggagaaaagttacaaaaagcagtttcatttgtattgaatactgtatggatttagaatcttgaatttgcatgtctttttaaaaaaagaagaggaagaagctgtgataagatttgaacctcgaattgtggctaaaagctaaggccaaaaccagtttagaaaaactgcttaagccttgaaaaaattataatagcaatttaaaatatttacatattttaaatcatgaatagagctcatttaaaaagtcttaagtaatatggttaaatgtttaatgttcagccatctagaccctttctgtgtgtataaaaacatgcataactattgacataaatgatgtaatattactgtacatgctattctgtgacacgtttttcattcaatgtcattggtattatgccattttaatctgtttacctgttctgtattcatctatgattgaaagcaaacattttggtaaacatacaaggatgtttaccaaagaatatttgaaattgcaaaaaaaaattagaaaaaattttacaggctagaattggttaagtaatcaatatctgctgtattattgtttcatagt

SEQ ID NO: 108735 - DNA, 1642 bp, Homo sapiens
atataagtatattacatgtatttgtttgtgtggaggtgtattagccagaaatctctgggtaaagatgtaggtggtctgtttttacaaacaatgctgcaatgaatatcttgtaaaatacctttgtgcacttatataggtaataagagatggaagtttttctggtctggtttttttttttattttagacggagttttgctgttgtttcccaggcatggagtacaatggtgccatctcggctcaccgcaacctccgcccaccgggttcaagcgattctcctgcctcagtctcccgagtagctgggattataggcatgtgccaccatgcctggctaattttgtatttttagtagagatggggtttctccatgttggtcaggctggtcttgaactcctgacctcaggtgatccgcccacctcggcctcccaaagtgctgggattacaggcgtgagccactgcgcccggcctggtctgttttaatcagtatttgctcttactgtctcataaagtaccctccaaatgtgatttaaccttttctttgtgttttgatatctggtgattgcactgtgagtgaaaccttcagactgtgtgcagctttgtgtttggtcttacatgagctgaaccagaatgccacagccttcccacctcccatccccgcctcttttttaaagatgtttaatctgcattctgactgtcatatcatgctggcagtgtgcgtgtctttagcaaccttgcttttctaatttggggaaccagataccaaatttgttataattgtgttgagagaataagtgagttcttacagccatgaagcacggttcacggtttttgagtcctctcatgaccagagagggttcccatctggtcagctgatttttgcctagttggacttgtctgacaagtggccttcaggtgaggttatattttgactgagtactaattagttactactttgctatagaaaagaagcaaaacagtgcttgagaatctagaatgatgaaaatgcttatttttaaaatattttatttcacagctcaaagttatgaagtttcaggatgaattggaatctgggaaaagacctaaaaaaccaggccagagttttcaggagcaagtagaacactacagagataaacttcttcaacgagtaaggaataagtatacccaataatacacatattttgaagttatttatttgacttcctagaatactggtatacctaaagatgatttcaaattatatcctttgtataaattttgaatactagtagggcaatcagaaacatttgaaatttgatattttaaaagtattttgattggaaaggagcttaaaggcagcagcacactattttattctgagtattacctgtggacaagaagattaattctgctaagagcatgctttcaaaactggaaaacccttcaggacaagtcacattttgtgacagtgagacgccaacaaccctgagaggtagtacagaaagaaaaagatggaggcagggtttgggaagttctggtgttgagaagtttattttcatttctcatggtttccagggagggacagcaagtggtagaatacctcattggtgagctctgagtgtttgagggactttatattctcgtgcatcacaaaatttataggcatgt

SEQ ID NO: 108736 - DNA, 5847 bp, Homo sapiens
tgtaacttatggaaagggcagtacattgttagctttttctgattggaatttttcggcaggtgggacagtgggggaagagctctgactctagagcttggtctcaaattctgacctgactctcctgtgtgaccatgcacatggtacttaatctttctgagtctcaattttcatctctagaatgaggataatagtaattttcttagggatgctttaaatgattacatgaaatggtctgtggaaagctgtttagtatattgtttggcctgtggtaagcactcagtaaatgtatagctgctgttgctaggattagttttattcagtataagcaaaagaaatgactagtttccctgaaggggtagatttttttttttttaatagtattgtaccttaagtagtaatttaaaaaattatttcctgtaagagaagatattgttctataaatgagattaacccacattgatatttttaaacaacttaatattttctataaaaaataacaggagaaagagaaagagttagaaagagaacgagaaagagacaagaaagataaagaaaaattggaatctcgctccaaagacaagaaggaaaaagatgagtgtactccgacaaggaaggaaaggtataacatttctcatatttaattgcatatactggtttcaagatttgcagtggtgttttataatactttcatcattgatgcccgcaaactggaagtgtttgttcatgataaacttgtttgggtcctgcttgcagaaggcagaaatagcggagaaatggggcatttagttggcacttgacttagttaaccagggcatcatcccttcacatggtttatatggtatccttagccttagttcagtgcaaggattcaattacagtattagatatcaaacctgaggtttaagtaacaaaacaacttgctagattttccttgttgcatccaatttaagcatattttccagtatctgtgctgaggctgctacttgtaaacttgagtcttagtcttatcttgaaaggaggttgtatacataggccaaagctcaccttaagtcttcattctaatcaaaagcatttctctttcagtttttatgtcttactctcacggttcctaaatctctgattgagtaaagaaaattgtttcccttaactgaactgaggttttcctaataaaaagaccaagccattgcaaataaaagtctagcttagtcacgctacagatagttacaaataacaagttatgccaattggttaaaagtctgtcacttttttgacttttattactattttgacatagttttagatttataggaaagttgcaagaatagtataattgatagttacccttcacccacattacccaaatgttaaagtatttctacttttgctttattcttcctcttctgtcccacctccaaccatttaagaataatttgccaacatgatgccccattctcttaaccacattcaacattttaaaaaactgatatttaatccagagaccttaattagattttgccagttgtttcaataacctcttattgcaaagagaaaatccaatttagttgaattcagttgttgtctcttgacaacctatctttaacacttatttgttcttgttacaaaggactttgagtattgttaaaagtaacattacatggttagaataaaagagtaagctggtagcaattaatagctaatttagtaaaggaaaatgaatacccgatcctttgctcatttatggaatgttttgggggctttgttccataggaagaggcgacacagtacatcccccagcccatctcgcagtagcagtggtagacgagtgaaatccccatcaccaaaatcggagcgatcagagcgttcagaaagatctcataaagagagctcacggtccaggtcatctcacaaagattctcctagagatgttagcaaaaaagccaaaaggtaaatgcaagtcatttttgctaatatttcagataccagtttccttgtcatttcatcagcttttgaaaataatttggttggcatacatttttttttttttttaaggattttagaaaaccaaagagatacactttcatttttggttattcctccccacctcctcatcccaatctctttcatgactgaagtgaaggcttccaacaagtgaggaccagccaagaattttaaacatcatatccaatgttttctgtggaatagggttagctgctttacttttcgttctgttctttagtttctatagaatattatttgatttttgtcaaagctgaaagaaacacacatttttcccccatagcaatattattagcaagttcttgggtagatatttttggaaatacatatcatgaataccattttttcagtatgtattttagtattttgtatacttttttttcctttagttccagaaaaatggttcagaaatgttttatttatctggtgatacatagaggaattttcctgagagctaaaactgctttgtatgctaatactttattattgtaactatttttagtaaaatctttacagaatagatacctttctccttttctaaatggcacctgtatatatatgtatgtatgtgttatatatgtatgtatatgtacatgtatctttattggtttaagtaatccttcatgaacagcacttacaaaattatgtcttaaatgatgcccttgaatgatactgcagtagttgtttgcttcaggatgataaacttcaaagctgctgtgttttttaaattttgtgcatgatcttaggtgcaactttgaactttatcttgtagattaaaggttcaaatttgggggttatcagtcacttatggagcttgttaaaaatgcaaattcttagttccatcctccagagattttgattcagtagagcagtgataaggcacagaaatctgtctttataaacaagcgctctactgatgatcattgatgcagtgcatagtaagtacaaaataatctgtgtgtgtgtgtgtacaatagagtttaaattttagaagttcatagtcttattgcagtgatttttcactgtgccctgttaaagatcattttcgatcgtttaaggataaacagttttgatcacatgagtactttatcaattgggatttttttgtttgtttccttagatcaccatctggttcaaggacacctaaaaggtctaggcgatcacggtctagatctcctaaaaaatcaggaaagaagtccagatcccagtccagatctccacacaggtctcataaaaagtcaaagaaaaacaaacactgacgtaaatttttaagatgctgtcacttattggaaatgcgatttgttttgtgcctgaacggtctgttttttaaaaaaacaaaaaatcaaatgaaagagcattcctggggttttttgtttgtttgtgtatgcatgtgtaaactcatgagcaactgcatctgtagatctgtcattgttttatattgtgtaaattactttcattgtggctatttctcaagatgaaatttttattgttctaatggatttcatcagaaatgtgtataatggatctgctgacagtagtagtattttgttttaggatgttgtgacttagcaaaaataatacagatgtcttccccccttttgtagctttgacaatttgaattagatttcaaataaaatctgaacagaaaactataatgttgtttttttgccccaccggtgatattaagtcccttaaagtcctactgagtttcacactactgttgtgcttcttatacctgatgcactttataagccccagtgttcaagtagcttaagttttatatttactaagatgactatccaaattaagggacctgagactcctatttggtggtttgctaaccatttgcttttgataagtttctcttgggtaatactaatacccagatatcaaagactaggtagatatggcatggcgttttgttagtggaatgcctggctaaaacatttttttcacagaagcaatatgatttccatacatccaacccatgttctgagcaactacttacttttagggggaaattaaatatcttttcatttcctcttctattatgaaagaagtttatttgtaaaacaaattttctaacaaggtttggccatagaattctcttgtatgatcgttgaccttttataatcttctgtaggctatctttcaaacactggcatcagaatattttttataagtttgtgtttaaacagcttagttggtccccccccactcccaagagacttgggtttagttatagctttaagtaaaatttaaaaataaaatgtttttcaggaaacttcgtatctaatggtttgtaaattcaaggtgcaaaaagttgatttaaaccatttgcagagttgaactctattatgaaaataaatttgctacggtatgaggaagaaataaaacttgtgtaatgttggtcataatactgctataaatataataaagggttatgtagaattgaactgacactattatttgtgaatcttgatttcagttttttatgtaggcacttcatacactggtttgatgggttttttttttcctccctaaaagagaaagtagaaaactattctaacaatggattattttgatttagcttgctttttaaaaaaatcttttcaacttgttttacttaatcttgcctagtcacaaaataagatgtgcacccatggtttggagagttcctatattagctgagcagtgagatacactatttccaaacggtgcacacctacagtagctttggaaatgagccaatcactgttttacttaatggttcttatcagcatgcaaatattgcttgaaagttatttccttattcactgttttgttagtccattttgttaggaaacattaattcctaaaaatttgttcagaataattaaaagtgaacatttggtgctgatactcaaaaacctacaaatgtagccatttaaaaagtaacatgtttttctcccctgctcattgcctgggagaatggaattttatataactacctttctttgcaaaaataacggtcgtgtcgagttggtggtgattttggcattccatcttgcactggtttctagtataggcttagaaataattggtcaggtaataatctttccagtcaagttgcaagggatgcttatttctcttcaaaaaaagacatcctgcgggattgagtagaaaattttaggtcagttttgggtgcttatttgtaatatttttcctactacattggagtttagcagttctttttttctggatccagatacaagtgtcatggtttatcttacagtgggtgaaactgactttcttttggttgggtgggtgaggatttcttaggcctgatagaatatatattctgtgaagtttgttaatgtacatattagattgtattggatttttttttcttgaattgcaaatggtattattagataggttatttccagttttacttcatgacaaattacctagagtaaacctacttaatactcccatggattctatgaaagtttaatgggatcagaaattggtgacttataagggggaagatattctaccatatttttataatagcttattattcatgtttcttgtctgaaggacactcaagttacagagcaaaatttctataggttgactagaatgttcataagcatggtcttccagttgcaggaaagatcatgttctatctgtggacacttactgtcctctaccacagctacgtgccagagttgttttccacagttcttataaagggcatgacttaggctctttaccctccaacttaatgtttatacacagggattgtttactaggttaatgacatttaactcccctctcttctgtagg

SEQ ID NO: 108737 - DNA, 1170 bp, Homo sapiens
gtgcagatactagtgaagatactagtataagtttaaaggaacacgtgactgtaaaatctcacatttacaaagtgcttgatctcttcatatttcacacgcatgttttagaatagattttagggagtgtttaattcattatccttttgacttaaaatttttgttaccaacttcctaggacttagataatatataaataagtacaaatcccaggggaagtgttgtgatgctagactaaaaggtgggaatgtgctgctgttccgtgagccttgttccattgttgaaaatttgatgcctcagtgtttattcagtaccacctcatggagcttcaatgtaaatggattatatgtataattggtaatttgtatagttttgtagattgtagattaaatgcactcatcatgtcacatgtaattgtgcttggagtatttgtgttttattcttttacttcaacgggttcttgtctgttacatctctggtgatttgaaatatcaggaaagacagtttgtcagaaatgagaataatatagttgaaatcagttgggctaaaatattctacagcaagacaatttcttttgggtgaactgattctataatttacttacttttaatgtaaggattagatttattgttgagctgctttccagatcagactgtcactttatagtttttctacataaagattatatagttgcaaacaaaggttgtgaaatttcccttttgttgtttttgacttttaattaataaaagtacattgttttcatagcaaacttagactgtccatgtaattttctccatattgtttttccgatgcaagcccagttaataattagttttttagcagctttctctcaagtgaaataagtgatgtgacatgtttatcagttatggctaaaatgttacactttacatgtttaaactataatcatatgttttcatgctagatggttctcttggttaggaaagttcatttccttattggtttccttttttaaaagttattttattctgtttaattgaggaaaattttaaacattctacaaaagtaaaatagtacagtgaaccttacataccataaacatgcagataacaacttacatgtatctctaaatactttgtttttaaaacatacctgcagtgtcattgtcacattaacaaatcattgggtcctttt

SEQ ID NO: 108738 - DNA, 3575 bp, Homo sapiens
gaagatgctcataacaaaatttacctcttaacaaagtggtgttaggtatactcatatgattacgcaatttccagaactttttttgtgttgcaaaattgaaactctgtacccattaaacaactcatttccctcttcctcccctgtctctcagtatcatcattctactttctgtttctgaatttgactactctagatacaacatataagtgaaatcatacagtatttgtctttttttgcgactgttttatttcacttggcataatatcctcgaggttcatccatattatagcatgtatattgtttcctttacaaagcccactttttctttaagtttccatattatggaatttgaaaatgatttagcccaaatggttcattagtattttctattttgagtaaaaacttcaaaagagaacatgtaataccaagtgtatatgccaactactccactttctttattttttaaccgtcttcactactttttgtgctctctgttctctttaatggttacatatgatgtactttgatatcaacacttcatagcatggggtaaaaaatacacttttgaagcaaactgattttgatattttagtggattagtactattgatgaccatacttgaatgcttttttagttttatgtattgcccgatgaaaagaaaacttaaaattttgacatgtagtaaactcactgattattcattttgtcacagagaaaggaaaaatagctttttaaattttttttcaagttattttctctcatccttaggaaacatagtgtgtcgaactgttttagaataaataacttacttttgattttcaaacgagatgtggcatggcacaatggtgaaggaagaggaaaggcctgggccgtgaagtcatatttggatttgtgtatcagctattcccttttatcacctagaaggaggggatattaaccttgaatggttattgaaaggatgaaatcacatgtatatcactggcacagggttgtcatacagtggtgcttagataaatattcattattcctgagaactaatggtgggaacatcttataactaaaacaagataaagaataacagtataattccatagcactgatacctttacaagatttccttatacttgatttgtattcagttaacagattttataaataaagttggtgatatgttggcatatttattgcatatggaataccacttcataatctgctttcccagtgttttagatgacatttaattcttgatctcctatgagaaaaactattaaatagattttaaaatatactttttattagttgtcatttattattgtgaattcccctaaccaaagttcctggaaggaggaatcccataaaggaaaatctaaatgtaaacagctgaaataggggatatgtggaaaaagcctggagaatagtataaagtgtgatgaagcactggattctttgtcaaagttcaaagtaaaagaaaaacctgtacaattatcagagcagagcagcagtatgcagttttcacaaaatgggtggacagaaaacaatcctgtaagaattaagaagagggctagtattatgagtacaactgaactcctgtgttttgtgtatgtttgcaagttacagtttgtattttcagattattcaagaataagaaatgtaccctaaaattacttttagagtagagttcaaaccatacggaatttggaaaggaaattacagtttaaattcaattcagaaattaaccgctttgtagtaacgtcctcaggacacatcaagttctttggagttctcacaactgcacaaatgtaaatctggaagagcacaactttgattagaaatactctttcgtcctccaaatagctgaaacattgtctttggaaagaataagcaccttgctatatagtttggctacctaggccactaaatattcttattacatgagggtggtattagatgattgatatggtttcgatgtttattccctccaaatctcatgttgaaatgtaatattcccagtgttggaggtggggcctggtgggaggtgtttggatcattgaggcagatccctcatgattggcttggtgtggtagttcacatgagatctggggggagcgtagcacctcccccatctctcttgttcctgctgttcccatgcaatatgcctgttctccctttaccttccaccatgactaagcttcctgaggccctcaccagaagcagatgtcagcaccatgcttcccatacagcatgcaaaaccgtgaaccaaaataaacctctttgtttataatttgcccagccttgggtatttctttagagcaatgcaaaatgacctaattgtttttgtttcagcatattttgttttattgcactgtgcaatagctactggatgtgaggggtttattaaaaacttctagaaaaatgcttttcagatggcttttggccgtgctaacattttaataaaggatctgtcatatccttctagaaacgtaagcagtctctctcacaggatgtagaaaggtatcaaaagccaaaaaacattctatgtagctattttatattttctaatcacaataacatttagctaacatgaacttaaactgtaaatttcaaagttacatattatgtatagcttacatatttcataggatgcttatcctcaactttggatacatcttatctgaagaatgtgttctccccagaaaaatacgtagcatgtctaattctgtgccaaatactatatatgtgtaagttccacaaagcaaaaatatcaagtatttctcaagagacatttacatctaaaaatactgttttaattctgaattgattgccctgaaagcatgtgtaatttgccttaaatattaggtaggttagagaaagtctttaagcagggactgatctttgtgcttgtttgttctcatgactgacatgacctggaacttgtaaaaactcagaatattctttatttgcatgtattttgtaataaaagtattatttatcttgcctattatgtaataaaaccatgactaataatgtatgaagaatgagagaacagtttggtgttaaggtaaagaattactgtccactgtatatttcagagcctataatgccattcataagttgcagaactcaactgtctaggtgagtttagtgtatttctagaatagtttatcttaaaatattcttcatggtgaacaatcagcatatatactgatattgtcctcccagtgagtgattctcttcaagtgccatagtgaaattcaaaatattagctacacaatcaccacttcgtagctttccttgtatctcacatgtccatatataacttagattatagggaaaaagccttcaagctattttagtgcccaagtgtactcatacatacccttctttattccacacttgggccctttgtcaagagtccttgcatagcacccacttgatatgtccttgcatagcacccactggacatccaaggacccttgagggccttgcaaagcttatgacttatgactgtatggaacatggtttacctctggtgaaacagaccgttttgatgaaaatagaggaggatgtaataaact

SEQ ID NO: 108739 - DNA, 1023 bp, Homo sapiens
acctgatgtatatatattttcttttaattatggaaaattcaaacatatacaaaagtagaaagactagtataacatgacatgcacagccactttaatttgtactaaaattccatacataattttaattgtacatatttttgtatgtttctgtataagacatggactttagtggctacttaatatcatgaaaaatcctgatattctgaaatctacaattgtcttacaaggtttttttgtttgtttttgtttttgttttcagtttgcttgaagtctttcaaatgaagttcatgcattatgattagttaatatatctcttaagtgacttttaagctattgatgtccctcagtttcattttttcccctttaaacttgttacagagacttggtggtttgtccacgagactttcccacagtctggattctgctgaacaccacaaccaccgcccgcctccccaagtttattttctgtagatcagtaatttaatctagaggtttgatcagatttagttcaaaaattgtggcacgtctacttcatagatgaaagcacttctttcagggccacataatgtctgcttgtgtctctttgtgacatttgcagccattgatcatcattgcctgagttctccaattcattagggtcacaactggtgattcctaaatttatcatttctttttcacttataacttgagataatatagagaaacttcctcacctactattgacttactccacagtacagttcatataagaaaggcagcctcaatgcttgattttttcctttattttccagttttcaatgtcactttcatgctgggatattattaccattctctaaagtgaccactaaagttttattattatttttagtattattacaacctcatggattttatactgatgtgctttatccatcacaattttttttttttttttttgagacggagtttctcttttgttgcccaggctggaaggcagtggtgcaatcttggctcactgcaacctccgcctcccgagttcaagcg

SEQ ID NO: 108740 - DNA, 1015 bp, Homo sapiens
tcatcaccactccctaatctcaagtacccagggacccaaacactgcggaaggccgcagtgtcctctgcctaggaaaaccagagacctttgttcacttgtttatctgctgaccttccctccactattgtcctatgaccctgccaaatccccctctgagagaaacacccaagaatgatcaattaaaaaaaaaaaaaaatatttaaaatgtagagtgcataaactgtaaagtgaaaattcccagtggcgatggctaacaattttttgttcaagtttcctgaattgtttttctgttcatgtactcatacacgcatgcccacccgcctcaacgttttcaacttgcctttgatacttatgagatcttgggtatacttcctgatcattacctataaatctgcctcattctttaattactattgagagacatttaagctgttgttatttttattttttcttattacaagcaccgtaagagtgaataggctttgagcactgggagagctcctcggggaatctatccactgaagaataaatctcttggagtgaaattgctgcatcaaagagtaggaacattttacaactttaacagccatttaacatttcctctaaaactctcataccaatgcccctttcttgaggggcagaagttgtagagtcaaggaggggcttggagcagagggaggatggattcttgtttgaaaacctgagggagacaggaggctggggcccagaaagaatcagaactcactgctctgaattgcaggggcccaggggccaagccctggggagaagggccatgcttgatctaatgctccactgtcactgtattgaaattcttaattttttaaagagaggccccacgttttcattttacactgggtctctggaggaaaaccggggcggggccagtgagtacttgtccttgtggtgagggaggagctgcatggaccgcagttggcttgaagtcttgggaaagttggactcctaaggaggaggcgctcagtgcacccagctgggg

SEQ ID NO: 108741 - DNA, 1054 bp, Homo sapiens
gcatggtggcgggcgcctgtagtcccagctactcgggaggctgagtcaggagaatggcgtgaacccggaaggcggagcttgcagtgagccaagatcacgccactgcactccagcctgggcgacagagcaagactccatctcaaacaaaataaaacaaaacaaaaaaaaacagtcataataaaagattattctccagatacactgcatttatttctttttaaaattttcccttttacgtgaccttttctttcaagaacgggcctctgatgttgggtttccttgtgtctgctgcttttcctccttctgagatcattctttgtgacatgatcaccatgtccctcacctctacctcagatgctgtgattggtggttgcaggtggtgagaagaaaacaacttgcacggatgaattcttgagacctgggccctgtatttatctcagtggcttcaatacagggcagggaagctcacagaagttgtgacacacaggtgtaattatggctaagtggaatgcttttcaaaactttagatggcattgttgggtttgtgaataaactcttttctgctcccaggtggctcccaggagcagagaaattcaagcaggctgttgtgtaggctgaattcccacctactgcatggagaaactggaacatggacatggaatagcatttctgcatggaatctgttttttttttcttctctggctttgaaatttgcatttcttttagtaaaataagctggttcaaaaacgtgtacacacccttgttttgtccatgtcacttaacaattccaaaggattttgcatttttacaggttttttttttctttcaagaattcagtgaaatagagctagtgttagcagctccatattttagttgggaaactgaggcacattctaggcctggcatcttatctaagcacagtctctctccactgtgtgaatcacagtttagtgctgtccaaatcagggttcttcgttgcatgcaacagaaactgactcatgatgactgagagaaagagaattgctgggcagatctgggaattgctaggaaggca

SEQ ID NO: 108742 - DNA, 1032 bp, Homo sapiens
tgcaaaaaataaaaaacaagtatggatacataaaattggaataaggctaaaaaccacacacttaacatcagtgggccaaaatttggttctgagcttttgagtcaaaccaggaggagtccaactggtcttagaatgtgagccagagggatatttttggagttcaggtaatcagtagattgtgatgatgacagcatttctcatgtatttaaattgaatttgcttttaaaagctagacaattataatgctattaatttcctctattgctcacccttccttctaaaaagctccaacattaaataaatgaacataaaaatccccccaaaaaaaccaaatctgcccaagacacaaaattatttccaccttacatgtgaagttgtgaactatcctacccatgaacattgttacagaggccattttcagtaaagaggaaacaagagtcctctcgtggtgaacagcagttttttgattgtgcagtatccattccataatcgcacccaaggggtgggcacgggatccaagcaggctgatgggaattccctcgctggaatttgaatcgcagagtgatgtagagacagaaaacgcccagctgtcattcatccagtttctgcacctcggtgggctggagtccagtctctgaggccccccacccctggctagacctactgaccctgtcctttgtgagcttggaccttcttccttcttccctctcctgtgagactaccagcctctccctgcccccctcagcctcctataacatctttttttacttacgataatcagagactcagttcctgtttcttgcaacccaagtgttctgactggtatgctttcaatacggtttcagagtgaaatacagtcagtgggatggttttaggtggcacacaaggaacatttacatttttcagttatgtaattattttaatgcacattgcgaaaaactataaacagcacatcaaacccacaatgtcatgggtattattgcttagaatgacttcaatacatttatttaagtcgaaaagtgagtcatttaa

SEQ ID NO: 108743 - DNA, 1067 bp, Homo sapiens
cctgaagagcttaccactcagaaaagagaaagaggattaagcactgcacatgtttttccttagtagtggcatgaactatcgggggcaacagtcattcttttggagacttatgcctgtagtcgaactgtgctaattgtgtatatattttagagttctcacacagctactctttttttttctcttaagaaaaaaaaaaagaaatatctgagactttattttgatctttcacatccatctgaagaaggttctttaaagataagtgggttttgtaatctggtgaaggccatgaatctattcaattcagtgagttcctatcaactgcatctgaaaagcactggtgaagaccacagtacttaaaacccatttttttaattttaaaaaattccataagaaacatgtacttatggtaaaatgataagtttcaaacatataaaaacatgaaaaatggaaattaaaaatctctgctctcaactattatagcagggcctccagaggcagccactgatcatagattttgtcctgaatttttctggtgcttgctgtcctaaatcgaggtaacatgcttgtacctctacttcatgatttatcaactttaagtggaacccttttacttttctctatcaagaaagatgttagctcacttcatactactgctctgttgcctgttattttgcctaattcttctggggactgtcagccaggggaattcctgtagattaccaacccactcttcctttcatctcttctgtctctctttttgacctcttctcccctcctcagtttatagttggtatatttacaatgccatggtttaccacaactgcattctgtttatgtaattataactaaggcagtcatcttgtctttaggttaattctaaaagctgaaaacctgttaacagtatttgcaatgatgtcattatgtaggtattggccactgtggacccaactatgatttgagccttgtagtagagatgtaatcctttttttaaaaaatttttttgcttgttaaagagaaatttttcaagcatgacagcctaatgcattttcccttaaattctcccggtt

SEQ ID NO: 108744 - DNA, 1093 bp, Homo sapiens
cttccagcagatcaaacaggtggaggagttttgctaccagcccatggccgtcctgggctatgagcgggtcaacagccctgaggaggtcaaagacctcagcaagaccctgcttcggaagccccgtctctaaaaggggttcccaggagacctgattccctgtggtgatacctataaagaggatcgtagtgtgtttaaataaacacagtccagactcaaacggaggaagcccacatattctattatagatatataaataatcacacacacacttgctgtcaatgttttgagtcagtgcatttcaaggaacagccacaaaatacacacccctaagaaaaggcaagacttgaacgttctgaccaggtgcccctcttcttctttgccttctcttgtcctctttctcctatttcttaccctgtcctccacctgccttccattttgaagtgggatgttaatgaaatcaagttccagtaacccaaatcttgtttacaaaatattcgtggtatctgtgaacatgttaagagtaatttggatgtgggggtgggggtggagaaaggggaagtggtccagaaacaaaaagccccattgggcatgataagccgaggaggcattcttctaaagcagacttttgtgtaaaaagcaaaggttacatgtgagtattaataaagaagataataaataatattctttttaatatttgcctccattactttggattcacctgtgttacttgtcctcagcttcagatagaatctccttcccctccctcgtttccatttttccagtctctttcctgaaaggcagctaaactgggtgggagcaatttttgcctccttggtaataacctgggggatgttttctcacatgtaaatctcagcctgttaggtgtccaggagtgaaacacatctttgtattctaaaggcagaaaccaaacagggcagtggaagaaaaagcacactactctcttcaactttgaacacaggaagaagcaactccttcaggacttgaaggcatttggtttttcattcctcttcagttaaaatggggaaccttgaagcagagaccaatgttttggtgctgaggctggttcagaaaa

SEQ ID NO: 108745 - DNA, 1133 bp, Homo sapiens
ttacctgtgtggggaaaatgccagcctgttcagtaaagtttgctgaaggaaataagccataggctctatttagatgtggggagtgagcaataggaatatcttcaagatttccagggcaactgtttatagactatttcccagcgatgaattagagaaaaaatgcacaatttctaaatgtggagaggtaaatgtttcaaagtaaggaatttgattgttactgttttcccacttgcatgaacaccataagggcggggatcagaacaaacctgcagagcagatgttgtccaggggtctcagggagggctaaaaagctatttatttttgcagaagtcatgtggcacttattgttttgagtgctgcaaatgtgtagtttgatggactgtgatggagcaaatgttgtccaggggtctaagggagggctaaaaagctgcttttttttttttttttttttttttgcagaagtcatgtggcacttattgttttgagtgctgtgaatgtgtagtttgatggactgtgatgtgttaggttggtgcaagcgtgattgtggtttttgtcattgaaagtaatggtaaaaaactgcaattacatttgcacccacctaatagattttctgcaggtgtagggatggttactttcaggaagtttgtcctattgtggatgctgagcgagacaatggctgcctgttcccatacattccctgcttggccacagccagttttgtccaggatttctgttgtacacagtacagttgcagctggattatgtgattggtttgaaattaatgtgaatttgggggaggctattaaatattccctaggtcttgaaacgcagactctagagatgactctaggaagagcaagagggaaatgaaaagcgtgtctcatcatgtaggcatggtaaataaggacaaggtgtcactttaccatcctcctccaactttctttcttccctacacacaacacacatgcacacacacatacaattgagtttctgcatcgtcttgaagagatctggatgagagaatgttctaatcccagctaacagatgcgtggtgaggcacacttttgatctcaggcttctggagagtgagtggtcggccaattgttatattagaaagcttgacagttctgcgt

SEQ ID NO: 108746 - DNA, 1052 bp, Homo sapiens
tgccccaagcgccgcgaagaagccgggaagagtttgccaggcttgcctctgctgcccgccggctgccctagcccgtccccggagccctgcggttcctctccgcaaagctgatttcccggtgccgcccctgagggtccctgaggagcgggccgcgaagcgttgccctggcggtagccatggggacccggggctgcttggtgctccgcacggtcacgttgactcagtcaccccagactgcaaaagtaaggcgcagatgccgcacgaaagcactgtgtttagggataagtttcaggggacccggactgtttagcagtagcgctagtagatacattattatgctattcacttttagtgctagagtagttaaaatgagaagtgatttttagtctgagggacaggtggttcctgatacgttattaaacaactgagtcttaactgagttaattttagggcttgaacagtgcttttagaagaccatggtaactggcatgtgtagatcaactctacagcgggttaataagaaacatctataccaggttatcaaaagtaacaatactttcagtattgtttaattgtaacaggtatttgttacaaattcttataagaactcagattttgaaaaaaaaactttgagaaatttaataaattcaaaatagacgtgattttgtaacgatttgcattgaatacggacagacaaattgaaataatattcaaagctttctagaaattgacttactgtacttaagtttggctacttctgcctagtgccttatgccgcctttggtgggaattttatttaacttgctttcaaatatccccaaactccatataatatagagttaaaagctcaagtgagattttcttaggaaaaggagtttggtgtgatggttctggagacctgtgctgtagttcagctgtgaggctgctgctgctgctgaattgtaaacaaagcaagttattacttaactacaaatttcttctttctgacatcttttctatatgcctcataaatttgttcgattaatagtagacaatctatttagaattggttt

SEQ ID NO: 108747 - DNA, 1608 bp, Homo sapiens
tgaccgaccggcgcttcctgcagctcaataagtgcccggcgtgcttcggcacgagctggtgccgccgcttcctcaacgggcaggtggtattcgaggcgtggggccgcttgcgcctgctggacttcctcaacgtgaagaacgtgtacttcgcgcagtacggcgagccccgcgagggcggccgccgccgagtggtgctcaagcgcctcggctcgcagcgcgagctggcgcagctcgaccagagcatctgcaagcgggccaccggccggccccgctgcgacctgctgcaggccatgccccggaccgagttcgcgcgcctcaacggcgacgtgcgtctgctcacgcccgaggcggtggagggctggtcggacctggtgcactgcccctcgcagcgccttctcgaccgcctggtgcgccgctacgcggagaccaaggactcgggcagcttcctgcttcgcaacctcaaggactcggagcgcatgcagctgctgctgaccctggccttcaaccccgagccgctggtgctacaggtaggcgcggagccagggcagggggcgtcctgggaggggccgcgcgtgggaatcagagtcgggagaagtggctcagccagcgcttgccgccagttcggactcggccgggctgggccaggctgcaggcgtgggaaggggcgtctccgggggagccccggggctgtgcagggaggccgagggcgaccccgctgatggagagtctgctcttgttacctagattcgggcgcatttcggatttgactgtggatctttcaacgccagagggagtgcgtctcttaacactccccaaaatgtctctactgcgagtttccttccgctctctaccctgcctttctgcttttatctgccggggcttgcaggtccgcggcgcagactgttcacgagcccttggacctttcctagttcttctgaagtgttctacaccgcgttcgctcttccttttctggcgctggtggctggcctaacttcggtctcagagtctttgttttcgctcatttacctggcagtcatttggacacctaattcgaggacaagttggggaggatgaagtcggagaacgggacagtggtcggggtgggtttaatctgtgagccgagctttgggtgggattagaatcagaaacaggaaaagtaaggcagcgttggacttggggctgggagggcttaaggccagacagacgttttcatcctgatcctgtgacctgccctattcatctggtaatctagttgaagggagatgaaatattaggccagggcgagtatcagggaaggagattcttgcctttcgccagttgcgttgtttgctctcgtctgactgttttgaaaagtaatgtgccttttaggggaataggatggaatctttactggtgacatcaaaaagagaacaaaaaacaaaaacactgtttactttcggagtatttgcttgtttctgcacattcccacccagcttcagtgcggtgtccttgaacagtgattacaactgtggggttgtggtttctccttctgtctgcaggaaaagttaccgtgctcctttccatgacaagagaaaaaaatgacttaaaagttcacaagtaattttggta

SEQ ID NO: 108748 - DNA, 1050 bp, Homo sapiens
gttagcattttgctgaagtagatacccggacaaattctctgagacccagaaatttagcaaggagctgtcttagtaatatacatttactgtacttaaaatgctggcgtccctaccgaaagattttttttttttaggtaattttgaatagtgatgtattagtaacaactaacagtagaattgatattttaagaacattatgtggccagttctttttaagtgtagtcatagcattgaatttgagaaactttggcatctgatttacactaaggtaaatttgtgctttgtgcaggaaggttttatatttttttaagtttgaacttctcatggcattctcagtttactttgtagttgagatagtcaagtgtgcgtgtatcttgttttctgtttaacttttccctcaaacttactctttatctgttctcatctttagtgatgaaacagccttttttgaaaaagcacaattattttcttatatatgacacataatgacacagctactttgagtgggtaaacacatgggccataggataagaatttgtttttagtatgtgatgaaacatgtctccacgttttagagtgaggtttgtaaattacatttttaatttacacaacccagttcccaggaatagtactaatactaatatatgtattataattatagctgagtacatactgtgtaatataattttggggtctttagtaccagccagtcatataggcatgtaatttttttaaaacctgattaacaagcaagtagaggaagaagatatttttaagtaagagttttcagagagccgctgctttctttgtagaatcacttgatctttggaaaaagctagtgaatttacaagtctgaacaatatacttgaggtttgatgattgtataaaaccaccaaaatgaaaggtatctcaacattctgtgatcaagtacaaaagttgctgtacagtaagtcaaaccatgatgttcattacctttgttagctaggaaactacatttttagtatttatacaggtttttataaaactgtttatagctgtttacagtaatac

SEQ ID NO: 108749 - DNA, 1253 bp, Homo sapiens
gaactatgttgacttttatattgtgtaaataggaatcttgaagtattcaaaaattgagttgttgaagtaattggcaagatcacaagttattgttgataaattttccatcgtatttgtatttaacctattgaatttacagaaagggagagtgtgtgtgtgtgtgtgtgtgtgtgagagagagagagagagagagagagagagatgctgtctggatttgttgaagttcagacagaatctctgactttataacctggaagtagtgaagatggtcttgtttgtaggaaatggagaaagctctttgttgtttagggggacgagctgggaatgttactatttgtggaacttcatttgccttaaattttctgaatcatggttttaataggatttactttatttttatagtatatgactatcattaagctatggtttttaagcttgcttttctattcttataaatgatataatacatgcaaagcacttcacgtagtatctggtaaattgtaagcattcaataaatgttagatattgaataaagtaaaggtaactttaactgcctggtgcatttgatcagctgttttgaagctcatttggggtatggatcaccttaaaaataatggtgattttgaatatcaaccatactttagttatactgatttttttccattattactttgatataattttttgtagaaaactttcagtgaatgttgtttttgcctttaaaagtaatttatatagggaacaacatattttttaagttcactggtgaaaatgtagtttttgaagtaaacaaaagattatttagctaacggtactttagaaaagttgatagatttttactattggactcacttccttctttataaaatgaagctattggattagatccttttcagctccaacattctggggctttcaaactcttgagaaatttggtttttattgttgttgttgttgttgttgttttcttttgaactttaacgagtgggtttaattaagctcttctgaaaggggattgggagtgggatgctctctttcaagcctttcttcctacccccaaatttttacacacatgaaataaaacaaaaaccaaaaccttcctttaaggggaaatatgtggagttaagggtagccaaggatcttgtgaggcaatagtgtgcaaaacgatgttccagactttgtttcaggagtttcttttcaaacaacagtttaaggaaccacctacttctcctttactggctgtttctttagta

SEQ ID NO: 108750 - DNA, 1039 bp, Homo sapiens
tagtttagtaattctatttagtacattggtaaatggtagtacaaaaaaacaggttaagtctagaccttagactctgagacagaatcttaaaagatttgtaatctgaagtaagtatgatgcttcagtgtcttcgtattttttctttctaatgcttttttgggggttaactctgaaatgaaaagatctgacagtaattatgtggaattggtcaatagtgccaggaactgatctgtatatacccctgggacacagtaagggtcagttgagactagtaaacttatgcatatttaaaacttgtgaacaagtgaagtgttttttgttttgtgtttttttttggtgggggcagcatttcttaagcaatttattctaaaagataatctatttctattaaatttagtttttaaaatgtgttttgacatcagtttccaattttagatacagctgttggacatgatattcagtaaaataacacaaccttactattttcaaggcattgtttaatattgttggaatttgaggtgggtggaaaatggcattcagaaaattatttcatgaaataaatgggacatatgctaggacttaaaaatcttgaaattgttaagcttctacagtatttgcaatggattttggctgctatttagcagtataaattaagaagctaagatcttagagaaattttagcaaaaattcagtaaccattaaatcatccccgtaattttactatatctcccctccagacagttcaccaaactgtgaacacattagtctgtcaccagtacagttgactaatctttatgaacagctgttataacatgcgttactacaatgggatttcattcaaatttgggctttaaaaaataattttaaaacttaagttagctctttctttcttttctttcttatgtgtctgtctgtctttattttgatggagtctctgtcatccaggccggagtgcagtggcgtgatctcagttcactgtaacctctgcctcccgggttcaagcaattctcctgcctcagcctcccgagtagctgggatt

SEQ ID NO: 108751 - DNA, 1023 bp, Homo sapiens
actgcatgctcttctaaaataaaagcccatggctaaatggagactgtttggttcacccttaattgccaccgtaacacagtgcctgttgcctggtaaataactgctggttaataggctgcagtgctatcagtttaaataaaaggattggttgattacatttacacaagtgaagaagataagggaaagcataaatacttttagatttggtaataaagacagtgtcttccctcttattgatcattttggttcttagattttgataagcaagacttgtcatcctattttagctttataatgtaaagttctctatttaaatttttttcaggtccatagtactggtatgagttaggaaaaaatgaagttaatctctaataaactgttgaatgtaataagaaaatccaaagtcattcctagtagcaatctctactgaaaggatctgaggatagacctaggatattttcatcagaatctcttgtaatattaagataattcttttgtagagttttccgtctgatgaaggttggccatttgcaaagtatcttggagcttgtggaagaatggtggctgtaaattatgttggagaagaactgtggagttactttaatgcgccatgggaaaaacgagttgacctcgcttggcaattaatggaaatagcagaacagcttacaaacaatgactttgaatttgcactctacctcctggacgtcagctttgacaattttgcagttggtcctagagatgggaaggtaatcattgtggatgctgaaaatgttttggttgctgacaaaagattaattagacaaagtaagtatataattttagatttttttctactcattttttcctatgtcaaaataatgtttatacttgtatgaaatgagccttgaatttcctccttagatggcaactttaagcgtctttctttgctttatatgaccactgtcaataaacaaatacagatactctttgacttactgggggttacatcttgataaacccggtgtcagttgaaaatattgttat

SEQ ID NO: 108752 - DNA, 1007 bp, Homo sapiens
cctagaatgctattttttcctagtttcttttcagatttgttttcttttaagacctaaatcagatgttctcctttttgcagccttctacagccccagggacaagtgctaatttaattccccactattcctgtagcattgtgtcatatttctttatggcactttctgtgtatgatggaaagtcgctagactaaacctgtaagtggtagagacctttctgaatctttctgcctagcgttagtgggctcccagtgaatgtttgtatgaatttatatatttaaatgtttatggttataatatacttttacctaaaagtgtagaacaaatactattaattagtgaaatattctatttttggaagcaatgaaaactatttaaaaaatttttttctacttctgcttttcctcctttcacagataaacctgaaaattgggatgtatggtatgaaagcaagtttgatgactgtgataaggaggcttgcttatcattttcaaaagaaattctttgtgctcgtgccactgtggaccacaattactatgctgtttgtcagaacctcttatccagacatgccacctggcgtggcacttctggaggactccttcatgatccaccaagtgaaattgccaaagatggccggctcgaggccttgctggatgagtgtgccaacccaaagaagcgctatggcagattccaggctgcaaaagaactgcgtgaatacctagcacaattaagtaacaacgtgaggtagtctatggtgaacttttctttttttctccatttaaacagcactggctaaaactaaaccaccaaaaaacgatctgaaaaaatgaaatttggaagtgttacattcagaggatgataaacttgcactgatagatcttaatgttaacatccatcaaaataagacattacttcaaaaatcacatgatgcttctgcaaataagtatgttcttatactttggaggcttgagctgtcatcagctgctccccactaccccggaatgcttgag

SEQ ID NO: 108753 - DNA, 1842 bp, Homo sapiens
ttaatcgggcatcataacttttcatttattgaggaactaatcattattactataaagcatacaaattagccagtcagcacactttggtcttctttacctaagggttaaacatcagaacatcaaatttaattatttgcatagaaatgtgtgggctctttatataagttgactatcactaacaggtaatatttttctgtttgaagttgttacttttgtttacagcaaagtttgatgtagtgtgcagtagtgagctctagactgatctttttctaaatcagaaagtgattaaagtatgcacaaccaaaggcaggtttttctttttcatttattcagcaactatttattaagcatcaactctgtgccaggcacgttactagctgctacatactgtctgaacatgacatacggttaagtaactttacaattattatcaaatacttcaatgtagatatttcttaagttgaaatagcattaactaggataatgctttcatgttattttattgtcttgtgatagaaattcaacttgtaccatctaaaactaggttgctataaaaataggaggatgaagtcaataaagtttatgccagtttaaaaactggaaggaaaaggtaagagctctccattataaaatagttgcattcggttaatttttacacattagtgcattgcgtatatcaactggccctcaatgaagcatttaagtgcttggaattttactaaactgacttttttgcaactttgggagatttttgaggggagtgttgaaaattgccaaacactcacctcttactcaaaacttcaaataaaatacacattttcaagagggagcaccttttatatttgataagttttcattataaaccttataataccagtcacaaagaggttgtctgtctatggtttagcaaacatttgcttttctttttggaagtgtgattgcaattgcagaacagaaagtgagaaaacactgccagcggtgattgctacttgaggtagttttttacaactaccatttcccctccatgaaattatgtgaaatttattttatctttgggaaaagttgagaagatagtaaaagaattaggaatttaaaattacagggaaaaatatgtaagtgaaaagcaataaatattttgttcactttgctatcaagatgttcactatcagatatttattatatggcagcaatttatatttttaatcattgcccattaatagacgcagtaaaatatttttgaatcagacatttggggtttgtatgtgcattaaaattgtcttttgtactgtaagttactgttaatttgaatattttattgaactgtctccctgtgcctttataatataaagttgtttctacaacttttaatgatcttaataaagaatactttaagaatcacacttttcagactatttcttaacttcagatatccacatttttcttgagtggaaagtgagtttgagtagataagttactagtttcctcttgcatgcactttaattagaattttgagggaactatctgattgggtgtgcaccaggctttaaggttatgtgtgttttctttttctgtagtagtgagtttttaaaaaacttttaccactaaaatggaattaaaagaaaaacttcattatggaaattttcaaatgtatgcaagagaataacataatgaacagtagtatatcattacactaacttcaaaagttaacaacatgtggcaaaactagtttcatctctaaactacttgcttccagcttattttgaagcaaatctgagatgtatcattacatctcagatttatattacgcattttctcctagtaaaacacaatactttttttttt

SEQ ID NO: 108754 - DNA, 2161 bp, Homo sapiens
ataatgaaaagcaatcattcaaaaacttttgagtgttacaaatagaagtgaggaagggcggggaaagcttgtttttagtgtttggtaatacagacagcagatatgctaagtgtatgctcatcaagcagctgagactgcctaaagggtcactgtaaaaaaagactcatttttaagaaaggatgtgagggcttaggaagtcaattttatttactttatagctaaacttcacatatacatttaagaagtaggaaaggagtctactgaccttacattactttgtttcgtcattgtatcattgacaaagctgttacctaagttattttgataattttacagttaaagcagatgatataccacattggaacaactgttatttttattgtctattatgatctgtggttgaaaaaaaatactataatataaatgggaattgcacgtggagtacagcttattatgtcattaatgttgtttctaggatagccgtatatctggtggttatgaaaatgtcccaactgatgatatccacatgaagcaagttgatctggagaatgtatggcttcattttatccgggagttcattgcaccagttacactgaaggtctttgcaggctattatacgaaggtagttatcctctcacccctccagcctatttcttacccatttttacacaggtgttctttttaatgtttttattaataagcaaatccactggcttactttgctttttcagggatttgcactactgaattttgtagtaaaatactcccctgaacgacagcgttctcttcgtcctcatcatgatgcttctacatttaccataaacattgcacttaataacgtgggagaagactttcaggtaattatgactcttgtgtttttagatttttcaaaagaaatatatcattatgaaaaggactttgccttaggccttagtttcttttttaaattttgctcaaatgacataatttgaattttgccactggttaaatataatctgatgtatttcttcattttaacttttttagggaggtggttgcaaatttctaaggtacaattgctctattgagtcaccacgaaaaggctggagcttcatgcatcctgggagactcacacatttgcatgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagattgaagaagaaaagaaagaaaaaacttaaatatttatttctatgctttgttgcctctgagaataatgacaatttatgaatttgtgtttcaaattgataaaatatttaggtacaaataacaagactaataatattttcttatttaaaaaaagcatgggaagatttttatttatcaaaatatagaggaaatgtagacaaaatggatataaatgaaaattaccatgttgtaaaaccttgaaaatcagattctaactggatttgtatgcaactaagtatttttctgaacacctatgcaggtcttatttacagtagttactaagggaacacacaaagaattacacaacgttttcctcaagaaaatggtacaaaacacaaccgaggagcgtatacagttgaaaacatttttgttttgattggaaggcagattattttatattagtattaaaaatcaaaccctatgtttctttcagatgaatcttccaaagtggattatattaagcaggtattagatttaggaaaacctttccatttcttaaagtattatcaagtgtcaagatcagcaagtgtccttaagtcaaacaggttttttttgttgttgtttttgctttgtttccttttttagaaagttctagaaaataggaaaacgaaaaatttcattgagatgagtagtgcatttaattattttttaaaaaactttttaagtacttgaattttatatcaggaaaacaaagttgttgagccttgcttcttccgttttgccctttgtctcgctcctta

SEQ ID NO: 108755 - DNA, 2142 bp, Homo sapiens
tattgatatgatttttggttttagaaatgatggggctattttatttccgatttccaaatttatataagcaattgtgatttgatgaaaagtcagaaaagttggcaagtatttttttcttagtttaacaaagcatgtattgtttgaatatgtttgttttctctacaaacctgtgtgcattattattgaatatcctcagtacttgtgatagtattttgtgctcatgtttggctaatttgactcaacagcgcatcatggaatggcctctcttactcattttttccgttgtcttatgtgtctaatgaaagttctgctaaggaatgagcttagacttatgtttgaccccaccacacctcccaaaaagaaaagaaaagaagggctgaaagagctggagatgtttctttgtgtgtgctataagctttgcttgttctgcatgttgtctatgaaggacatttcagaatgttagcttttgatcaacagctgctattatttttatttaccaaagaatacctgagagagcgggtgtacaggtcaacttacccaatgcttctcttcattttagactttacaaagggaaaaagactcccctactccggaaacattccaaatgctcagccccccaaaggtgttatttttacttattttatttatttttgtttatttaatatttgatatagtatattgcctagtagtaaagtttctttaagggccttatttgcatttagcttggtaaaatgttgattttcatcagtcatctgtgtgtttgcgtgttttgtgtgacttgggcatgggtcttgtgtgatagtcaactcttggttctttgagctgatttatattttatggctgacaggtgacaaagttaaacctaagtccctttcattctttttttaggtttttatttctttttaaagggagagaagagggtagaagtaggtataaaatagaatttgattacagtaaggtttaggtgcaccttattgagttattaatcactaactcttttactattaaaacaggtccaaaaagaaacacattacctagtggtgtttgccacatttgtctggtttggggcaagaatatgagactggttttctttatctgcctttataatgtatgactcatttgcgtgttagcctttaaacattagaaaaagaaaggaatgaaacagactggtgaaatataactggcagtgaattcttgattaaaaatgtgatgctttctttgaaagagaaagaagccaaaagaggtataattcattgcactgtgtctcaaaaatatttctgctttcaaacaggaattttttccccgatgtctacatctaggatcaatgagaaagggacaaaaacagtccattcttctttttttcagttgagtgtcagtgctatctactagttttgtgtggtgtctgaattcataatcaaaatttgagttttttattttaaactatgcacattttatatgaatactaaaaatgcatgttcataaatgaaatataaagatagaaattaatatcttctatatatttttcctatgattaaatttacttttgtacctacctctaagattaatactgttattttctggcatatagggtgtatttatgtacatttctaatagacatgaatttggaaggctattatccactgctaattacaatacttcccattataacaatgacctctggcagatttttgaaaatcctgtggtatgtatttcatactcaactttattatttttctataactgtaagtggttataaatcagttggttaataatatgaaatgtggttagaggctttttaaaatgacataaggtgaaatgcacatcaaaaccacaatgagatactgtctcacaccagtcagaatggctattattaaaaagtcaaaaacaacagatatgggtgaggctacggagaaaagggaatgcttgtacgttgttggtcggaatgaatttggaaagcagtttgaagatttctcaaagatcttaaaacagagctaccatttgacccagcaattccattactgggtatatagccaaaagaaagtaagtcatttgaccaaaaacacacatgaacctgtatctgttcgttgcagcactattcacagtagcaaagacatggacttaaactaggtgttcattaatggt

SEQ ID NO: 108756 - DNA, 1013 bp, Homo sapiens
cttgcccatttgtttggtgtaaatacttctaccatggctgatttcaagtttccaatgtgaaattactgaacatggacttggcagaaaaagttaactttggggagccagtatgagctgggtctagtgcaccactggttgtatgttatgattcatgctatcaaattctttaattttaaatagaaacaccgtctatacaatagattataatagtctaattgtaacaactgattgagatatgatagctataatacaaatgccaaacagataccaacccaaaattgaaatgtatccaaaggggcagtggtttatctcctaaatctcattaaatatagtgtatacaatgtaatcttatatatatatcattgaatatatttgtatgttgattcaataatttatgtatacaaaatctaaacacaaagcatttattttaaaaaggtaaaaatgaaacttaaaattgtttgtatttgtggtatataagaatgtcttctctttactttcagaggagtatggaatgtcccatatatggctaatgtgtacttaattaaaggaaagacactccgatcagagatgaatgaaaggaactattttgttcgtgataaactggatcctgatatggctctttgccgaaatgctagagaaatggtaagatatgcagtgatggcttgcttgaatgttcttataagatggcttgctttaccagttggtgtgtcactgtgttttgatgccctttgtcttgctaatttgtaagtactagccaatttttttggttctgtgttaaaaaatttgggagtaattttggagataatttaacatttacttatagaaatggtatgaaaaatgttagtttttgtgctcgggctaattcataggcaaccgagttggatttcagtaataaagatgtatttgttacaaatcagctttgctcttttaagaatacatctttaatttgaaattctatagtgaaaacttgacctaattaaaattaattagataagcttcgatgaaacaatatt

SEQ ID NO: 108757 - DNA, 1007 bp, Homo sapiens
tatttggtttcatttaatataggttccgaaatactttagttaaacttaaatataattaaataactaaagtagtttccctctgttggatgtaagcaaggcatttttaaaagtcatttttatgtattcattagcattttcaattactttttccttctttgttactctttttaagaaatatgattgaaaattagcaatatacttacttaagaaaagatgttgggaaagaagatccttattttatttttattaactacaggtttgttgaatgagctttcttgtgttatatgtcatactaagcccaaaatacataattctgtggtaatttaaaaataaataattatataggtttctctctctcacacacactctctctgtctttagaaagatcattgctcctcttgtaactcgtcatggaaagctgtggtccaatttctggggagcattgagtcctgatggatactatgcacgatctgaagattatgtggatattgttcaagggaatagagtgtaagttacttggtttaatattttaatgtgaaataccataatctaaagatgtagtcttgttagtattacttgaaattttttttgcattcatctcttttctttatagttaatgggaatttgagaacccaagaccacttggaatcctgaaatactagtataaaactaatatcttaaaaaaatgtttttaaagtcccaaatcttcaaaggaacaagctcattgctgtggggaatactaagagataatatatgtttaccatactcacattatggttgatagaagagtaatactctttatttaaaagcttggaaaggggatttagtttactaactttttaatggttataattaagggttgttttgataggttttaaaatttataattaagccaacagtaacactaacagccagaacattccagtattcctgattgcatgagtttttttgtgtgaaatagctattattctgctttaaatacaagttttttttaccaatattagatt

SEQ ID NO: 108758 - DNA, 1241 bp, Homo sapiens
cttgtaagtctttcaagccaggaactttcattccttttgccaaatattgcccatcttgtggattggaatgtataatggctatttcagaattgtttgtgcaattaatgaaggataaactccacaccaaaacatatctaaagagaacttaagaaaatatattaaaatatatacattaagataagatatattaacattaatgaaagaaaatagctctccttatacataatataataatgaaaggaaataaaaggataaagtctcaggtctcccatgattgctttttatgtgctcaaaattaagccctgaactttaagccgaggaaacaaaaagagaaacacaattagtatttggtttcttagacgaaactttcaaaatagctttcagatgtgaagaagtttctgcaagggctattttaaaggaagcactgactagtagtgtaggcagtaccatgaattacattcatgtaataaataggataatttcatctttaaacctaactcataaccaagatgggattcagtaaaatcactttgattgggggggccacaaaaatttgtttcaagtgttagagaactgccatggagcaattcaaatttagcagattatgttgaattgatattctagtattttttatgtcatgctgattaacatttgaataaaatttaaaacaaaaccatactaatgataattttatttttatgtttggtgtaaaacaaaggtccatccaaacgtatcaataggtgtttttattgagcaaccaaccccttttctacctcggtttctggacatattgttgacactggattacccaaaagaagcacttaaactttttattcataacaaagtaagtatttgagaaatgaatattttatgtcaaaactatttttggtcttttttggaactatttgttatttatgtcaaataaaattcattgggttaagttcagtggaggatttttggagtaattacagccctgcctttttaggacctaaggattttagattctagagactagcaccacaatattgatatgagccacatgaaactgccagtttctgtagatcaaaaatggctgaatattagccatcatcatatagcttaaattaatatataatcaaggagattcaaagggccttaaatccctttgcctttgggttagttctggtactttcttctatagaattggtcattaaattgtttgtgatttaagacaataacatataagaacttgaaacagtttc

SEQ ID NO: 108759 - DNA, 1039 bp, Homo sapiens
actactgccccatttactgtaggtgtctgtgctcagcctttaaacaggtttatcttattactaaattactattcatgtgactcttatttgtatttttcctaataagtctcactatcccatttaaaactctatttcattgtttgctttttcttttttgatcatcctttccggtattatatctaatataatatgaaataaaatgacctttatgatttataagactttttttttgacatttctagacatactttgtcctgctttacaattcatattctggagaagactattcagtgtgcacctacagatgatatattagtagaattactaaaggaatatacctgctgcagaaaacatgcttttaaattagatgattatagaatgaaaccacaccgatgagaggcctgctttcattaataaccttttccttcatttacaagattctcctgaattattttggaaactatgtacccaattcatggacacaggataatggctgcactctttgtgaattcgatacagtcgacttgtctgcagtagatgtaagtggaattgattatgtgtgaaatgtagtaatagaaagtacattgtcatgaaatactgtgatttataggaaaaaaggcaaattattttatagttttgattttatgatagataatggggatatagtgttaaaacatgatgattcagccatttgctagatttgtgtttcagaactgttttttgacagaaaaaccagctaataattgaacctaatgaaagagtcctgtggttaatatttaatagcttactacgattgagtgctcttgtgtttattctgttagcttagtcaaagcattgagaaaaaatcattacaaggcttcagcatttttattgactaattttatctgtgctggattttcaaagttgatatgtaaaaattaatactacctgattatataacaaacgactgttttaactactttacatataataactcatttaaacttcacaaaactcctaaaataggtagtacaattgactcagttttacagacgagaaa

SEQ ID NO: 108760 - DNA, 1049 bp, Homo sapiens
agtttgaagtcaggtagcatgatgcctccagctttgttctttttacttaggattgtcttggctatacgggctcttttttggttccatatgaaatttaaagtagttttttctagttttgtgaataaagtcaatggtagcttgatgggaataacattgaatctataaattactttggacagtttggccattttcacgttattatgagcatggaatgtttttccattcgtttgtgttctctcttatttccttgagcagtggtttgtaattctccttgaagagatccttcacgtccctcgtatgttgtattcctaggtattttattttctttgtagcagttgtgaatggaagttcactcataatttggctctctgtctattattggtgtataggaatgcttgcaatttttgcacactgattacaaaagataaacaggggaagagctaatcacctgatctacacatgaacataactcatttctgaaactaatttgatttgtaataaaaatagagatgtgaattttgtgcataaaagctgtagtacttgggtcactgtgaccttgaataattggatatgatttttaaaaggaagaaagaggaaaggatttgggcggaaaagtttctctgtcaatgaaaatgacatcatacttggaaacattttgatattgtgaaagaagaatcaggaaaatactatcacctagtagcccaggagtgcccagagcagcctaactgcataaacagccttctgcaccgtctagagctgccagcaaaaatgtctctagttttcatgaggaaaacagatgtaaatggggggtggtgatggtggataacctctgcctgtgtggtgagaggtccaaaagagggaagtttctagtcaaaagtaatgtttctaaaatatcttagttatctaggaaacaaattgagataaaaagcagagggtaggaaagtgacaagtttaattccgaaaactaaaagtgctgtcttttatgctctaacattttaaaactagtgatcattttaatattcatatagggattctagtagactgatcaa

SEQ ID NO: 108761 - DNA, 1320 bp, Homo sapiens
cacattttgttaagtcattgtgattctgtgaatgaaccatgaggaagaaagtcatcagaaaaatcaatgaaattatattatattaattaaattatagtgtcagtttttacaaaaattaaattatagtgtcagtttttacaaaaattttctcccaagtgtattgagctttaaaaacctgcagttgtctgaacgcacttattttaagattccatgctaaacagtcattcagatattaaacatacattgatgacatttagcagttaaacacattttgtcaaaaataattcttcagaaactaatggactggtacaaatttacttgaaatattaggcagttatggcaacttccgtaaatgattctatctgtattataaagttatacaacaagtaactgtatttctaacattttaatgctgtttcagaatttcaatttgggaataagtgattcctgaaaaaaaaattaaggctaacactaaaaaagctgacttttatttggacttcatttgctaatgtaaactaataattcaatacaattcatataatttaagttgagagaaattttgtttggtgttctgtgtaaatagttggcacaggtattaatcttgcattgtattcttgattctgacttttgttagagaacttttcatggtttatgtgcctagattctgacaagtgtattttaaaacacattttttcctcattgaacagctttgatgtcatatttgctggtggtccagaagaagttctaaaaaaattccaaaaggcaaaccacaaagtggtctttgcagcagatggaattttgtggccagataaaagactagcagacaagtatcctgttgtgcacattgggaaacgctatctgaattcaggaggtgagttagatactggaagaaaagtttaatgcaagttataaagactaatgaaacaaccatttttgtagatgtagtaactttagatatgaagttttaaataacccttattttattattagtatattgacaaagcattttcccatgtattatgtgagttggtgttcctaaaaacactaggtaatataaatgttataattaccaaattataagtgaggaaactcatgtttttcaaatttaagtgacttctagagatattctgttgttaaaggaagaaaagtatggatccagttcctttaattatgacacattgagaattttcttgctctaggataataagtttagtaagcttccttacttgaaaaaaaattattctcagtccgcaatcaagtagcttttaagaataggtattacttaatattatctgattttaaacattatgggattaaata

SEQ ID NO: 108762 - DNA, 1050 bp, Homo sapiens
tcttttttatgggtgaataatattccattatgtgtgtactccgtatttcctttatccattcatctgttgatacatacttagatttgttccatatatttactattataagtagtgttgcagtaaacatggaagtataggtatcccattgatatacttattttctttccaacagcacaacaaaaatatcccccatgatcaagtgggatttatcccaggaatgccaggatggttcaatatttatctgttaaaattgtatttgttttatgccaactaactccctttccctccctccaaaatttataaaataattttaatcattttattgtgattttatcataatctgttgtgcaaagtcaactgggtacgtgggtgtttttaactgtgtgtgtgcgtgtgtgtgtctgtgtgtctgtgtctgtgtgtctgtgtctgtgtgttttgagggtgggtggttaggagtggatccatagtattggtttgtgatgttaattatctctggaaatatagacatatgcttcaggtgaagatatgatgaaagaattatcaggtgtgaagctacttctgtgctgctaatagtttggatgattataatttttgctgaagtttatgccaataatgataaaggattggggctaaatgacaaggttagggaacacttctgttgctttcttttttggctatatgggagcttttgcttcttgttgagactcaagatgatggattctgtggcttgtaccactgcctgtttttgtaaaaagttttattgaaatgcagctgtgctcatttgtttacatattgtctgtggtggcttttgcaacacagtgacagagttcagtcactgtgacagacaatatggtcatcaggacctaaaatattttctgtaaaaggccagagagtaaatatttactgactcccgctttaggccatagttgagaaccattgatacagtctgggaactggcacagaatcatttttaaaatagtttgtcagacagtcttatttatgagtgaggaagagatgggtaatgtagaggtctctagggttttaaaa

SEQ ID NO: 108763 - DNA, 1049 bp, Homo sapiens
ttaagatgtataaggtaaagaaggtgatttttttcttgatgccctctgcaattccctgaaaaacccattttggttcagtaggaaaattgcttaaaggcccctcatcaaggagtcactgagcttcaatgttgatcataaagatttcctgccagattgaaaaaaaagtgatatgggaaatttattcatttttcttctttatggtctaaacaaataggaataaaatgatgtaatgtgagaaatactttctgggtctacttccttggattagactcacaacttttgagatggtaaaaattgagaagggcattttggggatggataacattgaagaattatgatctgatttaggcatctagatttttttttctagaatcatgattccatgaaacattagaagagtggttacggtacagtactgttcaagttgatgatgtctttaagtttttcatagtactttcataatttgagttttgctcaggaatgaaatgttgattttgtttataggtccttggtcaaggagaagaatggagaggtggtgatggaattaatagtattggagggggccagaaagtgagattaatgaaagaagtcatggaacactatgctgatcaagatgatctggttgtcatgtttactgaatggtaggagaaacaccctgtggattttaaaatctatattcaattactttttaaagagctgagatttatatttgtagatgatgtattaaaatatggttgggcacggtggctcacgcctgtaatcctagcactttgggaggcctaggcagctggatcacaaggtcaggagttcaagaccagcctggccaagatggtgaaaccctgtctctactaaaaatacaaaaaattagccgggcgtggtggcaggtgcctgtaatcacagctacttgggaggctgaggcagagaattgcttgaacccaggagcaaggttgcagtgagccgagattgcgccactctactccatcctggcaacagagcaagactccatttcaaaaaaaaattattgacaaggaattattgttttaaaaagt

SEQ ID NO: 108764 - DNA, 1039 bp, Homo sapiens
aaaatgtgacactgaattcttccctgaacagaaatttggtttgggtagtttcatccttgggatttatttctgtggattatgcttattgtggttgtagcatttcatattaaccgtaacaaatggaatatcccagccattctttgcatgctatgactttcagcctatggtccagtgtgcatggaccctcttgcaacatatacactgagacagtgtatagtgctgaatttgttttttatttggtttcaggaagtcagctggttacttcagtaatcagcagagattcagaaatatagatgttgtaatattatgcaaccatggatgtgttttatatcacttggtatttctgataaattgaggtacaagtctgttgtgctttgaattattggagagttgtgttatttcctcttttattatgattaagtgtattacaaagaatttgaggatgatgtttttaaaatactagggtaaatgcagaaacagtacagaggagtgtttgctttcttgatatagccagagggcgctcactatacaaggagactagagacctctaactttgaacttcaaaactttgaagtcatttttttctcattcctctgatttattcttcgtatttaggtatagtgctttgctcattattttgtctctgtctttttttgtttgtttcatctgtagtgaaaagtgtgtgtgtgtgtgtgtgtgtgtgtgtgtgcgtgcctgcctgcctgcctgcctgtataaataattagatatctattagatatttgaaacgggtaaagattatttttaacatgatcttaatattgttattgcattcaacagtgattccttaatgttatttaatacctatccaaattcacctttgcctctttttctcaagtatgtctttttatagttggtttgtttgatccggatccataaatttatcttcctaaacaccttccaagctgtcacttaccttagtctacactgcaggactctggtagcttcagggtcaaatctagcctaaatattgtttttcaaaagcctcaaattaagttct

SEQ ID NO: 108765 - DNA, 1072 bp, Homo sapiens
cgggggtttcaccatattggtcaggctggtcttaaactcctgacctcagatgatccacctgcctcagcctcccaaagtgctgggattacaggcatgagccactgcacctggccaataggtagaaaatttttatgctgttgcccatgactatttttgtattgctttaattcttgattttagtagcagtttgtgtatgcttttataaacctatataatttagtaaatctacattagtttatttagctaagctttacaaattccctcataatacaacttttttagaggtaactaacagcattgtaaatttttagatgcaaatgtatgccaacaataattcccattgtgtaatactgtgaaattttggtaattaatattttaaaaaataattggagtatttattgactggctagtctgtgttctgttgctttgtgtgaaggaaaaacagaaaaaacaaaccagaatgaacaaacaaaaaccacacaaggctcagttcctgttctgtattgaaattctaagattcttacagggaaaataatgtatgtataaaacggagcaaatctgagaagcacttacgggtaagcaacctgggctgcagggaagaacacacacatctggcatcaggaaacctacatctaagttctcatccttccactcaccaaccttgagccgattcttgagcctcgtcagattttacttgtaatttgtgatccttacagtgctgtgatttgatgtctcttgacttttttttttttgaaacggagtttcgttcttcttgtccaggctggagtgcaatggcgcgatcttggctcactgcaacctccgcctctcgggttcaagcgattcttctgcctcagcctcctcagttgctgggattacaggcatgcgctactatgccctgctaattttgtatttttagaagagaccgggtttctctatttttgtcaggctggtcttgaactcccaacctcaggtgatccgcccacctcagcctcttgaagtgctgggattacaggcgtgagccaccgtgcttggccaatgtctcttgacttttaagtgtcagaatggtggtaga

SEQ ID NO: 108766 - DNA, 1048 bp, Homo sapiens
tcatgtttacaatttcttttccgctataagaaattaggtttaaagtttagtttgtataggtttgtaattaaattttaaccaggaaaaaatctataaatagcaactggataacctttgctcttcatttcaagagcaattaacactaacttttttttttttttgctgttcttttttattattagtcttctcacaagggagtatcagtttctgtgcaagttcatgagtgatggggatactccccaggcattatcaatacagaagtgacaaggtatactacattggagtgtcctttccttttttggttgaagaactactgtatttataataaaaatctacaccagaagtttaaagaaaaaaccgtatttcaagtttgaatacaataaagaacatgattattactgtaaatatactcaatagacttttaatacaaataaaagtcttggtgaacatatggctaaaatgaggggctacttgaggcaggaaagtggtcaggaaaagtgtttcatataaacattggtgaattttcaaaaatgggccagagttgaaattaaatatcatttgttacactgatagtttattgattttaatattgcttttattatcttgtgtgcataagacatcctggtgcattaactaatcatctgctcatttaatttggggttatattctcaaatttttacaaagaactttctcatttgctttctagttactgctaacctattttagggttccttccaaacggtaggtgagagataggactttcctctgatttaaatgctgtttttcttatctttttttttttttttgtgctgtggacaggtaaaaattctttatggaacaaaggaattttcaagtacacataatttttattgttcttgacagtactcctggtcagtctcggacactcaagtgcagtaaggagatactgaatatgcatcatgctccacagcttgaccctcccacaggcacagcaacaagcgaaatagatatgtggattttggcaaccttggctttgtgatgctagggcatcgatctggcctgggagaag

SEQ ID NO: 108767 - DNA, 1048 bp, Homo sapiens
agtctgagatattgactagctggtcctgtacagaaaaactttgccgaaccttgccttaggagatgacattcccacttaagttgtggctcatgccgatctgctgctctgtgggaaggagctggcttctggacagtagcagctggctctgggcatttcagagacctgtttttcattttagaatttgccggtgattcctgtggtgttttgcgttcaaacatagagtttctctgttacatctttttaaacacagcacttgaagctatcaagacatgttctttggtgtaagtagtgttctcatgatcaaaaatgaattaaaaacactgatggctagttggaaaggagatgcatatttcttcttcagagcttgagtatattctagaaatttgttctagaaacctggttatgaatttgtggctgagctcctgggaggaaataattagcacgtttatcaatgagtatttttatttttctttaatcattgctataaattaggctaaactgagaatttggtggcttttaaaatgacatattctttttaatttacatcttactcatttgcatttgttgtagaatgcttgcctccccaaactgaactgaacagaactaattttctttcttttttcttttttttttttttttttgagacagagtctcgttctgtcgcccaggctggagtgcagtggcgtgatctcggctcactgcaacctctgcctcccgggttcaagcaattgtctgcctcagcctcctgagaagctgggattacaggtgcccgccaccatgcccagctaatttttgtattttttttttagtagagatggggtttcaccatcttggctaggctggtcttgaactcctgacctcgtgatccaaccccctcggcttcccaaactgctgggattgcaggtgtgagccaccgcgcctggccaatgaaactaattttcaaagctattgagattgcagttaaaaatagttatctagaatagtagaattatagagactgttatttaattaattaattaattaatttatttatagacagggtctcact

SEQ ID NO: 108768 - DNA, 1004 bp, Homo sapiens
agttcgtcctgcagtagtgagcctcctctatgcacctgcctgttcttgtccgtttgcctgtaaaacctttccccatcatggagatgctggctaggtctagtgtgttagcatctatatcgtagtataccttctctgcataggttaggtacccctcctgtctaatcccttaacatgctatgcatctacctatgattatgtcaattacttgcttcgtgacaaccattcaccttttcttatacatctttgtagcctccacagaacttgctgcccttggagacaggcatgcatttgaatgtctttctgtcttatatttctagcagcaagcacagaagctggtccttgaaatgggcttgaggaatatttcatagataaaagaatctttgatttatctcatggccttgttttcagatagtattaggagaatttcatgattcatgactattatgagtggcatttttatgagtaaccaaaatgtcttagacttcatcaccttcaaaggcgactggcttttgcattattggttgaccccagaccactgcattgtcccatgatgtcccatggaggtgaaagggtagaacttaaggacttaaaaatagctgctagctagagatgccaatccagtgtataggcccaaagccctccatagaatcacgcctggggtgctcttcttccttgtctctgatctagggggagtattagcatgatgtatttaaggacgtttctgcagtcagaatgctggaattctaattctactcctgatacgtcagctaatgactttcaccaagttacttaacctccttatgcctcagttttattctctataaattaaggataataatagtatctactatatatggttgatgtaaagattacaaggtttagtacttgtaacgttgttagagtaagggctggaatatgatgagagctcaataagttttagttattatctttctttttatttttttttaatcaacatagctttctctaacaggactttcttccag

SEQ ID NO: 108769 - DNA, 1026 bp, Homo sapiens
ggttatttattttcattttctcagatattaaagcatattttccttctgagttttgaatggtaagggtaaggctattcaccgcatactatcatccaaatagaagtggatgtgcaaccacagatatttcattgaaaaatctcagaaagagaaaagcgtattaaacatcacagatacagatgtctacgctgaaatgtcaacttatagatagatggcataaccctaaaaaggttgacaattccatttttggtgcagttacaaatcatttcacttgtttgtatttcaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcaggtaatttcaaagacacaaaatactcataaaaaacagaactgtgcttccagcttgcttaaccagattagcaaatgaataattcaccaaagtctgaaatagcaaaactgtattttctgctaacagattactctaattcttctaggtctggttcaattttaaagcaaaatacaaatgccttagaaaattgtattttctgttatcttaaatacaatctatgataatggccaatagcaaacatttaattagcactgtttcctgcctttgttgtatgcctgatacatgtattaactcatttaatccttattgaaagtctgtgatgtataggtgctacatttttcaaaagaagaaactgaggtccagagaggttatatagctcactctggggtgagaacctaaagagtcaagactgtttttttaatcccgaaactttggtactgagcgaagtgctctttagtctcaatactgaataattgccttataatttggaagaaaatttaaataaagtttattgttgagtttcaataa

SEQ ID NO: 108770 - DNA, 1090 bp, Homo sapiens
ttgcctaagtttcttctcttacattttatttaggatttgcccttagacattatttagtgcttttctgaccctgtagggacggtgagaataattgaaacactagtttcttaaaatttctgttaaaattggttaaaggccatagaattttttttttaagctaagcatgttatagagaggtatcctataagaagcaaggggcaggtaaagactttagagatgtatagtccagtgtgttaattaaaggatactacctacttctaattcggtatgtattaatcttttctgatatatctgttaaagtactcttcgcatatttttaaaaaattggcattttaaagtatagtctttgatggtagaaatgtgagattgacaaaaatcatgtcctcttatgtatgaatttagtcttacacagttcttcatatgatggaatctaaaacaaatgtagtcttgaaaacttttagtctactttggttacatgtgtttattattgctcaccttatagattaacagcagaaaagtataaattttaatatttctacctttctggcttgaggtctacagcattaatttctgaccagttaatgcaaactgagattcctattgtcctaagaaaatctgggaagttagtaacacaaacacatcttttgatttatttcaggaccacataaacccattttgaattattcaaccattgctgaacttcttgagtatgtataattaagagttgactataattggaatgttcttaagactttaagttgattataaaattttgtgcttaaagttggcaataatcaaaacaaaacaaacaaacaaaaaaaaccctttattttaaaacacagtcttgctctgtcacccaggctggaatgcagtgatgacatcatacttcattagaccgtcaatattccaggctcaagcaatcctcccacctcaacctcccgagtagttgggactacaagcgcatgccaccatgcttggctaatttttttttagtagagacagtgtctgtccatgttgcccaggctgatctcaaacttctggactcaagtgatcctcctgcctcagcttcccaaaatactggcattatagg

SEQ ID NO: 108771 - DNA, 1177 bp, Homo sapiens
tccattgcctcatctctgaaattgtgtaactattaaatgagctacagagtattaatgtaaaattcttagagcagtgcctggcgctacagaaagtactcagtgaaagttagctcttattattttaaatatttgacaaagttcctgcttctccaagctgattctctggttcccaggtggtttcattcatgcactgttattcctggaagtcttggcatggccacttcccagttccaggaacaggcagtcgttgttttttctggcttatcacattgagatacatggttactacaagtgacacttaaacgtgtcagacagtttgggggctcccttcttgaactttttctaagagcaaacctttgtcttaatgccaccctgtttacaacaatagtagggctttgaacaatgagaaaatgcggggaaatgaaaaagacatataaagggaaagagtggatttatgcaattggatagaaaagtggcatgtaaaatagctggtttatagatcaaactgcctttagatctgtaaaggagcttagagtacatacaggtggagagacatcagatgtgtgtgagcagacccttatgtacttctccatcttcatctctaagaatgtctccctcttttgctctgtaacctcactcgtcttcctttacttgaatgagggacgttcctccagctcaggaattctacctatggagttccctctatctatgatgccctccaacaccccacccaccatacctccatagactagttgatttgagacttccttcatctcctagtctgacttttcttaaaccccctaccaccatctaagttagtgccccataaccctttcttatagcaacattaattttatttatagcacttagagtatttttaataatatatttaattcttaattgtctgtctcccctagtgtctaggtattgtgctctagtgcctggtatagtgccttgcatgctctatgccttcaattaattcctttaaaaccacacaagctttatatttagtgaatatttatataggaagaatttctatgtgtatatatgtgtatctgtgtatatacacactgtattgcactgccctgaatagtgctaaattaaaaaaccaaaacactttttaatcagaacttaatagttgcactcttcaattttccatatgttcttttaagaagtg

SEQ ID NO: 108772 - DNA, 1119 bp, Homo sapiens
atagatggatgaattagacaaaacatactctctgaaagagtgagaaatacaatattcaccaattaagtgaaggaaaaatctacactatgaataaaacaataaatgtggatacatttgaaaatttgaatttcaaaccccttaagataatgtgacaaatacaacaggcctaatttaacatcttaaagagatctgtgtgacctattttgcagttttattttcttaggacaatgcttcagtatctttaactttcatatttaatcattttttttcttttttggtttctatggtatcaccatccatcaatccatattggttggagggggggaatatatatatatatatatgtatgtctcccaagagaaagtaattctgcaatcttcctcagcaattcagtctaacaattaagaacccttaagctaaatagaaaaattcatttcacaggcaagttttactcaatatgtataattagttttagttaactttattaatgaaatgtcgcaaatcaattaggtttgcaataatcagatgccgaggacccaagaggaaccattcctctcacaagaggggaaggtgatacacaatttagttgggaagcaaatgtaattagatttgatcaattgagtattcctgtcctgatgtggagtcagtcacatacccaagcctgagaatatatttgaaaagaggtagaaaaaaacccagtatgacttagaaaatgtccttgtggtcctattggccacaactggcagccaaaaagggctttgaagccacaggtagacaggttttgttcagacagggctatgttttagatttctctttcaaatctgaatggttttacgtagggcaatatataaactttcctatttgtcacagattctagcactctttaatgccttatactgggtgtttcacacagttatttaactgcccaaatcccaatggcacttcagtttgcaactatcatgacctagaagttagttattgaacagttatgaggtaacttaaagtttcttccctttgcctctagaataagaatatcaaagaaatgtcatgatgataggaatactactgaaagaggatattaaacactaggtattcctacttagggctacagtttgcagc

SEQ ID NO: 108773 - DNA, 1012 bp, Homo sapiens
attctgagtgtttccgtccgtttttttaatttttgtactttatgggctttttcttcatttacccccaattatgcgggaaaggctgtgtgcctcttttgaaagctctgatgttctcaatgaagagaccttttaaatgaccttgtttgtcccccaccgagttgcatatcacaacttcaaatgtctcactaaaatgttacccatttggcatcagtatacagaaaaggctgcactctgagataagaaagaacagtggtgttttcatagtaagagaatagagttcttaatgggaaaggggagagtataatttccactgatttagctggtctttcaaactttatgatgcttttctccttgaactagcctataagaaatttgtagggaaaataccacaggaatcaaattttgggcatagatgtctattaatattgctccttacaaagctttttcccagaattgtttctccttgcctacaaaaactactccatgcctttattagtcagaaaagcagttttgtagagaaggcaagtaacagagaatcaagctaagtaagtgaaactctgtaattgtcaaacttccagaaagtaacatttgtaactaagtatggtatctttgtcctctctctttctctcttctctccacttggtttctaatgaaagccttgattacatgttatatttaatgtactgttccacaaagaagaaaaggcctaatgtgaatgcaagctgaatttacacttaaatattgcagtcagttcagaccggaaggatacagatcgatgccctctgatcctgtcagattccccgaagtgtctatggcagtgataccacaagagggcagggtttgacttccggactaggtggcttcctcccttcagtgcagaccttggggccacgacaacagccatcaatctcttgaaaccctaatgatgaatctgagctcaaattccctcttcagccttatctgtgcagaatcctgaagttatgaaaaatgcttacagaaggtaatttctaga

SEQ ID NO: 108774 - DNA, 1046 bp, Homo sapiens
taatccaaatgaaagcttgaacaagcagagaagtttggtacctagtctcaaaccagtttaactttccttcttataatgtgataactgagtatgtgttgcggctctctagttagattctttctgaaatgtagcctgttgggtatcattttgtttaagttctcaacctttcagagcccacacagattgagaatttatcttgagacttgtgttcccttgcccatccatcttacactttctaatgaactgtttgcagctttcagacttggtctatacactggctttctcttgtggcttctgtagaaaggtatgcagaacttaaagattaaccctaattactttgttctcccaatgttttcactgagtcaagaagtcttcattttgttaggaaaaaatcatataatctatatttttgtgtcttttttgtttgtttcatgtaatacttttcagtttttgctactttgcatgatgattcatcctggcttttctgtcttcaatttattgcattctttaaaacagtttgattttcagctctcatagagtcaattatgctttcctttctaggaagatgtctcaggagccatatcacatctgtcccttggggagatcccagctatggcacagccgtttgtatcctcggaagaacggaaggaacgatgggaacagggccaggctgattatatgggagcagattcctttgacaacatcaagaggaaacttgacacttacctccagtagaaacactgcatttttctgtgaacacatccacttcacaagccttgtttctgatacttagtatctagagctgggttgagaaaagtctgttacagttgctagaggttttcattaaaacttatcagatgagaggcttttttaggataagaggtgagaactgggcaaaagttgtgaagcagcaattctgttatatggacagtgttctgctttttaatcctatttagcttgtttcagaaattctcacttttgttgactgccaacatacaaagtaagggaaactcaagatattaagatggctgtatcagttcttaaaa

SEQ ID NO: 108775 - DNA, 1799 bp, Homo sapiens
tgatttgaatattttaaattatggaactgctaaatagatatttctataaatagataatttttatttatgtagctttttttggaagtaactttataaatttttataattcagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtttattaccttcctcggtgccataattttgactttatcttcaaataaaatccttcattaattgtgacatttctatgcaagtgttacatttttttgagagtacatgaagattactgtaacagaataatgtcctcatatcctaactaactttattttgctcaatttagctggttgaaattcttgttcagaaatcaagagtgcttatttaaaatgccttgatctaaaaacattggtcccaattaatttcttcatctggaagaaaaaaaggagttgtgataatacctatatatacacagatagcactcttaatcaatcattgtacattttgtccttaaaattacagctctagaattggaaatacaaactaaccctatgtagtttgttaccagtgagtactaatgatcttcggcagtgtgtgctttgttttggggaatggcaaagacattgctgtatt

SEQ ID NO: 108776 - DNA, 1034 bp, Homo sapiens
taatagaaataccacttaagtaagttccacagtgtttttcactttcagtaaaaggattttatataatcatattgatttggatagcaaaaaaaaaaacttaatttgttttgccagttttagtcattttatctgaaagatattcagagtcacaatagagaatacttcctggcagcacaagaatttaaagattaagtcctgaatttatcagaaaatgactgactcagtgcctagcatattaataagtgttcaataaacatttgttaaaataaatgagtgaaagaatttattgaagagatttgtagttacttaactttgttttatttttataataatagtgtttgttacttgtctcttttcttcccccctttagagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagtaagtagttctgtaaattttttcagaatcttagtacttctttcaaaaaaataagacaaaaaactatttggtaaataccttcatagttataattaactgtgaaaattcttaggcaaactttagaaataaataacaaaaacttagtaaatgtggattaagagctttctcttaagcactttactgaaatcctcacaacatccttatgaggtagataccattattaaatgctctgttttggccaggtgctgtggcacatgcctgtaatcccagcactttgggaggccaaggtgaatggattgcctgagctcaggagtttgagagcagcctaggcaacatggcaaaaccccatctctacaaaaaaaagtaccagaaaagttactctggtgtagtggtttgtgcttgtagtcccagctacttgcagggctaagtcggaaagattgattgcttgggcccaggaggttgaagtttcagtgagccatgctc

SEQ ID NO: 108777 - DNA, 1101 bp, Homo sapiens
ctagaaggtaaggaaaagaatgtaaacttaaactagttgctttttccttctgctagtgctgctgctttaaaaactaaataagcagatgtacttgataaggagaaagttgaattttccagtctttttcttggctagtgtgtcatgtgagagctaaaaattagagcaaaactgtatcttgagatgtgtatatttttaataaatgattatagtcaacacttgatagtttaatttaattgataatgatgagcctggtacagagtgcccattttcaattgttgtcttctctgattgggccaaatagatactcttactggatactctggttaaagagttataacagtttcctgttatttctaggtactccaatccagaattctttaaaggacttgtggtctcttctttcctttttaaaacttaaaccatttattgatagagaatggtggcatagaacaatacagcgtcctgtcacaatgggagatgaaggaggacttaggtaagtactttcagacagtgattaatattagttacaaataactgttagtagcttgaaccagttggcactttctttactattttaacttgactcttaacttttccttctaaaaagtgtttatggctcagtacctttgtctttcagaacctagtgatgcttgtttggaaagacaaagatttctaattgtcgataactacccttcccctgttgtggctaaactgaaaggaaagacataactgttttttgtgtgttgctaagccccaaagccccaaaaccagcattaacagatttagcaggaaacatcgtatatcctttgaggatctaatatgcattaagttttcatatcttatatagctttatttatttatttatgtatttatttatttgagatggagtcttgctctgtcgtccatgctggagggcagtggcgcgatcttggctcactgcaacctccgcctcctgggttcaagcgattctcctgtctcagcctcccaagtagctgagattacaggtctgcgccagcatgccccgctaatttttgtatttttagtagagatggggtttcgccatgttggccaggctagtctcaaacttctgacctcaggtta

SEQ ID NO: 108778 - DNA, 1049 bp, Homo sapiens
tgatggatcttgtatatagtctccaacattttgaatctagagcctgtccttttaacactacccatcagaaattttttttttccagattgcttttctgttctgaaacattgacattggaatggaacctcttgattaattgtttatttgcagcctggatatgttttcttcctagtttgagcttcaaacttcttgttatgatgaaataatgactctcttggaatccctgtgaatataaggaccactcaccgttcttgccacttccaagttatctgtttatctctcatcgccattcttcttatgtcagaggaggaagagatcctactctttttaagaccagtatttagtctctacattggattctctcttttcccacattgctcatctgttcttttttcccttgtttatttagtctcttcccactggctcttcctgatacatactcaggttttttcattttaaaatacattctcttgatatgcatctttaaaagttgctactcttctgctttccttcactgtcatactcttggaggttaatttctactttgtgcttttacttactaattccttaattcattgtaatctggcttgtaccattagttctctaaattgcattggaaaagactacttgtgatagtttaattgtcaaatttagtggcctcttcttggctttatagtctttttttccgtgacatgaattatctttttttatataagtttttggtttatttatttattttttaaattacaccttgtcctgataagtgtatcatttttcctcttaggaccagaagaatgaatgttaatggtctgttgctatttttttattccaacgaaactgttctttctttaatttgttgtttgttatgggaaggatagtacatgggtacttgaatggcagttttgggatgaggtttagagtattaatggaggtataaactatctaactgattatttgagggcttggggtatagagatgtatttttaaaatgggtaatcagtatttaattataattttatatttaggaaagttcaagtaatgtaaagttc

SEQ ID NO: 108779 - DNA, 1056 bp, Homo sapiens
aaaccatattacaagaagtttagaaaatagagactattttttaaagtatataacccattaaaagaacaaagctacctcataatttgttttccttttggtgcattttcctactgtatttgttttagttagggccaaaatgtgatgggggcccttactcctctgaatagcagagatatttcttctagtgatggcacaaagcaatttgtggctgctttaaagcttaatttaattttggttaatttaagttaaaggtttaattttttggtattagaatttgcttttcattttaaaatgttagtgatctttgttatgattttatattttgtaattcataggaaaacaacactgcttaagagactaaatatttgagatgggaagagattgaactaaggttgagaagatctgagacaaattatatctctgccccttggtctccattattttacatgttggggatatagcaggctatctgttttcatatagcatatgatgtaatgatgagagaaatatacaataagcaagtcaatataattttaaataatgagaagtaatgtgaagaaaaaggaggataatgaagtaaagattgacctgaaggggcttgtttatgaagctaacatagactcatgagaaagagccgacttttggtccaagaatcagataattaggaatagaaaatataggcatgttgggtggattattctttaccctaattttagaaatttaaagaaatgtggaaatttcggttgagatagaattaaattacacattagaaaccactttcagttgcagatgcatagctgtgatacaagagagaacattttcaaagtcacagctgtgtgtcattttggttttaaccaaactaagtatatctttgaaagagaagcagaatagaaacaaaactctgtgaatggagacagaagccataatcctgattgtccttgtggtagatagtgatctctttagtaagacacaaaaggtcataaggaaaagattgattaaatgccactacattttaaatttccatgcatcaaaaggtgccataaacaaagtaaaaaa

SEQ ID NO: 108780 - DNA, 1185 bp, Homo sapiens
gaaactccgtctcctggcttcacgtcattctcctgcctcagcctcccgagtagctgggactacaggcacccaccaccacgcccggctatcaaatttattttaataatagtgaaattcgctgggtgtagtggcacgcacctgtagtcctaggtactcccgaggctaaggcgggatgatcacttgagcccaggagtatgaggttgcagtgacttctgattgtgtcactgtactccatcctgggcaaaagagtgagaccctgtctcaaaaaacaataacggtggtactccattttgtatagttaatgcatctatctggttatgaaagcagaatgcttttagcagatctgactttcatttgtcaaaatctttaaaaaatttttcaaaaaataaatgagtaggacaaaagttttttattgcatttattaaacatgtttgtatatcttattttgctttgggttggtccaaaaatttctttgtgtatacttaattttagaagaaaaactgctgtccagtacatagaaagcagtgattcagaggaaattgaaacaagtgaattgccgcagaaaatgaaaggtaacatgtaatagatttgatttgataatgtgtcctatattctaatgtcctgttttgcccatttttatgtttatttttgttttatttttaggcaaactgaaaaatgtacagtctgaaactaaaggcagggcgaaaggtatgtgtatactatatacccataatctagacttcaagattattaaagtacagctccattgatttgtatctcgctaggttggaatgttttagtaatagctcttaaacttggctgatgtttacatttgaactcttcatggagctaaccatgggttttaaattaattttgtaaaggaggaaaagtgaataaatagttgcaaattaaaatctaagggataataatatttaaactatacttaaaacaattttctactacctataaaatgacttcaataaaacctatgtgtgtagtatgaatagtaattacaaaattaggttgagaatgtcttcctggcaatactattattgtttacattattatacagatgtgaaaataatcaaattttttctttttctttaaaatatgttttattttcctgtaattcacatcatactatatttctcattcgttgagaaattgtattgcatttggaaaata

SEQ ID NO: 108781 - DNA, 1182 bp, Homo sapiens
agttaggtagatgagttagcagtagaaggaaagaagtaaggttgaaggaaagtatagataaatgagtggattaaaagataggaaaattgagatttttatggaagataccttctcattttctttgtaaagtgaaataggtcatcttggaataaaaggagttataatctaggcaaaggggtcaatgtagtatggatcattctggtatggatcattctgataaatgggtaggggagccgaacagtgtttagtaaaaagagttaccaagtgacacaaggtgacatctgagatttgaacatgtaaatttataacagcacctatttgtggttctgttgatttttttttccaatagctcttagctgccttggtacagcaagacattcagctagtgtggggatgggctggatgagtacaaagaaaagactgggtcataaaaatttgaaggtactttctaattagaaatgaggaaatactagattaggaaaaaagtagagaaaatagagtaatgaaaggaatgaagatcttaagaaaactgaaaatcagtaattagaaaaccaaggttttaagagggataatactagtttctaagacaccttactaatactttatatttgcatttttctttgaaatagacgcatctagatgtagtgaacaacccagtatttcagatatcaaggagaagagtaagtttcgcatgtcagaattgtctagctcccgccccaaaaggtaaactattatggtttgattatgtcatatgtttatttagactctgttttcttatgtgtaaaagagatagaggctgggcacggtggctcacacctgtaatcccagcactttgggaggccgaggcgggcggatcatgaggtcaggagattgagaccatcctggctaacacagtgaaaccccgtctctactaaaaatagacaaaaattagccaggcgtggtcgtgggcgcctgtagtcccagttacccaggaggctgaggcaggagaatggcgtgaacccgggaggcagagcttgcagtgagttaagatcgcaccactgcactgcagcctgggtgacagagtgagactccgtctcaaaaaaaaaagaaaaagagagagatagagatgaccatgacccttatatttgttaagtagttctttcaaatacattcttttatttgaaactaccaagatcactatga

SEQ ID NO: 108782 - DNA, 1050 bp, Homo sapiens
cataagaaatatatcttttatgctttatggagaagttatgacttttaagcttggtattatctttaagtcaaattttaataaaatgattatatgcatactggaattactaatcactttagctccgaacttcatggcaaatgagtagttataaatagttgcatgataaaaatcaagagttcaggattaaatgtagaattgtagaatagcagtcattcaataaaatgacacttctcagagatacttgtagtattttatagtgtaaatcatttaataattccctaataatgcagtgggggaaagcattttctaactaaatgaaatactcatttttcattaatatacagtacacttttgtgaccttgaatgatatttgatattcgattacttgattttaaaatgggaacgtttttctggtgaactgggtttcacaatctgaccatttatctttttaaaacatttttaagggtaaaactcttacggccattgcagtaatccttaccaacttccatgatggcagacctcttcctattgaaagagttaaaaagaatctactgaagaaggtaaagtagtagtaagtgcgctttatgtgaaacctccagtttattgtgaaatctttaaatttcatcattaaaaaaaactaccaagaaattgtgttttcagaaatgcgatgaatggtctctctgtcttttatgtgttgctgataagaatgaaagttcgtgtcacattctttttacgttttcagacaaggtgtggctctgttgcccaggctggagtgcagtggcgcaatctcagctcactgtaacctctgcttcccaggctcaagtcgtgggatttcgccatgttgtccaggctggtctcgaactcatgagctcaagccatctacctgcctcagcctcccaaagtgctggggctataggtgtgagccaccagcaggtatcacattcttgagaacaattgataatttgtatcaggagtcttaaaattgtttataatctttgaacaattttgccagtcaataatgccatttctaagaaactatctgaaaggagt

SEQ ID NO: 108783 - DNA, 1312 bp, Homo sapiens
gagtagtgtaattctagagttgatttatgtgcctttttggcgtttgactagtttgtggtttttaaatttaatttaatttcaatttcttaattttttgggacagggtctcactttcttgcccaggctggagtgcagtggcataatcatggttcactctatcctctacctactaggctgaagtgatcctcccatctcagcatccctaggagccagaactacaggcatgcacccccatgcctggctaattttttaaaaatttttttgtagagatgggatctctcactatgttatccaggctggtctcaaactcctgagctcaagtgatcctcccaccttggtctcccaaagtgctgagattattggcatgagccaccactcctggcccgtttgacattaacgccagttaattaaatgatttcaaatctgacttaaatgcaagtattattttaattagtttgttttacattgtttcttgttgctgtttattgtagcttaaaacagaatttgacaaattgtttgaagatttaaaagaagatgataaaacccatgaaatggaaccagctgaggtattgaaccaatattttttatttaagactactcagaatgtttaaatatacttagaatctactttttgtttaatcacaggatctgcatgtgaaaaaggaatggcttaatgtatttcgctttatgactttttatttataggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttggtaattatttttttctttagttaataaaatctaattttgtgattatgattttctagaaagtaattttgaagtaaaaagagataggaatatgttggtaccagtttgggactagatcttactatctttgtagaacacagtttttcctgtagtttttagttaaaatagtggtataaagatgtgttcctcagttttcttttttttttttttgagatggagtcttgctctgtcacccaggctggagtgcagtgacgcgatcttggctcactgcagcctccgcctcccaggttcaagcagttctcctgtctcagacttccaaatagctgggattacaggcatgtgccaccatgcccagctaatttttgtatttttagtagagacagggttttaccacgttggccaggctggttttgaactc

SEQ ID NO: 108784 - DNA, 1473 bp, Homo sapiens
cataatgtctcactttgttttctcctttttcagtttatcaggtttttcagttattgagaataacttagtgaatcacaagttcttgcatttcccattttccaagcagaatgagttactaccctcagtggttccgttagccaaactctaccctttgatttaacttattttacttatattacaatcttgtttacaggccatccttgcatttttaaaactgctttattccattttctcaattttttctggcactctgtttctaaaaatcacccttctgattgtttatggttctatttcttttcctttttttctttcaagtctgcccaactagttccttattactttacttcaatgtaaaatgtaaatgatacacttaaaatattgaactaattcttagtggggataaaaagtaatgcttctgatttccctttctttttctcccaaatataatagggtagttccttttggtgcaaacaatgcttttaccatgcctctgcatatgactttttggggaaaagaagaaaatagaaaagcggtttcagatcagttgaagaaacatggatttaaattgggtcctgcaccaaaaagtaagtttagggtttcacttaatattattctgatattgtaagatgcagggattatgaaacatttattctctcttggagtttgttggctaatttgtgctcaaggctccaaggtacaactttttttcaggagtctttttgaggaaatctctgatttttccttttgcctctattgaaatagattcacacataaaaatatacacagtaagagtgaggggatattaaaaaaattaaagaaaaagtatatatgcaatgaagtctcatatataccctcccctaattttccctaatggtaacatctggaaacccctgactttaaacattctttttgataaattttaggcaaaaataatcttctgatagcgaatgaaaaggattgcttggcaagagtttgttcaaataatgtggaattacttgtttttttagtgatttagtatttagcttttaaaatacctctaaaatacaaggcttttaatgcagtttgttatgcacgttttatttatttatttgtgtatatattttgagacagagtcttgctctgtcacccaggctagagtacagtggccacgatcagtggctgagtgcaaccttgacctcctgggctccagcagtccttccacctgagcctcctgagtagctgggactacaggcgcacaccatcacgctctgctaatttttgtattttttgtagagacagaatctcaccatgttgcccaggctagtctcaaactactggactcaggcaaaccacctgccttggcctcccaaagtgcttgggttacaggcatgagccacagcacccagccctgttaatgcatattttaaaagctacttaataaaagataaaaacctactttatttgatggctttattctttttattttgtaaatta

SEQ ID NO: 108785 - DNA, 1027 bp, Homo sapiens
gttgggattacaggaatgagccaatatgcttggcctcagtgcgttatgtttggttattatgggtagcaccccacccccacaccccagcgccttgttcatgtcatcgatttgttgcaaaaaggagatcgttttgtggaatcttctggattttattctttcatttctccgtatgtttcttatgtttaagcttctcaatagggtgtctgaagcatgttcgacaggagattccttaggagtttcatgttctggatttgtttttctcctgtatttcctttacattggaacgtttcaaattgttttttgattgtctgaaatgtgttgtctaggagattccttaggaagagacaatatttcctaagtttttatattttcatacttgtggcattttatgaatgacagtttcataaaatgaaagttatgaaggacttaatgacagttgggctgaatttaaaatctttgtaatatatctttgtaataaaatctttgtaataaaatctccatatcctaatgttgcatagaattctcaggccagtgtgattttctttcacttaagtgaattggatttttttttttttctttttttttgagaccaagtttcgttttgttgcccaggctggagtgcagtggcctgatctggcctcactgcaatctctgcctcccagactcaagcaattctcccaattcagcctcctgagtagctgggactgctggcgttcaccaccatacccagctaatttttgtattttttttttttgtatttttttttaggttttggcatgttgtccaggctgatctggaactcctgggctcaagtgatccgtccgccttggcctctccaagtgctgggatgctgcacccggcctctaattttttctaatagattcttgaactctatcagttcttatttcacatctatatattctctggctctcatatgcatttctgagcttttctgtttcagatttgtgctaatttttcaaaacttacattgctttcgataattattttataccaccatgaaatacta

SEQ ID NO: 108786 - DNA, 1030 bp, Homo sapiens
aaagagttcgtttttacttctcccactttctagtttttttaaaaagggagggagaaggaaggaataaaaatatcaatttctgtcccgtcacataatggaacagaaatatacatcattgtgtagcaatttctaagttaattaactgtttttaatgtcaatattcgagggttgacctagataacaaccacagatgacaaccaggcatctattgtgcacttactgtggagtccctaggtcctttttgtatgcagaagcagcctggagttgtggaaagaggtagaggagtgtgaggggtcaggagacctgggatctaattggctctactctccagagaggcggtggaccagtcatgaacctttcatgccccaatctttaaaacaagctgctggactaggtaattctgaagatgccttcagatggtctctcattttcaattcgaccattggatttgagtttgcatagtctgtgttgtccagcataatccaggatggatttcatcatgaggtggttgaggaagaacaacagttaagaaatggattttactcttggttttgatagacacccatctgtaccttgggcaggtactgggggcatcatttgtctgtaaaatgaagatactgacccagatccatggttcctaactagggatgcacatcagagtcacatatggagttttgtagaaatgtacacgtccagattcagcccctagagattgcgattcactaggggtgttatggggaccagttgtatatttttaaaaacacaccacagggattctgaggcattcctcttattgagaagaagtttaacttggcaatatttgacaaatacttgactgtcacccctgcccattgccctgtttgcctgtgaaaccctccctgctgtgggtatgttggttcttggcctcactttgctcagcagcctgtgtcttcctcctcagtaacaacctgcagtgtttcactgtgcggtgcagtgcggcggcagctcgtgaggaggacccgtacatggacaccaccctgaaggtaagaac

SEQ ID NO: 108787 - DNA, 1034 bp, Homo sapiens
ctttttttattaactagcctttgaaaacatagttttgatggctgtgtaatgttccattatctgagtgtgccatatgtatttactcatcctttgttgttaaacatgtagattacttctaaattttcaatattgcgaatactcttgcggtgaacatcattggacgtaaatctttaaccacaatgttgattattctcttaggatagagtcctaaagaatgcccattggttttaatttgcagtccacacaaagcaaataaaatcatgttatttaaaaatgattgctttctattaaagagatctttaaactagaggtagtttcaagattatattatacttagatttattaaataaggaccacgtgcatgtgctctaatatggcattctttctattttatttttggcaagtgaggtttagtcttaagaaattgaattctgcatgttgtgttttagtttttgaggtgcctcatttcataacatttcacttttctgttcatagtctcttatatgtggtccttcatttgacatagcttccattattccgttcttggagccactttcagaagacactattgccggcctcagtgtccatgttctgtgtcgtacacgcttgaaagagtatgaacagtgcatagacatactgttagagagatgcccggaggcagtcattccatatgctaatcatgaactgaaagaagagaaccgggtatgctttttcagattatgtttttaggcttgatcagtgataatcagatctgataacctcatttcctttcctgcaaaatggggacaatttatgctaatccaacatcataaggctgtgtgggtccattgagcatatatgtttaatatgttacgtgttttgagtactattaaatgctgttaaaatatatggagatggtatattatcatcattaaacatcttttgtttggagatgaagtagttgattacctgaagatttgggaacagtgtatgatgggaaaatattttctctgccatacggtttttagtttagaaattagaagaattttggacct

SEQ ID NO: 108788 - DNA, 1073 bp, Homo sapiens
gaaatgagctcaggagatttgccccaggttgtaaattaaatcagcacaaaggtagaaatgaacacagagctctcagattggaagctgtccagacagctgcatggagcaggggcacagctcactgtctttcaaagcctcaaccagggctgttgcatctcggacacttggcagttactggaaagtcatgttaggctttcctgttgattctttatcttgtggaggagttgcacagtcaatgccttgttcaagattaatcattttccctgttgcctatgactgaggctgtttctcacatcctgcccctggttttgcctgtcccaaggatttcgtctgaagggcgggacattccccctgcctcttcgcaccacagccagagcctgccattaggaccaatgaaagcaaagtacctcatcccctcagtgactaagaatcgcagtatttaagaggtagcaggaatgggctgagagtggtgtttgctttctccaccagaagggcacactttcatctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctggtaagtcattcaggattattactgaattctctcctgtttcctagatgttttcattatgtattttcatggaaagttttttgtaatgcatatttctaaatcaagtgacttttttgttgctgttcattcctttgaaagcagattatacaaaagcgagattggtacagtatagcgtagtaattttatgagatgttgttttacaaaatgctctttcaactaaaagtgaactgcctttttgctaaactctataggtaggaaacagatattcgcttttaaatcagatttgagagactatagagtttctactagaacgggcagtcatttaacatttg

SEQ ID NO: 108789 - DNA, 1969 bp, Homo sapiens
aaaaattgcaaaaagaattgtacattcttgctaaaaataaataaataaataaaaaattaaaaaaacaagggacctaacaaaactcagcagtgttactgtatttttaaaaaatatttttatagactcattttcaggttattaaatgtaagagaaacagatacccctcttttttaaagtaggtaaatcattgatgatttatattaccaatttttagaagtaattttctagtaagcttgtggcatcagaaaatactagaagatttttttagttaaattagttagaacatttatgaatgaatataataaatattttttcagaataaaatatggaccctttgtgtttactaatagataaagccagatataattttttgtttttaaggccacaaaatatggcctttgttaaagaacactaaagttagaaatctaaagttagagcaactttttaatggctatttcctattattgtaagtgttaaaacccctgcagaattcttgataaggtgctatttatactatatttcttattataagataactgtctttagtcttcttagtactagtctttttagtactaaatcaatcagtaaacatcatcatttcaccccaaaattttgtcacagaaaaggcgtatcaaatgaaaaataatttcagagatctttctttcaagatattttttcctgataaaatacattgtcttgaagtaaatacattgtcaaaacctaattgcaattctgttaaatctaagtaatttttagacagtgtttcaccgtattatttaggatgtgaaatgccatttctttcactgattacaccatatacaggaaacaggtaaaacagtgaaaactttattgtgctggttgatgccaacttggttgaaaagctctctgcagaagaagtgatctagactgacagaagtgttgctaattacaagttgtgttctcatgacgtaattagaaagtaacttctcaaagtacaacttttatgaaaaaaataagctgttaaaaaaaggaaatcgtaggttaatttaattgggaaaatgggcaattgacagagaccattttcctaacacatatatgtgctagtactttaactttttaaaattttacttctacgttttgtaatataaaaatttctattttaagtttagaatgttatacgtaccgaaagtatgcagccaaatcgatcagatcaaaccattttacctggagtttggtactggtttttacttctctgaatctgtataagaaaaataaagacaattgaacttccacttggagcttttgacttttcattatttgtctgtgttccttttactaggggatttgggtggtactgaagacaggcttatgtaaccctcctggcagacaatgaaagaaagaaaaatctgcaggcaaacaatttcttggctcacgtgcctggccttcaacattctaaatgttcacagaattctagtttccactttatttacaatgtccactgaggtttttaaaggtgtatatatacacctttaaaaataaaaacatatacctttaaatatatatatatcacatcattgtcctcccaacaccctcacagatttgacaagaccatcaaaaatacaggattcttgctgggcacgatggcttatgcctgtaatcctggcaatttgggaggctgaggcgggagcattgcttgagcccagcagtttgagaccagcctgggtaacattgtgagaccttgtctctacaaaaatatataaacattagccaggtatggtggtgtagaatatacaacaaactcttataaaccaatagaaaaaacaaacagcccaatagaaatatggatcaataatgtgaatggaaagtttatagaagatgaaactggctggtgactaatttaccaacctcattccaaatcagaaatttagataaataatgactgaattcccagtggctcataggcttgctggaactctttcattgacctaga

SEQ ID NO: 108790 - DNA, 1121 bp, Homo sapiens
gagttttgctcttgttgtccaggctggaatgcaatggcacaatctcggctcactgcaacctctgccttctgggttcaagcgattctcctgccttagcctcccgagtagctgggattacaggcacctgccaccacgtccggctaattttttgtattttgagtagagacggggtttcaccataatggtcaggctgttctcaaactcctgatctcaggtgatccacccatctcggcctcccaaagtgctgggattactggcgtgagccaccgcacccggccttgatgtttattttataaagcactgtaattttgtagctgatgacaaaaggcagccaaatgtttttgataaatcagtggcaactgtatttttgtcttttgaaataactctgaaaacatcaggacaacatagatttcaacctgatagcacaccacacacagtgagctgttgctttttaaattctgaagccttgtcaggtttgcttcctagatttcaagtgtttaaaataattctatctatgaaactgaaggatgaagcagatctctgactgacatgtaaaaaaaaatgccctttgagggtgtatggtggagataaatgtttctgaattcagtaaaattgattcctaagtatattatcctaatcctgtttgctacagttggtataaaaaggcatgaaatatgtattcaatacctcttatgtaaccaaaaccatttttaattagcttttaaggactgagagagcatcatgttcaactggcatgcagtctgcctgcattgccaatgaagtcctcaactgtttaatattttgaactaatattatttataatctatgaatttaatcttttttgaaagactttaataatttgagtctctgagaggatactttcaatttccatgggggacttatttgttggggatcttaaataagattccttttgatctaccggaatatacatgtacagagtacattggatcatgttggaaagaaggcaagtgaaaaggtcagagatgaagtagcaaagttatggaatatcgtggaaaggatactagttgtgaaatggaaagagacaagttatagtaccccaaaagcaaaacaagcaggagatgcaagagatgccccaaaag

SEQ ID NO: 108791 - DNA, 1023 bp, Homo sapiens
atttttgtattttttgtagagacagggtttcaccatgttgcaggctggtctcgaacttgtgggctccagtgatccgcccacctcgacctcccaaagtgctgggattatggacgtgagccaccacccctggccactgattgactttttaaagtaaactttcaactcattgttttgctttcctgtctgtaaacataaaactgccagatgcaatttaatgtagagcctggactctgtaattccacagttttactggcctgtaagtggcaaagaccagaatgtactttatagtccagaggagtctgattgctttgattgatgtagatttggtttgagaacctgagatagaaaaagccttgtctctgacaaagtgttttgagagggctttctatgatttgggtgtttaaataattgcatgggtgggatgattgcaacattaagtgcccttagatcaaataatagctgagcttcccattaactttgtgaatgtgaagtgacttatgtctgtaagactttcttcggagaaagaatactaatggttgcctggtgattttgacttgctgggagtaaatacacagtgctttgtatttggtgaaaagttttgatgtgaagtacactttgctccatgccttgtgacaatgagtgcatgactcttgcttcccattctgactgtaggaagctgccctctgtcgacagctccccatggaagctgagactcttgccccagttcaggctgctgtcaacccacccacgatgaccccagacatgagatccatcactaataatagctcagatcctttcctcaatgggtaagttaatatttgggggccacttatttttattctctttattatgtgatctagactataataggatctttgtttacattgggaagaggtggggagcttgagggttgagggtgagaataaagggaggaagtgggaggagctggcagaaaaaagaaaagcaggggaaatcatctgcctgttaaaaaatttccaaattaaaaaattggtgataggacgt

SEQ ID NO: 108792 - DNA, 1567 bp, Homo sapiens
ttaactgagaaagtatacacatgcacacacacacacacacacaaatgatctggtgaaattatctcataacttgtgataacctttgtggaatttgctttagaccactatgttctatgtaaggcttaaaatgtactctagacagggaggtgtgaaatgagattttaacagaaacaaaagccgaggctagatgagtcaggattggggccagtattcgagcctccgtgaattgaattaaggtaataattacttaaacagtaatggttaacaggaaagtactttggaaggaatctcaggaatctatactccaaagcagaaaacattctgatggtctatttttgataaggtattgtgggccctggtcattaatctgtatgttcttccctcttgcagtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggtatggctttccatggtgtctggtggaggctccctggccttggtgccaaagctgatgggtaggtagctgcttaccttcagggtaattcttctagagaagaagagacaatagggctcaaagccctactccaagcctcttgattaaaatccagtttcttctctcagtgttctgcctgccttttcagaacgaagcttaagggtacaaggacgagctgtattagcatggctgcctttggcttccactgctagtctttagaaggagagaaaggagaaagtagagagacaagagtctgttgttgtgtaacaaattatcccaaaatgtagttgcttaaatagccatttcattatatcgcacaattttgtgggtcagaatttagaaggggctcacctgggatattcttctgctctacatggcattgactgaggtcatttagtggtattcaactggtaggtgggttggtctggatagttcacaatggctttacctaagtgggtggcatgatggtgaggattgctggaagactgggctaagctggaacaaaagcctgggatctatggtgtggcgatctcagagtagtggtactcattccatagcagctgggttttcaagaaaaagcattctaagagacaggaagtagaagttgccaatttcttggggcctagctctggaaacggtcgtggagtcgcttttgccacactctcttggtcaaagtagtcacagagaaccccccgagattcaagcagatagtggagtggatgttcctcagaagaaatgacaaaggatcttggtccaccacagagcatgaaaaagagggaagctgaagggagaatgagaagggaaagtggtttgtatatggactccaacagagtgctctgcaaaactgcctgggcatcaatcaggcacttttgtaccatactccattcattcagttttcattccgtcagtcaggagtgtgttgccgtgtgccctctgtg

SEQ ID NO: 108793 - DNA, 1110 bp, Homo sapiens
ccagtgttacaggcatttctattttacacctgaaaaaggagagttgcctagatacttgcacactggtgtgtggactacattattgtttggatgggcaggcaggatagcaagtaggaaaatcatttcctggtgctaaaaattcagggtttcctgtgaagtaaacgaagcttgggttacaagtctaaaactagacaggcttggggcatctggaggaccggaggcccatctggcaagctttggggcacctggaagtggttttaaggcttgaaacagtgaagctgggaaagtgtggctgaatcaacatatattccagagctctgtgccttatcaactgagccggctgagaaatttccttgcagttattctcacccagaattggaataaagggctcagtgtgaagttgggatagtacaacttctcggtttaatactttacagatttttggaaccaaatgcaccctgaagtgaaaagctgctttttttttgctgaccttgttggatggctaatactgtttctgggaaataagagaaacaagcggctcattgttggcaggagctgagagagacacaaggagggcgagagacgcgtctgcagccctttttttcccttcattgtatcgtgactgagtcaaggctggattgtggctgggtttttcttcctacctctgtagacatatgttttccatcagacagggctgcgtgacacctgacgttggccagttcacatgagttaagccatggacggcgcataaacagaggaaaagacccgcagctgcacccagacactcttgatgctgaaatatttttcaaagcttgatgtggctgggtctgcacataagtcagaaacgatttacacctgtatgttttggcttgcttctttcagttgcatatcattattcccacaaagcctctatggccagaaggtctaccattggctgatggcagcacctctccttcccatatataagcctttctaaattatgaaatgtgagttttcaaagtttatttgatttttgtcttttttttttggaggattgaagaacaaaatgctctaccatttctataaagtgaggtcacacaaatggtgtcatcaaaacatgcgattcacgtt

SEQ ID NO: 108794 - DNA, 1089 bp, Homo sapiens
ccaagtaaacttcaaaaatgaggaggaaaattatagcttgggatccagattcttgaaatgtattgtttaatccactgggtaaatgtacaagtctgcttcagttttgcttgcagagagtgggcctgagaatccatcaggccttcgtaagcctaaaccgtgacgaattccagagaagcacccccacacctggggaagagggaggccttttaggaaggtgaaggctaggtcaaacttgttttcttttttagtcctttctttgtttgcaccacattaattaattagttaattaattaatttgtaatggagtctaatttcttcaccgagctgtagacctctgttgagagttttaaaaataattttgacaattttcatcctgtttgctggctgacttccaaaagtttgccctcaggagcttccttgctatggagaatttcacccagttaagggtgaaaggcaggcagtgggattcgaggtggtttgtcattcagccacttgttccaaattgataagtgctgagtgatattttgacacttctctttgatctcctctttggcgtccctggtaatattgctcccgcctgtgtgtgatcatcacctctcccacccaggtaccaactgattgatttcttcttcctttctggaagtctaaatttattccctgggtgttttgcagttgctggtggtcaagaacagctgttcttccatgctttattctgaatagttctccaggatgaagtcagcaaaacaatatcatttaagtgaagcctcaggaaaacaaaagccttgattgtctttctccttaagtgctaaaaagaagatcacccctccccctttgtgtgtgtgtgtgtgtgtgtgtgtgtgtgtgtgtgtgtgtgtgtgtctgtattttaaggcagaaaaaaaaaaggttctaaacatttttgaagcagcaagattcaagaatgttatttttttccatattacataattgctatttggtcactgtagaaaatgctgattggcaaaacatgagaaaataaaaagccatggtaccattcaaaatgacactagtgtgttttcatatattttcttgactttcttcaatgcaaac

SEQ ID NO: 108795 - DNA, 1011 bp, Homo sapiens
tttgtgcctctctctagttcagagcacctttaggctaagcactcatgggagtattatggtggcgccttttccaactcacagttaaggcagagacaagattttcagtcctgcactatagctgtggaattattttcagaggctgtaatgagcaggtataggttcaaatgtggaatgcagcatcattttttaagcaggaaatgggttcattttggggggaggatagctttctcattttttttctgattagaaaaataatgcttattgtacaaaaagaacaaagaaatgtaaagatatgaataaagcctacttcccccttgttcatatgtgttctatttaccaaaacgggattatgttcactcccacaatatattttagcaaatacagatccatgtaatttatcatgtctgttcagtcttccactgtctgactgtaccataatttgtttaaccattctatcatcatacactaaagatagaaacaaaaccgctgtggacatccttaagcatacattctgcatacttgtattggtttggagtcatgtttgtgatttacagggatgcgaaatgagatcatttatttctctaacattaaggaaatctgaattaaggaactcaagagctggtttgctggctccgctgcacctttctgcttagttgttcttactgagtggcttccattcctcataattccagctgtctgctgcagctccagccatcacgttcatatgccaggctggagaaaagatggaagggtgggaagcagaaacgtatgtctattgcttccgtttaaaaacctttcccagaagcccacacagcacttctgttcattgtctagaacttagtctcttggcaatacttagcacctaaaaagggagagcagatattccaaagcaacaaccatctctgtcattcccatctaattgttttctgggaataaaagctttgtgcaaatggacttactggatcaaagcttttcccaggtttttgttgcatattgatatactgctcttca

SEQ ID NO: 108796 - DNA, 1045 bp, Homo sapiens
aggcggagtgtgtattgcccatcactctattctcagcacttggtttgaatgagcctataagtggtattttacccacccctcacaaaagaagctatatcaatataagctattattcgtgtaatttagtgagaaatactgatgtttcctcaccccatagttttgtgtatcttttgtagacctcagtgtttcatgacctatatattataatgtttactgactagatttggtcagttactatttgaggaaatgctgggatttcttagaaattttaatgataaaagaatgcatagggccagaatgtttgaaaccaagactgccttagagaaacccagggcatatagcagacacatttttgacctgaaacgcttaaagcggaatgggacaggaaaatacatatgcatgaaataattagtatgtttctcagtctgtccaggctactataacaaaaataccataaactaggtggctcaggaaacaacaaacatttatttctcacagttctggtagctaggaagtacaagatcaagacaccagcagatgtggtgtcttatgagggcctattcctcatagatcatgccttctacccgagtcatcatatggtagaagggataaacaagctctctctggcctctttcatgagggccttaatcccattccatgtgggctctgcccccatgatctaactaccttccaaaggccccatgttgggaggttatatttcaacatatgaatttggtggggacacagacattcacaccatagcagtatgccacctgtgacagtacctgtttgtctttatagctgtgttctcttgtttctccagtatctcagtggtattggacaggatattagattcaggagaggacttcagaatgttaactagtggtaagaaagcagcttcatggggtggctggggcttgagggagtctgtaactcgggaccacattttagtaactagagaaaatgtttcagcaactgtatggtgataagtccctagtctaaatctctagcacaaatctttcttttgagtgctggataccctatt

SEQ ID NO: 108797 - DNA, 1226 bp, Homo sapiens
cactttaagcttctagtttgtgctgggactgcgggatgtagtaatgaataagtacatggcctttgtcctaaataacttaggttcagttttagaaagaaatctgaaaatgacttctcataatacctggcagaatgaaagaaatttattaaaagagaggacagcaggccaggtgcaatggctcatgcctgtaatcccagcactttgggaggctgaggcgggcagatcacctgaggttgggagttggagaccagcctgaccaacatggagaaaccttgtctctactaaaaatacaaaattagccaggtgtggtggcacgtccctgtaatcccagctactcaggaggctgaggcaggagaattgcttgaacctgggaggcagaggttgcggtgagccgagatcatgccattgcactccagcctgggcaacaagagtgaaactccacctcggaaaaaaaaaaaaagagagagagagagaggacagccattttattaggaaagtacagaggaagaaatacgtagttctagccaggggatttcattacatgggattacagagaagggtgttccctgaactgaatttttaaagatagggtcaaattttcataggcagaaagaaagggtgggaagcggacattctcaattaaggggaaaaatgagatcttatggaagctttaaagcctgagacatttgagggaacagaatttgagaattgagtctgcgatgagacaggaaaagcccacaggcagtaaaaaatgccggtggctgagtgcagtgtagcttccactgaactctgtggatgtttatgcttatttgaaccttgttggaatattcctggtttgttttatgaagggatgtctctcactgaggatattgactcagggacgtttcctctttcagtcaggatggcctccatcagaccaatattgttctcaggccatttttttgttttgttatcttggataaacagagagaggctgattcatttttctagaaaaacaggatgcactaaaatactgcaagtgacaatgaaacagacatgctcacgtacaataatatttataaagggaccaaacaatatatgtagcagacacctctgtggtgtggccgctacccctcctccatctcacttgccttgagtccttggccaagtgggttgtttctttcgatctgtttcctcagatatcaaatgagaccaataataccaactgaacaggcatgtctcaagga

SEQ ID NO: 108798 - DNA, 1021 bp, Homo sapiens
tggtgtgatcatagcttactgtaacctggaactcctaggctcaagtgatactcccgcctcagcctcctgagtagctgggactgcaggagcatgccactatgcctggctaatttttaaattcttttggtagagataggatttcactatgttgcccaggctggtcttgaactcctggcctcaagcaatcctctcaccttggcgtctcaaagtgttgtgattacaggtgtgagtcactaatctggcctggttccttttttaataatactactgacaaacactgcctcgtagaaactcctgtcagcgtgaagagttggaaggggaggggaacagtgctatttttcttcttcaagaagtttcagggggctcctcataggattgccttcaggagtgtccatactccctgcctctctggctgtttcttatcagctaaatggtacaacctccaagaggtgtgactgatggtgaatttcatctctttctgaaaggtgccatgaaaacatgcaaggctattcctctctgccattgtttctgtctgtctctcagcaggataaggtcatgacagaatggcacgtttatcttggatttccttgtttggcaagcagcctggatatctctgggttgaacgtctctgggtatctcacagacgtcaatgggttgaaggagatgttggctcttgcactgattctttcagaagcccaggaggtggtggggaggggggaggagaagaggggacaggattgtacttgtcgtgtcactgccctctcagttggagcttcctttacctttccaggctcctacagcgtggagaggcagcctagtataatgcaaggcacagagactttatgtctaaatagagctgtgttcaagtctcgactctgcctattttaaggtttttctcctatatactcctcaaaacccctgtacttattcttcgatgatattttttcacatctgacattacatctttctctctctctttttctgcatttgtctgtaagctttagatatgtggggaccacat

SEQ ID NO: 108799 - DNA, 1057 bp, Homo sapiens
catcccaaacgagcagcctctaaagggacaagagggcttccctctacccgccctcacccgcccacttcaatgtatgccagtatctgttcatttgacctcctgtgagctcagcagagaagggtactggattgttcatcattcaggaatcacagagttagaatggagaaagatttagttcctcaatggaagtggtcatggtagtggtggggagggatgtggccggacgaagggaagtgattctgggcagacgataaccacatactttctccacagagagtgatgcaagccacatgggagatagggaccctagccttaaccctgtagcctggctggagagctaagcatatatgcaagagagcacaacattgccaaaactacatgaaggtaacgaggagatgcagaattaagtgcagccatgaagcatggcccttcagaaaggactgtgaggttctggcattgtatataaattcccatttgccataaatagtagccctctagtttgcttatcaggattgtatcttctctacacggtcacatagtggatgattagccctgaaagcaattacataatttccacttatacagatttacatttacccatagaaagtatttctctcctattcaaataaggatgtcagaatgcaagttcgtagaagtgatgtcattcaatggacaaaaaatggattaattcatcagaaagaaagacaacatatattgcaaacttaaatgatgtgggatgcctttcacagctaatggcatcatagcatggcctttgggactgcccagaattccattttatagctgtaccctactttgttcatctagcccctcttactgagcatttaggttctttcccattttcacactttaaatggccatatgataaacattcttttttttgagatgtagttttgctcttgttgcccaggctggagtgcagtggcacaatctcggctcactgcaacctccacttcccaggttcaagtgattctcctgcctcagcctcctgagtagctgggattacaggcgtgcaccacaacactcaaataattttgta

SEQ ID NO: 108800 - DNA, 1060 bp, Homo sapiens
tacttggtttcctcacccttaaatgaagaacttaaaggagataatggccaagtttccttttaatttgcttaaccaattacacttgcatatatattttattttttagagacaagttctcacttgtcacccagagtgtaatgcattggcacaatcatagctcactataacctcaaactcgtgggctcaagagatcctcccacctcagcctcctaagtagctaggactacaggtgtgcgtcaccatgcctggctggcttattttatttttgtagcgatggggtcttcctatgttgcccaggctgtccttgaactcttggcctcaagccatggtcccacctcagcctcccaaagtgctgggattacagacgtgagccactgtgcctggccatacttattttttaacagcttcattgatatataatttacacagcacataattcactcattttaagtgtgtaattcaatagtttttaatagattcaggtatgtacaaccatcatcacagtcaggtttagaacattttcatcaccaaaaagagaagccccaactaactagatagctattagccatgcccctctcctccacattctcatcttcaccagtcttaagaaattactaatccactttatgtctctgtagctttgtttattctggaaattgtatgtaaattgaatcatatgatatgtagtcttttatgagtggcttattgcacttggcataatgttttcaaggctcctctatgttgtagcatacatcagaacttcatcctttttatggcttaatagtattgcattgtatggatataccacattttgtttatccattcatttgttggtggacttttgggttgtctccacctttttgaaaattacatccatttttgagtggaaaatgatcttcctttagtggcttctacagttgccaacagcagtttccctctactgctttaaaggtagggatctgggcttaatggctttgtttgcgttgtgtggatggacaggttggatgcttggtcatcaatgtcagagagcagtcatagagagtactcatgagctttgtaa

SEQ ID NO: 108801 - DNA, 1068 bp, Homo sapiens
cctcaccaagcatgtcattcaaccatttattgtgcatggaccttggtagggaataggcattgctctgttttctgatttatttctccttgaaagcccattctcaagggcagggaacatgttttattcttcccagaaccttaggataaataaacgggaaaaaatgagtgaaaaaggaaactttggtgggagataatgaggcttttccttactgctcttatctttagaagctgggtcacagacatcttaatatgcatttacgtgtatttatttaacaaacgtgtacctagcacttactttgtgccaggcattgttctcacactgttcacatttaattatgccaagaactctgacagaaacactatttttatccccactttgctcagaaaactgatgtacagggcatttaaggaacttgaccaaagccgcacactagtaaggacttaaacttgggcagtctgggcccagagccaccctggctctccttttccctctcaccggtcttgacatggttgggtcttcattatttttccctttctggacctctcatctttccttcctctttctccattcctgttgcctccaccctactgtgtgatgtgatcatttatttgtagactgcagcacactagcctctgacttcagtcctttgcacaccacagccaggctaatcttccttcatgatggctctcatcacccttttcctgctacagaactcttcttggtgtcctgtcctgtcagggctgatctcctgcctggttcctaaacctctagaatctgacagtgtgaccctgctcatcgagcctcacttcccttgcaacccatttgctgccacccacagctcctggcagtgcttgtaccccttccctggagcaccctcactcacctcttccctgaccctccatcagttcattctgccatggatttccttctaggtctcacctcctgcctgactacacagctcttagtgtccgctccacccctgaacccagtctacaggctgttggatttcattgttcctggcttcaaaaagcctgattaggtttaaactctttgggggtctaccattat

SEQ ID NO: 108802 - DNA, 1023 bp, Homo sapiens
ttttttttttttttttttttttttcacttgagacagtcttgctctgtcgcccaggctggagtgcagtggcatgatcccagctcactgcaacctctgccccctgggttcaagtgattctgcctcagcctcccgagtagctggggttacaggcacctgccaccacacccagctaattttttgtgcataatacttctctaatgcctggcccaaagcatggcatgcatagtagggattcatttaacttttgctgaaagaaatataaatgatttttttcttttaaatttctacattatttagattttctggtgactctttcctatgcaataagccaatacatatttatggagcacatactgtgtgccacatactggtactgtgcttagcataaaggatacatataatgtatattttactttagaatatattctattctttgtatttaattcttagcccgactataaattctaaaaaatcagtttttcaagcaaaaacaatgaagatccaagaaaggaaaatttcctggtattaattcaatatattcatctattcccagattatttccacattccacttgatggtggaaatttactaccccctccttgcctttcaaatgatcctaagatcgtaacctttcccaatggagctgaagaggtagagtaggctgtttgggtttcaaaggacttttcaggacacaaagtaaataggggaattggagatatcaacaaaactaattaagtggattgactgtgtcagtagtgagtacagagatgtcagaaaagctagttgtagcaagtatttaaacacagcctcaagttcattttcagtggtgttgccatcatccacaaacttcaaagaaagtttagccagattaatccaggaaaattcattctcctgggaacatcacattctaaattacttattcattgttaatatcttcatttaaaattttgacttgaacttttttattctttacttgtcctttaagatcacacagacccaagatttgataaggttatcatcttt

SEQ ID NO: 108803 - DNA, 1017 bp, Homo sapiens
atatatatatttttttccaagataattttagtcttagtctactctgaataacaaagaagaatgatttattcatttagaggcattttaagagcagtctttgtagaccattgctagatctttttggaatgggctgccttgaaagcagagagaatgtaaccatgtgtctttaagtggcattgtttagtggttcttcacggcagcccaaagagaaagtatctggcatcagatttgctggatgtgcagagatgccagtatctctcgtttgagctagcctctgcggtgtttttgctctcaaacctggtggtagagtgacggctttgatttgcttcctgcctgaagcctgctttggatgaatttaaaaacctgtttgtttccccatcggccggctgagccttacccataattcctgaactttgattatgggggttattacaggacaagagcttctttgtaaaagagcatgtttaatactctggggtctagcgtgactagcggatataaattgtatggaagcaattaaatgcgaaggaaatgtcatgtgggctgaatttaaacataacttgcggcattgattttttttttttaacttacactaagaaggatggagagagaaaaaagaaagagaatggaaacaggccaagcgagtcagagaagcacacgcagagacaagagaaaaggagtcatttttaacatttggttaaaagtccaaagcccagagctagcattatgtgaattatactagtattatgccattgccctttaaatgaactctttaaaaacacaaatgtcagggaagtatactgtacttggggcttgtatctctttccagttgctcctctttatcttaaggcatatatgtacatacagcagtgattttttttggaatatgttaataaacaggcctgaaggaagctccgtaaacgattaaagtgcttctttccctagttttctctccttttatgctcacggccactgcatgcctcttttcttttcttttctttctttttttgacaaagt

SEQ ID NO: 108804 - DNA, 1057 bp, Homo sapiens
cacaaatgacatcatgttttagtgatagcttaggaattgttttttttattatgatagaccaaaagtagtttattggctataaataatatatttattatctgccagtttctaagagtagcatgatatctctgatccaaactgtattgattctggtcgggctcggtggctcatgcctgtaataccagcactttgggaggccgaggtgggtggattacttgaggccaggagtttgagaccagcctggccaacatggtgaaaccctgtctctactaaaaatacaaaaattagctgggtgtggtggcacatgcttgttatcccagctactcaggaggctgaggcaggagattcactagaaccagggaggcagaggttgcagtgagccaagattggggcactgcatttcagctttgggggcagagcgaaactctgtttcaaaaaaacaaaaacaaaaccaatctatattggttctaacctttatctatagacaaaagcattggtttatgaaaaccatcagagatgcaagccatagaaactttcaaaaagttctttaagatgcaactgtctggatctgataaatagtttcaattgttttgctcttgatctggatgggttttgagcagaggagattgggtgaaattaaaggtttcttaaaattgttgacactggtagagaggcatttatctgaatacagtggggaagaccagagatgttgcttaaagagattttgtaagaaaagtaggcacaattcttgtgaaaagtgggctacgtgaataagggcaatccaagaaatcatgttagtgcccctgtgtagttgtatgacttctgtactttttctttctttctttctttctttctttcttttttttttttttttttttgagacggagtctcgctgtgtagcccaggctggagtgcagtggcacaatctcggctcactgcaagctccacctcccaggttcacaacgttctcttgcctcagcctcccaagtagctgggactacaagtgcccaccaccacgcctgggtatttttttgtattttttagtagagatgggatt

SEQ ID NO: 108805 - DNA, 1001 bp, Homo sapiens
tgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaagtaagtcagcctggagccgaagaaggcaccaagtcacagtgcccaacgcgcgcgtgtgttcgtgtgtgtgtgtgtgtgtgtgtgagagagagagagagagagagagagagaaagagagagatggtgcgtgtccttccacggttatttcacagatatggagagctggaagcagggagtgagtctctgagtgttggaattgtaagggatcagaagcagggatcagaagcagtggtgaagttcatccaccataaaacacacaggtgactttgccttgaatctgcaggactgaagccaactcttgggcacagacccttagtcccttccttggccactctaagtcagatagtccagagccaggccctttgggatgtgacaccgagataaatcagagaaaagctgtgaagcttggggaacagagggacttttggtgaagtaggtggtctgcagtttctatcttcttgggaaaagcaagctggaaaagtgaacagtggttggtaggccatagtgctcccagctgggtgacataatgaccacacagcacagtgatgttattagcaactgtgtggtggagtagttgtgggctggacaaatcaatcgtgtggaaattgttaggagtttt

SEQ ID NO: 108806 - DNA, 1050 bp, Homo sapiens
gccttaaaaaggaagaaaattcaggccaggcatggtgcctcacatctgtaatcccagccctatgggaggccaagtcaggcagatcacttgaggtcaggagttcaagaccagcctggccaacatagtgaaatcccatctctaccaaaaatacaaaaattagccaggcgtggtgacaagcaccagtaatcccagctcctcaggaggctgaggcaggagaaccgcttgaacctgggaggcagacgttgcactgaaccgagatcataccactgcactccagcctgggcaacagaatgagaccctgccacaagaaaaaaaaaatgaagaagaagaagaaagaaaattctgaggcatgctacaacatggatgaaccttgaggacattaggctaagtgaaataagccagtcacaaaacaacaaatactatatgatcccacttttatgaagtacttaaagtagtcaaaatcatagagacagaaagtagaatgatggttgccaggggtagcaggaagggagcaatgagttgttgtttaacgggcatagagtttcaattttgcaagatgaaaagagatctggagatggatgctggtgatgtttgcacaaccatatgaatatactgaatgccactcagctgtgcacttaaaaatgattaagatagtaaattttgttacatatattttaccataataaactttgggtaaaaaattaaaatgaaaagaaccaaagtgagatagcagaggaccctgtgagctgttgagcctgtgtgaacagagactagtggccctcatggcatgtggctgaatgagtggttggtaacgatctcctgctttctactatctgtttccttttcttcctcagtttttttcttaatctgcttccttgagaaaacaatcctgcttctttgagatacaaaattccaagtttgatgtggtgattatggggaaaaaaagaacgtaaggtcacaatgagaagatgggacactatggaaggccctttaattttctaatagtcacatagactttaaaaaatagtctctggggtctggtaacttggt

SEQ ID NO: 108807 - DNA, 1059 bp, Homo sapiens
gctcatgccagttatcccagcactttgggaggccgaggtgggcaaatcatgaggtcaggagattgagaccttcctggctaacatggtgaaaccccatctctactaaaaatataaaaaattagccaggtgtggtggcacgcatctatcagagtcccagctactcaggaggctgaggcaggagaatcgcttgaacctgggaggtggaggttgcagtgagctgagattgtgccactgcactccagcctgggtgacagagtgagactccatctcaaaaataataataataataataaagtaaaaataaaaataaaaaagtaatcagaagctaaagtaaagttcctttcctggtgctaactgtggtcttcttgacacattaagatgtattttgtattttaagagtctcatgctctaccgttggaactagccagatggccattattttgtattttaaatacataaataggattgaatcaactagaaatgaatctatatgttctgtatatatgaatgactatcttgtttttgctacttcttttgactgcttaattttattattttcatctttattgatcaaatttgaaaataaaattcacaatgtaatactactactatgcagaattttctaaacagttcagtatttttgacttttaaaaacaccccacagtgttaatagccacagaatattgaacatcaataggatttttaatgctatattgttataggcagtttattcatttttctttgtatatgaagatgataagtatcatattgcctaagtttgagtgatcatggttaattaattggcttaaatagtactcaaatttgtgtggtcgtatattgtattttatcaaggactaattcttccaccatacccaaagcatctaggagacactctgtcatttacatttacaaataatggatgcagagaaatataatcaattcttgattgtcctggatacaaattatagtcactttttataatttgaataaactatgatgagggaaggaaggccatgtttattacattataggcaactatcccttctcaaaacataactt

SEQ ID NO: 108808 - DNA, 1462 bp, Homo sapiens
ttttggaaacattacttggatcctactacttaggggtttttctgtagcatttattcactcaaatatttgttgagtaccttctttgtcaggcactgttctaaagagaaaaatccttgcctgcatggagcttatctgctaatgggagaaataaggtgcattttcataatagacggtaattagatttttctcgtactatgtatttgtacctatttaagcagatggtaataatgaatactataccagattgtaactaattttgcagagcatttgaaggaagggaccatgtctttcttattcgcatttgtctctcccttttccccttcctcccagtggaatggcttagatgtgtttaatgctcaacaaacgtaggtactcatcaaatgtttattacagggagaaggtgttaaggcagaggctacatcttaaagattaaaggagtcagttaaatgtggcatgtattaaggacccatataccccctagattgagggtgagaagaagagaatccggctgggcactgtggctcatgtctgtaatcccagcactttgggaggctgaggtgggcagatcacttgagaccagagttcgaggccagcctgggcaacatggtaaaaccccatttgtactaaaatacagaaattagccagatgtggtggcgtgctcatgtaatcccagttacttgagaggctgaggcaggagaattgcttgtacctgggaggcggaggttgcagtgagccaagaccgcggcactgtactccagcctgggtgacagagcgtgactctgtctcaaaaaaataaaataagataaaaataaaaagagaatcccctggcttatctatgaggttggaataggaataaagttatattgtagctgaaagcatcaacattatgggagtctgggtgtcacccaacattcccactaattagctgggtgattttgcataaatatcttaacctctcagttcatttcctcacctgtaaatgaagtagttggaattgtccagttaaaatctgtttttacgacttcttgtaaaatatctcttgcactaatgtttcacttcactaacgtagataatatagagccaagcatgagcttccattgaataagcatcaagctaaatatatactcttagttaataaactaatgtttaagaaaagatgtctacaaaatttgttgatgctatttaccggtaagattacattgtaattttttaaaatagagcaaaatattacctaatatatagtttcccccattgccattatgtaaaggaaaaataagccatagtattttagaccttaataatggatcataatactcactttcatactttaatttatacaacagtcacttgcctctgatattgtgctagatgctaggtattgtatacagaattagaaaatgtatagctcctaactttaaggagcttaaggaataatgggagtgacagaccatttagttgtgtt

SEQ ID NO: 108809 - DNA, 1047 bp, Homo sapiens
ttacatgtgaatttatattgaaccagaagtaaaaattttttaagttgtagaaaattttcaattttaaagcaaagatgcttgtgtgtatgtttttaaccattattttggttgaaatctagtttctctgaaatttgggttagtaagacaagctgtactataaactgagcactgtgggaggatgtttgttttgtgattaaaacagaactttgtcatcatgagttacataggtattgactaaacatgggtgtttacctaaatgtccaaatctgtgtaagttcttatgcttttgaaataaaagctttacttttaatgttaatacatgtttataattaaaagggatatttttggacattgggaattaatatatcaaatgatctattccctgggacaaagcaccagctctcagttactcacatccttgtcttccaggtgattttacaacgagatgctgctctccatagggatgctcatgctgtcagccacacaagtctacaccatcttgactgtccagctctttgcattcttaaacctactgcctgtagaagcagacattttagcagtaagtacagtaaaatttattcatgtctagaaacatcccttaaagaaaagcttaaaaaaagcctggaatgatatttataagacattgttataagacatttttatctaaaaacataccccaacacatatacacagttacttgacattgaggtaccttattcatttgtttatttattttttgagacggaatttcattctcgttgcccaggctggagtacattgttgcggtcctggctcactgaaacctccacctcccgggttcaagcagttctcctgactcaccctcctgagtagctggaattacaggcgtgtgccaccatgcccgactaatttttttgtatttttaatagagacagggtttcaccatgttggccaggctggtcttgaactcctgaacctaaggtgatcttcccgccttggcctcccaaagtgttgggattacaggtgtgagccaccacgcccagccccttattcattttctattgcttc

SEQ ID NO: 108810 - DNA, 1086 bp, Homo sapiens
aatgggaataaattagagcttgaagtcaaagtagtagacttcctgctcctcagagttgtttatgatagtttaaatttaactgttttatccagaactaaactataataattacaggttgcttcagttaaaattaaatgttattgtaatgtttcattaatttcttgctgctaagaaattaaaagtaaactaattctattgatcccaaggtttactacactattatgctatgtaatttctggactcggtacagtctgataattagaaactagaatacttttttgctgttgttataactttcctttataggcagggatggcagatggtacactttgaaaattagggaaatactgttattgaatatctgtttttgaagatgaaaccacagctcaggaatgaatacagtaggcttgttagccttcttgtccctttagtggatcctcatcatgagtctgagtacttctaaaggagtttaatgatttagtcattactccagctcatctcttttcactgcttgccttgaattttatgttgcagccatactgcctacctgaactctctcaactggctgtgccatgctgatcatacatttgtgcctttacatgtactattttctctgtccaagatctctgtctccagtgatctttaccacccatttatctgtctcatcggttacatgctagctgaggatgttacctcctcagggagccttacttttctttctacttcctctgttgcagtgcagaccattccagctcaatgtgccacccttccactttgtaaatacttccttcattgctttttatcacattgttgttactttttattgaatatatatatctcacttatttgtgaattgatggtgtttagaattcatgttttagtcatatttatgtatccaatttgtattatagtgtgtggtaatcaataaagacttattaaatgaagctgtgtaatagtcttttgcttatgtgtctaatatattcttgaaaaacatgtacatatgaaaaacatggaagaagttttcagttgagccattctaatgttagacagggaaatgttaaaaaaattctcattgtactttaccat

SEQ ID NO: 108811 - DNA, 1070 bp, Homo sapiens
tattagtgtcagtattataaatttgttcaggctagaaataagatgaattattgtgttgttcccagggttccttttagaacctgtcttattgaagacttttctattagcagtctgctatcttctgacagactggctatttataataacaagccaacagttccattatttctttaaacctcttggttaggtgccacctggtctatgtaatttagttgcatgtaatttgtttattggatgtaaaatactcagtgcatttaccacaatttgggctaatagctctgatcagtctccttaaaaaggcagattgccaatacaatttagaaggctttataatgtagttttcagttttggtggctgttttggatttagatttgttcactgtgcatgctttgtttcatgaatctttaagttctttgcttccatctgacaccatgtgtttgaggttgcattttatgaatgggaaactttgcaaatgcttactaaatgatttaacatttatttctgcctcatgtgttcttaaaaataccagctgctgcttagttgaaaatgtaatttaatttgactgacacatgagttttatagttcataaacatggatgtattttccttgtttgtattcataagcctgttagtccatatgttaatgtgttctttgatttaatttcatttctttattttaaaaatcgataaaaacaacaacaaaaaccttgggaaagccttcatacttgctacatttttgaaaacatgcatctattttttggagatcacacttatgcctacagaatttcttcccattttagtggtttcctaaggtttctattttaggagttttattattatgttaacagagaacagcttttgatattgatataattttgtagtgtatttatagaaacaagtgcattttggatgtgtgaaagacatatttctcctaagttgcttggtacagttttaaaagcctaatggttagatttagttaaacatggtggactgttataaatccattcatgtatatagatgattcttaataatttgagagtgagaaagcctcttgaaagattattactttgt

SEQ ID NO: 108812 - DNA, 1043 bp, Homo sapiens
gcaggtatttttaagtttttaaaaagctttgtaaaggaattttacagaatattttggatgatcaagctagtgatatgaattggttttatctgactcatttctgtgtgttaggcatggtattaagcatttttaaaatattattttacatatgacaagaatattgtcattctcatttcagaggttaggaaactgagggttacaaaagaagtaatttgctcaagttcatcccactaattcatggcagaggtgggaattgaatgctcaaggtctggtaactcctaagcctgattacagcaagtttctacctctttagagcaaaacagattaatgctttgagtccttttaatgttttagcttgtatcctcatcttttatttacttcagtaagtttttataatcaattgtaaaagacaaaccactgtcttccttataacataattttttttttttttttttgctttgcaggttttaaatgcacagagagcaggatacaaggcagccatagttcacaatgttgattctgatgacctcattagcatgggatccaacgacagtaagtacaggtatcacttttcttctctcctgtttgacagatcatttgtaactaaaaattaacaggattttccttctctcattttctttttaaaaagcaaaatttcttctctatcagataatccctcattcttaactctggatgattttattcatagtagagatgaaaatgactttcttttctgaacagtttttttttaaacatatatgttttatttattgatattttgttaaaaaccaaaatgggggaaacagctttaatagggataaacatgctgagttaagaatgccatagagggtgttttgtaatttatttagagattcacagcattattttagggtatgcacatacactaagtagctgctataatctgctggagttccaaagccacatacttgtgcttccttataccagttggttattagcccttcgtcatacattggtatgttcatagtttttcatttcagatgggaatgtctttctttactctc

SEQ ID NO: 108813 - DNA, 1090 bp, Homo sapiens
aacttatttttttccgagactatttttaaatctttatgctattatttcttatacacacacacaaggggctctatcaagcttcaacaaacaaaaaataccaggaatttaccccaataatttaaactttccaaaaattgctacgattgctagaatacaagtagctttttacttcactttccagcagaatgggggatgacaaaggatttcacacacatttgtatagctttgcacaaaatactaaagtaactaatatatcatcagtgtaaaaaagaaaatcagcagcagcagggcctaagctgctctatttgataccatctcttccagcacgaggccagccagctccgcaattaatatccctgttcccggcacataccctctgaaactgccctgagccagtggtaccacttttaagtataagagcctttccatgagacgctaatcctctataacctccctaccccacagccactaacctgctataaataaacactatcagggtttagaagccagactattgcatatcctaaattcaacccattgtaacttagtatctcagcagtaggaaggcttacaactctcatattctgtttttttttttcttctctttttatgtttatgacttcctaaggcacactcagccttgatgagataaataaatcctgtcctatgagacaagccccagggttgctcagaaataaacagagcttctaggtgagaaggagcaagctaaaagaacaaatcaggaagtcccagtgaactaggaacttcgtgtgtgtttgtaacggcagaaatggaatcaatttcagaatttcccaggaagcattatgctaagattcatacgcccgggttctaaatctaatattctacatatcctattaatgctttccattataaactaaataccattttagtttaccgtcaagatatattgtggggattttaaagggtcaacaattgataaaagattttgagcatcttgcctgtaatcccagcactttgggaggccacggtgggtggatcacttgaggccacaggagtttgagactagcctggccaacatggcaaaaccccatctctactaaaaatacaa

SEQ ID NO: 108814 - DNA, 1046 bp, Homo sapiens
caactagctttttttttaaagtatttctaatgcattcaacctagctttcaaataaaaccagaagtcttttacactcacagtttatggactgctgaatatttaactaaattacataattaccctaagtaaaacaaacaggttcaatgaccactgccactagccttttgtaagcatgcagctgatcatctgttgggacaaaagcataaggttggttagagaatagcctcctagccagtcttctaccatgtgataagtaagtatgcctatcggctagttttactaggtaaaaattggttaagaggtattgtatgtgcgaaacaccatgtaaattactctacttgcattatctcttttaatcttcacaacaaccctaatacataattatgttaatgtttgtgttttgcctttgagaaaacaaacataaagataagtgttttacataaagttacatagctaataaaaggaccaggatgggaacctcaggcattctaatatgtgctttaccatttcatcacaagtccaaggccataaaggttaatttgctacagagcactaagctccagtttggtccatgatcacaaactgtaccttggaatcttgacctgtcatcttcaaactaagtgctacggcaataaaatatgggatattaatataaatctactacttggaacaattcaaaggattgataagaaagctcagtgattccaaatcatcaagtctatacatttaaagataacccaaatatacctgtattagtttcctatttatttgataacaaatcaacaaaagcttaatgccctaaaacaacaaaaatatattatctataggttagaagtttgacacaggtctcacagggccaaaaccaaggtgtcagcaggactgtgttcctttctggaggttccagggaagaatccatttccttaccttttctggcttctggagggcactcaattccttgacttgtgacccttcttccccctatcttcaaagccagtagttgcatctccctgaccattcatctgtagccacatcgccccgactctgaa

SEQ ID NO: 108815 - DNA, 2227 bp, Homo sapiens
taaaaataaaaataaaaaataaactttcttcccgtccctacatgatacatacagaacactgaataaatatggcaagagattaaatataaaagtatcaaccgcagcatactaactaaagatgtatattttgcttcaacagcttatcactgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccactttaagatccagtaaatgtctgttctactgtagtattacttaccatattagccttatttatatatatcctataaagtgataatgattgaggtcagagaaatcacatcaccttaggactttatacaaggtaactgaccattcacatgcagttaggtaatatcccaaaaagtttagactgctgccaaaattattccaaaaataaacagtgtacattttggtaccctgttgtaaattatggtatatcgagggaaaatttcactttccaaattgccttttaaaaaataatgttcataatcaggaaaaaaataaataggtatttctactttggaaaataaacggttgaattcaacatcagctatctgatacctcatccctcttccccttttttataaaaaattaaagaaccacaggcctgagaaacaggacatcaaaggttaccacggtagttaagcagagtttggaatttgacataattgtatggccctaacctttttaaacctgcttggtcatttgcataattttcatttaacctaagagggtgtgaggagaaaacattgagctcagtatctggcacatcaatgcgcaataagtaatagccttcaaaataattattattaaataaaaacaaacctaaaacaatattttaaaataggaaaagggaaaaaagtaaaaagtcacggtaatggttaagtatgtattagatg

SEQ ID NO: 108816 - DNA, 1095 bp, Homo sapiens
ctggagtgtgtccagtttgttcttcataggaccaatttttatttgcagcttgagtttttatatgaagttgcattattgtggacttggctgtcttgtgatgaatttttttcatatgtattctgtgccatactattgttaaaatgaactgttgctattgtgagatggattttaactgacctattaagggtttctttcgaatggcactactttagggacattctagtatttgcttctattgtttgggccttgtggataatgtacagatttaaaaacaaatcttgttgctgatttgtccatttctttccctgcactttgttacatctgggatacagtctaactcatctgatttaatatgcatttaaaaaaatgccataactattaaacaccttgtttacagacagatgaaataaatttattccaaccaaatactctaggctcctgttgtttatatacattgtttatataaactgttaaaagttgatttttgacaaagtgggaatacacagaataggccaaagtctgctgcaagcataaaacttcagcaatattaggtgatggcctacttcaagtaatattacagataaaattagtgcctgggaatttctttttaatggactctgatctgttacacatagcttttagtcatttcaggctcatcttcaggagtatgtgagaagcaactgacttatctgctagaaaataagtattttcctcttcttgctggtttctagatgtgaaatctaatagtaaagggagtaccaagaagggtttctgcactattgtggatttttctgtattgaaatgtcatatgactttagatttggaagctgtgttggcaggctgaagtcagccagctggggccctcccacataagagcagaagacattccttaggcagcatataagataattgggatgcttttgcattttttggctttgtagtgacatgttgaccatggctgtgtaataggtttaaatccagaggccataaaatccctgatatatattgaagtttgataaatatgtaaatttagggctatttacataaatcattattaccaacaactgtcaagcggacgcttagagccaggggtgc

SEQ ID NO: 108817 - DNA, 1080 bp, Homo sapiens
ccgccggcccgaggtccgaagctcggcccgccaccgctcccggccggcgcctcccgcacgtggcggccgtgattgtcccggggcggtatccctccgcgcccccgcctcagtctccccccgcccttcccgggaccctccgtgcccgggcgccgcggaaggatcgcacgcacgcgcgcgcgcacgcccagccgtgtccgcggaaaacggagggcgctgcggtaaggagcagccgccacaggcacagccgcttcgcagcctcccgccgctggtttgtcagccccgcggctgcgggcggccgggcggccgagcgcgctctgaggttcgtccctcatcgctgaacccgcgtcctcccgccgcagctcctcggggaggggggcggtcggtgcctgcgcagagccgcctcctccccgcccccgccccgcctccccccgcgccgccgccgcccgctaccgccgccgccgccgctgcgcctgctgctcctcgccgtccgcgctgcagtgcgaagggctcgaagatggccggttggcagagctacgtggataacctgatgtgcgatggctgctgccaggaggccgccattgtcggctactgcgacgccaaatacgtctgggcagccacggccgggggcgtctttcagagcattacggtgaggaccagtggcggccggtaccctggtccctgcaccggagcggggtggccggccgcgggggcaccgcagcgcggggctggaacactgagggccgagcccgcaggtgtgctaggcagcgggcgccgaggatgcggctgccgggcgggcggggaggccgaggcccggggacgccccctcacccggggctgcgctgacaggctgggggcggcggccggactccttgctggccctggccgggcgcccccggcgttcccagcgtcggtccaggtgcccgggttgggggagggggcacgcaccggccagggcaaggggaggggttccttttttcctcctagtgcggttcccctaggttctcttgaagccctgaggtttgctatgcacgttctggggtggaagcgggggtcggggatccgggctggggcgcgcgggcc

SEQ ID NO: 108818 - DNA, 1006 bp, Homo sapiens
tttttgaacttgaagttgaattcccacattggttcctgtctgttcccaacaatctttctgcaccagaaaagtaagcatttggaattctttaatgtgctgggggtgctttctggaatggctggattcttggagattcgagcagcaaatggctcatacatatggtacagagatcggatcacacaagcccggagacagtgcagcttctccattgactctggtcgcagacgcaaaggcagggaagcatccagcgtgtagtgccttcggtacaacctggtccaaaaggcagcagtgcaagtgacagtccaggcattcttacaaatcagggaaaaattcacaatgtcctcaggacggatataggaggccagcaatagccaaatatccatgggatactcttctcctccagccccgtccagttcttctttgtgtctcttgcttttcttttttctggagacagttctctcatggatgttttcctcctgggcatccatctcatcactgctgtcgatgatgtcatagggctcaccagccccagaaagagcttcctctgcaggaacctgagaggcttccaagccacaaagagattttacttcctgccgaacagcgttggctacggctttcttgactcgtccagacctcacgaccgccagatccgagtcggcgtaatccgccacggtcactcggccggagcaggcgtcgtgggcccggaacttgagtcgctttcctctcttgggcatggcgaccgtatcggggcgaggcctgcctagcgggccgggcccccgggccatgtctccggccagagagccggccccggtagccgcaagccagctccgcccggctccgcggccatcccacaccctatcatggaactttaaatcacatgtttacacaaacacttggacaaaaatggttttagcagctttatttgtaataaccccaaactggtaaaaaactaaatgtccatcagcagaggtatggattagaaaattgtgatgtattcatataatgg

SEQ ID NO: 108819 - DNA, 1012 bp, Homo sapiens
tgtttcagttttggcaaataatgacatctgatatgaaaccatactctgagggtggcagaaaactcagtaaatatcctacctcctaaccctggaagaagaaatagacttcattagggggtggggtagaaagagagcattagattaaatttaactgtagatttgtttccctgccatctaattttaaacttcccaactcctagatttttctagaaggtactttacaaactagttcttggcctattagtgggttctgaaatcaatttagtggggcatgaccaataattttcttttgttttaaatttattattattaaagatatcaaatatataaaatattggaatagtataacaaactcccacgtgcctatcacccagtttgatatgatcaactcatgaccaatcttgtttcaccagtcgtctcacagattttgaagcaagctccagacctcatatcatttcatcagtaaatattttggtatgtatcactaaaagatgattagtaccattttgaaatgacatacagagaatagaaaatatcagagtgaaggttaagtaatattaaccttttgcttcagatgtgtgtgtgtacacatatgtgcacttgggtgagatgtgaaatgtatttcttacagtgagtcgcaaaagaaaagtgtgaaagtcacttttctaggagaaagtctagaggacttggtcctcaccagcaacctcagtagtgccctctaccccacccccacaaggcctatgtcagagcagaacctggctgaatccaataggagaaaaggattgggggaagtatgctggggtgtctggaaggtgacccagagagtatgatgtcctcatttcagagaacagaaaagttttccctagagagaatttgtgactgggtgaaaaagaaacagaataatataacaaatgtttgcaacctccccctttctttctaaggaggtcttacagcctggctttgtgttgctgcttggaataaaaaatgaattgaaggagacctagaaagctaa

SEQ ID NO: 108820 - DNA, 1083 bp, Homo sapiens
tacttaaaaaacaaagcaggagagttagttactcatttgaccagaatagtttgggtgcaaatctgttatactagagccatttcagaataagcacctaccttcttgacctgatggcttagaatttcactcagttctcacactgggtgactttaaattatctacgtcactgttgaccacggtggataattgtcattttcctaaatgtacatttgctctggtggtcaactactgcatattaaatccctagagaaaaggcgtgcactacagtcagagttgcttgaacatttaagatgataaagattgagcaaacccagtgactcaccttcgccgcgctaactcttcgctagctctccccctcaatacacgctcacaccctcctcaagatggcggcggcggcggcgggggactccgactcttgagacgcggatgcattctccgtggaagacccagtgcagaaggtgtggggcggcggcactgctggcggggagcgctgggaaggcgaggactaagacgagggcgtcaacgataactgggatgacgatcaagacttaaaaaaagaagaagcagaagtaaaaccggaggtaaaaagttcagaaaagaaaaaaacagcagagaagataaaagagaaagaacggcaacagaagaaaagcaagaagaaattaaaaagaggttaaaagaacctgaagaacctaaagtgctaacaccagaagaacaattagcagataaactggggctaaataaattacaggaagagtcagacctcgaattagcaaaggaaacttttggtgttaatagtacagtttatggaatagatgctatgaacccatcttcaagagatgattttacagagtttggaaagttactaaaagataaaattacacaaaatgaaaagtcactatatgatgtctttttttttttggaaatcttagttcgagatgtgtgtatttcattggaaattgataacttgaaaaagattaccaattcactgactgtactttgccgtaaaaacagaagcaagaaaaaccaaaaagaagaagaaaggtgtggttcctggagagggataaaagccaccatgaaagatga

SEQ ID NO: 108821 - DNA, 1051 bp, Homo sapiens
cactccggccagttcagaagttgccaaccagctgctgcctcatctccctatggcagccacctgacaccactttgggctttatgcctgtaccactggaactcagtggcaaaatcagatccaactcagcattatcatgggcactgcagaagtggtctgttctcaagttttagatgttcctttgtgtttggcgttccttcctcctggctgtctccctgacctactctctgagccggcctgtatcttctaacctattcattgaatacctaccacaacaaactagactctctgtgggggctctaagatgcacagggcatggttcctaccctcagggacttgaaaaaccagctggagagagagaggaatatgcacagcaatactaagcagcaacaacattctcttaaaggcacacattttttttttcaatgttctctggtctctccatgtgtctgtgtggatatgagtgccaaatcagaggtatgatgtgaaaaaatggtatttatctgtggaggttacagatcattgcttgtgaggttcatgggaaaagcgtggacaaatttggatagtgtatacatggctgggtgtatcaggaatacaaaacccccacaggctgggacagaatacctttcactacccagattcgtttcattcatataaattttacctgaggttagtttttaattttttgggtagctagactgtgggatcatgaaaggaatttccaggaaactaggtaaatgtaggtgagatatgaaacaaatgttttacttcagtgtaaacctaaacaatagagtcctaataaactctgtttttaggtttttgtccctcccctgcaaggtagcaaaggagtgaaaccaggaaaaggatgagtggaacccccacggcatcttccaggcctctggtttttcttcatccactgatctctccacagagaagaaattatatttaaggtcccagtgaaacttgaccctaactaaagcattctgttcagaagtttcaacccctaagggagaaaaagctgttccaaagggccgatcttactttttgttggaag

SEQ ID NO: 108822 - DNA, 1001 bp, Homo sapiens
gaccaggaacaacctttgttcgtcgttccatcacatggttcaataataaatattactactcatccagtgtacacataggatgtggtgaggcaaaaccctctcccagaggtcagagttcactcccttttccaggcagatcccttaatcaaatttattgtctttactttggggaaacacaattttcccatcaagtagaaggcaatcttggaacagcagattggggcctatttattacagtcgctttcaagttctcctttttttcttctgagtcccaaacagttcatggtcccctggtcttgattaaaccagtcttgtattttgaagttttgctttctctcttatctagcctcccctaagttccaaatgatctcactttgtagtttcattggctagagataccacaaaagtccgaagtcactgataatgtacttggaggcacaggcccattttatgagattctatcgttttggttcttcatgagaacacagtcttctttcaacacagggttgtagatccattactaggtgttagcagaattataaaatagtattgtgcaatacacaatataatcaatttaacacaaaatattgtattattttaaaaacacaatatactgtggttttgacttttttctttagaaaaataaaatagcccctttttttttttttagaaattcaaagtatatagaaaacatcacactctatgccttcgtatgcagaaaaaccataaagaaagaaaactggcctggcatggtggctcatgcctgtaatccctacactttgggaggccaaggtcggcagatcacctgaggttgggagttcaagaccagcctgaccaacatggagaaaccccatctctactaaagacacaaaattagccaggtgtggtggtgcatgcctgtaatcccagctagttgagagaccaaggcagaagaatcacttgaacagaggttgccccaagctgagattgtgccattgcactccagcctgggcaacaagagc

SEQ ID NO: 108823 - DNA, 1017 bp, Homo sapiens
aaattaacaaaaagattgaggtggtttaggttgatacattgaaaactcttatcttgagattttggttccattacctaatgcaaagttctatattggcttaattttgagatcatttataattaaagaaccgggccttatagtaatacatcttaatattatcacacctttaaaaggctgatggttgtatatgcaaaaagttctcaattagcattgcctattgactctacattattaattaccataaagtttatctttctggccattttcattagaaaggtttatggtcagttgttgagactcttcagattgattttgtgtaaactcgtggatgtgatggttgaaaatacagtccttaaatatgtagctacttttatagtgaactttacaaaacttgtttaaactacgtacacacttaacagtctcctgtaaatgagaggaggtgcaaaatattactggcccttttggaaaaggaacacagtacagatcactttccatagatagccaaccaatgtgaactctgtaggccgcattccaggaactcttatgaatggctgcaattgtgagctgtcatctgtggccaaaagactgttgaaaacctgattctaaggatcctttggtggcagatatttctatgtcttgttaatggttttatttgtgtggtttgctaatgatcactgataaaatattatacattgtgaatgttaagtggtgtgtcctggtatgtgccataaatacacattttgtttgtacatttatatatattttaaaccaaattctgctgctttttttacttgaagtttaagtgagaggattaagtaaatgtataccaggaggcagaactgtctcagtcttcgacctctgttgtatgaaagtctcactgaattgaagtctctaaagatggaaatttcttacttgaatctctgtttcttggaagctgacatttatctgttaaattgtgaaggtaattttgctcttgtaggtttacagttgatgtctgaatcacatactagatactat

SEQ ID NO: 108824 - DNA, 2358 bp, Homo sapiens
cctatctacacgtttaagagtgttcttactgaggagttagtagtaaaaatgtaaattcgtatatatgtgtcattattgtttagcataaaaactgatactgatgtattcatcagggattactgatggataccacatggattactaaaacatactttattcataaacgtggcttgaaataaaagaaatgacagatttccaaaaaggcttacgattttccaaactacccgaaattcctaaaccatgagctatatctgtaggagtgtggccttttatattcacagtgacacatactgtataaaattttatgtgcactaaatcatataggccaaacattggtaaatttttttagaaaacatgatggcttatatgtgtgtgaataatacagatttccagctgactattttagtaacacttgttttttctttttaggagatcacaacccctgaactaaatcacctttatgagaagtcattttatataggactggtggtaggggtatatatgtcctctacttcctgagaataaatataatgccaattcatttgttatttaagaatcctgggccaggagcggtagctcatgccttgtaatcctggcactttgagagaccaaggtcagaggattgcttgatgccaggagttggagaccagcctgggcaacatagcgaggctttgtctctacaaaacatttaaaaattagccaggtctggaggccaacacctatagtcttagctacttggggaggctgtaggaggaggattgcttgagcccaggagctggaggctacagtgagctatattataatattgcactgaagcctgggccacacagcaaggacctgtctgtaaaaagaaaaaaaataattctgatagcactaatttggaaatagtgaaatatggtactggatctatgaatctggtacttcctaattaggaatgggagtctatctttctctgcaccagaaaagatcagaagcagttatgaacaaatagcagccccaccaatcaagtagtagagaaacccaaataaatctgtttcctaataaaggaatggtagttaggaaagtataaaaggaatctgaccttcctttcctaaaatggcaggagttggggaaggggaagtgtagaatgatagcagataatcaaaatggaagaaagtacagtggagtggcatgaaatatagtctcaaaagaaataggaacacttgtgaatactgaggaatggtgttctaattctttctttgaagaattgttttagtccagtgtgtatttccttttctgaagattctgtttatttcttaattgcattactcgttaaatacttaaagtatgaggaaggagaggccttacaaaagcaggtctgtctggttaaacatagcctgaatgatattccgtaagtaattccttaaattggaaaagcagatttttggtaagaaatattaatcatatttaaggagtatgtgtagcaaaactcctaaattagaataaattatttaagtgtatggtttttctttatactaaaccagtgggcttgtgatttgaggctactgttttcgatggtattgtattgagtccacagagaatatgtatacctgaatcattggtataatgtctttcccacagcaattcttgaacatatcaaattactcgatatttgttatattcttaatctggcattgcttagggcaaaaactgggtgtccctcataaaaaggtaggaacagtagccagtttgcaccattcctatacattattccatgactttaggaagtatactttgaggtatactcttcagatttggtttaataatattaaaggtatattgatggattgtttcctgtatgaaagtattgcatgatttctgctcttaaatcaggtgaattaaatttcatctggattgcttatctcaaatttaaagcctcaaatcagacttaaataattagtatttagtatttagtttgattcctttgtacccaagctaatttttgtttaaaaagaaaaagtgcttccatccttttaagtagtacatttatttgtgatgttagtgaaagttctgcaggtaactgagttaattttattagtgtttgcctgggacatatacctattattagggtaggcaggacaaataagtaaagtctaaatgttaaattacttaaagcttcttttcccataagcctttcctaaaatttgtctaaagaatattgctttgtagaagatggagtttgtgattaatgtgtcaattattgtaaataatgatggcatagttttaaatgttagttttaggctgttcatcttattacacaagtatataatttaatctgaataaaggattcccaaaggtaagtgtaaagcctctagtttc

SEQ ID NO: 108825 - DNA, 1046 bp, Homo sapiens
ttggaaaatggtattgttaatttgacaagaaccagagtgaaggactttaaatgtcatggtaagaaatttcgatttttatagtaagttgctgttaaaggtatttctggaagcttttattgttaaaataatatatatcttgaaacgatttcagtatccttttagtgattattgcattttaaattataatcttatgataaagctgtgttaagggaataccttcagagcgctgagtcccaaaaatcagaattcttacctaatgaaatgtgctaaatattttggtacccctggctctaagtttaagtattctgtttccctcaatattaccttgataatgtcagaacatttggtacatgttgagatactctaccaaaatttgatttataggtagcataatttggaaactaaccttatattaaacacaaagcaagcttacttgtgtcaggtcctatgtatatagactttcatttgatctttccaacaatttgtaagaaagtggtttcttcccttccccctttcttatggattaaggaaactgagactcttaaaatttgagtcacctaggtattgggtgacaaagcctagactcatattcagacctttaacctaaagccagtgcttttgaatattcccagagttagaagtttgttttattacttggcacacaataagttaggaagaaggaagaactaccatagccactgatttgttgtattgtaaccctttacctaaaggatttttttaatcatttaaattccccagataataatactggagatggtgcttgttgatgttcttcatattgtatgtccctggtttctatttagagatctctgaagtcgaattttggcatagattaagagaaagaggtgtttgttgagtgctcaagtaccttatgctttaagctttgacaatttttgtagcttagttttgaggtatggaatgtttgtttttttctccctgttgtacttagttaccctacaaagatagtgtcttgcaaaaacaggtagacatgccacatgctttgagtcattttctgatgtagtatt

SEQ ID NO: 108826 - DNA, 2277 bp, Homo sapiens
ggctaagaattttaaaagttatgtggcaaagtttttttggcttccagatgtacaggttgaaggtgggggagactatggaagttgctgaggaggagggaacaggtttgtcaaaagtttaaatccccgtggaaccagtccctagatttgaggtgaatcatacttactgggagatagtccagaagagcccatcagttaagagtctatggtgaaagccctagggaatggtagaaatgaaagataattatgataaataggcttttacccctaaagtaacattgtaccaatgctagaatcagaaagctgccaaacaattgcagcgccattttttgccctagacgaggaaaaaacacatataaataaatggattttgaaggtggaaatgtgtcaagtccaacccaggaaagaattcttcattgttaatcaaacctttgctacttttaacagagcctaagaaaagtttttatattgtgaagatatagcttaacttagtttatatgaatacctaagaacagccttgttaaactgctaaacaagatagatatttgtaaaggcatttgatatagaagagtgttgattaggctatgaatttgtcacatttatatgcacgcacacaaaattggatgctacttagtatttagtttcatctgccttacctctttattttataactgtgatcctgaattattgttgaagtctgctggattttgtccagtttttaatttcttctaaagtgttgttttaagcaaacttatgtggttttaaaatctttttattattaaaagttacactgtattagaaatctaaaatcttccatcttcttttgaaaagtagtgattatactgtacgttctcaacctcatttccatttgattctcggatctcacaggaatccttcaactgctttctaccaagcgttccatttgaacacgttaaaggaatcaaagagcctctgggataggtatgaatacttacatatggaatgcatacatgcaaaactgtatgcatgaattgctttgcactgtactggtttctcattaaaactgatctttgttattttaggggggaaatcacatggtatctagcatgggacaaagcagcaaaataaaccaaaaggacaatctctattttatatagaaaataaacatacttttctgcatcctgtgtactttaagtatatctatatttttgaagggttcatactgtgttgaatttttcttatgaaatagtcacttccccagtgtattttaatgcaaatgcatattctataaaataaactatattttaatttttgtgctattttatgttttttttctgtaaaagccatagtgattcaaagcaaaatgttatttcaaattatgaaattggaggaggaacaagaccaaggtatcaaagtaatcattgtttaatttttggcaagaaactttaacttcaagtttgtttgctagaattcactaggtctgcattactgatttgtaagcccctaaaacagtttgctttcttacagaaatgttgtatagattttactgttaacttttaaaaatacagaatgaagtcttggagttcttttatggcaaaagatactttggtttatctttctgcttaacacacattttaagtagtgtatgctctgttcaatcgttttgctgaatatttattagcattccatcactttgtgtttaattaatagaagttgagttcaaacaatgtttttaaaattcacacaaagctcgttagattcttttaactctgcctggcaacgcatttgtgtcttctggcatagttttggataacactcatgaactcaactccatctctttcattagaaaagagtattgctaagtgcatgtacatgtcatattaagacatgatacacattgcctagaaatgctaaaacagtcttaattcttcggcttgatttgcttgtgtgtgtcactctagggaaattttctaacagtatctttttgatggtgtgttccagaaatctttttaaatagttacttttagaacaggaagttttaaaatttgtagtaccatgtttataaaataaatttttaaatagttctgtagccatttaaattaatacataaatgtaaattgtgagatgagataaacatgaaggtttaatctttcaaatagttttccaaatgtagccagaatgtgagtactttggggtatgctttatagtttctcttagaaaaaggaaaaatagcactctgtttagaaatgtaataagagtagctttcaaaagtatgatgatttatttcaaatagctaacttt

SEQ ID NO: 108827 - DNA, 1029 bp, Homo sapiens
tccctttttctgtaggtgccatcatggtttctgtcttctctgtttgccatttgcagagccctcagggaatcaatcagctgaaccatcttcaaatgtagggacagtagatactgataacgcaaaaataatccaaccctttctgcagtagcccaaactgttttgagttgactctttattaaaataaatactataacttacatagttagctttctgggagattatcttactatggaggagttaatttttcctgagatcctaagcctactggcatttgagaatagtaactttaaaatttgacttcctattttctaaagaacagttttccaaagttaatacttggcattgctttgttaaattggcagaattagtttagaaacctatcctgatgatcactggggagcggcaagcaggttctcattgggagtcctttgtttacaaaagctcagcgtaagggtttatagcaaacaattttaccctcttctaaataccaggtcactaaagtaaaggagtactaaggggaagaaacttcagctagactaaaggaagaaatcaggtagcttgtaaggctttaacctcatcgataagcacttgcagggcttttgtcttcattaagaaatgcataaatgtacttaaaacaagtgagagaacagttgctaggtgtacatccccttgagtctgcttgtctgtccttatgatagcaccagtatttagagagaagttaataaggaaagtagtagacatgggttattaacttaaaatgaaagtctagtaagtttatcctaaatttttttactagataattgatgatctctcaaattgttttctacagtgattattcacttattacctctaattttaaaattattggataaaaaaagtcttcttatttaaatagcctcaagtattttgtgtagggaacgccttccagtatttcctatcattgtttcctatgagatttttttttgaagctaggaataaattagaactaagctgtttatgtcataaataccattggtaccatatgagaca

SEQ ID NO: 108828 - DNA, 1107 bp, Homo sapiens
taacaatacgtgtttgtccccaattatagttacttgctatttaaggcattttcctgttaccatcttcagtggtcttagatcaccttttccaaccaaaagattctaaagccttaaaaatctcacttttttagagtaactcagaatgaagctgagggaaaataccaggaacgtttgcaattacctgactcagcaaaagtttgttctcctataattaaatactagaagaaacaataagatttagtaactgctttcagtgagcttggtcttaatatggaaaatggtaaatacattatcacatgattgaaagtaataactcatataaaatgtaagcacttcatatctctcaagtacagctggagggattggtcaaagcttcttcaggaggtggcttttgagttggaaactgaaaggtgggtagaatttggtcaagcagaattaaagaactgaggggaagggaacattccagttagaggaaatattgtgcaccactatggaagtactggccttatatgataaggataaagttaaatttggtaggtgtataacatttgaagacaggagaggagagcagttagattagagacagagattctagaaaggtactgaagcctgaattaggcaatggggatgagataggaattacaggattttacaactgattggtcatgataggggagcagtcaaacttgactccaaagtgccaaacctaattgactgagggaatgctggtactgttagaaagtattagtgaaagaattagtttgggaaggagaaagtagtgatgaggtttttgtttttagctgttttttggatgagttgataagctggtacaaagtcaaggtgaaaatatttggggtgcagctgaggctgcagacttgcaggttggtatagaaattaaagctagttgagatttaagaatgttttattagagttcaagctttaggaaaggccaagattgccaaggattagagtagggtaaagggtcaagccaggaccttaggcaataccacctgcatttagataacagaaggaagtctgaagaggatgattggttttagagattagaccattctgaggatattattttctaatcaaaaagaagagaaa

SEQ ID NO: 108829 - DNA, 2140 bp, Homo sapiens
ttcttgccattatgttgtctattttcaaaattgggggtagtagagacagatgaagatttagatatagaaatggaattctgtcttaagcacttaaatgatcggtatggattgttactgatccagccacccatgctataagtctagaaactcagccaggcatggtggctcatgcctgtaatcccagcattttgggaggccgaggtaggcagatcacgaggtcagagatcgagaccatcctggctaacacagtgaaaccccgtctctactaaaaatacaaaaaaaaaaaaattagccaggcgtggtggcacgtgcctgtaatcccacctactcgggaggctgaggcaggagaattgcttgaacccaggaggtggaggttgtagtgagctgagatcgcaccactgcactccagcctgggcggcagagcgggactccgtctcaaaataaataaataaataaataaaataaaataaaataagaaactcatatacatggatgtggaccaaacaatataactcaaatgcctttctacaggactacaaagctgtctgtatcaggttatggtgttaaatcataatttctggatcatgatcttaaacctttaattggttccatttctactttactctttactaacaagtatcctgatggcctgaaaatccatgttgaaatttgaagtttgaattttccagatcaaatatgaaatttattttcattttttaaagtacaaaatatcagttgtataatcatggtaaaacataaaattttgctataaaagatttttaaaggctatttgattaaaacatttatttacttaaactctttgctagaattttttttagaattcagcatcggaggaggaatgtgacataataatgatcgaaagccgaaagtttaaaagttgtgatgccctcacatggttggagggttattctagcttctaaggactgaatgttgtccacaagagtgtcatcaggtcataaattggtaagacttaatggcttagattttatgtattatacctgatgttattgtattgagatgaatatttatgaacaaaatgagcacattgtgtaagagtatagtattaaatataagttaaaacttggaattttaaatacttggagtatgtaagcctttcgaagtctcttgaggctgaaggccgtatctttgcagtggtgtttagtaaatacatcagtttaaaaaaagaaagtgaaatcctgtattatagtaagattattaaaatattgctattgcatctgctgtagatgcctacaatatagtgaagaacccaaatactttttaggtgttataccaggagatatttgagaaataatatattcatcttttctttaaaaaaaatccattttcttaataacatacagcttaattttattgctttggagattttatttcttaataaaagacatgtttcctctaaatgtctaaaataaagccaagaaaattttttcaattcttacattgagaatacctaagatgccaatatcatatgaaaatgatatattagaagtcattgcacattttttatattccccgaaaattaattttctctcagtattctgcttagaaaaaaactactttgttttgtgcagtttcttattttgctttgttttacacagctgtattttgtagggggaccattggaaggatagagtttagctcaggataagaccttatatcttttaatctcaagattatagtattttgcagatgaagaaaaggagtctggattatttgtccaaggtgatataattgtagaattcatattttcattaaagtgtggtatgcatatcctgcatgtcagtcaagaattatttgaaattatttattttccaaaaaagccagaaggcatgggttgatatcagctaaacaggccactatatatattccaactttatccttaaccagagatatgttattttatcctttgcccattctgccttttgaataatattctaaattgtttctgatatagtattccatgacttcattacattctgtaagcttaagtcccttaagccagtaattgcaatcaatagtagtctggaaggaaatacaacaaactaattaagttatctcttattccgtatacttttctattttctttattttctataatcta

SEQ ID NO: 108830 - DNA, 1642 bp, Homo sapiens
taacctggaaattcatagagcctagcccttttctgttactcaaacttgaacccgtttttctatttacatcagttgcctatattacatagaaactggcgcactttccttctttctcagtaggtaacaaccagatgcaaggaacatcaaaaacctacctttattggggagaaaaaaattctcgaggtctgcccatattttactgtgttccagcgatacccttaattagtttctaatagtttaaatagttggttaatttcttagatctttgtcctggcatgatgagctcaatataacatctgtttataccaaacttataaaatataattagataatatattgtaagttgtattctgtctttttcttcaagtaatatgtttactatcaattatatgcagagtagtgttgtaataagtagaccctggagatggacagtttctgcttttaaggtttaattcaagagaaaggaacatttgataaagacaaaaaaattatggacgaatcagagaagtggagcctgttggcaagaaaggaagaaggctaaggaaaatgtaggtggagcattccatctcaagtgacagtcttatctctggaatctaaatcgatttaacaaatttcaggtcatgatgtaagtgtagaattcatcataaaagatttcacacaaactattgtaaaattctgtcattcaccatgtctaaattattagaattattacctaaaagaattcaaggacatgaatctagactgaaatgataaaaacttagatgttaaactttttgtctctgaaaatgtgcctacttgagtgcagttttgcttgagtgaaaaaaacctaatgaccctttagattttatagtagtgctattttttactttatgtcagaatccctttgaataaggtaattctaaagcagtgattctcagctagggtaataatttgtttaaaagcaaacaacacgttataccacttttcttatttgcttttagtaatatttattgttgaattttcatataacactactaaaggaagacctgggatatttttaaatactctttttggaaatttttatttgaattaaattagttatatttcagtgggctttggaaaaatttcccacagtaagttaagattattttactctaaataatgaaacatcgagatcccaaagaagatccgtaagaatgttattaatgtccagtccacgggaatcctgtgtttaatatgccttgtacaggagaatcgcttgaacccaggaggcggaggttgcactgagcagagatcgcgccattgcactccagcctgggtgacaagagcaagactctgtctcaaaaataataataataataataataataataataataataataataagccttgtaaatgtaaatctcaagtcaaacaatttttattaacatatactttgtggctgcattaaatctttaacatttaattgaatacaaaaaatcaattaaggaataactaggattttattttgggtgaaacataaatataaaacctgtttcttaatactaatcataattgatttttattcatgtttcactgccttgggagattaactcttatttaattttcccaagatacactgggaaagtagaccttataaagtgtcaaagtccaaattgat

SEQ ID NO: 108831 - DNA, 1326 bp, Homo sapiens
ttgttgaatatagtaccttatcttgcagaatgaaatagttgctagagaaaatagagttggcacctcttccctcctttctccctttcctattttctgtcattgcttttcctgtctgccatttgttcatgtctggagtttacactgtaaaagataactccttcatgagtcattttcattttggaacatgtttttcattgttcttcaaaatgtagtagaagtactcttgcttctatctctgtcctgcatctgcctgccttcccaaacagccactttcttaatgtgtgtatatccttctttatgtgtatataagcaaatcaatgtatattatcttctttaatgtaaattataatgtattgtgcacacatctgtacctttacttttaaagatctccagaatacattgttcccatctcagtactagaaaagtatctttgtggttttttaatagatgcatactatttaattgaatggatggctacaccatgattcatttaaccagaagcattgctgttataaacagtgttgtaatgagtagccttgttaacattatttgctatgtatataaaatatctagaggataaattccaagatgaatgattgctggctcagagagtgaataattaaggggaggtcgggagaggagagaaaaggagagaaatctgttttggaaaatagtattacattatagttttaatttgtatttttattttatgattcagatgttgagtattttttcatgtctttcttgttaatgttcagtgtgaattctccccatttttctattgggcatctggtcttaacagattttaggaaaatttattagagactttttaactttaaaaaaaaattagacatgcagttacatagtcctttcccaccaaagtattaaagaaattctaattaaatgtgtttatttaaagttcttagtacagatgataagactgactctagacaaagggggtctaaggtaggagatggacttcatatagattgcatgctctttaatctacgctttactggctagccatttgactgaaattaacaagataaatataaaatatgctgagggcattggtgaacaaggtttttgtagaagatgctgacaataaatatcaatatataaatatttaactgagtttttaatagttccttggtaaaggcattcatcacaccattgcgggactggctacttgagaaaaagtaacacttaagttttgtaagtagaaattttacctgcttgctcaggatgaataatagctttaaaataacttattttgtgttactgctaataataatctctatggggcattttgggtttttttttaat

SEQ ID NO: 108832 - DNA, 1055 bp, Homo sapiens
ttgctttcttttctcttttctttcttttctttcatgggttctcactatgttgcccaggctgaatttttttattttaaataagtagtcaccatgtctctgtccacattactacagataaagaaaaaagttggtttctcatagttttttaaaaatagagatcaaggctgggcgtggtggctcacgcctgtaatcccagcactttgggaggcgaaggcaggcagatcatctgaggtcgggagttcgagaccagcctgaccaacatagagaaaccccgtctccactaaaaatacaaaattagcagggcatggtggcacatacctgtaatcccagctactcgggaggccgaggcaggagactcgcttgaacccgggaggaagaagttgcggtgagctgagatcgcgccatttcaccccagcctgggcaacgagagtgaaactctgtctcaaaaaaaaaaaagagagagagattaaattagattacctttttctttagtgattttaacttgtgacagagttggaaattcttcatccatcctcttgctttctcagtaatgttgcaagtaatctcatggtaagagtaaggaaacctaggaggaaaagctgtggtggagagccagttaggatcaattaaaagatgaacagcatggaaagccaacctgccttactgtagcattgatactctgagttatactttttctgtgagtgtaagtataattagctttaaacactgaattcaagctcatttagttattttggagcagcaattccagtaaataaatattttcttgtaggtctttcttactttccacagctctatatttctgttcattctctccatatccacaatttttaatgcatctgtaaatgctaataaatgtttgatttttattctaagaatgattcatagtaaatagaaagtttatttttaaaaattatcttttgactttatttagcatttccagtttaccataatagtttaaaaaagaaaattctgaactcatttttccctcatgcttctgtagcagtaattgtaacacttgatttaaaattgactta

SEQ ID NO: 108833 - DNA, 1136 bp, Homo sapiens
acaggattgcatttaatagataaaacgtttaggcaataattgaacaaaagaatcctggcatatttctaacactaatggcaatttacttatggtatttattttcagtagtaaagacccagcttgaatgtaaattttgtatagtgtaagtatgaagaacatagtgcaactgtacaggtagtcaccagttattgtgatatgataaataattgggctattttgatgaagaaaactttgttcatttgtttctactttctaagagaaattgccacgattcctctgcttttcaacatttcgtatgacttttttttcgggtgggaataaaaagctgtgaaattgttcaacctactttgtaaccaaagaagcaaagctgtgtaatggagtttggtttttttttgttgtttttttttttttgtctttttttttttttataatgcacattctttatgtatttttatttagtgttttctcagtcacaattttctttactgtctagcatgatctgcatgacctataatctttgaaccactttcgtacctcatgtttttatccagcactcttattgtaatatgtactagtctgtgaacaatgtcaaataaaagagaacgaacaggtagtttggtggagctgagctagtgtacaatacactagttgtaaaaaaaaaaaaaaaaaaaagtgagccatcttttgttcatttaaaatggtgttttgaatttcgtatgcagaaaacgttttgttacattgcagattttaatgtatttaataaatgcaacatgcagattaagtgcagtgtatactgagtatttaaattaaaatgtacatttcataaatacagtttcaaaagaaagcatcattttgtgtatactaacacattaagtgtatgtcagaaattgatgtataaatatatattttaacattttctgaaattaaactgcagttttgttgaaatatttggctctatatgtgttcaaaatttgactagatttgtattttcacagttcaaaatactccttaaagacctgttaataatgacttactgatagttcttaaattttcaaagtaaaacaatttaaagaatgcaaaaatagtgagcaatatttgtactcaatattcatattatgttagtgatacttaagtag

SEQ ID NO: 108834 - DNA, 2098 bp, Homo sapiens
tagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatatttgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttaactctaacatttcaacaagttgtcaattaattgtatctgttgggttgtatataatgttgctcaaaataattaagtggacttccaaaaataagatttccattgtaacaggatgcattgtgatgggctttgacttacatt

SEQ ID NO: 108835 - DNA, 1039 bp, Homo sapiens
accctggttattggctctcttcatttttgttgtctgtggttctggtaagtggcttgggggctcccatcaggtagagtcttgggttgaaaggatttgggatgacgtggtgaccggtcagtagtgagtcctacctgcgtagttctcaacccacctgccgaggactccacataattctgtttcgtctgaaccaaattacttgttccacatatgcacagagggtggtgctccagaaacttctcccagcttaatttgtactcacaggagatcaaaaaggaggtcaggtcttggtaatgatccagttggaataaatgttaagaccggacaaaacctaacgaaatgagaatttagaatgttttgtaactccattatcagtctttgcaaagaaaattataaatatgtactatagatgttagaacttgatttaacatataccagaatctaatgtcttaatgtcaaaattgagtatattttataaaataaagcttgtgcaaagaattgattcactatagaggaaattacctgattggcattttaatgtgtgagtcaaatgtttttaggttaataaaagaaacgtttgatacatggtttaaaaaaaaagtgtcggggtagcctgctgtcccctaagagtaacagacacttgcctttgcaaatagattacaaaaaaaaggtctttcctctcttcatttatcattttaatatgcaagctgttaatattgaagtagatgtttgttttccacattctaaaattactgagatttctgtttaacgtttcactttgcctttcttcttcacttaccaattggaagctttcctgataaatggatgagagccaagcagtttatataacctgaagatgattgaatttcagctttgtgagaatgaggaaacatgcatgtgttacaggccaggccttaaaaggatgcttataaaccaaaataattctatgctggaaaaacctgttggctttggtgctttaagttctttgtaaaatgattacttatctgcaagttctcttggatacttagacataaagttcagc

SEQ ID NO: 108836 - DNA, 1068 bp, Homo sapiens
tgtctcattccacttgttctcttagtttgataaattgtgaatatattaatattgccttatatttctaaaaactttaaacatatactttttttattactttatataaagcatacagctatcctgtgttctgatatttccattttacagattaggtcacagattcagaggtggtaacgtatccaaggttccacaggcagttataaacttaggtcaggctctgaattcatgtcctctttaccacaagacagctgcctttctttcagtggtgacaaagtttcgagttttatttaaaaagttacgtatttctcagcaattatatgattttatgtaacagagtaagaaaatatgcccttttgttgctaatattctatagttcaatgaaatatttaatgatttcattaatattttgactaaagctgcttttttaaaaaacacatttgtgttaactgagtctttattaacaaagtaattgtggttctttttattttacttctttagtccgaggatcagaaggactgtacatggtgaatggaccaccacattttacagaaagcacagtgtttccaaggtatgatttattttgttaagtaatgttatagggaacatacagtacaatctaaaatggttttgttggtggtgtattttgaacaagaaaggaaaagaacagatgaactcatttttattgtataatatttaccgaagatgaaaagaatacatattctctatcaaggaaaatgatcttcagatctgaaaatagtaacttaagcctatttataaggtagggggaacaatactaagaaaaagtgtagacactagtgtaattgaatacaagcctttattttacaagagttgtatcttaaggaatgagaaaaacttgcaaatttgatagccaaatcatggccagtaatcttagtgaaatcataatgaaaaagatattaaaaagggaggacatatatatgcacatagtatatagctagctagattaatttttttttccccaaagaaacaatggacaagtaaaccaaaaactagttaaaaatgcttatctatagggggagagagttacag

SEQ ID NO: 108837 - DNA, 1026 bp, Homo sapiens
agttctcatctcatgttgtgactacactaatgtacatctacatgtgcacagatacaagtttctatttgggtattcattatcactgggtgatgtattcatagtaaacatcttcacttcggagatacagtacttagagttttgaatacttgatagaatattcccaagtagttaggtgaagagcctcttatttttgttatactttctatctctacacatgagaaattgatggaaggcctaccacacaaacttattcacccaaaagggctctatttttttcttaaaatccatctgttagtatgaaatcattttccagcttactttacagtgatagcattgcattttaaagtattttggcagatgaaagcattttggaattttctgaaatttgtgcaagttcttagttattaaattgatagtgaaatggttgactttataatcagatttttttgaaaagtattaatgcttattcatttaaaccttttttttttgtcattttcagggaatctgggaagaattgcaaagtctgtatctttagtaaggatgggaccttgtttgcctggggcaatggagaaaagttagtgttcatttacataacatattttgtgtgtcacgaatataaacacaactggcattatttgaataacagatatttgagtgtcattaataaaatccgtcttttaatgtcatgatgtagtgagatattacctctcgttacacaaaataccttcaaagttgttcatttctatgtatatgccatgacttgtttatctagttacttagaattaaaaattaatatatgaaaaatataatttaatgctaaagaagttgagttgttttaaacagtgctctaagttattggttggagtttcctaaatctgcagtaacactgagaaaataattctctttactcatttaatcctagatgtagatacttttttacctttgctgttaaattactaacaactgcctgcagttattattattagtcttatgtatataaaagtgtatgttattcaaaagaacgtt

SEQ ID NO: 108838 - DNA, 1006 bp, Homo sapiens
ctagatttcatgtattgattgtggtctttgttcagtttctggttaactaagtcagaaaccgttactgattcttccttaaatatgttttttcttaattaaaataaacatccttcattaaactaagaataactcttaaagaccatcaattctgagtaggctccagttgcaaagcaaagaaaaaaataaaggttaacaacagcaacaagaagaaaacaagaaagcgtcttgtaattctaaaataggttatttgcagcaagttgtaaagatttccatgttaggtgtgtgtgtttaaatactatgtggtaatttttcattcttttcagtgactgcttatcttaacctcagttatcttcctcaaacctgagtagaacaaagttacttacagcaacttctggaataagatggagagtcttttttttttttttttttttgttaaacaccccagagtgtttagtacataacagtaagtcaggccaaactgatttcaaagcttggctgtggcatttatcaatagtatgatcttgagcaaatcgtcaaatcattttatttttctaagcctaaatttcagcacttgtaaaacagaaatgatgacatttgtaagattgttgtaaggattaaatgagaaaatgtacataaagtggttaggtacatagaaaacatcccaaaatggaactgcttttatcatacaattattgtcatttttgtcattgtaccataataattcttagaatcatatcttttagagattgctcttgagattgtagtagacatcaaatgtctccttactgatttccctagctgctatagcttctatttatttaaaaaaaattttttttttaattgagatgggatcttgctatgttgcccgggctggttttgaactcctgggctcaagcagtcctcccacctcagcctcccaacatgctgggattacaggtgtgagccactgcacctggcccatttattcaaatttaaaagtatacttttgcgggccggacacggtggc

SEQ ID NO: 108839 - DNA, 1026 bp, Homo sapiens
gggatgtgtatggtagagtcgaaaatgttgtgccattttccaaaatatttaaagagatacttaatgataatacattatatgaacatttcatataactgtgtttcatgtaataaaatagttataggggcttattttaagaaacattttctaataatgttgatatttttgaataagtaaatgataataggtcattattggcttacaaacctcctgagtttttgttctttcaagaggtatgaactctcatgaatctaatttttccaagtaaatgaaagagatactgagaatcagttgagaatcatgagtgggttatgtaacctttcatttatttatttatttattttggtaacacagaggcaagctttcatgatttaacccatttgatagtaatccatatcaaacttaataaataagaaaaataatccctttacaaatgttacaaggcaattactgaaaaaaagaaattttattgcagcttctaaagatggcacagctgggatacccaacctacaactttatgatgtgaaaactgggacatgtttgaaatctttcatccagaaaaaaatgcaaaattggtaaataaatggcttaaaatactaattttttacatagtatttttaatgtcatcactgtataatatttgttttcctgatattgatttaaaaaataacttatcagacaaaaatctacatttttaaggattttgtatgtaggaatgtaatagagcaaaaacttgatccttctttcctttagtattaagtggaaaggaacaatgttttcttttttttgtttgtttgagagggagtctcgctctgtcacccaggctggagtgcaatggcctgatcttggctcacggcaacctctgccttctaggttcaagcaatttcacctgcctcagcctcccaagtagctgggactacaggcacgtgccaccatgcctggctaatttttgtatttttagtagagatggggtttcaccatgttggccaggctggtcttgaactcctgacctcaggtgatccacct

SEQ ID NO: 108840 - DNA, 1460 bp, Homo sapiens
catctttgatcaattaatccttagtgacttctttgctatatggtaagacaagtcattctaggattaatttgtacatttctaaccattacacctagaactggctaatttttcaggaaaccctgtcgcctttttggtgtgctacttttgaatagctattgatctctgaaattgaacaaagaaaaagtattagctcttgatctcattgaaggaaacattaaaaggtaatagggtttcttgaaaaattggctgagtctagcaaaaaaaaaggtatttaggttctagagattcttatttgctgttgcattgatcattgtttctaggccttttttttctatttaaaagatgtaacaatcataattttatttaaattaaagttttatacgtatagttttatttaaattgaagactacaaggtttttatttaacttctatcttatttgtattgccttctgtcaccaccaagaatcttgttactctggaataccagggatgataatttgagaatatcacattcacataagtattcatttggtttgttccacattatccacaaggtattcttacaatcttaataccaaaaagtaacactgttactgaaaataattttttaaaaagggtttgcagttcttttgtctttagagcatcccattactgattgtacagttttgagtatatcatagttagaataggaattggtaactttgttcacacgtaccaaagatggcatgtaggctgattttgagcagcatccaatcagtatagttatgcattttattttcctgtgtttgaggcgcactgtcacctcactgtttctgggttagcttgctttcttgtcttattctcctctttgtgagcatgtcaaatgaagagggatcaccactttgacagtttggtgtgctgcttttgaaaagccattgatctctgaaattgaacaaagaaagtatattagctcttgatctaattaactagagtggcagttttattaataatagcatggctcagactgcctggaatagagtaagctcttaatatcagccattgttactgtggttgtgatcatcattatcatgcatctgtttatcacattaagttacagaatttccatatccacattctgcagtagcaggccaaggttgatcttttccttctaataggctctaagaccactttatttcagcgattgaagagaggataactgacatttatcaaatacctaccatgtgcctggcactcttctcttaaaaccaattactgagagttgggtggtataatcccattacttgcctaagctcacactgcaagtaaatgactgagtagaaattgaagcctacatttgtcttgctcctaccccatgctttttccactgtgttactgtatctcaccaggaggagactacagtgagtagtattggtgtgtagttatagtgatctttgataatgtattcagagtttaacatgttc

SEQ ID NO: 108841 - DNA, 1001 bp, Homo sapiens
tagtttgtattttgattaccatctgcacgtattaccccttccaaaaacaaatttattaatagtaacaaactattactataaggccatattaccaaaatgtttaaaagaaattaagattcaataggggttcttaaataaatttatgattatacattaatccccctagtatataatgtaagagtattttaatgttaacattccttgaaatttttttatctgtttgatgtgtttgtgagtactatatgatggtaacttttgctaacaaatatttatatagttctttattgctaatttgggctttatattctttttctagcaaaaaatggccccatttatgatgtagtttggaattctagttctactgagttttgtgctgtatatggttttatgcctgccaaagcgacaattttcaacttgaaatgtgatcctgtatttgactttggaactggtcctcgtaatgcagcctactatagccctcatggacatatattagtattagctggatttggaaatctgaggggacaaatggaagtgtgggatgtgaaaaactacaaacttatttctaaaccggtggcttctgattctacatattttgcttggtgcccggatggtgagcatattttaacagctacatgtgctcccaggttacgggttaataatggatacaaaatttggcattatactggctctatcttgcacaagtatgatgtgccatcaaatgcagaattatggcaggtttcttggcagccatttttggatggaatatttccagcaaaaacaataacttaccaagcagttccaagtgaagtacccaatgaggaacctaaagttgcaacagcttatagacccccagctttaagaaataaaccaatcaccaattccaaattggtaagtaaagttttactacttttatagaaaaaagtttattttgggccaggagtggtggttcacatccgtaatcccagcacttcgggaggccgaggcgggaggatcacttgagg

SEQ ID NO: 108842 - DNA, 1225 bp, Homo sapiens
accatatgccatattctttttaatgtttttacttttaaatagctttactcttaaatagaagagatatggtattgatcatgtgaatgaaaaagtcaatattcctaagaggcatactatgttattactgctgaaaataatagcaatttgttatattagacaaatataagattctctcaagttgtactgccctgtttgccttttccctcctcctgtcaacatgtttaagcccgaatatagaattgaaaatttttggggcccaaagggatgcagtaagacagtgtctgttcttttcaccctcgattcataccagataacaaattagaatttgtttctaacctgtattttaaaatctgtgtttactagtgaacataataaattgtcagaaataccattttttctgtattattttggttacatatccagtaattatttcataataacttcattgtttcaaacttttctagttggagaaaattcagaaagaaacagcccttctccaggagctggaagatttggaattgggtatttaaagattcacggaaagcaagttgatgaccagaaatcagtgcaaacacatcttctgttaaacccattggtatacacagaatattcctgtgcccacacttaatgtcaatctataattttaaccatttatccaagattctactaagtgtaaaattatttaataatgtctattaaattgatatttatatcttgcatcctatatcatgtcaatatgtgatatagaaaagagatacgtgaattttttagctaagcttgacagattgaaagacaagtgtcatttttttttgtagagggtgatatataccatgtaaatgaacaaagacattttaaatttaatcactgtttttattataagttccttagttcagatatcctttattaatttataagatgtgtaaaactacttaattctcacaagactctatgaagtaattcttttaatctctattttataaatgaaaaaactaaggccataaatttaagaaatttgtcagtgtctcaaagctaggaaatggccatctaatcccagagcctatgctttaggtcactatgatatatactactcctgtatcctcaagtaatgtatcatttagtaacactaagcaccctgcttagttttcatggatactgccaaattgccctatctcaagctttatacttgcaccatttaaagttttccacactgttggcaatatcagaa

SEQ ID NO: 108843 - DNA, 1056 bp, Homo sapiens
ggctcaagagattctcatgcctcagcctcctgagtagctgggactgcaggtgtgcaccaccacgcctggctaatttttgtatttttagtagagacggggtttcaccatgttggccaggctgattttgaactcctgacctcaaagtgacctacccaccttggcgtcccaaagtgctaggattacaggtttgagccactgcccccggctgaaattccctttttgtgttttccttttattgatttttataaatttgtattgatagttactcttaggcatgatgtttgtcatacatactttctccgtatatgcgatttaacatgtaatcagatctacagcatttaattagttgcagtttaaagagattattggctacaaccctttacagttaatatttacttgaacatttgacaactgaattgctgagaatagtagattaaatgaaattgagatttcaaaacataagtagaatatggcgggattttcaaagttttgttagtttgagaatctactgctgtaattttaggacagccaacttctaaatgtagttttaagaggtaaatgaaacaactgtaccaaaacagatttttatttaaatttacaactattcagccttggctttcatagtgtgacagcaagaaaataaagacctaaggttgatttggatgttgatactcatcaagattagtagtaaaatgctgaattggagaaattgtgagttacagagatcatgttggttactgtagacttgatatttgcatattcaacagatattggagcacttactctgtgcaggcactttgcttcctgcggagaattcaattcagtgctctcgtggacttcacaggcaagagcagatgcagacattaatccatggactgaccacacagataaaattcaattggtgttaagtgctgtgaagaaagattatgtggtggtatgagagatgcctagtcgggatcagggaaggtttccatgaggaaatgaactttgaactgagattcgaaggataagatttatttggcgagaactttccaggcaatgggaataacatgttca

SEQ ID NO: 108844 - DNA, 1017 bp, Homo sapiens
gtagagacagggtttcggcatgtttatcaggctggtctcaaactcctgaccctaagtgattggccctcctcggcctcccaaagtgctgggattacaggtgtgagccaccatgcccggctatatatatatatttttaatgttggtcattctttctaatgttaagacatatcctttgaggataattagattttggtgtcatgtaatttgggtggtatcacataatttcgttcatattctggatctgccacctattagttatatgactaaaacaagttaacctatctgagtctatttgctcaattataaagtgggcatgatagaacttcacaggattgtcttgagggtttaataagaatatagctagctagctagtttgttcaaggacataagtatctgataaatcttaatgtttcccctgttggtgagtcagaacagaaataagagttgaaactgctggtaagcctattttatccatcttcttattttgcccatagttaaaaagccacttttgttatattctgcactaacttccaaagttcattttgttttagcttttattcttttaattagacatattgtctaaaaccaaaaagtcatgtttctgaagcagagtttttaaaagatactttatatttctcattaagattgtgactagacagaatccttccccacacacaaactccagcttatctatttttcaatatctaagttagagttcttggcactattcacatttttactgtaccttcttgaagatgaaagagtccgaaagatttaaagatttttgagcagaattagacataaaaaactgtcatagtttggtgttgctataatagaatatcacagacaaggtaatttataaagaaaaatttctttctcatagttctggaggctgggaagtccactgtcaaggtgctggcatttggtgagggccttcttgctgagtcagctcatggtggaaggtcaaagagagggcaagcgaaagcaggtgattgaacttgcagcctcacctcccat

SEQ ID NO: 108845 - DNA, 1953 bp, Homo sapiens
cccccaaaaaggccaaatctgtgtgagagctcaaagtatgctgaatgtgaataggtatttgctgttgtccaacagtaacccaaatctataaagtttaatgttcttttttttttttaaacaaaaaaatcaggccgcattactggcatatataaagtttaatgtcttaatggaaggatttgagggggtggtaactgaaatatgtgaaatgtatttaaaaaactcaatgtatttgtcatcctggttcaattattatgaatttgtgactgattttgagaaaaatttgtaatcttgataatttttaggctttaactaactacaaaataaatctagatgtatgctaaatgacttaatggaaacacttatttttctgcagtgtttcctgaggttataggcgggtgtttgaggagtacatgcgggttattagccagcggtacccagacatccgcattgaaggagagaattacctccctcaaccaatatataggtaagaaattttaataacttaaaaggaaaacaatgtatttgactttataagtgtttgtgaattggtttaattagctgtccttagttattgtaattacttagttggttataataatatacagagaatgctgttttatatataacaagtttatttgacccaatatagaaggctttttctgtaagaaggaagagggtcgtttcagagatggcaacccttctaaagatgtgttttcatatgtatttttaattgtggaaatagaataacaatcctaaatttttatagaaagtggtattaaattctgtatttcataaaataatagtatttttaaagaccaattctgtataaatttgtaggttaatttttcaggtgattttaaatatattaaacatttttgttttaacactgcacaataaactttaattgctttttctataagtaacttttagatttggtgtctagaaaatctttacatacacttgaattactaaattttaaagtagattggaaattgtggcttctgatgattttctttcttttcttttgatagacacatagcatctttcctgtcagtcttcaaactagtattaataggcttaataattgttggcaaggatccttttgctttctttggcatgcaagctcctagcatctggcagtggggccaagaaaataaggtatgtaacttaatagctttggtaactgtaggtttttatgttgtcagtgaaatattctaatagattttcttattttgaatacttgttattgattcacctgttaacatgtattattttaatttataccagttttatctctggggaagtcacttagcctcccttcaccttcatttccatattgatatattaagaatgattaggtcttaatctttttattttggggggatagggaggtgttaatttagtataacctgggcacaaaataatttgttatctgattttgattatattacttaggtcaaatcatatccagcaaaacataatatatacataatgcaggccttttaaaccaattaatgtcatattagtgggttgattcacattaaaaaggggattcccattaacttgttcttatcaaaactcctctctctttttaaattatttgtcctttgcctcttctgtttatggatctgtttgactaattgcctgaaagaaacaatgtaaatatacttaagaactttgtgctgtttctcttttccttttgtagggtcttattgccacatacattctttctagattactctgattttaatttattttacttttaagtaaaatattttaatattaaaaatgattttaatcattgtttctggagggcttactgtcctgtctaaaatgggtctaatttttatttttctcatggattagatttttctaggcttccttttatgaagtcttcctttttggagtcttctatctgatcttgtcctttaattctaggctgaatacctttag

SEQ ID NO: 108846 - DNA, 1634 bp, Homo sapiens
attcctataaaaacaaaccccacctagctcctgtggggcagtagggaaagctctttctcatctgctgtgaacatttgatttatttttctgaaacagcttgctgtgaattggcattctcactgcatcctacttttagtcctgtgattttgttaaagtaaaattttctgtccaacaagaaacacttagccgcttttgggagagagtatagatttgcctttgaaaggtgaatgaatgtactttaatatgcctatgctttctaacctacttctttcttagtttgacttaaaatgatttgtttgaaacatatacaggttgtattgaatattatatggagttactaattttgcatcacaagtctcttatgaattcatatattataaaaatggtaaagtgaactcttatgcttgtattcttttgtttaacttattaaggctattatgaaatctctcaaattctgtgtacattatgaatatcatctataagtgcttcagcatgtatggagctgcaaattaatattggtttacttttgctctatgtatgttatctgaacatatggaatagcagtaatagtttttatgggaacttttaaagtagattaaaaagagcatttaccaaacatgactttgcctgttgtgcttaattatattttcttttaggtttatgcatgtatgatggttttcttcttgagcaacatgattgagaaccagtgtatgtcaacaggtgcatttgagataactttaaatggtaggttctgaatagtttgcattttgtgattgattttaaatgatttataatgagtatcaagcttttatcttttataataagataaacttctttagtgtttgtataaaagtaagtttatttgaaagaaattgaaaattcaggagatagaagaatttagaaaattttaacttttttttttttaatttgctccctcaacttaatctctttatctctgcttgaacttcacaccttcgaattccttgaggagttggccctattcttttatcagattgtctctgtgaactttatctactcccatggctttaaaataacatctgtatgatgatccctgaatgtatatctctcgatctctctcctaaaatgctatgctgaagaatcttaaacataacctactctaaaataaactcttgcttacttctccttcctataatgtctgtaaactcttttgctcctcctttgacatttctcatttatttagtgataccatcatttgtctactcagttgcccatgccagaaacctatgataatatcaccgtcttccctagtccccctattttatggattaccaagtcttctcagttccacctcctaaatttcaaaaatctaccttctgttcatcttaactgccaccaccctagtccaggacacaattaacttgttaccctcttctgcattctctaaaccaagggttggcaaatacggcctatgagctaataatgttttttacactttttggttaaaaaaaaaactaatgttttatgacacatggaaactatatgaaattccaacttctgtgcttataactaaagttttgctttgcatcagtgaaaaatttgtagaaatttatctttatattatataagtacctacataatgttcttgattttta

SEQ ID NO: 108847 - DNA, 2734 bp, Homo sapiens
atctcctgaccctgtgatccgcccgcctccacctccgcctcccaaagtgctggaattacaggcgtgagccacctcgcccagcctaaacaataacttttttaatgcaaattttatcttgctgcttgagtgttcccaattcattaaatgacttgactttgttctcaagataaagaccagaacatttaatctggccaaaaggctctgcatgatctatttcagtggttagcaagctgtggtcctatggaccatatcctctgctgcttgttttgtaagtaaagctttattagaacacaaccatgtccatttgcttgtgtattgttacagctgcatttaggctacaagagttgaatagctgtggcagagactatgtatcttccctagcccaaaatgtttactttctgtccctttacagtttattgaccccagtctaatcctttccaccttcccatcctcccttatatcactcctcttctatatttccctcagctatgctgattttctcttattttcagtgccaagctactttctggtctttacatttctgttctctccctcaaaggttttctactctcatgaatccccactctgtcttggtaatttttctttatcttttagatctcaatttaaatgatactatttctctgactagacagggagagccttgtgtatatgtccctcctagtacagtagtgccttttagttttagttctaagtacacaattgtaattttgtagccatttgtgtagttcttttgacatttcccctactggaatgtaaagtccctgagagcaagcagtgtacttttttgcctacttttgtatcccagttgtgtacatagatgataaatattagtgggatgaatgcatattataaaatcatctttaattttttggggggcggtgccatttatttttatagatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgtaagttgtttaaaatatagctaatgtataggtttctgttgattcttatgactcagcaagttagtaaatattacatatattatcacttgagtttccaatttaagattaaacagagggatgtattcttcattaaaatgttgaagtgtatgaagagagttcggccctgccaaaataaagtcaggttgttagtaattttatcttcaaggcttaatgattgggtctgtaaccttattttctttactctaaattcctaatggccagagttgatatattatgctagaggtgtgtatacttcctgtccttaccttcaagtaattagttcctgggagtatgcaaattctttgaacatactcaagataaaaaatttataggcaaatgtgtgaacacagagaggtattagttaactttttctttgtgatcaatgaattcactttctaaagagtttttatgagtgatttttgcaataaaatattcttttttctgtatatctttcaggcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaaatttaaaagtttcaatttattgctcagtgtacctgttaacattatatttaacaattgcttaaatttttgtttttgatttatggataatttcttaagagtacacactttagatacacaaataatcgttcatttaccatctttaggatcattgaaactcatctcactaaagaaagttcacttgaacctctttatagcattgatactaggtgaacagaaattacctgactaataatttgtctaacatcatatatcagaattttattgtatatgatgaacaaaacttaaaattttttaaatttaatttttaaatactgtttcagagttctaaaaaggcagttttttaaaaaacttaagttgataaaaactgtaagaataatttagcagaaatagaaccagaatgtagaagagtagtcatgtaacagcagtaataacatacttcagcttc

SEQ ID NO: 108848 - DNA, 1536 bp, Homo sapiens
aaatgcttgggacaagaagtatttcagatttcataatttttttcaaagtttggaatatttgcattatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgtaccactccaaattccctgccttctgcaagttgaatgtcttgctgaatgtgtctaggggttcatcttcagtaatcgacattccactagtgccatagttaacttcatgacatgtagacattcaaaacttgagccttggatgttcctgtggacctgacagttaaaaatataaagaacctaggattcaattccaactttctctgtttgccttgggttgaataacttatcttttggagaatagctttaagtggcttagacactgataaaattcagctgtgttgttgacgctcatctcttttgtcttacgcttagccatatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccatagaacatgccagcaggttggctaatgctatgggggtttttaccacagttgccattgtggaagaaattatttggtacattaataaaaaaagttggtaaaacatggttttatacctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattgtgaaaataaactttgattaagctgattt

SEQ ID NO: 108849 - DNA, 1042 bp, Homo sapiens
cagcacagaatacatcacagagctattgacagttcagcagcactgaagcacaagtagaccgtaaggcttgagaagtagcataaggtccaagagtatggtaagacttgagtgccagactgatagtgagtcataaacactggtcgggttaagaagccattaaaaagtaatgataataacttttataatgcaaaattttgtgagtatagttaccatataaagtgctctaatgtagatttaattccacaaagtaggagttcctttcaaatcagcttaatcaaagtttattttcacaatgctacagaggtaagtccccaaactttacaatcctcatttgtttctctcaaaaagatctctttttttaaaaaaaaggctttagaataccacaccatgtttaaaatcctgtaagctatttttgaaatctaaattaaattctgacaatgataaaatgtttgccagccaatcaaagtcccaaactaattaacattcaaagtaaaaaagaatcatcattgggatctcattatattttgatagctgtaaaggctgattgactcctgtcattaatagtgttagtgtcataagcaaataatatcacttatattctagaaaaggaaataagcatatttgtcttgcacatcttatacactgaggtataaaaccatgttttaccaactttttttattaatgtaccaaataatttcttccacaatggcaactgtggtaaaaacccccatagcattagccaacctgctggcatgttctatggtcttctaattaatatagtgcacagacatttataaactacacagccacagtaatttacaagtaactaataaatattgaaatgctgggaatataacaaaactacattctaaatagtttactttccctttttccttatattattacttttatattcattcttcccactcatttttttcactagactctattaaattcaagatttaaatatggctaagcgtaagacaaaagagatgagcgtcaacaacacagctgaattttatcagtgtctaagccacttaaa

SEQ ID NO: 108850 - DNA, 1230 bp, Homo sapiens
aacattcacactaacatccttaaatctggagagaaacaaaatgaatgtttttcctctattgactggtatagacaatttaacaatctcagaagaaagagcaaatatcagattttttttttttaattcagctggctccttttcccctaggcttcagaaaagcaaatagaaacaaatagatccacagcccaggtgcagtggctcatggctgggagaccaagatgggtggattgcttgagccgaggaattcaagaccagcctaggcaacaaggtgaaactccatctctacaaaaaaaaaattagccaggcatggtagcatgcacctgtaggcccagctacttgggatgctgagacagcaggatcgcttgagcccaggaggttgaggctgcagtgagtcaagattgcaccactgcaggtgacagggcaagaccctgcctcaaaaaaaaaaaaaaaaaaaaaaaacccagctccaaactgtatcttgaagaaaaatataaactggtttcagatacagtagaaagctgtaaagtcatccattctataagactaacagaatgttttcttttgccaatgttaagcatgagcaaaataaaaaagcatgcagacaaacagtagtggttttaaaattttaatgtgcttaaaaatcactgggacaaatttctggatcccactcctaatggttctgatttagttgatctgaaatggtaccaggtaatttgcatttcaaacaagcttcaaaataattctaatactgttagtctgtggtgtataccaggagtccccagtccttgggccatggactggtggtggtctgtggcctcttagaaaaccagccgcacaccagcaggtgagtgtcaggcaagcaagcattacctcctgagctttgcctcctgtcagaccagtgcattagattctcataggagccagaatcctattgtgaacagtgcctgcgagggatctaggttgtgcgctccttatgagaatcctaatacctgatgatctgaggtggaacctaatacctgatgatctgagtttcatcccaaaaccatccccccaaccccctgtccgtttatggaaaatttgtcttccacaaaagcagtccctggtgccagaaaaggttggggaccgctggtctacactgagtagcaccataccacagagcagaatgcagaagattcatcctagatgcatcctagatgcgtcacgtgtagaatgacttaacacaaattcagc

SEQ ID NO: 108851 - DNA, 1058 bp, Homo sapiens
tgtgtggtgcttactttggggaagggagttagaatagaagaagaaataaagggaatctcattttttaaaaaattatctttatttctgtattgtttgaatctttaaatctttaaatataaaaatatattcacaagttgcttgtaattaaaaaaaaaacctaaagggtgattatgagaacaatgagaaaagtaaaaaactttaataatgaactcttccttttgcatcaaaatgactcttttttgattaaaattaatttctaagtggggagaggaagggaggtgcaggggtgggggaaggaagtagagggagagagagaggggagaaagaagtatttttatattttgtgtaagaatgtatttactatggatgtaatgtaacaaaaggaggggatactgcagatttctaaccaagaaagaagtttgtctggagcctaaaaatttgactgcagtttccagacttactgaaaggaactggaaaagtgcttagcacattgtagaccctcgctctatgttgcctgaatttgaaatctcccctttgtttggtggtcatgagatattccttcctgtgttgaatattgagattctatttccacatacttaaaagttgaaggcacttttgaagtttggagctatgtcttcctttaaaaatcaatgaaacaggccttacatggtggtgtgcctgtagtcccagctatttgggaggctgagacaggagaatcgcttgaacccgggaggcggaggttgcagtgagccaagctcgcaccactgcactccagcctggcgacggagagagactccatctcaaaaaaaaaaaaaaaaaatcgacgaaacaggccgggagtggtggctcatgcctggaatctctgcactttcagaggttgaggcaggtggattacctgaggtcaggagttcgagaccagcctggccaacatggtgaaaccctgtctctactaaaaatacaaaaattagccgggcatggtggtgggcgcctgtagtcccagctactcaggacggtgaggcaggaagaattgcttgaacctgggaggtggaggttgcagt

SEQ ID NO: 108852 - DNA, 1038 bp, Homo sapiens
agggactccggtatccgccagcccactcgcaggcccggagaggcgggcggcatctctcatttaaaaaaaaaaaagaaaaaatgtttacacttcgtccaccctccctcaagcccactttgggtgtaggtctgggttgacatttaccgagtaataattgttaatagacaattaacagattaattggcatttgctgatcgttagaacatcgtagctcacccggcccaatgcccgcgtcctctgcagacgtgtattcgggtactctcggtagggctgggccgcaccagtaaaacttggaccgagaaactgactgtgtggggattgaggagggaggaaacgggcgagctaaacgccccctttaccagcgctgggctcggctgaattgataattggagtcctgcaccccgcgcctaccgtctgcgcacccctgacacgtgggagctctcgggattgtagctaaaaaaagggcgcctacagcctgttttcctctagctagaagaaaaccctgcaagccacgcctttttctctcctagccttccaaagactgggaaggactgaggagttgtggctgcgttgttgtactaagtggggtgaaaacagtcaatcaagaaattaacaagggcactcaagagctgttgttacagttgtttaaagctcatcacttcattttttatttaatgtaaaaagttttcaatgcccttgcgaaaaatgcaagccaccaagacaagaagtaaaatgaaagaccaagatctctcccctcctttcccaccattgttaggtttagtgtgtatctttttaaactatatatacatacaccctcgcagctaaatatagaatcatagatgtcagtgtatgtcagggaggttttttaatacccacacatagatgtaagtttttctccaaaaatggcatctgcaacttgctgttcttaaattcatattatcacacatatttctctatgcctgaaacctagtcgacttcattgtattttaaatggctgcatagtattgcattgtgtggtcatattataacatttgttta

SEQ ID NO: 108853 - DNA, 1036 bp, Homo sapiens
attcaccctcccaaagatcctgactgaacagaattccacttccttcccatatttctgtgagtcaatagttctctctgaatattgctggctttctgttttcttggcacatggttggtatgattattaattttttttttttttttgagacagagtctcactcagccacccaggcttgagtgcagtggctccatcttggctcactgcaaccactgtctcccaggttcaagcgattctcccgcctcagtctcctgaatacctgggatcacaggtgcccgccaccacgcccggctaatttttgtacttttagtagaaatggggtttcaccatgttggccaggctgatcttgaactcctgacctcaagtgatcctctggactcagcctcccaatgtgctggtattacaggtgagagccactgcacctggcccattatactattcttttaacttttctgtaagtttagaattttttaacttataagttagaaaaagaaagggtttcctgtatattagatagttttctgtgggcaaagaacttagaacaatgcttggcttaagcatgcaaataaatgttacttgttctgatcattctaagtgctttacatgtagtatcatgtttaaccctcacaatggccttgtgaagttctgatcgtaggatgctgtcagtctctcgcatcccttttaccaggcaagtgcacacctctccaagttaccataaagtattggttgctaaaggtttacagctcccttttctctggagaattgccttcagtctaacagaaaccgccccggagattataccacacaccaaccctgggggacggtcagcaaccaatgactaaggaacaaagaggcataaaaagctagccctagtggtggcctgtaatctcagcactttggaaggccgaggtgggtggatcatctgaggtcaggagttcaagaccagcctggccaacatggtgaaaccctgtctgtactaaaaatacaaaaattagctgggcgtggtggcacatgcctgtaattccagctccttgggagg

SEQ ID NO: 108854 - DNA, 1101 bp, Homo sapiens
agtacttgatatgtgtcttccactgtgttaggtgatatgggggtgtagaaaagaaatagaagcctcctatctgtctcctctagaaatgtgcttctcaaaataactgtggcgaaggatcagtttttagaaaaattaattttcaatctgttgtagattaatataaaaatgaattaccaggaaaatgaaatgctgcttgaatgtagtggtaatgtcaaattgctgtaaaagttttcaaatactcttagtttttgcacattttatgttgaggaccagtgacagtatcagaccacactcagggtggtagcaatgctctggaagttaatgtcggtttacctacccacataaaacaatttttaaaatgactaattcattagttttatttatttatttgaaaattgaagaataacattccgtagagtgtacaaagtgccacatgacattataatagccactatttattgtgtttgttgttctgagtgctttaggtgtttggtgttatgccagcctcacggtacctgtgaggtggtcattattatctcttgcttagaaatgaagaaactgaggcacagagaggtacttaacttgcccagggtcattgagtggcatagtgatggagttggactctctgagcccatgctgtaaacattctgctctatttatatagtgagtctaagaatgctgcgtgagttcagaaaagagagggctggatacatggaggatacactggctgatgtagggtcttgagaaaggcaggacctgaatgggtgggacatgctgtatcctctcataagaaaaagctggaagggaggaggaggggggcagtttttctgcagatcaggcctggtggagcgtctgctggagccccagcaggttggggggtgggggatggtggtgagctcacgtggttttgctgttagatttatctcactagctcatgcctaataaatccagtgtgggagacagtggagtcggagaggctgggagggagacgactctagtaaccaaagcgtgaagtaaaaagagcccgactgatcagggctttaaataggactggagaagaattggcagttggtgacagattggtcaaaggaaaggaagaga

SEQ ID NO: 108855 - DNA, 1039 bp, Homo sapiens
tttctcttataaatattttggctgcaatggggaattcttccccagcctcctttaaaaaacttctcaaacagctattaagtatcatgtcaagtagaggagctccaagtagaaatcagtccctattgctgtgcagtcagcggccgagatgtctgcttatccagagccttagtgaagctgcttttcttggccattgtagactctgcagtaatggtctccatgctgctgctaaatggcctggatcctggttttagggggcagtcttgccatggggaatagagcagagcctgccctcccctacctgtatgttttcatttcctagggctgctgtaatgaagtaccaaacatttggtggcttaaagcaatggacatttattctctcatggttctagaggctgcaagcttgaaatcaacatatgcagggccatcctccctctgaagcctctagtgcaggacccttctttgcctcctccagcttctgctagctccaagtattccttggttgtggcagcctaactccaatctctgcctctgtcttcacattactgtcttccccctgtgtccatcccttccatatgtggacattagctatgccagattaggacccaccctaattcagcatgactgtcttaacttggtcctatccacagaaaccctatttccaaagaatgtcccatgcacaggtacaggggttaggactttgatatatctctttgagggaccgaattctacccatcacagtgtggctccaggggctgtctccagatcctcctctgcacatcctcctgagttggtctggtactagctattgccttctagggcctgggttggcagctcattccctcctgttttctcaggagcttgaacttatctgccatctccctttcttcctgttagcttcaattgcttccttcatcgccttcttccttgtgtgattaaaacatgcaccaagctctcacatcttagatctcctaccttagaccccatgtttgcatctctcctcctttttctccagacttccagaagcatccagtgtactcac

SEQ ID NO: 108856 - DNA, 1033 bp, Homo sapiens
tttttttctttttctaacttataagtaaaaaaaaatctaaacttacaggaaagttaaaagaatagtataatgggccaggtggggtggcttacacctgtaatcccagtactttgggaggctgaggccagaggatcacttgaggtcaggagtttgagatcagcctggccaaaatggtgaaaccccatctctactaaaagtacaaaaattagccgggcatcgtggcaggcgactgtatgtaatcccagctactcgggaggctgaggaaaaggagaatggcttgaacccgagaggtggaggttgcagtaagccgagattgcgccgctgcactccaggctgggcgacagagcgagactccatctccaaaaaaaaaaaaaaaaaaaaaaagaatagtataaggaatacccatatactctgcacctagagtcaacagttaacatttgcttcatccctctacacatttatgtgtttatgtattggtgtttaaacttcaatttctgccttctctgattgttgtcctttcaagagttctcctctacagagtataacaaatttagccattacttaggatgcaatatgtgggattatgttgaagcttttacatccttctgcttaatcaataccgtctcttgaacaggatgaacttactgctgtgaatgtaaagcaaggcttcaataatcagccagccttcactggagatgaacatggctcagccagaaatattgtaattaacccatcaaaggtaatgttatttgtttgtttcctcaaactcctgaaaaagtgtgtatatgtgacacccttaataatcactgttgataaattagtgttgtttaagccacagtccatattcagatttcccccaaataccatgtataccgtcctgccccaggatccaatcagggatcatacattgcatttccttgtcacatcttttaatttagtacagtacagctctctgcctctccctcctccccattcctgcctttttttaaaaaggcttttatgactgctattctagaagagcccaggtcagttg

SEQ ID NO: 108857 - DNA, 1191 bp, Homo sapiens
tgaaaagccatggaagggtttattattactattattgttatgactctttccctcagtttcttgtctgtaaaaaaataaggataattgacagtacttatttatttatttatttttatttgagatggagtctcctctgttgctcaggctggagtgcattggtgtgatctcggctcacgccaacctccgctctcaggttcaagcaattctcccacctcagcctcccaagtagctgggattacaggcacctgccatcgtgctcctctaatttttgtagagacgaggtttcaccatgttggccaggttggtcttgaactcctgacctcaggtgatctgcccaccttggcctcccaaagggctgggattacaggcgtgagctaccacacctggcctgatagtactttttaagaatgaaatgaatcgatacctttaaagtgtttagaacagtgactggcatacagtaaatgtagaccattgataatatgcgacaactgctacttagaactgctgttaccagccagtatttattgattatcctgtgttactccgttgggaactttgcagactttatctgtaaccttgcaatgtaggtttcattattccattttgtgtatgagggacctgagtctcagagaagttaagtaacttgctggcctagatggagttggatccctgcccaggcacctgccactagagtgcctgctcctcactcctcgctgtgaggtgatagctgctggtggcctgtgtgtggtgtgggtctgggccactggaggcaacaagcatctctaggtggaaagatgctggcaggaagcaggctgcgggactggtggctctgagcagcatctgaggagtcagaactcttgttctcatgggtgctatggggaacaggaggagcaaagcaaagtccagggtgccatggcaactagagaaagaaatatgaaactgcttgcaagatgagcagccttaattctgcctaggaatttttgggtattcaatatggtgaaaagtgacaagacatatcatgcgcatgaggtcttttttgggggaacagatagattcaaagaagcttaaaatgcttcgtggttaaactgcctggggcactgctctgtttacccctagtcatttcctctgtgccacctgaggttttgtggggatttgagtcagatgagagacttttcttggttgactatactc

SEQ ID NO: 108858 - DNA, 1038 bp, Homo sapiens
taaatgctgccctacactacctctctggtggtgtaacaccgccagtgacctttgtgagcctcacttcatttggtgtgctctgtatttgcctccatggcgggtgttcctcctctgctgagcttccatttctctctttaatactgcaggtatcccaggcctgggaggagctgcttgtatgtaatgtgacacatctctgctgtcacccattatgtgtttataatttacgtgttttcatatactagagcaaggcacaatttttgtactactaaaacaaagcactcagtgtactactgttttagctatgcatcggtgaccaagatcacagtgctaataactctaaaatggtagggtggactgcatgacccctgaaaccccttccaggtcagccttctgttcctagggttaggcattaacaaggaaggaatagtggttccagaattctggatgctaggtagagtatggtccaaaaaagctgtcattcttttcaatcctgacccctcacaccactctcagtaacattcatgatcataaactttctaataatctggcttcatggacattaagttctatttaacatcaacaactacacatgtattcatatcatctgcattgcctgaatttagaactgctctactttcagagtagcttgcatagtcactttctttgtattttctacccctgaacattccccgccccttcatcttcagtataatctgtatgtatccgtttctgttttctttcttttttttttttttttttttttgagacagactcttgctctgttgcccatgctggagtgaagtggtgtgatctcggctcactgcaacctctgcctcccagcttcaagtgattctcctgcctcagcctcctgagtagctgggattaaaggcacccactaccatgtctgactaatttttgtatttttagtagagacggggtttcgccatgttggccaggctggtcttgaactcctgacctcaggtgattggcctgcctctgcctcccaaagtgctaggattacaggtgtgagctacctca

SEQ ID NO: 108859 - DNA, 1021 bp, Homo sapiens
ctgtaggtagcctgcaaagcttaaaacatttactatcaggcttcttatagaaaaagtttgacaaccccttgtccagggttactgcctgcccaccatttatgaagctactattacatgattatttgattttgtttttgtttttaaatacttctttttttttagcttttacagccttagaaattacatattataagttcatctcatgtttttaattgcatgaaaaattggtttaagtgacgatttttaagtgatgattactgcatttttattaagttccttcaggttcctgttggagtattagcttatgaattattccttaatttctcaacagctgtacttcctccctttcaacttaataatttttagttttgtcttctcaattgcgaagttgagaatggggtaagacactctcgtattttaaacttactagtaggagacaataatacagtgatgacagggtgtcgtttttactgtttagctattgttatgcttttctccttcctctgaacatccaactttatctgtttcatttccagactgtcactctctgttgcccaagtgccttggtgtggaattattccacaaatgaaaataagagcgcaaacccaggctcacccctggatctgctgcaggtggccccgtccagcctccccatgccgggtgggaacacggctttcaatcagcaggtagactttatgtttcagtgatttgatggctgttttcattcttgacaggcatcagggcacagtgggtcaagcacaggttttagtatctagatgcttgggtgctatcccagttttgcctgctaacactctgggtgaccttagagaattgtttagcctcttcagaaccactgaaattctcgaagttgctccctttcttttcactgtcttgctgaacagttcttgctgagagttctgccacccagactgtaattatggtggtggttctaatacatgaccatgactcctgtagtagttttgatatttggtaattattatatgttcttattggtactggg

SEQ ID NO: 108860 - DNA, 1770 bp, Homo sapiens
ttaaaaaaatctttttagcaacaactagactggtgtttgaccaaacaactggatacaatagcttagccaagttaatatctaaaattgataatcacagataatttttatctcacacatatctagcaatagattgtttcatgaatgaattgccccaaaactaggatattcagttgtttttttcctcagccttatttggggagaaataaaaagtttgtcttcttttcacaatgaaaactgccgatgataatatccagcctgtgctaggcactaggactgcagagttaagttttaagacaccttcaataccttagttagctgatggcaagcatctttgatatttcaactggcttttgggaatgcatatgtggaaagaaaagatgaaacagcaacaacaaccaccatcaaaaacctttccttctcttacctttatgtgagcctgatacatattccagattattattctttttggaataatttttgattgatcaccctgcttctcaaagatatggttcaagactaatggtgccagctaggatcattcagaacgttgagagcaagggactgattgagtgtgctttttaaattcatcgcgagttcagtagcaatgcctccctacttcagtggagcatgctgatataatcctctgcttactgaggcaagttagagtgctacgtgctctttttgggtggaaaccttaaagtgtgtttttagtaaagactttcttagataaaagacttcatgaatactaagatttttaatacatataggtgagttatctggaaggaaagtagggatacccaaaattcagggggatcttggattgtttagcttcttgcactaagtattgagtaaaagctacattgtttcctggtgagggttttaccaagattatcataaccaccttagttttgtggttagcctgactatataccttcagagtgtatgcactggctaacttcaggattattgccccattcacctgcagacacttaagttacagcactctcaagaaaaaaataggggtgttttttcaaaaaaattcaagggcagaaattatgttgcaatctttctgaatgaaatcacactgtgaggttctttgtaaatcacagatatctccggagtgggtgcttgcaatgagccattagggtgcaagaaggttattagaacttctgttcagattataattttcaaaagcttcttttgtctctggaaatgaatgtaattattatgatcgtataggtatagaagttataaataagtgtgtgttgaaagtttttactaaaaaaactctttgagctgagagggtgtgtgggaaatgtttggaaatcactgccggaagcttcccctacctgagtgacttctccaggattcagagaggtgcgtgccaccagagggcgacatgtgctcaggactgagagtcctggaggctctaggcacgcacatttctggaagggccatcagtgttgccccatttagcagtaattattttgaatgttgactcaacttcagaaagacttgatgaaaactacgttttcaacccataattcagattggtcaccttttcttaatagtctggcaaaaaggataacaaaatagatggatccttctgtaatacttaacattaaattattattagtatttttccaagacagtctcagtctgttgcccaggctagagtgcagtggtactgtcttggctccctgcaacctctgcctctcaggttcaaacaattttcatgcctcagcctccccagtagctgggattataggt

SEQ ID NO: 108861 - DNA, 1086 bp, Homo sapiens
tattggagtgggtcactggataacctggcttgtcagaattatttattgtatgaggcattgagtgagtggggggcctgagggtgccaacagtagagtgatgtactttgactttgtgacagctgttcttgacagtcagtggttgtttttttcccttactatttggttttgaaatttgagttctagagggtagctggggctaggttatgtccctgtgtaagtgaaggcatccacagggaagctctaattcttttggaattgtcacagattcagcataagtgatttctttccttgtataggtttattttttgtatttcaattaaaaatgttttggaagcgctttctaaagctactataataaaacatggaaaaaagctttaaagtgttagatattcccttgcttgcttcctgcctcttgctgggtgaatgtttcatttgatgtggctggtacccctctctgttggtcattaggttgcgcccaacgatgaagctgtggtgacgctgttatgtgaatgggccgtgagctgcaaacggtctggcaagcacagggccatggctgtggcaaaactcctggagaagaggcaagcagaaattgaggcagaggtaggttccattttctttctgcttgttgaatgccgtaatgtaaaaatactgttttggggaagatcattttctcttaccctcattatgttattcttttgctcttgaggaaaaaagggaggatgtaaaaattcacataaggaagattcttatagtagaatctctctaaattgatgcagccatttatattctggactaatttaaaaatggtatcttttaaaataaaactttaggctgggcacaatggctcacacctgttataatcctagttttttgggaggagaaggcaggaaaatctcttgagcccaggagtttgaggctgcagtgagcttatgatggtgccactgtactctagcctggttgatagagtgagactctgtctctaaaaaagtaaataaataaaagataaaataatacaattttagcatctgatttagaacaaagaaatttctttgctatattgaaatatgcgtacacaaaacatacaca

SEQ ID NO: 108862 - DNA, 1030 bp, Homo sapiens
ttcttttgccccagtggttgtttatctctacttctcgagcaggaaagatatttacactgtagcttcttatgtcttccagaatttccctttggatactataaaactgtaatgaaaataatctgacaggccataacatttttcataggattggaattatatactttcagttctagatgtttctaatctctagtttttctttaacattgtgtctcaaaactggacttgttttgacctttaagtgtcagctgagttttcattctaagaatcgtcttttccctaatgtatcattcattacttatatcactcttttattcataatgggaaattctttgttagtcacaacacatattttcatttcagttaattaaaagtttaatctctgtttctcaaatgttgtagaagtgtccttttcaacaaattattttatgctatgagtgtgactttataattttctgccaaattctggtattttggatattgttccagatacttactgaaattttcaaggcaaaaaagatggaggtggtgataggaagttatagaaaatgacgagaacttgagacaattgcttaaaaactgacagtttagcctgggcacggtggctgatgcctgtaatcccagcactttgggagactgaggcgggcagaccacccgaagttgggagtttgagactagcctgaccaacatggagaaaccctgtctgtaccaaaaatacaaaattagccgggcgtggtggcacatgcctgtagtcccagctactcaggaggctgaggcaggagaattgcttgaacccgggaggtggaggttgcagtgagccgagattgcgccattgcactccagcctgggcaacaagagcaaaactgtctcaaaaaaacaaacaaaaaaaaaaaaaacacctcacagtttaggcatataccattattattttttaaaacagtagctatacttacaattaaaaacctggtattagaattgcaaacatggattcatagttcatactgttaaggcttgttttcaaaatggtgtcggg

SEQ ID NO: 108863 - DNA, 1726 bp, Homo sapiens
taaaaagtttattcttggcttcactaactttttttctggatttttattttaagtacaatttcagggagtcatttttttcattgggtgttacttttacatataaaaagcataattgggccgggcgcggtggctcatgcctgtaatcccagcactttgggaggccgaggtgggcggatcacgaggtcaggagatcgagaccatcctggctaacatggtgaaaccccgtatctactaaaaatacaaaaaattagcaggcctggtggcgggcgcctgtagtcgcagcttctcaggaggctgaggcaggagaatggcgtgaaccccagaggtggaccttgcagtgagccgagatcacaccactgcactccagcctgggcgacagagggagactctgtctcaaaatagaaaaagtaattgtagatgtattacgttactttctgggtatcttctaggagtttttatcagcaaaacaaagtattctgttaagttatttatttatttatttattttggtattttggaatatctcctgaaatgactttcaaaattaccaaacccatttatttttttcttattacagttaaaagtctctttttttgtaatttttctatgtccagggccatttcaaaacttgtcaaattatcaaacccatatttttttccttattacaattaatccattttttgttaatttttctatgtccagggatatgtcaaaacttgccaaagtttgttcttatctatcactgcctgaataatatctatgcttttctactgttacctatagacattattcatttataatataatggaataatctcacagtttatttaggggagcagaaagagtagccttatattttagagatgtatcctgaagaatttatagatgagctatcatgatgtctgggatttgtttttaaaatattctgggtaaaaaagggagacaatattaacgtccggagtttatttaatagtaatataccaatgttaacttcttagtttcaccaaatgtactgtggttctcttaagtcatttacattagagaaaactggctgaatggcatatggaactctctgtactattttgcaacttctctgtaaatcggaaattactctaataaaaagtttatttaaaagaaagaattaaggggggtgataaattaagcaaagatggcaaaatgttgaaagtgtttgaaactggttgaatggttgagggttatgtgttcctttcttgggtaaacagagctttgcatgtctctctcccaggtgtctgggtgtcagagctggacactaagcctcagcttctttattctgttgttcctgtgaccttggttttacagcctttccctgcatttaacattctacttccttggaagaaagagcttaaatgattttcagtgaccacatgtcataatgaatcatgagataatttaactataacaattcatgaaagaactgctagacaattgatattgtaggatacattttttaatagccttccaccactggttgccctaaactccctgttaccatgagttcaattcagaagaagccaaaggatatgctaatataacactgactttaggaatgctactgtctgttttttttcccttaataaaaagagaaaatctgactagcttctcattgcatgtgaggagactataaaaatatggttaagaaaagtgttttccatgtccccatctgtcatatggggccctactaaatgaaga

SEQ ID NO: 108864 - DNA, 1366 bp, Homo sapiens
tgcttagaaaataaataaactggctgggcacagtggctcacgcctgtaatcccagcactttgggaggctgaggcgggtggatcacttgaggtcaagagttcgagaccagcctggccaacatggtgaaatcctgtctctactaaaaatacaaaaattagccaacgcggtggcgggcacctgtaatcccagctactcgggaggctgaggcaggagaattgtttgaacccgggatgtggaggttgaagtgagctgagatcgcaccactgcactccagcctgggtgaaaaagcgagactcctcaaaaacaaaacaaaacaaaaacaaaataaaagcttattagattttctatgggaatcacagtggaatcttcttgaaatcacctattgtaatgtttgtagaggaaagtcatcttaaggcctgttgttccctgttgtgaagatctacaacatggcctctatccacccagttataagattgagttactgaatagttatgctcgctcaggtattcagtctggtgtcaattatcctgtcttttggagacagatgaatgggttcatcagatataagaaaattatagtgtcattcacagctaggacctatttagagtttaaaaattgatgctttttttttatacagcttggctttttctacttataagccttaaatactgaaaaatcacaattttgttttccacggaaaagcatttgaatatattaagtgtttaaaaagacatacctggggctatcttctgtgagcctcagcaagccttgctgcaagtcttcagagaagcatgagctgtttggttagccgcagcagtagcaaccccattgcaggctgctggctttactaaaaatttcctttcctttttgtgtggttttaaaatgttgcatattgacgtagatgaaactgtggtttgcaagtagtttaactttatgaaagtctcctaaagaagtttttttaatgtatacaatttcatgtatgctttcttaagcaatttatttgtcatattttttagagaaaagatcttcatttagtacctagcctttttttttttttaaagtatccaaggtatgttttgtgtcataatgatttcaaagaatatcactcttcatgccttgatggggattaataattaaagatataaggtgtttaagcaaatattttttcagtatatatagtaacacagcatttcaaagttaaaatttaaaaaatagttgcagtttttattcctgctgagacacctattattaaaaaaagaagtaaacaaaaagatgtgttttacagagtcagctaatgtatacattttatttatcttattttatgttcattatagaaaaatctggaaatagaaataaaaaaggaaca

SEQ ID NO: 108865 - DNA, 1035 bp, Homo sapiens
gaggtccttggagctggcttctgcctgtgattgtcagtctctggtacctttgtgtggctgccacatgctggtctctgttaaaatgtcaccttctcagcaaggcctttcctgttcatggcatctaacatagccattccccctatgtcgcattctctagcctcttaccacgtttgttttctcttgtctccctttgttgtttaaaatattaggttggtgcaaaagtaattgtggtttttgtgatgactttcaatggcaaaaactgcaattacttttgcaccaatctaatattttttaacttattctcctctccccctattcttacatacagcccttcttaaaggtaagctttgccagaccagaatttatttctcttgttaacggcaaaattaggaggtcccagaatagagcttgctctacagttagaagctcaatgaatatttatggaatttcagaatgaacttacttatacaactttggtcaaattaaggatttccttaactgtcaaatgatgagtttgttcagcacttctagagttttaaaatgtacttttatattttgaattgccacttcaatgtgcatagtagattaacatatatagatatccttttaaatctctggatcacagaattagaataatcataattcttgattcaggaagcattcttgttatgcagcattcaagcaaggatgactttttacagatttattttgttattcttaacgatgttaataatctccttcagactcagtaaccaaaacgaaagccaagaccttgacagtaagcagctgctcttgtctaaatggtccatcctcccacccccatgccatctctctggatacttttattccacattacctgagtcatgtgttcttcaatctttcacttttcctgttttacaaatttttgtaacatctatatgtattcctaaaagtgtgtgtgaatgaagttatgattttaaaactgtatgtaatctcttcatgatttttctatatattttactgacataaatatataaaatttgatttcatatatat

SEQ ID NO: 108866 - DNA, 1028 bp, Homo sapiens
aaagccatgatgtgtaaaatgttcaggtgtcttagcacaaatcaaggcagtgcactcaactgttcattgcattttataccttactgacatacaatcttaaacaagaaaagaaaaatcagttttaccaattgcttaataaagcaatactagtttttattaaatctcaaccataaaaatatctttttaatattttgtgtgccaaaatattaattatgtataaagtacatttgctacttatgattgtctagaggaatgaacacttgtataattgagttataagctgaattagatgcatttttcatggaacaccatttttacttgatcgaatgacaaactaataattgtacttgggtgtttggcaaacattttctcaaaactgaatgaactgagagacaatttttgacaatgataaaattcaagctttcaaactgaaagcagaattttggaaagcttctgtctgctgttgtgagtttcgtagctttccggtattgacactgtgaggaggggcaatattaattagtatgattttttggtactgtagaatgaaaagtgtttatatttacaaatttctgcatgaatgtattttatctacatgaccaatgtatgatgttataaaattgggcataagtaaaacacatagacttaaaggtcaagaccaaaagatttcagtgttacaaagtataaaatattcattgacatggttttagatccaatattgcaatcatgctttaaaaaaccacctgttgagttttgtgctgtcaaagaagaaaatccagaaggccattatttatctgtatgggattggattttcttcaacatacttttaacctaaacattttgcaagagattggacatggaagtggatatgagaatccaactgtcttctctaggccagatgttaaagagatttgcaaaaatgtagaataacatgacttgttgacataaatttttttgaaaatatttttcataaaaatgttacttgtgttaacctgctatttaaaagttttataactgtcacaattttaatt

SEQ ID NO: 108867 - DNA, 1073 bp, Homo sapiens
aaggaatataaaagtaaagatgtgttgcttccttaattttctctttcaagttttacttatacttgtgtttcgtaaatgatacttctaaacatgttcataaaggccagagtgaaagtaaaaaagtaaaagttaatatgttcatttttatttttgaaggcttatgatgcatgcaaatagactgtcttttgtacatattcagtttgctatgcaggagtaggtttgttcatatgtaatctactaacttatctactaactagataagttctagaacttatctagaaaaccttgagtaaaatgtgtgtattttaaccaaaactggtatttggggttgtgtggatcaaacctagtccaattttattgatttaaagcaatgactgtagtgttaaaaggagcatgtactacattaaaatgacatagggaatgtgtatacatttaggagaatatttattttaagggaacttgcccttaaaataaatattacatgtcgtgagctaaagggagaaattatgttgccttaaactaaagtccctgtcttttgagttcaacactcttgggaaattgtaaggaaaatgtattaacagaatccactagcatgcagctaaggacttctggagatctggggtcatgacaggcaccctgtatagtgatataaatgtcagtgtctgagatttaagagcctgttccgagaaaagccaacaaatatggagagtatattcctataaatgagttaattgagaggcacgtatactgcactcaagttttgcactgtgccggaaaccattgactgtcccaggggccttccgctcttacccctcactccagtttagagtggagcaacagcagcataagatacacattttaatatggcttagatcatgttcatttccaaacacaccttctgttctccctcctctggcctttgttgggccgtttcctaagcctggcatgggccctcttaaatttcaactttagtggagctttcctttatgttcttactgagaatgaatggttttcctctctctgaattcctatagtgcttaatttaattctacttaggccacccctcaggcttt

SEQ ID NO: 108868 - DNA, 1049 bp, Homo sapiens
atttcatctagtgaccaggggaaaccttgctgtcttggtctaatgagggcaggcttccctctgggttctgcctgcccatttgcccattttcccatttataattagttgagatatgtaaacatgctatataaatgttagctgttattatttcaatattataatttgaaccaaaccttatttaatctagttcttagctatacgtgtatgtgtaagcttaaaagtacttttgtgaacagctgcatttagagagaaatgtgaagtccaagtgcatgtttatgcatatgataaaactttcgcagcatagatgcttcttagcattacaactcaacaggcagaggagattcgtgttgacaaatgtgcttgttattaataactttgtgttacatttcaccggagagacctctagcttaccagttttaggccttttgcttttggcaggttgcaattattgctgtcttataaatgtcacatacatgatatatatacacacttccaaaactgtgtttttcattcttgtcggaatagttgagacttgtctgctaccaaaagtctgagtcagattctgatactttgccttgctgctcttttttttgtagttttcccagaaactttatattatacttaacaatataaatatagtattatactcataataagcgaggcctttgcttgtattcatttaaaaatgtagagaagcgcttaaaagataggaactttcgagtcacaaataggcaggctgaagattgacttatggaattgatgaagctgttgggagaccaatttcatgtaagaaggagcaatctgaggatagaactatcagccatataacaggggatgtgagagggatacagtgacttccatttgtttgtaaaaatgctgttttgggatttatactaatgggtacccttcatgtgtgacatgcagtgtgacttaaatatctaccttagcttttgccatagttcaaaagttgggggagggagtttctagataatgagcatccagtagagtagacggaaagtccacggcagttaaattgctcagcagaaaag

SEQ ID NO: 108869 - DNA, 1090 bp, Homo sapiens
tagtaaacttaatggacacggtgtttaaaaataaagaaaagagccgcaacgtcaccttatctagcctaattaaattgtatggactttctgttaagagttgatacagccaaaatgcattatgaacttatgttaacctctcatttccttcttaatctaggtctactaatatcttttaaaagccagtttttgttgttgtttgttttttgagacagggtcttgctctgttgtccaggctggagtgaggtggcatgatagtggatcactgcagccttaaactcctgggtttaagcagtcctcccatattagcctcccaagtagctgggactgcaggcgtgtaccactgtgtccagctaatttttatatttttcatagagataggggtctcacaatgttgccgtggtcggtctcgaacttctgaactcaagtgatcctcctgccacagtctaccaacatgctggaattacagacctgaaccactgcacctggccctaaagctggtttttaatgacattttacataagtacagctcaatgctgaccggctttgtttcccagtgatcacttttctgaggtttgtaggtatttggacctagtctttaaaaggtaaataactgtattcttgtaaataactgtaatctttttttttctcttcagaatactgttcctgccttagttgtattcagactaaattatactcaaagctgagacgtttccagtaaagtcaacatttatctttatcttgacggcgtcacatccatttttctggccttccagtttccatctccccagactgatttccttgatggtgtggatgtgtatggtgtctttggttctgtgtgttgcagggcaagcatggcctgaggatccctgtgtgtttaacaatggaatgtcatcggcttttgtttttttggaggggaagcatcttgattttcagggccatgtttatttatgcatttaattctgaaataagagggggtgcaattttataaactaaattatactgttccccattctcttttggaaatgcccatgaatgagacagattagagaggtattttgcatgaacgaatgatggagagaccaaaaaaaaa

SEQ ID NO: 108870 - DNA, 1043 bp, Homo sapiens
tcttcaaacctcagagttaagcagaagtataattacagtttttaatcattgctgtgtcttatcaaccacggcttttaagaaaatgaaaaatttttcgtttacctttcattgtggtggctggctgtccattcacctcatacggtgtcttcaagttgaaacaggtttcttgtctctaattaagaataagctttgaaactaaggtcggcagggaagtggattttctggtaaagcatgaaaacgaaacatctcccctaccagacaaggtaggtatctcccttacccctttagagattgtcctttggggcaccctttcaaattctcctgccaggcgactactggaacaacttgctctcttgctaatgtaaatgactcataactaagagtaggtgagatttgtcgactggggaagagtatttcctgaacctgcaggaatcagatggtgattcacctgaaggaaacacagagggctggagcttagactgccagaagtctgcttaaggagtgggggatgaagtctcgggttggggcctactaactcatcagatccaatttttaggtcattttttttttccagcctcctattgctatctagaaaacatgtatttgcagccttcctgccaattaaattttggattaaaagaaataagaatatgctttatgacagatgaattctttgaaaatattattctacatattatttaaagagtattgttgtaattgataactttggaaacttgtagtcttatgaaactaatgaaatctgtagacatatttttacacatacacaatagacatatttttacacatacacaatgataagtattcaaaatatgttaaattattcaggggctgggttcactgactcctttgaatgctgacctttaacataaaacaatttattttattgctttaaaaaagcatccaacaatgacaaatttatataatcatatcacttttttttttttttttttttttttttttttgtgagacggagtctcacactgttgcccgggctggtatgcagtggcatgatctcagcttgc

SEQ ID NO: 108871 - DNA, 1047 bp, Homo sapiens
agatgtaatttactatttcatgccagactagaccgaactctgatttaaggaaagagcatttcttcacattcttgtctctcggctgcctgttggtcagaatcatgttaggcaaagagagtaagaacatgaatgcccagatgacaacagagagaatcttagcccccaagagatttttggggttggatgttttaaatggcctggtggtcttctggtagcgatcgatagttatcagtcccaggaatgaaatactgatatacattgtgaaataaaatatgacggaggtaacttgacacacaaaagttctcagtggtcctgttcccagtttggcatcactaagaattttgaatggaaaagtcagaatcatgagaagatcagaaatgactgtgttcttaagaaaaataataaagtttgatttactccggatttgaaagaaaatcctcatcgccaggccatttgtgataagtccaacaaaaaacaggacagtgtagagcagtgggaagaggacctgggtgattttgtagtctctggtgcacagactggtgttaccaggcgcagaggtgaggttgtcgacggcttgcatttcttgttggttacctagagaacaaaagagaggatggttattttcagcctaaggtagttattattgctgttatctctgtgtgtaacttttttggacacagcctcctctaaaagttgaggtttctcatcttcattgtagtagttagtatgaacacagaaaactgaatcccaaaatatttcattgcagcaaatattgcatctctgctgaagagaaatgatctgaagtacaatatgtgaagttatagatgcttagtatttttttatttgttgaatgtttgcctcttaaagcacattttgtcttagagctcactcatatttatatgcaaaagctggaagagaaataatggggctgtgctttactcttctctagcttcccctccatgccttttagctttttggtttctattcacagtcacttttccccccaacgtccttatttctgagcttcttttactgtagtaccgtcaa

SEQ ID NO: 108872 - DNA, 1079 bp, Homo sapiens
cagaactgcatgttttattgctttctgtaggcttaggtggaaagctcatgcaaatgtctagtgttcggaaaaaggaaagataatacagaaataaaagggaaattttagaacagtctgtgtgtctcatacatcaaagtttcgctttggagtttctgttataactgtgagagcaggggaaaggatgctttctccggtgtaacacctgtttctgattttagttcctccgaacgcaggggtgtatggttggtggcccccctcatcgccaggttgccaacttctgtgcaaggaagagtgctgaaagccgctggggaagagctggagaagggacagcacttgggttcttcttccaaaaaggaaagggacagacagaaacagaaaaggtgtggctggaagatgggcgtctgtgtgagagtttaaagaataattgagaaagtctcacttcctgtaaacctgtgtggtcactgtacccacagtccactgaaatttagtttttaaatggaactgggaatattctattaggcaaggctgtcttattcctaaaaaatttcaggttataatccttaatacattagttctcaattctgcctttatatccaaatcactgctgaactgttaaaaacagtgatttccgagacccgctttagaccaactgaatcagatctggatagctacctgatccctgtattttatttttaattatttctatttttttattatttagatatttatgtttaaaataaatataatgtataattctggcatgttggtgtctgaactagttgctcatatttttaacatttagggctcctgttctagactagacattaagactcctcggccaccacaactaatgttttcttaatttattttatgcccaagaaaaggtttcaagtaattatatttgaaaaccgtgttactgagaaagaaagaaacctcaccctaatgtgaaaatgccaagaaacctaggagtaaaggaaaaaaattgataatttcttccattaaaaaaatattttaagcacatagatttcttgtccactaatgaataatactatagtagccaccatttattgactgcttac

SEQ ID NO: 108873 - DNA, 1074 bp, Homo sapiens
gactcatgtcttccaagacatgagtgtaacagtctttacgtgatagtgtgtttgcttcagtgttcttttttttcctcttcttttttaaaaattctctgaacatatctaacagagaaaactcttgattattgttaggaatgccttactacaatttgttgattggagcaataaaatgtgtgattgcaatactaattgtgcatggtgcacatgagagttttgttataacttagtttctaccttttccacctcaaagatatttggcaaaacaggattatgatagacttttttctgttcttgtttaattagatcccttagagtgtataactgtactgtctgttgtagtagctgccagccacctgtggctgtttaaatttagactatttaaaattaaattaataatatagttcctcagtcacactagtcacatttcaagtgttcagtggtagccaaatgtggccagcaggactagcttcaatggtgtgtgacgtgcactgtgtttagaagggcctgtgtttaaaaaggcttcatgcttagtttaatgctctgcagtttctctgtggaaattcttactaagttttgatcagggagccttgtgttttcgttattcactgagaccccaaaattatgcagttcgttcttgtggctagtagttatcttattggacagcgcagagagaaaacattgcagccatcatagaaagttctgttggatagtactgtcttagcagcatcatgtaaaacgtgtccatctagtggatagcagcacagctcccatctgttaccatcaatggctgcatgacgactccaagtaatcgctctttggaaagttagcaaggttgatggtaacacatttgagaaaatagatattttggataataatttggaaaatgtgcattgtatgtacaatttttataataaatagcagcatagcatggcccacaaacttgaatttcaaagcccaaaagttctgggttcaaatcccacctgtgccatttgctttcttaataagttacctctagctctgttttttcatttttaaagtagggataacgaaactgctgaccttaaagggctc

SEQ ID NO: 108874 - DNA, 1030 bp, Homo sapiens
agccaaagctcttcattctttgtttttttctttgctagagaagagggtggtaaggtagctgttgaagataagtgaactcttcctgttttggggttctgattcatgctgtatcaaagtggtaatggtaacacattgccccccatcccctgacttgtcctgctgctatctggtgacattcacagttgaattcaataaatgcttttttcttagggtagtgcagaagtgattgcagtcgtgtgtgtggtggagaccagcaccctgccagatgttatagagcgtgccagtgaaacatcacttcctgccactagaggacttagaatcataggaagtggctcaatggcagcactgcctgtggaaagtagtttacggttgctgaatttttgacagaagagctggaggcattgtattagtttgctagaactccctaacaaagtacgcaaactagatgtcttcaacaacagaaatgtactgtctgttttggaggccagaaatccaagattaaggtgtcagcagggttgttggttccctctgagggctgtgagagagaatctgttccatgcctctcctccagcttctggtggctcgctgggactctttggcatcgctcggcccgtggaagcagcaccctgagctttgcctccaccttcgcaggcattctccctgtgcatatacgtgtctacttttttataaggataccagtccttatgcgttttcactttttataaggacaccagtcatattggtttaggtcccatcctaattatctaatttcaacttgattaccactgtaaagaccctgtttctaaataaggtcacattctgaggtactgggtgttacgactccagcatgtcttttttagggaacataattcaaccgaaataataacaggtcagaaggtgagagaagtttgggaagccttgacagaggaggctgaatgtggcagatgttgaaggcagtaggatttgattcattgctttttttttttttttttgaaaagaagaaattgaatgttaattttttttagagtta

SEQ ID NO: 108875 - DNA, 1043 bp, Homo sapiens
gagaccagcctggccaacatggtgaaaccccatctctattagaaatacaaaaattagccaggcgtggtggtgtgcacctgtaatctcagctacttgagaggctgaggcaggagaattgcttgaacccttgaggcggaggtagcagtgagtggagatcgtgccactgcactccagcctgggcgacagagtgagattctcatctcaaaaaaacaaaacaaaacataacaacaacgaaaaaattctgtttgttcttccttactcgaaggtttgttatttgagacatacactgcgtttcttgcactgtcacatggcctttttaaaaataaggtattcagctcttagtaattgtgcattaaatgtttgtttactaactgcctagcaacgtaataaggctgttggatttgacagaacttgcagaaaataagtgctgattgtttctcagagctcgcctttgtatttctgctaagtatatttatttagggtctgcccatgaaatgaaaactgaacagtggaatttgtactcaggaagttatgtaacactttatggcagggcttaaaacaatgaaaattcagccactgcatgtttcaaacaagtatttgctgtgttgccaaagtagaaagagcagaagggaaacatcatgggaagaaagactattttgtttctgattgcaggggtccttggggcatattatgtttatactcctctctcagataatattgaggaactctggtgactggtgtggatagctacacctgtgaaaatggtaacaaatttggtaagttcagaatttcattgtctctgtgaatatttaagtttaatcaggagaaaataattaccagctatattatttttaaaactttctgctgtcttggaaattttgctcttaaagtttgcttgacgattttcaaaccttaaaaaaaaaaacaaacttcattctttaacacaaatccctaacagaataagtatgaaggaagtattcaagtaattttaattttaaatattagaaaacaaaatatgctggctgagaaaaacaatcttactg

SEQ ID NO: 108876 - DNA, 1065 bp, Homo sapiens
atggtttgagatattattgcttgtgtttacatttccacatttgaggcaaagttagactccaagttgaattcattaaattttgattccaacattctgttcttcctttgggcacagaattcctatgaaatgaaacactgggttttgttccagaacaagaacagactaacccaaaatttctcctgggggaaaaaaaaagagtaaaattatatttctcattgaaaattgtatttctcattgaggaagggtgtgttactttattatataaaatgccttatcttcattataagaaaaaaatgcccttgcatttgtcactgttgccatacattaggcctgtatttgatagatctatatggaaacagagaataaataatcttgctgcaccttctggctttctgcttggtgatagatgtgcggattagagaacatctcaggtcttggttaggagaagctgaaaagaataggtgattgggtttttaaaattctgtatgcaaaggcattagggtgggtagtagatatgagagtcaaaagagtggaggaaagaagtgaaataggttcacgaagtgattggcccaaaataaaatcccatcaaccatatggatcatagagaatgtgacatagaaagattttaaagtgtatggtttttttaggccaaaaagcttcatatgtttggaaatctagaatgtgctgtccagtacagtagccacatgtggctgttgagcacttgaaatgtgtcttgtccagattgagaagtgtaaaatactaccggttttgaaaactttatatgaggggaagaaagtaaaacatctgattaatatttttatatttatgatatgttttaatgataatttttgatatattggttctaatagaagatcttactagattaacttcacctgtttcttttctctctctctctctctctctctctctctctttcatggtgtctagaaaatataacaaatgtggctaacatcgtatttattttggacagtgttgttctaggataaagcaggaaaacaatattctgggagaaagcttaaagattttgctggtcaaaacaataaa

SEQ ID NO: 108877 - DNA, 1129 bp, Homo sapiens
tcatgccactgcactccagtctggcaacagagcaagactcttgtctcaaaaaaaaaaaaaaaaaaaaaaaaaaggctaatgtttataccaggcaggtagaaaaacaaaaacggacctcattagaggatacatgaggtttctaaaagtggaactcctttgtaaatgtaagaagtgatatcaatattattattattttaatatacttattttgaagtaactaagtttttttgtttatttcttgaaagaaacaatagattggggaaaaaccatttactcttttcatgccctagtttctaaatctgtgacattataaaggtgtaaatatttatgaaaatagtagaagttgccactggctgtattcttttaagtaaggtatctcatttaatcttttctactgtaaagtagccgtaaagtaataagacttttaccttaaagatcatgactagaacaattttttcatttgcggagatatgaggcttgtcatttttattattccaatgttcatgtttttaaccaatttttcttgtcttgcctccactgattatatataaagaatagcgatgagaatatagctgtaattatgattactaacatctttgaatactttctgtgtgctaagctaaggtttataattaattcatttattcctcagaacaaccctatggtataggtactgttaatattctgattttacagataggggaactgaagcacagacaagtccaattaattgtgcaaaggtacttaattaataagtagcacaataaggagttgaaccaaggtagcccagctttagaatccatgctcctgtgtaaaagaataaaaacagattttaaaaatacttattttggatgctgataggagcttgagaacataaacgtttggaatactttaaaagacttgtactttctacatcatttgaagagattccagaagaatgggcagaaagtaagaggatagagagaaaaggcctggggtgaggggtgggaagcattaataggataggaagaaatgaggaatcaggtgttcaagggagattggtgctacacttttgaggtcattgatgaccagctagtaagtttaataatacgtagtgtggaacataaacagacacttggtgtttagggta

SEQ ID NO: 108878 - DNA, 1054 bp, Homo sapiens
gaagcttaactgtgggcaggaggagggagaactgggagaccaagaaagatacagaaagataggttaaagacttgtgagtaggaaggtaagaaaaagttcatgcttaagggctactgttatggctatgaaatattcgtgacgcataatattattatccactattgctaatgaacatggagaaagagtaatgaagttttagaaaggctgccgtgtgcaatgagatagggagctgtccaaggacagggctagattgtgaggcagtgaaagggcctatgtgaccctggaacataataatttatagaggcaatgattgtgtgtgtgtgtgtgtgtgtgtgtgtgttttcaaatgtatgtttcagtgtgttcatgtgttgtattcatatatgtgttcatgtgtgtgtgtttgtatattttgtaccctagaagtaatccaaatcctgatgcagcagttgataatttagtttaccaatatttttggaactccatctattttgcatcattatggctaagccatggggttactgagatgaataatatattttttctgtccttaaaaacatatggtctagtgggtcagatatataaggaaataaaacactgtatagggcataggtgcagagataattcagagaaggcagtattacgatatggatggatagagatggggataatgacatcttggtagctttttggaggaagtaacatcttagctggctttagaggaagaaaatagttacatgtgaggcacttgaagattctgaagagaaggagtaaagacattgttgaccatgcaggtggtccattctcaaggcatgaaatcattgagtaattcttaatgcagaacaaagtttcaggaagatagacacagcttacagtttatgactggacctttgttttttttttttttttttttatagaaactggcattaagacctaggaacttttttgaaaaccaaaatatttcttgaacactggggatgaggtttttttttttttttttttgatggagtctcacactgtcttccggcctggagtgcagtggcgcaatctcggc

SEQ ID NO: 108879 - DNA, 1016 bp, Homo sapiens
tgatactgtaggacatcagtgaagtgctacttagtaaatcttaacctatctcttttttctacaggttggtactaagaagtgcctttcctgacgtctctgctgcttggaaccgcttctagagcagtctctgcttttgccttgcttgctgccagctagactgtgacgacagcacatccaccctccacctctagcccagacacccccatttctacttataatcaagagaaaagctctaagtatctggcattgccctaggctgctttagtgttaaaagaaaagtttgctgaaaaagtaagatatcttctgccaggaaatcaaggaggaaaaaaaaaatcattttctcgattttgctctaaactgctgcatctgtctatgccaaactaatcaataccgattgcaccaccaaactccattgcaaattcagctgtgaggagattccctttcagacaactttgctgaaagcagcttggaaattcggtgtcgaagggtctgccacgttttcatgcttgcattttgggctccaaattggcactgggaaggggttactgagagcacaaggctgataccaggccctacttttaaacgttcatctacttacaatcctagtatttctctaaaaaccaaaacctctttgaattaacagtttcatgctgtgaatttctagtgggagatcttttccttgatattgacgacacaattttccatgtacttttaaagcagggagtggggaaaagtattttgaggggacattttcatcatcagttcagctttttttttttggttgttgctcttttttgggggggttgggtttgttggtttcactgaaacatttaactacctgtaaaatctaaacatggctgttagtgtcacaccaattcgggacacaaaatggctaacactggaagtatgtagagagttccagagggggacttgctcacggccagacacggaatgtaaatttgcacatccttcgaaaagctgccaagttgaaaatggacgagtaatcgcctgctttg

SEQ ID NO: 108880 - DNA, 1029 bp, Homo sapiens
ttgtaatgacaatgactgagttttttcctgccaagttcagttccattttttttttaagtaaaatatcagactatgtgaatttatagacttatttctcagagtatattaaaaatagtggaagttgggagatttttaattcttcatgagtccaagctgagacatagctacaactgacaggatctgttcaccatacatacttccaagtttggaaactatcagcaggcacctgcaactaaacccacaagcgtaaatgttccagagtgttagaatcttattcgcataatacctagcaagatcccagatgtaaacgggagaactcaaatgttcctttggattccgtgatggctgagaagcatccaggcctgctaactcactgaagaagaatccagcagaaggggactggacagaacctacttttgcataaccactgatcccacctaaagcagccagtgctgcatagacaaagccaagccagtataaaggcacctgtgggccagggtccatctgcattgttctcttctaattctctccagacaggagactgcagcaggcctgcacctataccactttcctgaaggtctgggtaaattgatgaggggacacaaactgtacgatgcttattttttaaaatgaaaagatgtttaacaaagcattttattcatatatgaaaacattcaagtttattccctctagacttcaaagtataactaaatgaaatgttttgaagtgcattaaaatgggtaattctttcatatataaaaacagaaaagtgaaattttcatgcttttattaacacttatagtgagtttataattttttaaaatgtgtggcacagtctcaagctagtggttagcattatttgcaagtttgtctatagagtgcattttgtcttttctatttctagaactcttaaattcccttgggacaagaaatgaaacaaatataagaatgtaaattatgaattctctttcttggaagtttaattttaaaaaatagtttaagtacttttagagtgggaatttagaacac

SEQ ID NO: 108881 - DNA, 1096 bp, Homo sapiens
gcaatctgacaatgtataacaaagtacaagtttaacctgaatatccttgaatagaaatccaagttcaacatatattcagtatacaatcaatccttgtcctgctgtcacctgggcagagagtggacagtggcacagcattaagtcagctgcggctcagggaagtgttggtggacagagaatgccctaggccctagtttctgacagcttgttgataagatttggaatgcacagatagttcttgttgtctgcaggttgctgctttgtgctgggaggggttggggattagaggtgctacttgagggcacttcatcaggcaagagccatcgacctggcagagcagctaaacatggcattcaaaccaacatgttcagaggcataattattttaagttgaaatggtataatctatattgtattgtttcttctcaatgaatcacattaggtattacatattctgttttttcatatttttgttagtaaaaatgtatagctaaatgcaaagagtttgtttcccaagcaatttttgaggtcaacagaagagttccctaagaaaggccttcttaacattgacagtattgacttttggggctggataattctttgttgcgaggggctgtcttgtatgttgtaggacacttagcagcatccctggcgtccatccattgaatataatagttcccctccagctgtgacaaccaaaaatgtctttagacattgccaggtgtctcctgagaggcaaaataactcagttgaaaaccactgccctaagaaaaagggaatacttgaaattcattttatttttctaaatatagaatcagggccagagtgaatagaggatatattttatcttttaacaaatttcttttgtactataagaattacatttgtaatatataccttatattgcaaaaagttttactacagagctctcttgaatactacatatattcagatatcatgtaacttcttattcctgtcagatggcagaattagttattaatacattctaatgtctcttttattctaaagagtcttctataattctgttcattactgctgagtaaagaaaataaattgttaaatattaccttaaagaa

SEQ ID NO: 108882 - DNA, 1047 bp, Homo sapiens
aactagaaatcacatcatccgatatttatctagggattttaattgtacaataaattgactacagttacatttacctaatcaccagaattatgaggattacaaagtagatattttaatcctttttaaatgaaaatagagataatttctttacattaaattataaactcatgatcagcgatgctgtggacactttgatcaaagtgattgatcaaagtgattatctaggattactttttaaagtaatacttagaaaaatttagcttgttagttccagcttaatagaaagtgaagtccatgctgcttattggtgaacatgtagctatatgtctttgaatacgtttcttaatattggccattaactattaaattgacttctcaaaatgttaaaatggacaaagtccctgtttcttgttataattagctttctgttcctgcttttgattgttattctccaagatgactgagttaattatacaaatatggtgaacacaaaacatattacctcaaagggatatctccttaaagaatatgcaaatgaccctccacttttgaataaattcaaatattgacattaatctccttagaatcccagtgctttaacttgagagcattgctgagtttaatactacttataaaacttacgttattttgaccattttgaaatatagtttttcatgtattaaaaaattagagatcaaatgacaggattattcatattatccagatttgtatggtgtgttgtaagctatgcattattttattcagtattcatgaccttttaaatagatgttaatagtgttttcattgtgaagattccttagctagtaaagtgataggaactggaactcacaatttttgactccaaaccctattgtctgtccgctatattattgctatttagttaacaaaagaaggtttatttagaattaatttacattttcttgggaaattttcctgattatgttttcttttgattatttaaagtttataattattccatagatgtttttctggaaatagaacttaaatgttttcagtgaatatctt

SEQ ID NO: 108883 - DNA, 1031 bp, Homo sapiens
tcataggtatgtcgagagtaccaacgtggcaattgcaaccgaggagaaaatgattgtcggtttgctcatcctgctgacagcacaatgattgacaccaatgacaacacagtcactgtgtgtatggattacatcaaagggagatgctctcgggaaaagtgcaaatactttcatccccctgcacatttgcaagccaagatcaaggctgcccaataccaggtcaaccaggctgcagctgcacaggctgcagccaccgcagctgccatggtgagtagagatatcagctctctccttgttagcagtcagaaaagcaaagtgagcaactatatctgactacaagctattcatttagtaacctttttaaaaaaattgctgaagatatgtttgttcaggtatcccagacaatatataaagaagttactttcacagaagtgagggtaactcctcaaatggttcagattgctcctactcttggcctaactcttaatctgtcttattgtggatgtagggtttctgaaatctctgctttgtaaagaaccacctgtctccttttcaacttaacgatattgccattttcagtcttcttatttctgtgtgccatctaatcagccattgttttcctttggtgtgttcttttgcacatcaaggctcttctttacatatatcttgcttttaacaataacatgatctggaactatttaggagaattgttcaacaaaattgttcttagaattagctacaggattttgagtagtatactatctagattgtctgaaataatattgtggcataaacataatagtaacactagagaagcttgactatgccattatatagacaggagagagacagcagtactcaaggagttagaaattggatcattaagaatagctactaaactatattctcaaggtaaattttaatgtgatctagtagctgattttaatgagcccattctttgttctttgcttacctgttttaatgttgtcatttttttacataaatatatgacttaaatcaatgaaatactcatt

SEQ ID NO: 108884 - DNA, 1384 bp, Homo sapiens
aacctatggtgtacctcacagcccctcaaaatccactgctaagtttaacttatatctattgggcaagtccatttcccttttactaacacttgtcaattaaatgccattttctgtttaattgacatggactcacataagtgttttctttacacacaacagtttcctttagtcacctttggtggattttgattggactatgagttctggtgtgtaaaaaaaatctatttcataaaagtaatatactgtatatttttataatagtaaatgagaaaaaaatactttcattcaaacagataactgtatatatgaagtaaatacttgtattttgacttagattttgaatgtctgactatgaacactatataaaattcttgtttttgacttagcatattaagcctgtttgtgtcaattttcttgatttgatggtaacaagcttttttcccccttttttttctctttcatccctcctccccttctctccttggaatgttgtcctgctttgcgctgtgattgcatgtcactcgctggtgatgatgtcctgtcacatggcttattgctgtgataaataccatgcccaattatctcttccatgttgccatggtttccatattgctacactcttctgtatgttcgcttatatgattttccctccgaaagttcccatggtgcacggtgctacgccagccactgtgtccgcagcaacaacatctgccacaagtgttcccttcgctgcaacagccacagccaaccaggtttgctaatttacagctttgtttcttaaaaaacaactctaatagggctcaatccaacagcccttacgcacgtggatttcccattgaggtcagtgggaatcgtgtgtacgtgagggctgtagagggtgctttaataagcatggggtttcaaagatacctcttgttggcctacacattctctctatgatgagcagcagaatgcttttatgccatttataagtgctccaaagtcgtcgcagctccatttctgaagctactaaaatgatatttacacaagcaattctcaattggtttcaaccaatcgtgcaggtattttgaccaatcaaaaatagaggccattttaaggtttttatttaaaatatttggtatatacagtttcttagttcttgcctaaatgattaatagaaagtaaaatacttaaatgtattacgtatgccacaaatgaccactcttgtaaataagtttgttataaattcattataatctgaatcatttaatgagcagattcaaaataaattgtttgcatgtagcatttctaagcttttattctcaatgctttcagtgaaagaaaaatcctaagcgctcttatttttataattaccctgcataaatgttggagatttatgaaggaa

SEQ ID NO: 108885 - DNA, 1027 bp, Homo sapiens
aagccatcacttaaagtatcattctttttttttcaaacatgcattatgctaatcaagcacccaaaaagaataaatcttgtttaatagaacatattacatgaattttaattttgtagaccagacctttactcttgaaaccttattaaacttcagaaaagaagtttaaattttgccctacaacaattgtgctaaaaaagagctctgtatattaggccccctgattctgcaaatgtattttatacttttagtttaggattggtaaattttggagcacattctacagttttattaaattgtacgtgttatttcattcgtgtagagatgatagacaaattttgatctgtctactcttgtaaaatggtttttgtttttatatgaagatataatgtaaatatactggttaatcaaaaagaaaattttcatattaaatgtatattagaaactgcttttagatattacctgttctaacaaagcttatctctttttcccttgtagatcatgctaaagaggaaaggacagtgtgcttggttagagtaaaggacgaggtcattagccatattgtatatatcgtcaagcaacacacacaaaagttcctcagccacaagacatccacatattgcatgttaaccagaagaaaagacaacattttccggaaatccactgcacactgttgcctatacactttgtacatttaattgatatttgtgctgaggtgatattcctgtctaaaagaacaacattgtctttcttttctagcacagagttatgcattcaaagatgcatacctagttagtttcctatatattcatgccatcttgaaaagacagactatggtgtaaccatgattctattatgtattggtacgtctgtagaccaagatataattttttaaaaataagtttatttctttcaaggtttacaaataacaaaggtgcaccttgtatttaaaattgccattatagatgagagcgtgcatgcacagtcatttttgtttaagagtaatatttttaatgtaatagattgtaag

SEQ ID NO: 108886 - DNA, 1096 bp, Homo sapiens
tatagcctctgtcaaaagtcaaaagactataaatgctttgcaaaaatggtttcacgtttgcttaaatgcttcatcacagtcacattcaaaatagtgactctaaacaaagaagaaagcagcactgtcatcagatgcatgataaaccaaaatatgaaaatgggaaatgtttaattaacctagtaattgggtgggttaagtacatgggtgaattttatatgtgatttttgttttgttttgttttgttcagattaactgcttatagccttagaaagccttttacaaaattaaaaaaaaaatagatgtgcattcagtttttaagaatggaatcatccaaaggaattcctttttttgaggtttggatgttgcagctagtaaaggatatttttgctctgttcagcagttctaaaaattgctgaagtaggggccaggtcactggtagttatagtatggaatgggagaagtgaaagttcagttatagaactttccatacttccaagtttactgcaagtttttatgcttgagagagatgctttctaatataagactgatgtgttgattttactgattgtactgtacatctattaaagccttagattattacattacgggttggaacccataccaatgtaatttcaatcgtgttaagaaagtaatggtgacttcacatgttattgtagttagttacattatagaatattacttatttttcttgttaaaatgtagtttttcatttcctacatttattagattttcattttctattaacaattgaataccatttcagtttatagacttgttttattagattttaccaatgaatttttcaaaatacaaaaaaaagtagtttttccttcataacatactcagttttgaattacatgtagtgtcacatgaatattcgtattgttaactaaatgatttatattttactgatttaatattacagtgtaagaatgtcagtcattgttagttcttgtctagttttcattaaaagaacaaagatcttttatatggatatcttataaatatataatcattgctaagtaagaagttaagttgttgctatcgcaacaatcctggcagacaattgagtaat

SEQ ID NO: 108887 - DNA, 1030 bp, Homo sapiens
caaatactcaaagtttacgtaatgaaaattatagcgtgtgtgcaaactcttgagggttgattatgctgcaatttagcatgttggaacgtctagggagaaggttgactttttgcacttctgtatatagtcaaaagagagaaacctgtataatagtaagatcttattttgaataaaaacgtctataattacaaggagttttgttaaggctaatacaatgacagactgagcaaaattgcttgcaaaagtggcacagagttagcactccataccccttcaaacatgttgctttgctttcttgtggacagcttgtagtttgccaggattttttcagctggaaagatacgccatcctttcaaaccctcatgactgacaaaaactccatggggccaaatctgcctgaagatcattaccaaaaatagcaggtacttctaccattaaggtgaaatcatggatcagatattccttacatttttcaaaactactgcatgtttaaaacttcaacaaaaaaagagagaaagaactatactaagaacatatattattcagatcagtttctgccaatttcagtggtttattgttcacaaaaaaatcttcaaaacaagtattgactttcacaaaatttaaatcataaacaggcaaaccaaacagcacactgtagctatagttgttatgtgattgttttttaattgctgtaggatcctgttctttcagcaggtgaaaaataaaacgcagttcaaatttcatggttttaattttcaactcagaagcactcaaaaatgcaaaatgtgataatgggcacttgtttaaaagaattagtgtatccagccttcactccagctggttaaaaatgttgcacttatcagcaaccctaccactttcatctgctgaaaggacaaatgtgcttggttttactattatgtaatcacaacttactttctgcttgtagttgcttaaaattatgtattttgtcttgggctgcaatttgttttatgcttattttattattactgcagtagttgactttgctgta

SEQ ID NO: 108888 - DNA, 1026 bp, Homo sapiens
ggtaacttggttaagctagaaaatactttaggtggaaaagaaagacagaagtaaagcatagaaatgagacagggagccactggaaatgtatgggatctcaggcagctaggtccagggactatgttgaaaggcaatcagggagttaacttgatttccaagacagactccagtctttggaataagacaaaggatgagactaaatttcatctgcaagagattaaagattttatattcctaagcaggggacttcaatagattaactctctggtgttgtgcagaacagagaggggtgggcctgttccttttactcatggcatctgcacatgtgcacagatagcagaatgtgaggtaagagtttgaaaataaatataacaaatgtctctggctatggagtaaagagattgatccctcctcccatggatacagtttgcgtgcagttatggcctccttccagaatttttcttcagatgctagatcactgctgattgttgtagttgctacatttttggccaagagtcaggggctaaaccaggccaaagtgtggtgtttctgcttctgttactaagctgagaaattcaaagtaactttctaagaatacttcattgaaatcatgatgataagatttagaaagaaattatgggtcatatttgttgtcataatagcctatcagtatcaaccttcagactaagaggatctatgatttaccccaaagagctgttctgtgtgaacgttctttatggtatgttagaatttaacagaattaatagacttaaggtgaattgggataatgaagtttctgggctcacagcccatgaaatcgtcttccccacttgtctaaagggaactttccattctatctggaggtgcattagagatggaatatctcctgactcggagcattttgccctgtcttgtccccacccccatcccacccctgccccttgtgactgatgctttgactcacagctgtttttctaatgcgtgtccagtcttcttttagaagctgccttcaaattgagtcctttg

SEQ ID NO: 108889 - DNA, 1046 bp, Homo sapiens
aaatgtgataattttattctcaaatgttgtttaatacataaatggtgatgctcagatgttttttgtggtctttctgttgttagcctcataatttattcaaattgactgaggagcaaagtgatctatttaatttactgttctatttaaaaaagagttgctttgccatatattaatctgacctggtgaaaaatttgcataggatcaaaatgaaatatatgtaatgttgaactatatttaacatatttataactccattgggatcactccaaacacataaccaactgccaaatcaacatacttccttggattctaacaggcatctcaaacttaacatgtccaaaactgagattttgatctttccccaaaatctgctcctcccagttttctcttctcacatttcataccaattcatcagtgaattttatggactcaactttaacacattccaccttgggttgttttcacaacctcctctgctaccaaatggtgggccaaaacctcatcatgtgtcttctagatgattgcagaatcctcctacataatctccctaatgtttatagtctcatcacagctaccagagtgattttgttaaagttagattatgtgacttcctactcagagctggccacaggcaactgcatttaatgtgaattaaaaacctgaattctcagtgatgtagaatggcctgcacctaattgttacatccctgtcttcctctcttggtatgttcccttaatcactctgctccagccactctggtcacctcgaggttccatcattacatctgatcagacctgctttctccacttcggattgctattcaaatattaacttcacagagaaacatttcctaataaccctttttaaaatgtcaagaaccatattcctcttcctcattttagtttccccactgccattcatcactttctaatatactatatattttacttatttattttgtttatagttttttccctccagtagattttaaactccatgagagttcaaatcttatggatacagaagtagatatagtatctacttca

SEQ ID NO: 108890 - DNA, 1124 bp, Homo sapiens
gcagtgatctctattggctgaaaaactgatcaggtcatatgatgattgaagtatgtttattgtaagggcagaaatgtgttggcatttggataaaaaactgctaacattatagaacttattacctaacaaaatttcacaccacaaaaaatattttaatggcaaattcaaggtgttttattgcttacaaatcagcatctttgactctttgaacatcaatttgtgtttacattgaaatgacaaaaagacaaactaagaagaaatacagcatgcaagttggaattcagagttaaaaccatgatgttgccgctcagccagctatgtgactgttgaccctttcaagaacacacatggatttaaaagttggatgacatccattgttggggccttgggggatatggtaaagcatgaaaactaaacagccaggagcctgtgaaatctgctactgtattttccaggacttcattccactccttggctaaaaaaatcttggaagtttcacagattatgatgtggacctgtcacctgtaaattgtctcaatctactcagacaagacactaaactgtctttggatactatagatgtcagtgcttatagcagctggaatttggctagtgacaatgtttaaagatgtaatactagttagtatctattgaagcttaaactttgctggtcaggttgtagctattgtaaaagtatttattgaagaagctcacagtccttcagttgtacagactgaaaaactttcatgaaagatccaacatactaatgtaaattatatttattacaatgtatgatattaatgtgtcaaactggtgtattttacaaaatatataatgcatacataaataagagttgtatattacagtgcttttcaaatatcagtgtcttggaatatttaagtcttcacattttttggtctaaaatatgaaaatgtttcatgatacaagtgattaattttccctagtagtgcttttgcatgtttgcctttttatttaagtttttttctatatagacacaatttggtgtcagactatcataagatcgatagtgaatataaaatatcttagccaaatggggtctgtattgtctacattttatatattaaataaaagtttttgttgtc

SEQ ID NO: 108891 - DNA, 2115 bp, Homo sapiens
ggagaccactttgcattggccagggtgtcttgggagcccggctggcctccgcggccggcgtcccctgcctccaccctgtgcccgagggggtgtccggtcctgcccatccgatactctggtggaaatgtggctctttgcagcatgtacgtttctccctgattttggttgatgcatatttccccgtttaagtagccgttagggcgcagtatcggcagcttgacacccaccaagcaaaagtttcagcctggaaaaaaaatgggggggaagggtggatgaaaaggagggagagaaggtggaaatggtttttttttttttttttctattttctttctttttttttttttttttttttggtcaacagccgtttttctagttccaagttttaaatacatggaaggaagtccgggagaaccatatgaaggagcaggaggagaggaagaaactttttttccttcttttccaggagtagctggaaattaagatcgggttccttttctgccagcttggaagggcaaccccatgactgattgcgattctgaggatgtctatgcaaagttggattcttgttacagtgtatccaatctgaagtattgcacatctgaactgggactgttaacactgatgccaatacagtgtggggtgccagaaagtgtctgctgatatttgtggaaaaaaaatctattttgtttacctactgtatcaaaggggagtctgggggagaatggtagtattttttttttttatcagctgtgaaaaaaatgttacagatctgcacattttcgtgtgtactatggtgtgtgtgtgtatgtgtgtggtgtgtgtgtgttttaagtttagccttttgtttttgttttttggttggcagtaaccgattttaatgactagcttttaaaaatacagtacaaagactttgtaaatgtgattcagggcccccagcacccctgtgtctgcagagtgccttcaaaactcagctgttccagccggtgccaacctgtgaacttcccaccatatcccagaatctgctattccccaaaccacttcccagtttcctttcagtaatctttctgaaggagccaggacaatagggcctgttgtttagtgaatttctttattattttcagcctttaaaatgtaatttccatctcttgcaatgaatttgtttcccttttttttgcttcattttgtttaaattttcaggtatttagctcccctttcatattatttttaaattttttaattacctgttgtagggtgttcctccagaagcaaagagcaaaattttactgttgtgatgtaccaattctaactaattgtaatttttaatttcatgcgtttaatcattgtctcttcattttaagacttttaatacaaatgtcatttttaaagaaacaaacccaaaactattgtttgtgtttctgtgtttcatattcagtgatttaatacagtatcatggctgaggtggatggggcaggtgcatgatactcttcagagctatttgtgaaattttaaagacagaagtgtctcagtgacaagttggatgacactactcccaactttttaaatttggagaaaaccatcaaggtcgaggaagccctgggtatggccattaccatctgattagaagatgaacaggtattttgaatctgatctgacatggaacagtttacctcattgtaggtagggaacaagagaacccatctattaaaattgccttagatctgggaaagtaaccatccttctggcaaagtaggatggcacttttaagtttttcttccttttttccctctgtttatattgcacatcaagtcaaaaacatgtttgggaaagatggttttcaattctgaagttatacctagtgatgttttttgcagtacatttgaatggattgtagacactgcctcaacccttttgaggttttgatttggaaatagatttaaaagaaaacaggctaagataatatccttgttctcatttacaccctgcagtttggaccacatttgacctcataagtttttccttttaacagtaggaggcagtgtgagctttttattttttatttttcttaaggtggtcttagtaatataacatgttcatacatatcaagagagtacttgg

SEQ ID NO: 108892 - DNA, 1051 bp, Homo sapiens
atttttgataaatttgtccaaatgctatgcataagtaatctgtcttcgagaaatctaaaataaaatgagaagtttgtttatggaaagtcatgataaaataatgggggaaagtattttgctgggagtcagaagacctattctctttttctacctctgcctcaaacacaatatatcaaacaaaatatgttaattgtgttgttttttattcataatggttttatattcccactgctatattcaaagctaacccttttcatctcgtttacagacaactgcagtagtcatgtaattcaactttctattatacatttttactcaaattaagaaaaaagcattgcttcaagtaatattttgtctagattactgaaaagttgaatatcttataactaagttcacatttttctcaaataactgactagggaaaccacagtatacctcaagcacgtggtacagacagcaatattactgtgacagcttatgaaattatgcagtgtatagcctgtttggcctcgcattaagcttttgtctataatatgttcaaatcaatcatttaagcaattcttgggtcttaaaacccttccctgatttttcttttcattgtccatgccataaagtccagagaatcagagaaaaactgtgattcaccatccttatatttaggtctgacatgccctgacatgccttcccagatctatttctccattgtgtcctaataagaagctgctatgccatccagactggtcttgcataactcttactcagaccaatctagaggctgactatggagcaaggtatagaaaggagaaacaaaagaagtgtcaaaaatgggtagggctagatgaaatagtttgaagataaagcaaaccaagaagaaaagttacagatgttactagaaggggatcaggagacaaaatccagaaatttgtctcggttaccacaccataactccattggttgagagagaccaaatgagtagagagactgaatcctttagctatttgatgagacctctattagacatgagagagagatggcatttgactgtctgtta

SEQ ID NO: 108893 - DNA, 1035 bp, Homo sapiens
gcttttaaaacctctctctctctctctctctctaatacaggacaaagggctttacaatagttctgtaagaaataagcaaagcacaacttcatgtaaaataattcccaggcaaacacttgtatctttgctatgatgtctttattgggaataagatctattttttacacaggctcaagtggaatttgcaaagtacaaagccaatcgaaaacaaaatacctcatgaatagaagtgttgctcaccaagagaaatctaaaatgatccatttgtgtctctctatgccatactgaaacaaattatacatagcctatactgctgtcttctggagcaatttagagcaacttggagccagtgaggcagatcttcctgtacacagacaccgtctctggcactgagtggccagtatcagcagtggctttgccctacagccagtttccagaagtccagatgaaatctttcacttctgtggcatgctgcctggatgctaatagcatctcttagacatggccacccctcacagggactccagaggatagaacaagacactccttgttgctatcactaaaaggagcagctttttgagactttcaattgagtgagtcccacccccccctcttagatgctgtcaaatccacaggacttcccctggggctttcaagagtctgccaagaggccgggcggggcggctcacacttgtaatcccagcacttttggaggccgaggcagggatcacctgaggtcaggagttcgagaccagcctgaccaacatggagaaaccccatctctgctaaaaatacaaaattagctgggcgtggtggtgcacgcctgtaatcccagctactcaggaggctgaggcagagaattgcttcaacctgggaggcggaggttgcggtgagccaagagtgcaccattgcactccagcctaggcgacaagagcaaaactccgtctcaaaaaaaaagagcctgctaaggagctcccccagctatgaagcagaaagtactacatctctaaagcaggaactaagttgttataagat

SEQ ID NO: 108894 - DNA, 1255 bp, Homo sapiens
tgcttcctccccacttcccttcccacacactcaaacctttccgtaaacttgagaaacttgacatatttagttgtctcatccctcatacaactaattttgccaaatatgagtcttactgaaatagaaattctttggccacttttacactgttcccaaatgcttaaaatggtttaatgagcacaggaaaaatgaccaatacttttaatataatattaagctataattacataaaaataattattcaactaaaggatcaaaagtttcagataagcaagcacttctctacataatgcagtcaccctggttttttattttgagcaccaagtattaaaattacaattaattaaatactgccccgccacacacatacttttaactctcttatgtatttattaaacacatgctacatgtcagacactgcactcaacatccactattccatgtaatcctctcaaaagcccatctgaaggatgctaagatcagacagaagttcagaggcaagcaattcaaaccaaagtcagtttctactgtgccactctacattcttaagaaaaaatgccttcatgaccaacacctggggaaaaaaactcttctctcatagcagcctgaatctacagatgcttgtcgctgtcaccccaccttcatccccatatgcatccttccaacccaggcagagaggatgacttaccgcattggaacatagcacccttgccccagcctttcctattccttccctgtttttgcgtagataagcccactcattattgccattaaaatttcttaacatacataacataaactgagttaatcataagcgtgtacagctctgtgtttacttaccaagacacagatgcgccaggcatttccattctgaccctttccaatcaataacctctgtccaaaggtgactgctcttgttttccattaccatggaatttctattaccatgcttcttttgtactttttgcaaatgaaatcctttagtatgtatgcttttgtatttggcttcttttgctcaacatatatccactcaatgctgaaaacacaaggctcacttcctccagtgggggctcctctgatacataaaccaatccttccatctccatcccagtctgataatcctgtttctagggcacccctctgcacaattctattatattgctggtcaacagtaagcctcataaaagcaggcagcttatccatttggttcactgcattatctctacaacattgcccaacacgtaacaggggctca

SEQ ID NO: 108895 - DNA, 1050 bp, Homo sapiens
attcataagatgcatgtatttccaaagctgtttaacattcttataaattaattcacaggattcaaatagttgctttttagcttcaactgggtattagcaaaaataatacaaaatgatccccgtgcaagcacaaatttaccttccttcctaaataaaacatgacagattatattacaacttgatagcctctcttttaaaaagtctgtgacattattaaagaggtgacggaatgcttgttttgcaaaccccaacacatctttcactgtggaccattgctattacttcattaacacagttgctcagatctcaaggtactcacggtctgaaatatattttacaattagaaggtatgcacaggtcaaaaagagcaatccaagggttagaagtccccagtgccccacactggctcattgccgaggtgacagggtgcaggctgtgtgagccaggcacacttacccctcaactgggcttctgtagctttacaatttggataactagttagcggacagtagttgggacatgtcacatacagatttgagtcctccaataatgtacactttgccaggttttatccctttgttaaagcaaatagaacagagagggaatatagctgccagtaaaaatcatttcccccctcttaatctcccatccttcatctccatgaaaccgactattaagataacctttctctctctgtgcactagtggaaaaagtaaagttctatagaaactcacagttaagagggactctgaatacagcaagttaaggcttttagtgcaaatagaatgaattcccactaaggtcaaaaggtttcaattgggtaccatgctgacttcttggtatcttttaaggcctaattttcccttccttgagattactgtagtgtgttccagctaatttctatttggaaacgagttggaacagctgaaaactaggtattattgaaggcaaagcagcctcacgtcagttttttatcagctcatttgggaaggtttttttttttttttttttttttttttaattaattagaaagtaggctgggcacggtgg

SEQ ID NO: 108896 - DNA, 1213 bp, Homo sapiens
gcatcagcgatttcagataggggatggagcaaataggaggatgcatcctgctacttccagggatggtattccttacctctttcctcttccatcactagcttgagtgaaaatccaggaaagaaggctttgagtggtgtattctaagatagaggtagctgattgctgtttcctatcacatagctaggtgtatcttagctgcaagagatgctggaaactctaagcctcaaacatcttaaggttttatagaaggtgttataggcagaaatctaagatgtcccccaatatccctccctgatactacatccataattattttatattgcatggcaaaggaatttagcagatgtaattaaggtcccaaatcatttgattttgagttagtgtcataagggacttatctcatgagtctaacctaattatgtaagaagttatttaaaagcagagttttctcccgctggtagcctaggagggagtcaaacagattccaagtgagaaaaggagttaacatgccattgctgctttgaagatggaaggagcctgtggcgaggatatgaagggcctctagaagctgtgagcagcccccagctcacagccagcaagcaaacaaggacctcagctcagcaacagcaaggacgtgaatcctgccaataacagaaatgagcttgaaagaagacaccaagctccaggtaagaaagcagccagccaacacttagagccttgtgaaactctaagcagagaacccacccatgctattctagacttctgactacagaactgtgagatattaaatgggtattgttttatgccactaagtgtgtggcaatttgttatgcagcaaaaaaaaaactaatgtcaaggaagtcatttttttacttctaccaaggttcacaaggtggtaaaatttcacaaacacaagggttcagatacgaggtgaccaaatgaatggtagaatatgctccaggggataagggaactgtgcactatgtaagataagcgatttagtcctgcaggtttatgccaactacgagaagaaacagcatgacccatctcctaaaaatgttctagtcttctagggcagctgatgccagcatgtacccaaagagaaaagattagtcctctgaaatgttagctacagataccttttaaatagagctctgatttggccaaaaacccaggaaactgtatacttaactgaaaacaacctagagtaaaa

SEQ ID NO: 108897 - DNA, 1068 bp, Homo sapiens
aatattagagcatactggttttgcctctaacgtcgaggtgaccatctggtctttcttgctctgtaagagtttctgtttgtgcttttttttcccttacttttattatccagtttaaatccagtcagttggccaaaatggtcttggaagaaaggatttagagattctgtaaaaaagattattagttggttctgtgtttgcaaaccagtatgtaattcccatatgaatggggaaaatgttcctgaggaattatttaattgatgaggcattcacagagattaaagcagttattgttacctccaatttatgtcttctgcacagctgattaggttggacattttaatccaaggtgctacttacattctgtttcttttgtttacaaaatagggcattactgagtagaaaatacattccaggtctaagaactgtttgttctttagtggattttaaagaataagacattaaattaagaaggaaaatctgtttgattcatcattttgagtaatgcagagaataactcttaaaaaaaaaacctgaaacagaaactttcaggaaaaaaacaaaagaaattaaactactgaataatctttcaaaagcatcgttgaacagtgagcacatgtgatgccttcccaattaattaatttgggcaaaagctctagataaacttacaccaattgttgcaaggcattctctattactgcatttttaaaacaaagtcctcccctaaaagttatgaattatacaaaagctttaggaggaattttagtactcctttacccaaaataaatagtggtaaatttccttctgttcttagctctgagtttgtatttatttataagtcattgtgatcatgtatacttatatatttttaatatgctaattgcttttaaatgggatttttgttctgattttaaaataatacatcctccctggacaatatttggaaatgtagcaaagtaaatcatgttaccattgttccattttgatatatataaactttaggtattattttatatataataaattttaagatattatatacaataaaattaaccaatttaagtatatgat

SEQ ID NO: 108898 - DNA, 1359 bp, Homo sapiens
cgctaatgacagtctctttctattcattaataaactaccctgtattcagatttaacatgtaatagaggatcataatcatgtacataattcagattaaagagacattttctgctcccaaaagccacgtgtatctgagggtaaacatttatcacctatcttggtaaaatttaaatgtaatttggtttttagaggcagtatcttttttctgtggctctacattctgtttcatgtgacatattatgggaaagttcatgtttttttgtctttgagcttattcagcttgtctttcctttttccccatttccctcctcttaaaaaaaaaagcaaactataaagaaaatctgtgaatttgaaaatatataatagcatttaagtcagtttaatagtgtgttctttttgattagtgtattatgtacagtttggatgccattttgtgtaaaatacataattaatatattactatatacttaattgtataaaggtctggaacttcagtggtggttgtctcttaaggactaggatcatggggagtgtatgtgtttttagttttatcagttataaaattctttgaattttttacaaagaaaattaaatattagtagaatattaagcttttactaaagtaaagagggaaaccagtagtaatctttgtttgcgggagaaatatagatttcttcatttctttgccccatagggctgggaagaggctaggcgacgtggtttcagatacgaaaaggactattgctgggaatattttctgtcttcaaacacactgcaggtaatggtgaatgttttgcagtaattatcatatatgctagattagagaatatatacatccattttgtacaattagatctatagcaaaaaagtcaaatatatggaaattgagtatatttgtatatatacacaaagtaatgggggatctttctgaaatcaactgcaacaaaacaaggaaaagaaacatggttccagaggataagagcaaggcacagtagggttcgatttctgttcctgtccccacattctagttgctattttgatgattcaaactgagaatttttgctaacactactaaaatctgttgaaaagtatcaaataggatagatatctgtaagttttctggtttagtatagtgaaacaccacaggcaagcatttgtaaaacagaagaaaacagtaaagagggcatatgccatcacatttcagactacactgaactgggtattcgaagccagtgagaatagaaatatcctcatcttctcccagtacacatacactccagctatgtgacatgaggcctgatactggacatttaacagatctacaaattagtaaacaaaaaaatctaacataccaaatca

SEQ ID NO: 108899 - DNA, 1004 bp, Homo sapiens
agagagtagtggcttgttactctttttaaagcaagctaaaatcgttttaaatgtaatgctttacaggatctattttaaacacacactcttcctttacagaacgctttggataaacaagaagaattgacacctcttggagtccacttggcacgattacccgttgagccacatattggaaaaatgattctttttggagcactgttctgctgcttagacccagtactcactattgctgctagtctcagtttcaaagatccatttgtcattccactggtaagaaaaatggaaataaaaccgagttattttagatgtgaacaggagttgcttagatatatttttcattagcgttttattagaatgtcattctccattatagcatcagagcaatttaaattggctatgtctgctatttttaagggaaaagaaaagattgcagatgcaagaagaaaggaattggcaaaggatactagaagtgatcacttaacagttgtgaatgcgtttgaggtaaaaaaaaaaaattttgtcctggattatgatagtttattcaaatgaaatgctaataatagaataaggatcatatttaaccttttgaaatctctgttataaggccgggcgcggtggctcatgcctgtaatcatagcactttgggaggctgaggcaggtgtatcacctgaagtcaggagtttgagaccaggctggccaacatggcgaaaccctgtctctactacaaatacaaaaattagctgtgtgtggtggtgggcatttgtaatcccagctactcaggaggctgaggcaggagaattgcttgaactccggggcgcggtggttgcagtgagctgaaatcatgccactgcacttcagcctgggcgatggagtgagactcaatctcaaaaaaaccaaaaaaccaaaatctatattatcataggtatcaggagtaaattactgagaatgttgaaatttagctgaacatttgaaaaaagttataattcatttttaattttgta

SEQ ID NO: 108900 - DNA, 1029 bp, Homo sapiens
gatgtcgtttatgtgatagatggaggaaaaataaaagagacgcattttgatactcagaacaatatcagtacaatgtccgctgagtgggttagtaaagctaatgccaaacagagaaaaggtcgagctggaaggtaaggtgggaactctgtccaaagcttttagaacacacaaaaattttgtgtaacaaaatgtgatgttggcatttaaagatatttattaaaagagttacctttcttattattttgagcttattgcaaaacatttttaaataggaaagttgttctaatcgtagtttgtttggaaaagtatctgccaagttttctattttatgaatcttttgccttcaatttctaagtttgattaataagttatgttacttataatagttggttttcatttttttaaagcatatattgtgtgataataatagcaactaatactttttgagtgtcagatcatctcctgaacacttgatccatattaactttcttaatcctcactacagtactatgaggtaggttattatatccattttacagataaggaaattaaggtacaaggaaattaaatgacttgtccaaagtcccatagctttctaaattacagagccaggatttgaatccaggcattctgactacacaggctaggctcctaatcactgaattttatagcagtactgatttttcaccagtagttttcaatgaaagcacaaggaaagtacttttcctcataatgtcataataacttaagaagtaaaactatctctgtcttaatgataggaaaaatgatctgtcttgaacttctacaaagaattggactttaatgcatatttcacagtatttctgcacttattcatatgagtgataagagccatatatggattttcagaagagggtttttcttttgcctcttacagatagaatgagagatttccattaatctttcgatacagacttaagaaaaggagagttgaaagaaaactttacaggccatttatcaacccctcgttttaagtttgtacaatatcca

SEQ ID NO: 108901 - DNA, 1023 bp, Homo sapiens
tcagggatgggatttaggagtctgtattttacaagctctctgagggattcaattcttacgtgcagtcaggtttggacttaacattaatattaacttttgttctaaagcaaacttaaaatagaaggtaaaagttacttactttagtctttttctaaatttttgactaaaaatgatctataggtttatatacttcaataaagaagaatgatttttatccaaaatatcaggttttataagttaatgaacacaaactgatattttagctagcattcacttgaaagcataatgaaaatgttctttggaatcctttttgaaaatcctaaatataaaatgtcacagattttagctaaaactagagtttcaaaaaagtgaagatattcaagaatgtttttattttaggtatgttccagaacaaaaagaacacagatcccagtttaagaggggtttcatgcaagggcatgtaaatagacaagaaaaagaagaaaaagaagcaatatataaagaacgttggccagattatgtaagggaactgcgaagaaggtaagtttattttgtctgaaggtgagaaatcagtggctaaataaaacaaaaagccagaggctgggggcatcttcttgaatctgtacgtacttaaaggagagcattgtgagtctcttattcgagctaaatattgtgctgatttgacttttaagcagtaattaccccagtaattctctccgatctgtagattatgttcctccatttgcagattgagttaattttaagcttttgtagcaagttaacagaaaacttgattaagtatttcatgactttgtgtttaactttgataggtattctgcaagtactgtagatgttatagaaatgatggaggatgataaagttgatctgaatttgattgttgccctcatccgatacattgttttggaagaagaggttagttttatttttctttcttcagttaacataattttaattttattaacgtatcaaggccatgaaaaatacagttttcttaaatgctta

SEQ ID NO: 108902 - DNA, 1103 bp, Homo sapiens
tgtgaatggtcgtatcttttaaaagaaattaacattatatcaatgacaacaaagataatgtataatgaacttgaagtatttcccattaccccattgtggtaggtgttcttataagtaaaaaattaagtgtgaagattttcattaaaactgaaagcatttctaaaattgaagatataaacctttgtggtagttaattattagaagagaaaaccaaggcttattaattcatgtctttcattcacagtcggttgccaaggaaacagggttctatcttatactgtacaacaggaatcatccttcagtggctccagtcagacccgtgagtatgtttcaattaaggaaatataagtgttatcaaaagatgtaattattaaattggattttactagttgttaaagaaaaatggttttaaaattttgtacttcacacttctgccttaggtatttgtccagtgttagtcatatcgtacttgatgaaatccatgaaagaaatctgcagtcagatgttttaatgactgttgttaaagaccttctcaattttcgatctgacttgaaagtaatattgatgagtgcaacattgaatgcagaaaagttttcagaatattttggtgagtaaaatgtatagttattacattagaaaaggtactagaaaaacaattaaaaaaattaatatggtactaggtaaagagtagtcaaaatgaatgtttagctgttaattttattttaatattattctaccctccagtttcatggattagacaattgggtctatttttaaatggtggcatcatctctcatagtgaggacaggtagcttcttgttgctaccaccacacaattaagatggcatcattgaagtcaaaccacagatttgcataattttataaacttctttctgttgtttttctgtggcttttatcacaggttagggtggcagtttgctgctaatactgctagtgaccacttatggaacaccttcaatgttccaggtagtatatttgccactttgtcttccttagtctttataacactttatgaggtagttgctattatcattcacatttttacagatgagaaagcagcctcagagcagttaagtaggttt

SEQ ID NO: 108903 - DNA, 1057 bp, Homo sapiens
ttgttctgcagacaaagccatatttatgaattatataaatttgtaatgtcctcaatagttgtttaggccaggagtttgcttctgtactcagtagccccacatatcaacattattttaattcttctccatggaacttataagctgtctcttcttgtttatgtcaatatgtttttctttaacagtgctttggctttgttctttataatttggtgcacttatctcttgcaggttggtagatccagatatccaaactgccagtattggatatggcaaaatttagaaagcattaatatgtttgttaaaaatagctatgttcagtttggtcgaattttgattaatatcttttttcagacttagtcaacatgtgatattctttattttcccttttgaaataggaattggtaaatttaattgataaccatcaggtaacagtaataagtggtgaaactggttgtggcaaaaccactcaagttactcagttcattttggataactacattgaaagaggaaaaggatctgcttgcagaatagtttgtactcagccaagaagaattagtgccatttcagtaagtaatctcttaacttattaaaaattgtctttttaaaagtaatcttgctagaacctactgattctgaaggtgtggagtgattcttaattaggcttaggattggtgactatgaaagcaaatagttgcttaacatgtttaataataaagcccaaaaaattgagtaacctctctcttaacagataatagatatttatgaattcaagataaaattgatatccaggcaaatttcagtacatgttcacaagaatgaaatagataaaatatttatagaattgattacaagcttcaaataatctccatcatttgattctttaaattttactacttggtttatttaacttttttttttacttctgtcattttttgagtatgtaaatacactgaatggtggtgaaagtgggaaaccttgtttttttttttaagctgcatttctgtagtcagtgatttatttatttattttttgagacagggtcttattttgtcactta

SEQ ID NO: 108904 - DNA, 1034 bp, Homo sapiens
atattttaattatttccttttttttttttgagatggagtcttgctctgtcacccaggctggagtgccgtggcacgatctcggctcaccacaacctccaccaattctcctgccttaacctcccaagtagctgggactacaggcgtgtgccactatgcccagctaactttttgtatttttagtagagacgggatttcaccttgctggccaggctggtctcaaactcctgacctcatgatctgcctgcctcggcttcccaaagtgctgggattacaggcgtgagccaccatacccagccgattttttccatcttaataaagggtgtttattaaagctgactttatttttatgccactgaagttttttttttacattatatgtacctagttgaatgtaaactacaggactgcttcttaaatgtttttatgtaatacgggtatagagttccataaaagttttcagaattaggaagaaattgtcacataaatataggaaaaatagtcattccttttgtagtattctaattgtaatttaacacatttgaaattcattgagtagcttatatgtttcagaaactggtatttgctttttatataaaggtttttcatttagatcttgtggcaaccgtatgagataaaatctttgaggcattcatactttaagtttgacttaactgagatcacagctctaaaatggcagtaccagattttctgactgcagatattacttgttttaagttttctcttacactcaaaggcaagtatatcctgaaatttttgattctgctccagtacttaatgtattagtaaatagtgcactgttgggtgggaaaaacataatatagaaatcaaatctaagatgaatatataaaacatattgaaaaatagtgaaagtaatttagcaattattagaatactgttagaggacagatccgatttcattttactgccactgacttaaagcattgtctctattttgctggatgtaatggagttctggttttgaatgtttcagacataaaaggaattggtaaatt

SEQ ID NO: 108905 - DNA, 1023 bp, Homo sapiens
ctcacttgctgggcctagggaaagaaaatctacgagcctttggctggctgttgctccagaggtacaaagataaacaactcgggggctcagacagaacctgatccctgccaccctccagaccaccggggtcgtcctcccgtgacgtcaccagaaaccactgcttgtgacgctaaatggcccgccctcttgtgcggtgctacggaagcaaaacggaagtgggcgcacagtggcttccgggcccggacgccatttccagcggttgctggttctgacgggttgtagtctgccaggacaatgagttatgactaccatcagaactggggccgtgatgggggtccccgcagctccggtgggggctatggaggggggccagcagggggtcatggaggtaaccgaggctccggaggaggcggcggcggcggagggggtggtcgaggcggcaggggccggcatcccgggcacctgaaaggccgcgaaatcggcatgtggtacgcgaaaaaacaggggcagaagaacaaggaagcggagaggcaagaggtaatctcggattcagtagtggagaggatgaggcagcacaggttttcttctctctcccgctgccccctttttcttggttttgtttcttaagtgatgcacgtgttttgtgaaatgtaaatgaggcgcaaatatattatgctggcgctccccgtagcgggtgtactgcgtaacattagccatgctcatctgaccaaaaacaggcaggatttatgcaggctgaatatatactttgcttaaaggacttgagaactgtgacaaagcaaatgttaagttcacgttccaaccgaaattaactttattaggagtgtcgttgtcgtatctctggccgtcctttcccttagaataataattgtcactttaaggtctttgcctggtgaagaagcacatagcgacctttctacatttgagataggtttgcgcggaacaaaagcaggcagacactgttttggatgtggatcattcagaaaaatagtccagcttttatta

SEQ ID NO: 108906 - DNA, 1039 bp, Homo sapiens
gtgggtatacaaagttgcaaataaatacatgaaatccagatatgaacaggttgaccttattggataaatgactcaaaaggctgcaactactgtggaacacttggccattcagtgtcattggtctcagaggccagcagttattggagatgtccttcaagtctacagtgggtctgaagggagggctattattttctgtgagaccaggaagaatgtaactgaaatggccatgaatccacacataaaacagaatgcccagtgtttacatggggatattgcacagtcacaaagagaaattacactaaaaggcttcagagaagatagttttaaagttttggtggcaaccaatgtggctgcccatagtttgcacattcctgaagtagacctggtgattcaacattctcctcctcaggatgttgaggcccgtatccatcgctctggatgcacaggtagagctggacagggatttgtatatgtttttatcaaccaagagaaagaggtcaactaagatatgtggaacaaaaagcaagaattacttttaaatgtgtaggtgttccttctacaatggatttagttaaatctaaaagcatggataccatcaggtttctgacttccgtttcttatgctgctgttgattttttctgaccatcagctcagagactgatagaagagaaaggggcagtggatgcattggctgcaactttagcccacatttctggtgcatcaagttttgaaccacagtctttgatcgcctctgatgaccatgactctggaaagcctagaggaaatacaggatgtcacctgtgcctggaaagaacttaatagaaagctaagtagtaatacagcgtctcagattaccagtgtgtgcctcctgaaaggaaatatgggtgtttgctttgatgttcctacaactgaatcagaaaggttacaggcagtgtggcacgattccaactggatactctcagtgccagccaaattacctgaaattgaagaatattatgatggaaacaagtcttctaatccccaacggaggaatggctgg

SEQ ID NO: 108907 - DNA, 1040 bp, Homo sapiens
agatcttaaaatggtaccatttatcactgaattttaaatgatactaaaaatgacaataaggatgttgaagaatttttttccaaatgtatcttatattagtccattttcacactgctgataaagacatatccgagactgggtaatttataaagaaaaagaggttccacgtggctgcagaagcctcacaatcatggcagaaggccattttacatggcagcaggcaagagagaatgagagccaagcaaaaggggaaacccctcataaaaccatcagatctcatgagacttattcactaccacgagaacagtatgggggaaactgcccccatgattcaattatctcccaccagatccttcccacaacacatgggaattatgggagtgcaattcaagatgagatttgagtagggacacagccaaactatatcatatctgctcatctcccaagcaattcaaggttaacttgaaaatatttagcaatacaattttaaatgcctgctcttcatggagtttaaataaacattcaggaagttggggggcagtattaattgatggttaagaatatagtctttaagacctggattccagtcccagctctgccacttactggctgtgtgaccttgagttaagttaattgagctgtagggttctcattataaaatagagataataatatctacttaataggcttgtcagaagacatagataacacgatatgtgtaaagtgcttaacactgtctggcacttactgggcaacaaataaacagtagttgctgctgaccctagttcaactcttccgagtttacaaagtggaccataactgttacaagaacaggattcctcatgagacccacataacttcctgaatatgggtaggccagaaattctctgggaactgttgaaatgtttccttccagatctgatgaattccaggacttgcaaaaactgcagaagtgaaaatcattaactaacatctgcaaaaatcattatatatgaatgggtgaattttgtgttcgttctcattgaatcccaaccatgttc

SEQ ID NO: 108908 - DNA, 1801 bp, Homo sapiens
ctatatttatggtacacaacatgatgttttgatgtgtgtacacattttgaaatgactaaatctaactgattaatataattttgaaataaagataaaatttttttaacaaaatgagcatgtaaaaaataaaagtcaggggaatatatcccttatggcattgggtactttaaactctgctatactgagagaaacaaagtaagacaaatcatactaaaaacaaaggagatgaacaaacaaagtgggttttttccaaggccagctggataaattcgtacacagactaatcagtctgtatagagggttgtggaaaggagaggttgattggcttaatgcaagatttctcacctttagcactcttgacattttatggtcaggtaattctctgttgtgaaggttgtctgtgcattgtaggtcagatggttagcatcatctctggccgctacctactacacaacagtagcaaaccctctcaagttgtcacaaccaaacatgtgcccagacattttcaaacattccttgaaacaataccaccccaggtgagaactgatgcctgaacagacacttgcctatgatgtctatatttggaattttagaagctaggattaaatatatgtttacatatatatacatacataaatacacgcacatatatataaaatacacaaacatatgtatttatgtatatataatatatttacatattatgcattatgtgtatgcatgtaatatatagaaagggagatagagaaagactgagacagagagagagtgaaaaaggacagtacagtagatgtaataaatgttaatatttggaaaaatatgggttgaaagtatccaggatttgtttatactattttcgaaaatttttcataagttcaaaataatatcaaaaaaagactggcctatatttgaaatgaaatgcatctggaaaactactaaagtcttatattgtattatcttgattctcccatataaccttataatgtcatgattcagaaattttaagaaactattactcaaaatttatatttgagaaaaaagtcaaggcaaggctgatggtagtttgtttttaatttgtggctcaaaccattagagaaaatctgtcactgagacataaatttctattacgaagaaagaacatggatatactggttgttataaagactctctctatatgtacattttcctcaggactctcccacacaacagagaacatctttctcaagacaaaattctaggaaccatccttgattcttctccctcaccctccacatctagttcttcagtaagtctgttgatttgatccctcatatccctactgaacccctccattctctttgtctctataatcatcagtctggtccatgtcaccatgtcactcccctgtagacctgttttcattattgccccttcccccaatccatctacacagcaactaaagtcatctatttaatatcactcttgtttaaatgcttaaatattcagatgtgctagaattttacaacatttcacctgtagtcaacgataatgtatgattcacttaaaaatttgttaaaagggtggatttcatgttaggtgttattaccgtaataaactaaaattaacaaagaaaagaaagctatgtggcattaaagctggtttacatctttaaaaaatctattaaaataaatttttaaagaaaaggatttttccataagattaataaagctaataagaaagagcaatcaagacatgcaattgccactttaatcttgaagatggtggttcatattttcttgcagggtatttagagcatagcatc

SEQ ID NO: 108909 - DNA, 1331 bp, Homo sapiens
attgccagcaatcaccagaagctgttctccagaactgtgagagaataaatttatgttgttgtgttacccagtttgtggtaatttatttcagcagccctagtacactagtacagtgtagaattaacttttatttctttcgtattattttcctatatgatggatttcaactattggattttttgggactatgtttccttctttaatcgtttttattttagtgctttttatgtaggctttatgccattcctttttcctttaattatttttcatttgttctattaagaccttctgtttgctcctagataattttggaacattcttcctctcatgttactgagaggaattttttattcttcacaccttcaatatgagtatttttatatttctgatttagcatgaagaggaagagtgaagtcaggctatggacaatcacggatagattactttgcctgtgcactctcccatataattttgttaaaaactcactgtataagaaaaatggctagactgggtgcagtggctcactcctgcaatcccagcactttgggaggccaaggcctgaggatcaccaaggtcaggagttcgaggtcaggaggtcatggcgaaatcctgtatctacaaaaaatacagaaattagttgggcatagtggctcacccctgtagtcctagctactcagaaggctgaggctggagaattgcttgaacccaggaggcggaggttgcagtgagccaagatcacaccattgcactcttgcctgggcaacaagagtgaaactctgtctcaaaaaccaaaacaagcaaacaaaacaaaacaaaaggctaaagacttcagtgagacctcacaagagcatatccaaatggccaattaacatatgactaaaaaacactgagtttccaaggatctagaacaatcctaaatgtcattgattgctggcataaattagttaaccaccttgaaaaattgtttggagcatctatctatatgtatggtaatatatcatgtgtttgctctatgaaccagcaattaaacttctagatgaatactcaacagaggggtatttatgtgttcacaaaaagacatgtaaaatatgttcatagcatttccaaactgaaagctgatcaaagaactcaactgtaaaatggaaaaaaaacgattatatgctcacacaatggaatacatacagtagtaagagtggacaaactaaaactacacacaacaatatgctaaatctcacaaacataatattgagcaaaaaagagatttaaaaaatctattgtattgaccaggcatggtggctcatgcctctaatcccagcactttgggaggccaa

SEQ ID NO: 108910 - DNA, 1028 bp, Homo sapiens
aaaaaacttttatataattccaccatttacataaatttcaaaaccaggcagaactaatctgtgaaattaaaagttaggataatgtttattctcgggagagatggataatgactagaaaggagcccaaagaggtccctgaggcactagccgtgttctgttacctgaagtgattgccagttatgcaggcgtttaaactttgtgaatattaattgagatgtatacttacgacttattcatttttctaattgtatgctatgactcaacattatagggttgaattatagggtttttgtattattttaagttcagtgcctttaatttactccttcaggttaggccattgtttgtttgtttgtttttactttaactgctcttaggatgtagctcctcaattcacttaccatcactcaccaactgccactatccaccccatcccacccaatttttcttctctgttttttaactacaaattgttggttcatagaaagggaaattgaattctacctgcagcactccaaatgcctcttccctcagataatgttgttttatttcctcttctagcatcctttttttaaattttattattattatactttaagttttagggtacatatgcacaatgtgcaggttagttacatatgtatacatgtgccatgctggtgtgctgcacccattaactcgtcatttagcattaggtatatctcctaaagctatccctcccccctccccacaccgcacaacagtccccagagtgtgatgttccccttcctgtgtccatgtgttctcactgttcagttcccacctatgagtgagaatatgcagtgtttggttttttgttcttgcgatagtttactgagatgatgatttccaatttcatccatgtccctacaaaggacatgaactcatcattttttatggctgcatagtattccgtggtgtatatgtgccacattttcttaatccagtctatcattgttggacatttgggttggttccaagtctttgctattgtgaatagtgccgcaata

SEQ ID NO: 108911 - DNA, 1022 bp, Homo sapiens
gaggaggaaatcttcactatgcctgtcatattttgcctctctttccctgtcttgcttatatatctatgtatttgattcttgctgccatactaaattattcttttgtacatcttatagttgttgttttaaacttattatttatttattttggaagagaaaggtctatcatacaacttttttccactatcttttcccagaaagcacaggacaagtttctctaaaagctactatatattcgaaggtacaccagtagagagtctacacaaaaacaaacaaacaaacaaaaacaagacaaaaataaaccttgtattaacccctgtaaataatgataaaaataataaattcatacagcaagtcaaaaattttaatgaagactcacgcaatatttgacccaaggtgttaaatagtagaattcgatcagttcaggtccagaagtaggatgaacatctccctcttctcaaaagacaattaagcactgcgtattttctccttgaaggcaatgacagtgtcctatttactcttcactcccctacccctaccactaagactctggacaaagtccagttctaaataaatatttgtaattgaataaattaatggatgaatgagaatgtaatcttaacaaataaaatataaacatagcacgttaatgttagaaaaaagagaaaaacagaaaatgtctctttaccattcccttatactttttaaaacaatttgctagcattgtgccaaagaacaaataagcatttaacttaataattaggaaaagaaaagcctaaggaaaaaatattaaaaaaggcaacattggaattgaatgtataataaataagtaaataagttgagaaaaccataaactgactctcaaatgaacaaagaaatagattttaagcctcaccaggaaaggattgaaaactaaagctccacattgatatatttgaaaaatccgaatattttaccaatagtaaatgtaatttcctagtaaaacacccatttccaaaactgcttcatgaagaagaagaatc

SEQ ID NO: 108912 - DNA, 2736 bp, Homo sapiens
gcggggtggagaaagcaggagcaaggaaggaaagaaggaaacggggagggagagtaagaaaaaagaaaacgaaggagggagggagagaggacatttaaatgaagaaggaaggaagcttggattcagggaggaaagggagcgggaaagagagcgaaagaagagcgtgagaagaggcaagcattatagtctccggtccacaggggagagatggagccccctcaggactagagaatcccgaagagcccgtgtattgttttcttgaaagccccgaagctaagcaattctaaaaatgtttagcaaagcccttttgggaatggtgagatggggggtggggaggatgggacattttcattgccaccgcccgccccccgtctccccggccccctcacatgaagtgactggatttgggagacctagcggaaaccttcaggtcacccagggaactgctcctctctctggtcctgcagcggcgaggcggggtagggggtggggggggtgggccgtgagagcgccgagacgcgcggggcgcggagatgtgcaagtggcgaagcttgaccgagagcaggctggagcagccgcccaactcctggcgcgggatctgctgaggggtcacggtgagtctctgtgggtgcgggtcggagggatgcccaggtgcctcgtcgccccacggcccgggcggaggcgggtccggaacctcccccaagtccggcctcagcctggagcccgcgcgccttgggcggatgcacggactgagaggcgcttggctgggctctcagcccgccactgccacccggccccgtgcgctcattggtcgggatgtgtcggctcagcagcctccaacttctcccgaatcccactggtgagtcccaggagagcgagctgagggagaaaggtccaaagggcgcgagcgcccagggcgctgggagcccgtgggacgggcacggggagggcagagccagccgaggggagcggctgccgggaggtgcgctgagcagggtccgcagctaaggtccagcgcgatccgagcgcccaggaccctgcggccgtggaggaggcgtgccctgggaaggagccgctactgggacctgaagagtgaggggagggagaggggcccagagggtgacctggaggagggctctggaagtcacgtcaggttggctcttcaggttcatttccatagttccctgcggcctctgccttggggagttatgttttgttaccgagatccgcgctaccagattgcaccggggctgatttgggggctgggaatttgccattctgctgtacagacactgatttttttttcttctttttaaaaagcaaggtttgttttcattttggtttctgtcggattttctcatttgtaactcacttttctatttttacttttcttaaccggaagatcttttcattatcccacctcttcatcttgcttttaacctgatttcctattatataattaatgcttaaatctcacaagggttggtcggtgcggggctggtgtgtccttttgtagatgaaagtttaagacctcttaactggtttcagtctatttgtctggtttcaaaataagggtaattgcaaccaaatatccctctttagcttctcgatcaagtcgattcctcccccatatatgattcaaatggcaattttattaaactgaaaactagtacctgacttgcagcgtcagcatttggaaagtgcttgtcggcaaatcgactgtatgaaggcgtgtagcttcatcccctgccatttttgtgggttctagcactttaaaaaattgtctggtaatttcttggacttaaccctgtgtctttggttgtagagcagcactaaccaggggagtaatatggttggcacttcgtgtccagaactccgtatttcaggctgggaaacacctaattaatgtctgggaaacaagaagatgatttatcctgagtacctctgtcctcagcttctgcagacacagtttaaatatggaaactgtttctccttcttcctgtgcctcagtttccatagaacaaactgtaattgcatagcacagcttcaggaacctgcagatataagttaatgttataatgtgcagtgaagatgaaaactgcttagctaagtctaagtctgtaagtcaatgagatttcctttttaacaaatcagttatccaggtttcctgctttgactgtctgatatagtaatgcttatgctcaactggtataagaattgctgctttacattgctttgaaattaagcttacacttaaaatagtaatttattctgttggtaatattgtcgagctgaagtttgcaggttcttgttatcttagacctcctaattctctattctcgtctgtggcagtgtccacttttccgtttaaactttttatttaacacatcttcagttgaagtgaaatattttaagaatacaggtatgtttttgcgtaccctgctttatatgggactataagcctcaacttggtattttttttttttttgtattcttttgtttacttgtcccccttactcttctctatgggattgggtgtggttaagttggatattcaggtatttggggtttagtcatatgttccacagtgagattccagatactgtcccctgatgtcttaaagaaaaattgtgaaccttccagaattaactggaaatgaacgacaaagttaattaggagattaaacttgcatcatttctgcttttgctcaatgcttttgaaaaaaggctactaaga

SEQ ID NO: 108913 - DNA, 2183 bp, Homo sapiens
attttaaatttagattttacttattttattttcttatattttttctaaccactgacaatgatatataatgttcagtttttagttcttgctttaagaaattgcttatttaattggcagtttttaaaagaacaaaagaaaaatagaaatttaaaaatttgtgttgccaatatttatgtatattctctcctttttctagatggtatttgcaagtcatcagactgcataaaatcaggtaagaaatggtttttacgtgtaatagttatacaactgatgtataatatttaaaattaaatgctaatcttaatttgctttgtttacacttttattcattgtagatcaattatttatgtgtctggctctataatcaatggaaataaaaatatatttaagtagtagattaattaacttgtttactctgaaaaatatattactattttcagccctgggctgtatagcagggcaatagaaaactatatcgctatttgtatggagcttgccatgtagttgaagaaagaaaatgaacacatatgaaatggtaagtttcgtatcattgtgttaaatgtctcagtgcacctcactaggtgggtgagaagaagggagtgagatgtaggcatgtaaatctaggtggagaagttaaaatctgggaagaaatttcattttatttattttttttattttttatattttgagacagagtctcgctctgtcgcccaagctggagtgcagtggcgtgatctcggctgactgcaatctccgcctcccgggttctagcaattctcctgcctcagcctcccaagtagctgggactacaggtacccaccaccacgcctggctaattctgtatttttggtagagacggggtttcaccatattgatcaggctggtttcgaactcctgccctcaggtgatctgcccccctcggcctcacaaagtgctgggattacaggcgtgagccaccgcacccagccttaaatttgggaagaaccttgaagcagggctagaatttagatgtggcggtgcagaagagggaattccaaacacaaaagaaagaaactatgttattgagaagtagtaaaagtgtacgcttgatagaaggacacattatggagaaccttgaaatccatgtttagccttgatattgtaatacaggagaaacagatatttttgaacagaggagtgatcaggccaaaggtgaaagatgattctgcgaatgtgaggttgactggattgagtgaaaaggagggcaggcaggtgggggctgcttctgtactccaagtgtaagctgaagaggttggcctgtggtgagagaagagtactattgagataatggggagggagaattgggtgactcagtagaactgacttgctaaataaaatgaatgaattgagaatgatgccaagttttaaaacccaagggactaaagagaatggaggcagcccacacagaaatagagaggttatgaggtggatgtggatgtgtttggtctaagatgaaaatagacaggaggaaggtagagatgaggtttaagaagctggaatttggatttgagatctgtcagtttaggagtgatagtggaagccttggaagtatttgagttctcaaaagaagagaagaggttcaagggctaaacttaagaagaggttcaagggctaaacaacatcaatgattagaagagaagaaaaataagtcagagcagaaaacagagaagtgtatgaagctatataaatcccatcaattggagtgtggtgaaaatgggagtatttcttctttcttcaagaaaaaggaaggtggtagctgagggcagcacctgggatatgaacacaatatttgtgtcctttaacaagagattctaaacctcctttctaacatctatgtgtcttataagaaataaataaactgttccaaataattttaaccattttctgctggatatttttaattttatttatttatttatttgaggcaggatcttgctctgtcacccaggctggagtgcagtattgtgatcacagcttactgcagccttgatctcctgggctcaaggcatcctcctgcctgagcctcctgagtagctgggactataggcacctgccaccattcctggctaggttgtgggttttttgttttttttgtttttttttgttttttttttttgtagagacagggtctcactatgttgccc

SEQ ID NO: 108914 - DNA, 1001 bp, Homo sapiens
ggaaatggctgcacaggtaccttggctgggggatctccgtggtcatgtgcaaaagtcagcatgtgcccaagttgtcaaagttaacgtttacttcctccccagatcctcctatgcttcctctctctaccagctaccctattatatgctcaggctgtcctgtttcgggaaacttccacttacatattgactactaagggttaattcctctgtctttaatacacttgacatgtctctttggtatcttaatctatagattctctcttctctcactatttttcctttttctcttcttttccttgaattttattttcgaagaaactggattttttgactaggtaggtgtatttctataaacgacaagtgattttgcctcagagatctaggcaggtttttcctcccaaggagcaatgtgacattcagaatctggaatcttaaatgtgacttaatgtttagagataggatttttaaatagtgtttggcaagtctcaactcactaaaatgtatttaacctgtatcctttaattgtagcttagaaatcaaaccaaatgtaaaacaccttgcaggatgtatcttggcagagaaatgtatacaatagaaataacttcagtggtaaacaaggttgctgtatagctgtatatttttcttcattctgctctgttggttcacaagccattagaatacttgttcacattggtagttactattcttcctaggagaataaataagatgacacacaccctcatggatacactctgcatactcataaacacacacactcgtgcgcgcacacacacacacacacacagtcttctgctggttaggaaatcttttctgccacagaaaaatacaactatttcttttagaagttgttgcaaattaggaaaaccctagaggaaatcttggacaaaagcaagtattaaagaagagtggccagagtagagtagatggaaagaaaaagaaatgtgaaaagagaaggctgggcacggtggctcacgcctgta

SEQ ID NO: 108915 - DNA, 1039 bp, Homo sapiens
aggaaggactgatggctaactcatgggggctactggccctgtagcagccttttagtgtaggaaatgaggctatttcattatgtagttaagtttggaaaaaatccttcatggaataagaaagcagcagacatcttagtaggaagaccactgaagcacacctttgttaatttaaatgtggcatgtggcaatttgctttgtgtggcttccctggcacaattctcgtgaaaattgtgtagggatattaccttacatttatccagtcaaaattagcatctgtcaatcagatcctttccaagaaagggaatcagttatatcataaatacacaaatatataacatgtgttttttaccctccagggaaactttaagcaagtagtacaccatcattttttaatgaatggtcaagaaattgaaaacatatataagttgagttaagcagttaaagggaaagacaattagcaatgcctggtaagctaagtggtactccaaaggtttattttatagctacagaaattatctacatgtagagggggtggatacaaactagcttagactggggtgagaatcctggtttgacatttaacattttagaataagagatatagaaagattcctctgtagttgaaggatcctgttttgtcctactcataagcaaatccatggggtagcaaggtgctttctggtaagcctttgatatgatatgaagctcaagttgataaaacagattaattgaaggaaattgaaaaatacgcaatttaaaaaaccataaggagaatgttgcacaagcttttgaatcctgtaaattttcattctttaagaccattcagaaaaggagattttgtcgggggccagtggtggcttgttttgatcctatttctgaaccagctgaaaactagaatacgttctttctgttcaaaacatcctagatgggccacatattagtcaggccttctccagagaacagaaccaatggtatatgtatataaagtctcagtatccaaaggcccaagaacctggagttctgatgtctaagaacagga

SEQ ID NO: 108916 - DNA, 1038 bp, Homo sapiens
acacgcccttcagggagatgcaccataggtataatgcacagataggattcatagacatcttatttcatgaaaattgcaaatgcactatttaaaattttttattgagaatcaaataaaaatcaaatcaaaaggcgaacagtgtatttttaaagaggaagttgtagccagaaacagagagaaagaaaaaagagaatgtggtacattttacatattctcaaataaaaatgtgtcatcctttatgaacaacatttgatttgattgctgtgctctgtcttagtatgggggtgacagttcaggctttgaatcaattagaatgagcacaatcagaaatgaacacttgaatctgtgtttcctgtaaagaaaagcctaccatcagggacaccttagtttgtaaacctagctaatctgcactcacccttgccagtaccccttttctcacctctgattaatcccttgaagtaagtaagtcagaggtctgcatcaggagaatgactagatccttggtattcaatgcgtggtccatggaccaacaacagcagcagccactgagaatgtgcaaaaatgcagtctcgggctccgcctcagacctactgaatctgtggctgcactttcagtagcctcttcaggtgatctgcaaaataaggttgagaagcactgaggaatagtgattttcaaatatggctgcttattacaatgatttgggaagcttttgaaatgtacccatactactaaaccttccattcttcctgggcacacaaagtttccatttcttcagtggagtagtttctgttatgtgttaggaggaaaagcaatttaagtaaatgaatagatgttaaggggtataggaattgcctggatatttgcatttttaaaagaaggtacatattgaccaactgattgctttaacaggttcaatttcagactgtgtgctcagtgaagactttaagttagagaggagtgaagactttaagtcagagaggagagacactgagcctgattttctgcttatcgtggacaagctgaacctggaatatcttc

SEQ ID NO: 108917 - DNA, 1067 bp, Homo sapiens
ggtgcatatcaactatggtaataaagtgaaaacaaagaagtgggaagctttgaaaagttgacaaattggttgagtaccatatggaactccagctgtaggatcagtcccattccaggcccaggcactcactggggccaaggtcagtagctcaaacattccacttccagtcagccctactcttggtgatctgcctctgaccccagctctagtaaatgggtttctgccttctcccatagggatttcactcctggctcattccccacttctggaaaatgagtttctttttttcttttctgtcttctgggactgaaatctagcttagctcttaacctcatgaccttttgccagaccacggagaactgaagtttccttggatcaacacacaccatctgctggttatagctccctcctcacagctgccgtgggtgccctccctgtgtgacttatttctgttgcttgtagctgagaacttcttctgttgatggtcctttatagtttaactaaaccgggattcagtctcactgggctagtcaaaccacttctaccagagcccagtttatgtgaatgatgaatgttttacatggaaaaaaaatgtttcttcatttactgaggaaggagcaccttcactgattttgtatgccaacacagacagcgaaggatcctgcttgtccttcacctatcagccatcacacctattaggaggggggaattggtcttttgttttgtttatttagtaaaaggaaatctaattatatattaaaagttaaaaaaattttagatcctgcctacatgactttaaaatgagcaataaaagtcattttttattcagggatagtaacaggaaaaagaagctagtatcagaatgttttaagattccgatacagtgcatatgcaggttttagtttacaaatagcagatggtgatgatttactataagaaggtgtaattaattgagaatgaaggatccttttggagtgtccattatgggctagtcattgtgctaggcgtaggaattagaatcctttccctgggtgggggtatacttaaaattattgcttttgtattct

SEQ ID NO: 108918 - DNA, 2113 bp, Homo sapiens
cagagatgtctgccagggtccagggaacttgggatctacctgaagagtgttactaagggaacaatgtagccttttcatgaccttctatagctttagtttaaaaaaggaacattatcatcatttgctaacattacaatcaacagcagatctgataactcattttaagtgatatattgtatttaaattacagtataatccctaatagctttttgccagcagagtctttcaggattcaaaatgcaaattgcacctgaaaaagaaaaattatttttagacttatggcactttaacttaactgtaacacagttagaatactttttattattattattattaatagaatatgtttcggttgcgaattctggaggaatccctactggaaaataattgccagtcctcccttggctgtgagccattcattgaaatggactatgagataagactgaagaatttcactaatttcgggagtgccaactgaagtttattattgtgaatccattagacatgagatttctgtgattatctcaatgagttctaaaatccaggtccaaatgaggtggaaaaattttatatgactatatacatgttatagagcaattaatattttaattgggtgtcaagaaaagcagtggttgctctataacttaatttgggttcctctgcctctctgtagagtttctgaaaatttttaaatgtcatttggagttaaggcagaatgatactgtggaaaaagcatcagcttaaaattagacctaggctcagctttagttgaattccttaaatttacattggtgacgttgagtttgtaaccaccccatacctagattttcttaaaataggagtaatatgtcctactttataaagcagttctaaggaagaaaaatgattagaacccaaggcagtttcacatagtataagatcccagacgctggccaccaggtttcttgagttcaaacccactgcattatcctttgccaactatgtgaacttgggcacaaatcacttaccgtcaatttctatatttggaaaatggggacacaaatatagttaccatacaaggttaaaagaaaacaaacattaaagaaagcatttaaaaaacagccatcatgaagttggcacttggcgtttgacatatgtcaagtgttggcttctattgttattattattattacatttaagcgtctttggctaaacctaaatgaaaatcctataatttacattgtatatttaaatctgatagtgaatttatctgatagcaaatggattctaggttgattattcatatgcttgtgcctacgtgtgtgtatgcatatttgttgtatgtataagacctatggatttaagataaattagtcacatgtatatatgaaatatagttataaactaattactccccaaactagaacagcaaaaataggtctccttacttaagagtacagctgtacagagtaaattcactatgcttggaaacttctttcatatctatttgtgtaagtctgcagctagtttctgaacagttgtatagtgatggtttcatggtactcaccaattagacaagtataagtcatgaccttggctttcttggaacgtaaccagtggttgacagggagtgtttgagttaaatgataaactagcagtccagtttacactcagcatctggtatcccccactctccatctttcttcaaccaaggcatcacaaaagcaatttgggggcaggcattttcatttaaaaatggagagtggattgtggaagcatcctgagtgtttgtaatgaaagccatttggtttttattagcattagagtctacgtgcttgctagttttcagtcattttctcttcaaaaatggttccccagattccagttttcacattgctgccttttgaattgaatcctttgtgacccgttgtgattacattgcattttccttgtgttcttttaaaaagttctgactttctctgaattgtggttggggggatggtgggaggagggtggcagcaagggaatagggtcacttgtacttttagaatgttgtcaaaagagatttttaaattgtcaaaaattgcctagaagtaatatcaagcttagtgtctgctaataaagcaaggattta

SEQ ID NO: 108919 - DNA, 1024 bp, Homo sapiens
gggctgggtaacatgctcaaagttacagaggcagaaaaccataaggtgtctcacagaaactgaatatactcatttaactgtgacagatggctcatgcgagaaagtagcaaaggagaagcttcattcgttctattagtgttagaatgtgctatggaatctggattttattatgattgcaaaaggatggtattgaaaactttggagtggaaaatgacattctgaagtattttgagaatatgaatctgcctgtggagtacagaatggacataggtaagaagaggcctggggccacaactttgtcaaaagggcacaaatagagtctgagagaaagagggtttgagacagaatggaaacaatgggaaagatggaatggactctggaggcaatgaactgagaacggatctgacctctgtggcaaggggagaggaggtgagtgatgggctgtaagagaaggtggtaagaagactcatagatgattcagtcacacataaccataattgcacccctgttacctaggtgctaggtgatacaaagagattaatcacatcaacaaaatggttaggtagacagagtaggtatttacaatgaaaaactcaaagtagtctcacattgaagacagagtgaggcaatgagctctcaggagtcaagagaaatattccttgaagtttggagtcacagaagcatcagggaagagatggaacatgagctgaatgttgaatgatgggtagaatttggaaagaatgacaggggcaatcaaagctgtgggatgaggaggttaaagcaaagacacaggactaagaaaacacaaggagtgtttgtgacacattgacgagggccatctggttggaacagagtttgcataaaccaccaaaagaggaaaaggggaaggtagggtgatacgtttattctggtaaaggtttagacaccaagctaaagattttatttttatttctgagatagtctctctctgtcacccaggctggagtgcagtggcgctgtcttggttcactgcaacctccacctc

SEQ ID NO: 108920 - DNA, 1063 bp, Homo sapiens
agcagagttggcaactaaagttatcagagtgaagaatggcatgctaacctcaggtgcaggatggccaactcaaagtagacctctattctttgttcttctgagataggaactagccagaaacttagttattcaggggtggggtgggaaggctgtgggacccagggtggaaggacccacacagttcaaaataaaacgaaccaactatagtgaaggaaaagagaactatacacagatagtattcctcatccccctgaattgacttatataaaaaagaaaacggagcatccgacaaattgatgcaatcaaaagggagcaataagcctttttctccttttaagcctcttaagaaataaacccatcattttatctagtgttttctctgctcttgcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaaggttagtagagattgtgtctgtgcatcaaagatttctctcttaatatgttcattttttaaatatacaattgttagccattacaaggaatgtcacagaagattaaaaagttaataatccttccaggatttgtgtaccaccaccaagtcactctgatagtggcagacactgaaattaatgtgttgacatctcttagcattcctgctttcatttgtaggtatgcaaataataaagcggtatcatctctagagatggcaggtttggttttttgtttgtttgtttgtttgttttttgagatggagttttgctcttgtcacccaggctggagtgcaatggtgctatctcggctcactgcaacttctgcctcccagatttaagcaattctcctgcctcagcctcccaagtagctgggattgtaggcacctgccattacacccagctaatttttgtatttttagtagggacggggtttcaccatgttggccaagctggtcttgaactgacctcaggtga

SEQ ID NO: 108921 - DNA, 1418 bp, Homo sapiens
cagtcacacaaagataattattttccagccatcaaaaagactattcatactaaattccaaattcctctgtgttattgtttttttttaatctcaatttcaagaaaagtaactgttacctatggcagagccgtatgcatcactgttcataaaaaaaaaaaaaagataatctagtcaaaaggactttcatctaaattggctgattaaactgactcccagttctgtgctaggaatgataatctggtaaggggtttggtttttcctataatgttttggaactggggggaggaaatgaatgtacctccagaaaagcaaggtttttttttaactgaacccactttgcaaatgttaattactgcaaatgagcaattatgtttgcatagtgcaaatgagcaattatgttgatgcattttattaaatgtcctatttcagatgtccttcaagaacccaaaactgaagatatagtagcagtgcagaaagcaaaagcattgtacaggtcttgtataaatgaatgtaagtgctcttcatttgatttcattaggagtatatatatatatatattggtgccaaactatgcctagatttctaattgaatttatgtttgttgtttccaaaagctgctattgatagcagaggtggagaacctctactcaaactgttaccagacatatatgggtggccagtagcaacagaaaactgggagcaaaaatatggtaaggcaattttcctactaaaaaagaaatttccatgtaaaatctatgttataatatcattagtgaactaaagcttctaaagatatattttatcttttattgctttaggtgcttcttggacagctgaaaaagctattgcacaactgaattctaaatatgggaaaaaagtccttattaatttgtttgttggcactgatgataagaattctgtgaatcatgtaattcatgtaagtttgtgtgtcaaataactaaagttacctttaaattgtaataaaacttccacatacattgttgttattgatatttagaaataatgctattttcaattgaattgaataagcaaggaggtagtatatccatgctctgtccctaatacctggagttccaattttgaaagtattttcttaatgctgttttcgacattcaccccttgcttctgctacctctgttttagatacctctcccttcacaaaacaaatgataagaagggctccaggcccctcctattcagaaaaagttcctaatttctttgtatagtacttgaaaggagcatgctttcgtttatagaagtaatgcaggtctagaaaccaaaaaataataattgctttcaaaaagaacacagaaaagggattttaaacatcatttttttcctcactaaagagtatctgtacttttttctcaactaaaggtaaataaaatgcctttctt

SEQ ID NO: 108922 - DNA, 1045 bp, Homo sapiens
tttcaccattttggccagtgtggtctcgaactcctgactttgtggtccacctgcctcggccccctaaagtgctgggattacagatgtgagccaccacacctggcccatgtgcttttcttacagaaagtaaggaacagcaggagacaaaactaataatcttacacgttattagatattggggaaaggtgttggttctacaaaggtttgtcttataattattttgtagctcaaaagtaagttatctttgatgatcctaatggctcacagtgtagtgatgtgactaaaattacattttagttaaaattactagctaaatatgtttatgattggcatttattttgccaaattatgaagttcgaataacatggaatgaattcactgtaaggtatctttttgaatgactacacaacactgaaatgaagaaaaagatatatcatcaaaggccacaattaatagcacagataaatacatgggtatgggatatttgagttcagtacaatctagttgctgtgtggggtacagctactggctttaagagcaatgcagctgctttctgttacagatttgaaagtgattgaggaattttggttcactattgtacatttttatcaccatgaactgggatgcttttcatatttaggattgtgttcttatatcaaatttttcaaatcctatgatacatattttttttacattttaattctgatatcaaggtatacctggcagtcgatgtatatatttaaggcagtaaaagctttttttttttcattgttaagatgttgcatttttgcattttatactcaatgctatcccataatctcaaacaggtcacaaactggcagtctttggcttgaatctgatatagaagcatttttgtttaacctgtagtgtttttttttaaattttgaattagttgtcaatatttttcaaaattgaaagatttcatttgagaatccagatttcttagtaagtcagtagaatttgagcccctagcttgcattcttatatggcagcaattgaccagagtggtgttgtggttgctcct

SEQ ID NO: 108923 - DNA, 1798 bp, Homo sapiens
aatttgtaagtgaaaccaaccagcaacctcatgtgagaatgttcttctatattgattcactgagagaaatgaggaccttaattttcttaagaaatcacccaccttcagaagagtctgaactctgtattgggggtgaattggaattggtctcaaagcttccctttctctaccttcttagcttttcaagagcaattgttatcttactttgttgtccttcataaggaaatctgaagattaggaatccaaaatatttgagcataattacataatagatatgtttatgctctgtactgatgtttgcctgagaaggagcaataagtgaggttagtggtttccaactctaaggactactttgtgtgtgccaattacagggctctgtgcagaaacacctcacatgtacacacacttcaaaagccactatgatttatttttacttgtgcatttatacatccacaaaacatttctttgagtagagcatttcaggtctaaaagaaaagtaagaaaaccactcaggctagagtttgagagcataaggaggcgggaaaggaactggagagtagaagctacagggtatactgctgcagggcatggctagggagaagaagccagagttataaagaagtgtagagccttcacaaaatctgaggttcataaaaatagagacattttagggatgaggatagaggacttggaacatgggcacaatggactgaagccagaaagcgatgacccagagtctgtgctcctagatcagaaaagccaggagaagtctccaaattatatgtacctgggaaagaacacaagctgagattggctatcctgtagatgagcaggtgcaagctggaactgggattaaacaagaggggattttctttgtccacctacccaatgtacaagctgagagaaactgttcaggacttgagctaagaatagaagttccgaggaaataggaagtgagagaaacttaatatatttacaatttaacttcatttttttttaattcaacagatcttcattgagcttatgctatgtgacagatacttttctaggcagtagacattccaaggaaacaaggtccttgttctcatggaactcatgttctaatgggaagagatagacaataaataaccaagtaaataatttaaggaaatgagacaaattgtgagtgttataaagaaaataaatcaaggtgatagaataataagtgactggggtaaggcatgggtgattcaatttggcttgctgaaaccatctctggctgttgtttgtagaatgtgttttaatggaagcagaaagatcagagaaggccacatggtaattcatgtgaaagataacgatggactcagatggcagcaagtcagatagagaaatctgagcagacctaagataatcttgtgtaggtggctctatcattatagggaaacagtttgtgtactttaaactgctcggccaatatgtgcctcagtgatacgtggcggagcttgtctcactgcataacacagctatgacatgataagacaggccctgcaagggaaactgctgacctcactttgtcctttctgggtaccaagtgactaatagtcagaaggtttcactcagttcagtaatctgtgtttaagaaaacaaaagggggcttttaaacatgagatttagtgaatatgacagagaatttttgagatcaactgaactcagtttgtaaaaagagctagattcagccccccaagcatggaataaaccttggaagttatgcaagaagttgtacaaatcttcaggttcttattgataacctgatgaaagc

SEQ ID NO: 108924 - DNA, 1316 bp, Homo sapiens
aagtgatacctcattgctctcctttaagctcttattcaaagatatattgactgtctaagaatctgtgcaggtcatttctttaaatacttagaaaaggatttttattttactaaggttatctattaccaaaaattaatattgaaatgaaaataaattttaagtaccatgatgaatatttagagctactccaacagtttagtgctatttttttcttgcaggcttgtacagcatatgtggattttatgatttctgtggccagattgattcgtcaggaagaaagattgcccatcgatgaaaaccagcttgctttggaaatgaataaagttatggaattggaaaaagaaattgccaatgtaaaacacatttttttttctgatacactgaataatgtcaaccgctttttttctttcccctctctatcatactttaagagtaaaaggtacagcactttaaccaagtagtaaaaatgcatggcttggtaatagatcattgacttcaaaaggacctttgaaactaaagaattttatagtaaactgggttcctgacatttaaaagacacactaaattggacaaatattaaactagaaacacttaattgccttttataagtggattccatcagaattctaccatttacagtcaaactgttgttagatgcccttcagactcagagcaaatgcaaagctgttttagttttgatatgtatagaatattactttattttaaagtttaaagtgatcacagagattgtctctatttctttgctaagaagtattaacccctgaacatagccatgtggcaatgtgatactactgagttcaaattgtcaggctgctgagctgacggagggtaagacaataattttgcaacaaagcccaaggagtgtattcctgaatttcttctggctctagatcaacccttggagtctgagttggcactttcttccctgatgattctttgatagggcactgcagtctcaagtgagtgaactctgagtctaagcagcatccaggttactgattaaacccatcgtcagagtcagtctaggacccacagagttctctttgtcattgcaaacgacaacctgcatccctgactccctatctgcttgcccctgccatctaagctcatcagaatcttgaagagttaagatcatggagggcaattttagctttcctggggctacgtgaaaccaaaaatctcctatcagaaccagggtgttcttggagctgccactgaatgaatggcatttgaatgggttacatgtggttctgtgttggaaacagacttgctagaggagaaatgtttcctgctct

SEQ ID NO: 108925 - DNA, 1740 bp, Homo sapiens
ttggacagtcacacaataaaagcactagatttccttttaactccaaaaaaggataatttattcatagaacttcccgtgttctcatcaaggccatctacagaggtgttcagaacaataattcagaaataggacacaaataaaaagaaaagctctctcatagattccatttataaacagcagttgacttctttttccttacctagtatccaataatctctttttgtggctatgcatttattctcgtgtattagttgatgcacacagccaagagatgaagcaatatccatgggaaaacctacaaactaccacattcagcgatgacattctctttggcactaattctagttaacaaggacttttccaaaggcataaactattgagttagacatcttacatagaattttttaatataataagtgtttaataaatacgttttgaaagaatgacctaaaccaccaaaggaaatgaagaaaattgtatagcatagcaccctatactcagtaagtgatgtgtgcttgtgtctgtgtgtgtaaaatacaacctaagatattgatagtcttaaacattatcaattcccatttagaaagacaagatttcatcttttggcaactccgtacttagcttctgaagtataaacatggcatgcctgtagacccaatatcgataattgaaaagatgctgttttctttgacttcataacatcactgtaccactgctataacagtatattttcatctataataggatttccactgagatgtgttactgtgtttgaatgaattgtttattaatacccacttttaaaagctaaacactttacacacatttccatttttgcataaaccaaaaaagctttatttttaaatttaaatttaaattatatttttattttctgtattggttagacaaagaagatgacattaagcctaatttctaggtatatgttccttaagcttaaaggctttgttttcgctcttaaatggttggcttaattatgctaggtaaataatcatgttgcagaactagtttttatttaaaaactgattgaaacaattgaggaagaatcccaagtgaatatcaaactgatccaaccctctaactataactgaatcttggacccaagaagagaaatccacaatttctgaatgtttcatgcctgcttttttccagccattcagctggttgaatttcacaaatgaaatcatgtcaactgtgaatattagtattacaaatgaggaagatgtggttgtttatgctccagaatatttaaccaaacttaagcccattcttaccaaatattctgccaggtaggtatgtcacagtccccatgtcctcaaagtttgcatttcatatcactcttcagaagctttgcagcctcatcttttctgttgctgggcggtggttttttttatacagagatcttcaaaatttaatgtcctggagattcataatggatcttgtaagcagcctcagccgaacctacaaggagtccagaaatgctttccgcaaggtgaagaaaaaatctctcttttcttaagacttaaagcataaagtgatacatggttatgaaggcttaccatgtacactgctaggacatggtgaactttgcaaagggacaaaatgccaaagttcgttatcttgcacatatttaggacatgttgctgaggaagataaatcttcatgggctttaccatcttatgatggtctatgtggcacgatgattgcattgtcctgtaagga

SEQ ID NO: 108926 - DNA, 1944 bp, Homo sapiens
cccttacttaggttatcctgttattcttaaatttatacacatacaggttctgtaagtactcagagttcagctaaaaccttgaaaagcagtaatgtgttttctcatataccatatttcccccattacatttattgaatatgacttcacatttatgtttgtgcagtggttacagtgttgtatgtttttctaacgctttctacaatgatattaagttgtaatagcaaaaagttctactggggcatctactgaaaatatgcctagttttcagatcatatataagtaaacaatccatttggattacatttcatcataggctaggaacatgggccttgtgaggagaagtgatgaatatttcaagaacttagatgagacatttgtgaaatgtgtgctcttaacatgctccagacctttccttctggtcaaatgccatttcctttttcttttccgtaggccctttatggtacaacctcagaaacagcaacttggagacgttgtgcaaactatgtcaatgggaatatggaaaatgctgtggggaggctttatgtggaagcagcatttgctggagagagtaaacatgtggtaatgttttcagaataatacactgtcagttatacaggacactatcagtttgttcacactgatgagcaattacagttctccatcatttggctaaaattttattaatttaggcagagaacctctgaatcataatatgccattgtttcccaataaatcttcccttgccttccccaagagtctagttatgtttctgctcctaatactgtctagtctgaaaccaactcaccattttccagaagcagtgtatttggagtacccagtaacatgttctattgatatagtcatttataaactcttctattatcaaaattgcccccaaattagtattttcttaaaaacatagaaagtaaaacaggatttatttggagtataagaaatgtgctttatttttcattgttaggaaaatgaagacagtggaacttaatggtatggtgaaagaatttattgaaatgctactttatgcttagctaaaccactaatggtaatgacagccctaatattttacattagttcttccagtatgatagtgaaaccattatattctgaaaatgatttttaccttaatgcatatattaagacctatttaatcaagagtgtcgataatagcaatattgcttttaaaatataatggtcccatatatctgttagcttaggtcacagtttgtctataaatttacgtttattaacatattaagtcatacaaagatagcatgtagctctatttttaaaaatctgtgttacaaagaatgaattaatgacctatatttgtcttctgttctgatttgaggtcgaggatttgattgcacagatccgagaagtttttattcagactttagatgacctcacttggatggatgccgagacaaaaaagagagctgaagaaaaggtaaagagcagacagctaactagcaaagaaaaatctttgctagtataggaaaaattaactttaaaaacatttagaaaaaaatataatcaaagattgcataaaaacttgtaagctccttcaatatgtagtgtttccagaaagagtttttgtggataaagatatatttctacaattttaatcttttatctctgcaaccaatactctagcaaggtgaaaatattaagtttctgttcaagcaaatgtaaggtggtgcactattggtgcattataagatctataattaaagagatgttgaagaagcttttttataactattcatgcccacccataatgtgcagcttttattgagacttttactgagtttcataagaataggtctaagatttctcaggaaatcttaggtttaaatttactgtgatcatttgtctttataattatataataactagggggaacatgtcctgtgaaaactgttaaca

SEQ ID NO: 108927 - DNA, 1149 bp, Homo sapiens
tgagctggaataacaaggaaaacctcgttttccacttaactaattaatgtcatttattgaacttgagaagataggtacactgactttggagaataaaggagaacataaaaactccaggaaccaatatttaggactagtattagcagtaaacctataagcccatatctgttttctcagtcaaatcaatgaggcagaaaggtaattataacctgctggaatggaagctgtaaatattacttcttctaaaaaattgaaaaaaaaagctttgagagaaaaagttcataaaagtacaaaatatgtggaacaatgagttttgtcagtttttatgttggttttcttgagaaagctgcagcctataaggataaggcattagaaactcaatttcagacctgattttcatttattcttgaacctcccaggaaagagccattgcaaagatctctgtttaagtatgtcagacactcattttatgaacagtatggatcaagttattcaattgctagtcatgggcagattataaatttgtatctgaaagttatataatcatcttcacattcaatattataattttcataggccttagcaattaaagaaaggatcggctatcctgatgacattgtttcaaatgataacaaactgaataatgagtacctcgaggtaagtctctataaaatagactctggactactgatacttagggctggtagtagtgtcatttttagctatggggtgcctgaaattatatgaagtagcctgaaaccacaggttgtattatataaagccttcaacgctggtgccagaatgatatttgttttagcctttttgttttcattagccaggactatatttggttattgttcatttggtttccatatattccattttaagaaccgtaagtaaaatctggtgtcctttaaagagtatcaaggaagggatagacatcaaggtggtgaacaacaggcaggcttcttatcacattttacacaggcttcgagtttccctccaccttctaagttttcctctactggaaaaaccaattcatgcctactgtattttaaaaacaaaacaaaacaaaccctgatatttgagaactgaaaactattttgttctgccctggtaatgtaacagttaaaagagcagagagttgct

SEQ ID NO: 108928 - DNA, 1458 bp, Homo sapiens
agtgactaaactatatctcagtttccttgactttaaaatggggataggagcccttagttcatcggtattaaatgaacataatattagattctattagtataatagaattaaatgagtataatgtaaaatttaaagtacttagaatagtacttggcacatggtaagtactaaagaagaatgtgctattatccacatgtgttatgtgaagattaatgtcattaatgtgaggtttgtttgacacttggtttcatttgattattataaaataatacactgaatttgtgatttggctggaatactgacctgtgatatactaatagaattaggttaactggaactacatccttttttggtaagttttttaatgctctcttttaactttattgactgatataatttaagaaaatccctatgtttttagcaaaaatttagaagataccggttttaatatttcttcccaaatcttctttataatacagttgaactacaaagaagatgaatacttcgagaacataattcaaaatttgaaattcagccaaagtaaacaactgaagaagctccgagaaaaggtggacaaagatgagtgcgtatattctcatttctaatgtgatcatctagaagcaggtctttccctcctttctttgttggattaagtgaaagagcctcagttagaaaaatattaaaaagtacaaagtcctctttttattgagaacttctaaaagcatctaattatggtatactaaagatatggatcaagactttaaccagattaaaatacctttctcattaaggtatcctcaaatttacatgtctttagtttcgtcttatgtcattgcctatcagctcaatttatttgtgaacaagattctcaaaaaccttagcttaagtaagccaattcatagctcctttaagccttctcttaggccttactctgtgtccagaattttcttctgctgacagccccaccttttttctatcagtcaatcccacaactccatccccttcatagatagttaatgtaagacttttctaaccctgtggtagtcaaataggagatactaggaaccattcttattcacagtcttcttatgctcttaatctctgcttattagtgacattagtatttcctaataactattagtttagattttattttttctattaaatagatataactaacatatttatcagcatatgtgtttatgcaccgaaattcctagaaccacttatgttgactttttctccctaggctcttagcccctagacaacaggggctattccttttgaccataaagtctcagcatctagcatactgaagaatctcagttaaaacaaaattaatgagtgagtgagcaagtgaaaaataaatatactaacttgatttgtgtggtaactaacacagtaacatgccaaagaggtgcttgtttcattcatgcattcatttatcctttcatgcat

SEQ ID NO: 108929 - DNA, 1031 bp, Homo sapiens
gcctgggcgacagagcaagaatccgtctaaaaaaaaaaatgtaataaagtcattactcttttttcttttctctttttgtggagcaccaagttcaagtccttgctgtgtatgtttagacagataatttctgttgcttctacttgtccacatagcccgtagttacatcttagagaattacattttcagatgctcaagatcctcactcccaaagtcttgaaagagaaatatgtgtgcatacccaaaactgaagggacagagttgagacttttgtagggttgtattgtagggcacttcagagaaatgatgatgcattaaattttcaagacagcaactaatgtaaatgaattcaattagccaaatagtaaacttctagacacttttttcccccaattcacatgctctcactgggcaaactcattttacttctcgacatcttctatcatcatcatgtcagctgaatatttgtatttgactcagatccatttactaagattcaaatccaaatgtctacatgcttatgaaacatctccatgtagatgtcttattgaccctaaaaacacagcatttgtcatttaggcaaaaaataatatctgcccattttctaaaaacctccattttactgctaccaagacagaaaccaaggactcattttaatcatcctagacttatccctttctgttattcctgacatctacagtgatagttaattcaaatctccattttaaaaaaaaagtctgcatccaccagctgctatttaaatattacgtaggaatgggaagaggggatctctagctcaccattcccatggtcacttctgtaattcagacatttctcactgttcattgactcatctcaattattatcctactttttttaccaaccaccttctatatcttcagtttatcctccacactactaccttagagatttttttgaagacacaaattggcattttatttcctgatgaaaacacttcagtgtatccctgttgcctgtctcatgatgtgtgactgttttgaagagaaccaagg

SEQ ID NO: 108930 - DNA, 1003 bp, Homo sapiens
gttctttcctggaagttctcagaattactttaaatcaggagaaaagtcaccaaagaaaattctgacagaaatgatccacccacccaagtgtctccaaaattaggaatctctccgaaataaagcataccaagtgtgtatgcacatatatgtgcatgtacacatatataaggttagcaaagactaaaaagattgtgccttgttgccaaacagaactacacacaaacaactggtaacatctaggaaaacagtagtaattttccattaccttttgttgaaagagaagtggcttctcccagtttagtgtcaaaatcagagtcctagcctcagacagattcaggtaagtcacccagagtacttcagttatgttaacaaccatatgcaacaatagaagttctttggtcctactgtgcttttgcctttgggtaaaaagttacacttatggatcattgggaagagcctgtgctgtggagtcagggggtgaggggagtagacctgagtcagaattcctgctttgcctcctaacctctgaacctagaatttttcctttataatctggtgataatgacttcacttttgtcctgcatggttgtgttctacgttgtataatgcacctagaacataacttaggtgctcattaaatagtaaccagtgtgacacagtagtaagaaatggtcatcttcatttttaaagaggatggcaagaaaatggcattaatccctgtaatgaaattttgtgtatggtgcagatcaacagcttaggagtaggagatttgattggaaggtgagcaggttcctattcttcttagtttaaatataattttcccagttatataacgtagtttgtaggtgtattaggaaagagattaataaccatattgtgcctcagtttctatacctgcaaatatatggatggtttgaaagatgaataaaagtatacagaaaacttcgaagtcttgatgagagaatattgataattgtaaaggattagagtgattattgtgatt

SEQ ID NO: 108931 - DNA, 1620 bp, Homo sapiens
aaattgaacactggcagtaccggctcactaacaattttgttgttttcagtttttaagttacacaagagtgggtgaaaaaaatttattctaggtgcttttgcaatctagtgggcttataatacccaaaaggctataggatcagtctgttgtcttctgcttttcttcccagctataaaaattatttctgcacactttcatcagcactaagcttcttcagggcaataagagatagaagagaaacacctggttcctctgtcaggtatatttcagttctattccccacccacattgttagctcagctttgagggccatactgcttctagtggcccctctttgttttactgccaaatgcccccaaacgagaataagcttacctgacaaaattacatctcataaattaaaaataaggtttcttccttcctgcttccccactcttcactttataccacatacatgcccacatttgtatgcatacagaccaccagaggaaggatgagaaatggaagaacagtggttcatctctaaagtctgatactgctctgtggaggctgttagtgtttggcctccacactttaaaggtatcttcaggtaacctacactatctattattttaggggcaagaatcaccaccatttcactttctctttgtgaattttctcttctctgtgctgccagtcagcatcaaatttggactgcattccaaccaaaagaacttacagtttttgttacatcactgtttagttggccctgttaatttagtttttatattaacattgagatattttgtgattgatcacaaatattagacattcagtctatagttgttatcatcaccttatttaagatgtaatgatctaatcacagtacttccagaggttctgattattaccagggacaaaatgtcctgtgcttttggtaattcccagactggtttgagggcacatcaagaaagatctcaaagaagaaaaggcaaatactacacactagtgctgtgtaaacccaaccaccataattctaattttatttgaatgtttggtggtcataaatagctacctattttctttaaggtataattcacagtggacattttaatatgcaaaactctccctgctggaaatttgcaaacataaatcaaaatgcagtcttaaagccctcaatgtaatgtaacagaagagcagaaaagcactaaaacaaaaggtatgacatttatttttacaaaagcaatagacacaagatggataatatataaacttcattcgtgtcctacttttgtgatctattgttatctgaaacattaatttcatatatcctgttcctctcctctgtaatcacagtttaaaaacaacttggattggcaccttttctatttcaatattaggatttttgactagtccagagccaaaaaatatgcaactgttatttgtaattacctgtaaaacccatgtagaattcactgtcactaaaccagaagttcgcaattgagaaactgaaccctaaaaccactgggacctagatacctgttaaattaacttttatagcagttaaaactttaataactataagctgtttacctaaaaaatttgctgccacgtttgctatgaaaatgtcgaggacacatc

SEQ ID NO: 108932 - DNA, 1111 bp, Homo sapiens
tatcctcatccctcaaattatcatctgggagccatttttttccattttttcattcagcctatagttatttatgcatttttctcatctcctcaactaaactagagtctcctgaagtcaggaactgtattttataaaatctctgggttctatacagagccttagacatggtatagacagacagacagaccgacaaatctacttaagaatgacctgggtttcattttaaagtcatacaaaaatatatctttgctcaattagctggaatgttgtattttttgaaaacacttttaaatggcaataatcagagacatattactctaagacaactacttgagatatcttagttcccaaaaaggttctttgtaaaccaggaattaactatttttaatatacttggatctgaagttttaatgacccacacttcagtattctgtcaactgctccagaatcgttgtcatagttacctagtatcaggaacataaagctaaataaatttcaatacaatcttaacccattgcaatttctgaagtgatacattttaataggttttgcaacatcagaggcctccataaaaatccatgcaaataaaataaaagattacagacttgaatatatgctgatgtttttcaagaaatagaaatgctttcaaatgagctctcacctagtgaactaattttaatttgttgatcatgtttcaaacagaaagttaagattcatctaggaatggtaataatgctttaattgtgtgagtgggttgaatcagataatgcagtatcatttgtaaagagttcttatgttttctacaggtggataagtggagcagctgtagtcaatgcattttactcttcaggaagaaatcagataggtaaggtgtattcttaaataattatttaatatttctctatcgttcccaacctgtagtgcattgtatgaccaattacaatacctctaaacaagcacagctgaggctgagttattgctctattgaatgcatttcttgaaagtaaatgcatccgtgtaccttctttcactatagtgggaaaattcagattggtacaaatcacgttaagtagttttgtttcttttacaatattcttatttatatctaaaa

SEQ ID NO: 108933 - DNA, 1844 bp, Homo sapiens
ctgtaaatatctaatatttatccctgaagcccatgcaaggttatactgtgttcagcccacctgaaagacaaagaaataacatgtgctactctgtgttaactagatcttaaatttcttaaggtcagggcccttgttttattttcttaatgtcctgcatagcaatgacccagggctttgcacttaataggtattgatactgaagggtttttttttaattacagaaagtaacgtttcagttattcagtggatgctagagttttaagccattaaagatagaattactaaactatgaacatttaattaatttaattttaatttctttctaaggtcaaagattagttacctccaaataacatgacccaaaatttgattaaacaggggaaatatattccaagggaagatactctccatcttttattagtatttaagacacattattagtatatttcagaaatagtgaaatatatttcatgagagtatatattataagaggatactggaatggggcagggaaggggagggtatgatggaggtggagaggtgggagaggaccctggggccataggccagaaagatgtgtttagctagagagcaatggtaagccttccaaagatttttagcaggagaatgatgatgcccagagttgtctttaatctggctacaggatagattcagagagtagattagatttagaatagattgtagttgtgtgagacagaaagtgggagactgattaggaaattaagtcattcctgagacaaggaatgagagtatgtgtaaacagtaatactgacaggagaagataaagatgctcctgaaagctacctcacccagcctctgcctaagcagacttgtaaaagactgtaaaagaaaggaggcatctaagataagtagaaacatttacttttgctgatagagacccttcaagggccattagcagaaataatacaaagactgagggcctagaggggaaaatgaatttgatgtttgatgcattaaatataacacatttgtgagacatctgaatggagaaagttagcaagttaatgcagatgtcagagtagacatactgaaaactacaattcatttatttattcactaaactctgtaggacacattagtaagttagggtgatcattcatttatttatcattgattattcattgattcagcacatttcctgagccctgattatgttccaggtactattctagttttaggcattgttcaattttaggcatttagataatgaactagaaaaatgtatgaaattaaaaaataaacaaatatatgtacagacacagaaatctctgctctcaaagggctaatatttgaggagctggggtaggattagggcagacaagaaaaggaaggactgtgatcataaagaaataaatagaatatgaggtagtcataagtgccttgatgaaaataaggtaaggttatgtgattgaggtataccttcaattgagtggcaatacttatttaagatattattgtagatggatacaatttctgcaataacattaaaaataatattggtgttactgagtaactatttcttccaaatatttataaggcagaaaggaccttctgaatgaaggttataacttccctttgcttcaaactccttacagcacaaaacaatcttggattgtaaagtgaatcgtgatgataaatcatagtttatagcaccactccaaggtgaactctgttgtcatccataataaaatgcctgcattggtttctattacagaaggtttttgtatataactaagtgaaactgacatagtgaacagcagcttagcaagcacaaagccaaccccaagcctgccatcactgaa

SEQ ID NO: 108934 - DNA, 1033 bp, Homo sapiens
ggcatgcgcctgtagtcccagctactcctgaggagggaggactgtctctaagaaaataaaaattttaaaaacttatgccacaaataatctctaactatcttctctccttgtagtcttcccagccggcattctgcagccccccttctttagtgcccagcagtccaactcattgaactatgggggcatcggcatggtcataggacacgaaatcacccatggcttcgatgacaatggtaaagtgcagttgacattttcctttggctgaggtatatgctcataaatttgattaagagttattataatttattactacaaagctacatttattcaaacatgtatcatttctctaattttcaccacactttcaattttccctttaaattgttgcttaaagagatcagaaaattctcatagtgagttaagcaatgtgtgctttacactctggcagaatgaagtaaatattcccattgggaaaatactatggtgtttgtcagcggcagtgataatactaggtcttagtttcctggttgtatatgacgtatcttgtcatactcttaaaggacaggctgcatgtctatgtcttaaaatcagatgtaaaatcagaaaatattgcctctccaagagctcaaaagactcttaagctgcttaagagaccttttttttttcgtcttgtacctactacctagttcaagtctttgcaaacagttaggcacttaaatgccaccctaaatggaaaaatcaatttagagtttcaatcaaagctgaattcctgagaggaataaagacgtgaaatatgtaaagaggtgatagttcaatctatgacaaatttcattcacaaatggaaagtagagaacaatagagagaaaatacttaatccccattttagagagccagagaaagaaaaagagacagaaatgttagaattcttaaaaagacttactaagtgtctattaactcaaactatgcaacagtctttacaggtaggttctaatactgtttctgttttccaagtggaaaaaaataaaaacacatg

SEQ ID NO: 108935 - DNA, 1092 bp, Homo sapiens
ggcaaggaagctgtaggagaaaaagactttttttgtgtgcttgaagtagagggaaactatgagtccacagtgtcctatgaagggtccaggaatataaaaatgccagaataaaaatgttggccattttaaaaatctcaaaatatcaaactaaacagacttgggtcaggtaaaaaccattcaacagaacaaggcataacttcaagaatattttgtctggcggcctcttctgagatatcaagagccaaatgggtgaaatgtctgggtcaatgctgagaagcattagcaaagaaagctctggcagtccaggctttgccaactctgtgatgaggagggatgacagtctctctcatcgtctgcctaatttaatgttctgtcacacagcagtatttcagtccttgcactttgaattaaacatatcttataattcttgttgcaatgagttcccattttacttaaataaatatattataggcagaaactttaacaaagatggagacctcgttgactggtggactcaacagtctgcaagtaactttaaggagcaatcccagtgcatggtgtatcagtatggaaacttttcctgggacctggcaggtggacagcacgtatgtcattagcattctcttgaaaagttttagacatgttcaatcttaagtgtattattggtggtttctttttttaacaatcctaataaagtgtcttttttaacagcttaatggaattaatacactgggagaaaacattgctgataatggaggtcttggtcaagcatacagagtaagtaaaaaagattttctttccattttagtgatttagagtgtttctcatatttaataattcatttaaaaccttttgcaaaaaaagaaactcatataagcagtaaatgatgaatagaaaatggaaaaaaatatgagaagaaagagtggtgaatatgctaaccataagggtcaatacattgatgtgacggagctgaacacttaagtttgcaaagagccaagaagaagagaaaatatggaatattatatcagctgaaatgaggagagagcaggttcacaaaggaggcaacatttttctaagaaataatctctggaa

SEQ ID NO: 108936 - DNA, 1032 bp, Homo sapiens
tctagggacattattctcaactgctgagataagaatctactctgtgaatcttggggatttccattcttgtcctgtgtaagtaccataaattattatctctaatccttttgagatattgttttcctagcattgggtattttgctcacacacatcttcagatcaagactaagctgaatgcttgaggatgaccatctgtaatctctgaggttctctttttgtgtagctttctcctctttagtaacctgttcttggtgtccctgaactctcagctccttatcctcaactcaaggagtacccccagctctgactggtttgctcctatgatatggcctgaaaactctcaggacaataagctcagcagtcatgggactcactgagagtaaagtttaacatctctcaggggtcattctccttttgcctgatgttcagtgttatgcaaaccattgttttaaatattttgttcatcatttagttgtttccacaagaagttaaatccagtccctatcattccatcttggctgaaagtggaaggcattggcactcaatattcccatggtgattctaatacacagccagattgagaatcactgctataaaatccagccaaagttgggattgatagtactcccatggagaacctcacctagagcaagtacagaattgttaatgatgaagcaaattacaattgtgcaaatattttattacactttgaaaatatgtaaattcttaacgtgtaatgccttgcccccctgctagattgcgagctctctaagagggagcaggtgcaagcctttcccatatccccagcatctttacatagtagaggttcaataagtctatgttgacggtaagtggaagaaatgaaatatattttctgctcatctagttggtcacattcctttgtattaaattggaaatgacacatctcagaacgtttattatgaattcgttttaaaagtttatttagtagaggaaaactcatttttttcagtagcataaatctttaagaattaagaggattttctgacattc

SEQ ID NO: 108937 - DNA, 1466 bp, Homo sapiens
gagactaggcctctaagggatctcaagagaatcctttgacttggcaagaatcactcgatcttagtctggtgagtctattttgctaagatagtagtaactaagttaaatgtagcaattgcagacttccttggcaattcatttgtcctgactggtcttattcatcaatttataaaacaacatttagataagtttttcatcacttatttaggtcatccattcattcagttgacatttattgatcacttgacatatgccaggctcttgtcatctactattcagtagcttcttcttttcaaagcatttgtaaataaatttgatttgtctttctaatccataaaatagttgtaggttaccataactaaatgtattatcagggtgattttaacataaaatgttaattacttggtggcatgatcttttacataggtttatatataaccttaggaattaatattattgtttttctattttatcaactgcctaggcctatcagaattatattaaaaagaatggcgaagaaaaattacttcctggacttgacctaaatcacaaacaactatttttcttgaactttgcacaggtattgtgtctttcttgattgatagatatgaaaaccattttgagttataatttcacagtaagttagatgtcacatgctgagttcccttgttttacagagcatttgacttgattcactttcattgtttataatagactgttggatcatattaatgataaataactatgttcctggttgcctttcattgaacattatttgaagagcgaatggttgaggaatgcagaattccaatttaatttttctccttcccctcaacttgctcaaacaaataatccttgattgaacctgagtacatgctttgcttttcctattcctatctctaggtgtggtgtggaacctataggccagagtatgcggttaactccattaaaacagatgtgcacagtccaggcaatttcaggtgcgtggatatgaacagcaatcaaggtgctcttatattgggtccattgcttccacatttggaatttagacttttctaactctgattcttttacatttggaaattcagtgcttttttttttttttgagagtcaaaggtaggatcgagagaacacatcggagcattctacataagcatagccttggccactctctttcttagaatctacaataattataattccttagaatctacgaggctcagggcttgatctattccaacaaagatgtcgcctcagaacagtggctcaatttaaagctagaacaaagatatttctaagaggctgtgaatggtttaggcccagacccaatgagctccaacttgcaaagaaaaatttcaatataaaggaaactttctactaattagaggttcttcaatatggaataacattattcccaaagcttcaggagagagtacattgaagcacagcccatcaaggatgtgaga

SEQ ID NO: 108938 - DNA, 5498 bp, Homo sapiens
ttacagatcattctgactgtggtgtggagaatggttggaggagagagaagtcctaagatgtacacacagtagtacacctgccacgtagggagaattccataaatcaaaatggactcacctgtcatttgtgcctagtccttccaaaccagtccacttgtctctgggcccctcctcccaacccaagcaaacgtggtaggctggccttagcaggaggagaagggaaggaggtggttcagggttcagggtgggtgtgaaaacatcacctctgcatcaatgtactgacccatctctcccctcaaacactgctaggtgcagatagtgagttggactgtgttgtttttgcccactggggtcagagataagaggaaaatggcattttgccagccctttccagttattcaagctgaatccagcttctgatatttaaggagcccttttggaaaaaaggaaaataatcctctataaaagcaacaaaaaatatctatttaaagtctattatatttaagtcattatgtgagccctttcaagacatagtgagaaatcatgattatattctttgaccaaactcttattataatacaactccaaatacctgcattttcaaatgtgaattattcatgttttacaaacacatataatgcttataaattattaactctccatgacaaccttaagatgcatgttctattgtgcagaaaccaaggcacaaagaagcttcataagcaggattcaagccatgtagtctgtctcccaaattgcttttaactcctgttctttgttacttctccatttaaaaattctgttaatgagaaggcactgactcattgtaccaggttattttaagtttaactttaaattccaaattcattcacttgacctgcagagggaaatgcttcagggctccagtgtggtatggacgtgagtatcaaatgctgacggtgactttttttgtttgtttcaaaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctgttccaaactgccaactcctgtgtaaatctctaccccatttatttcttgaaaaatattaagattaaatggagcttttatctctgtagtcttgcatttcccactagcttcaaattgaatttttagaaaatgaatgatataagctttgtatccattatgtccttgttttccccaccctttttcaaagatcaccatgactttctgattggattttttttcaaaagtgaaatggccatcaaatgttatatggagtcactagcataatcagatgacttaggcaaaagccaaaagtaagtgtctttatccacagtctctagtctgaagaagttgaccatttggttggtcaagtggacagaggagtcacatctgactggtggtcaaactggcacatgtttatcgcattctaatcttttatctaacaatggtttcttaatttctgcttctttgtattttgcatttcctctaaaacagtgagaaacactactttcactttcaacctcatagacaaaatgttgtgcttctattttgcttgacaaaacagatcttctcagttgtacaaaggaagtctggcagaaaaataatcattggctcttgccagaaataatgatgagtttccaacttggggaagtatagaaagactggaaagactaatatttatgataaatgtttatactctggattttccttctacccagaaactgacaattttgcgggtattaggcatattagcatcccatttcactcttataaatacacttgatagaatctccaatctgacatttatgctatatccaggaagacaaatggagccaagtatctgtattatcgttttaccttggtgtaaatccttcttacatgctatgaatgctctatgtcctctgacatactgcatcaaagatgtaatgctaagacgtatggcagctttataacaccaaagaaatagggattcaaacactaactagggctgggtgcagtgcctcacacctgtaatcccagcactttgggagtctgaggcaggaagattgcttgagcccaggagttcaagaccagcatgggtaacacaaggaaaccccatctctacaaaaagtaaaatacaaaattagccaggcatagtggcacatgcctgtgaccccagctactcgagaggctgaggtggaaggatcgctta

SEQ ID NO: 108939 - DNA, 1032 bp, Homo sapiens
gcaaagtctatgtaaatttactatcaaatctgtacctcactataaaatgcacttaatcctatcaaaatcaactcattggctgggcaaggtggctcatgcttgtaatcccagcactttgggaggccgaggcaggaggatcacaaggtcaggagatcaagaccatcctggctaacatggtgaaaccccatctctactaaaaacacaaaaaattagctgggcatggcagccatcacctgtagtcccagctacttgggaggctgaggcaggagaatggcatgaacccaggaggcggagcttgcagtgagccgagattgtgccactgcattccagcctgggtggcagagcgagactccatctcacaaaaaaaaaaaatctacttattatttatagctaataattcccaaaacatatatctttttagaaaaatgaatgaaatgaaaagtagtatattacttatatgtctcctattttaaaagaaataatacacattatcaagtattttaagtaattctatcaataaacatttattaatcatctgatacgttcaagatactatattggaaacacaaagttagaaaagaaaagcaagataaagcaatattgtttagccagtactgtacttctctaatacatgtgttcacttattcactggtgaaacattgagcattatttatgtgtggtgcactataccagatccattagaagataaatgaaaacaattgtccttttaatatagtagagacatgaaaaatgtacacaaacatattacacagctaaacatgacatgccaagagatatagagaaaacaaaatttgaaaattgaggagaatttcctttcctatcatggtaaagacatcctggatgggatagaatgtaatttgcatttgacaatatggctgggattttggcaattaaatcaggacataaggaaatattttggcctaaaggtatctcacatgcaaaattagataacaaaatagtaagaaccccataattactctgtagcaatgctaaatctgaaagaacatagca

SEQ ID NO: 108940 - DNA, 1032 bp, Homo sapiens
ctaaattcatgtgaaacctaattcctaaagaggcaatattataaggtggcacctttgggaggtgattacatcaagagagtggaacctccatgtttgagattagtgtcctagtaaaagagaccccagagagatccctggccctttctgccatatggggaaacagtgaaaagacagccatccatgaatcaggatgaaggccctcaccagacactgaatctactggtgctgtgatcttggactttccagcctccagaactgtgagaaatttctgttgtttctaagctacttaatctacaattttctatagtagtagcctgaactgacttaagattatcagaataaatagaatatgatataggattcaataatgatcaaagtgatggaggaatcaaatgaagaaattacatttacctatgaatatttgcaaagtctttagtaaaatgtgtcattgaggtaggttttaaagatggagagattttttttttccccaagagtgaatggtaggatgggaattccaagagaagaatacaacctgaatcaacattcgtaattgggacagttcttcgagtcagttgggttatctcaaactaaccagacaaaagagttatttttcaaggtagttcagagccaaactgggggcatctagaattcaaactaagaagttttaattttggaagtgcatttgaaattttaaagccatattttctgccaaaaagaggattgtgctaacatgaaaatagagacctggtagacaacacaaaagcagacttcatgtctgttttttaccattgaaacttcagggcttgttacagcaccaggcatattttagcactctttctttttttctgtttgggaactaaaaggtgagtttatgctattgtccttaattattctaccacaaaacacacctgttgaaatatcttcagcatatccaactaagccaacccccgaaccatctcttgagtcattttataaaacgatgtttgtatcctttcctctggtaaaacatcttgccagattaaaatgctaaga

SEQ ID NO: 108941 - DNA, 1050 bp, Homo sapiens
gtccaggggtgtttcagtggcttgagtgccatcccttacttgctaaggacatctttttgtcacataatgactccagtagctccaaataccacttcttctcacatcaatattcataggcaggaagagagggttggggtctctctgcctcttttttctaatcaggtgctgtggagcttctcttctcccaccctgactctttatcaaggaagagaatctttcctaagagcctctcaatagacttccaattatgcttcactagtcagaactgggtcatatgcctacctctagctgcaagggggcatctgacatttgcagcctcactcatgaaagtcaggttctgtcagcttagaaaaaggggtaggagaatggctgctgtgttcagaatcagcaatcaataccacgtgtctgccacacacagcaacaatattctcactgtccatgtataggattataaaacatgtgccccaaatcactatgctgttgaaacacaactcactgaatccccaccatgtgggagtctgaatcacaatcaccgacggcagagttgtatttaatcacaacataccaattcctgaggaaatagagtatttcttgaaatccaatatcaagcaacttcctgggaacatctatttgaaggatcagatgagaaatcgtggctcttatgtaacaattcataacaatttaagagaagtttctgttatacagagttttccagaactcataatcaaaacggtagactacaaataagtagaaggctggagattgaccaagaaaattttccctcctgaaagataaactacaacttggcttatttttcaaagaatcaacttctcagactctaggcagataaatgaacacaaaataacttactactgtgtattttagaatcatacacattatctgagactttaataacagttaaacagatggtagatggtagcagagatgcctgtttcaaatgacagtggtctaacagctctcagttaaattgcttgtgacagcaaaaggaaaaaaagacttgcaatgctatcaaaagctaaaacttaaaaa

SEQ ID NO: 108942 - DNA, 1038 bp, Homo sapiens
ctacaaaataaaaataagaataaaaataaaaataaaaaaatcagccaggtgcagtggtgtgtggctgtagtccccactacatgggatgctgaggaaggaggatcacttgattccaggatttggaggctgcagtgcgccatgactgtgccactgcactccagtctgggtgacagaatgaggacctgtctcttaagaaataaaaggatgccacgagaaaagaagattcagagaaaaaaaaaatctcttggaaattaaaagcatgagaagaacaaacaaaaaagaaatagaaaaaaataagagaaaatagaagggagaaacttatcaaataaataatacaaaaaatttattagcatggaaaggtaagattctctagactgacaaacccaaacgagggccaacctcagtataaagatccacaaagaggcaaatcagagtgaaatttcacagtgccaaggataaagtggaaccctgagtgcttgtaaaaagagaaaactaaactaaactaattagcaaacaacaactggtcctgtgaaaaggactggaatcagaatggcatcagatttctcaacagcagttctggaagccaaaaatcgtgagagcaatgattcaacctagaattttctgccaaaaactgtcaaacaaatgtgtgtgtggaataaaagacaaatacaccagagcacacacaaaaacacatgagggaaataaataatttacttcctgagagctctttcacaagagtgacagagtaaagtcagagcaaaagctgaatacagttccagaacccaaccagaaggaaagaaggagaacttttgtagggagaaaaaaagcacaattcatggattatctgttgcctttgattatgtggaacttgagagaccattagagtcattgggaagaatttgtgataggtacattaaaagttaaccaaatgagtaggaatgtcagcaagtaatcataaaaaatgttctgtgagaaaggaaacacaatcacagtgtacaacggattcagcattgttcaacattcgcatacttggaataa

SEQ ID NO: 108943 - DNA, 1055 bp, Homo sapiens
aaaaatgagaataatgaaattaaatggctgcatgagaaaatccatccagtctagagcgtaacttatttctgcagtatggccatgctgagtgatggccatgatgcagtactcatacttactagaagaaatccagtgtcattagggatcagaccctggtgctgcactgcctgcggtccagcccccactctgcctgtgctatgcaaatttggatgaattacttatgttcttttgccttcaagtcttttatctgcaacatggtgatgatgataatgacagtgtctgccatatagaggtgtgttaagatcagttgattatatatagtccttagaacactgcctagcacttaataagcagtttacaagtaataggtactgctgtcattgctaaaaagaggtaaagagtggcaaatctttagctttcctattcagataaatgaaagtctgaatactcagcagatctgtatgcaaagatgatggttctggcacttaggctcagcatttttctctatcagaccattctccttcatgttttccccaccttatctcttgaccccatgagggaaattattacttccagaaggctttaggccacctgttatgtatgttataaatccagaccttattcttcccccgtcaaactgctgggcaaatctggcccactcccaatccaggaggatttttgcgtggactcctgagctaagaatgggttttaaatggttaaaaaaaatcaaaagaaaaacattttgtgacctgtgaaaattacttgaaattagaatttcagggttctgaaattttaataaaggttttattggaatttctgaaattccaataaaggtttattggaacacaaccgtgttcattcatttatatctgtatggctgctttctcataacagtgacagagtggaatagttgcagctgagagcaaatgtcctgcaaaacttaaaatattcactatcaggccctttacagaaaagtttgccctcccctgtgctagataggatcattcaatgctttgcatgctcctacagtctcttgatagaaaatcctagatcat

SEQ ID NO: 108944 - DNA, 1080 bp, Homo sapiens
tactaatatttaccctctcttaattgcttgagaaactggaatctaagtctcattcttgattaaacccatgcttgtggtcctgcagtgctgacaagataaatgattaatggagttggtctgcaggcatccttcttgctgggattgactgggcatatagcaaggcctttctggcctcagtttccttatctgtaaagtgagggtataaggctagttgactcccttgattcccttcttcaccttttgaatggccttaaaatacaggtgtctctgtccttgcagggagtagcgctactcccttgccgtcattagaatgtgtgccctaatttttttcgcaggggttggtgatatatttgtgctgctctggctataatccttcacccagagtattgctggaaaagaatggaaataattcagctcatgaaaggatcttgacagtgtgaaaagtctgagttgatgagccatgaggttttcatcaatattcacagcatgcagataaaggcaactgggatttagaaatgaacaaaacacaaacaggatttaactttctgtgcttaaatctgttggtttgatttctaactctttaacatttggtaaacaacaaccaaccaaaaatactgaatgttttctggtacaagtatcagaaaccgtactaacagtgccttaaacaataaagaatattaattttctcataaacaagagacctgagatggggcagttccaggggcagctacttcactggttcagtgatgtcatcagagacccaggtcctgccattctcaccgtgttggcttcgtcttgcagccgactgccctttggtcagagagaactgctgcagctttaggcagtatctctaaacacagccctaaacagaggtagtagagtttcttctcacaattttttttttttttttggagatggagtcttgctctgtcgtccaggctggagtgcagtggcacaatctcggctcactgcaacctctgcctcctgggttcaagcaattctcctgcctcagcctcctgagtagctgggattacaggtgcctgccaccatgccccgctaattttttttttttttttttgt

SEQ ID NO: 108945 - DNA, 1053 bp, Homo sapiens
gctttttattaatatcagaaattcaaatgaggattacttctctaatgtaattgccatgagcattcataataataatattacagatcatgtgcagaccatcctctttagtttactaataaaagatttccataaatcaggatataactttaagaacactccctcaccaccatttagaaaaattgtatgaggaactgttttttttatttgcaagatttttaagcagagctcttaacaatttttttgtgagcagtcattttaaagtgcctacatttgcatgactttatagagacacagttaaattgacataggcctagtcatctcaatacagaagagaaggcaaaaattgcattttaaaaactgcattttggactggaaagtatttaatccccaaagataaaccgctttacagctgatttgttcatggatatgatgatggctctagaaggtaatagatacttgatttggtttccctgaataattccaaattctggattaaagcatggtaattgacttaaagaagacaggacttttttcttgatatggagatatagggagtagcgtgtgtgaaagtgggtaggaatagagtattctgtgactacaaatgagctgattctatggagtttccacttgtagctttttggtagttgtaatatttcagccatcaagcacagctcttttcagacacaataatgatcacttgctgacatggccctttcaagccatgtccggtgtctgacagagctgatggccactgtgaaactactgaaagatgtcctggatgagtcaagctggccagactggcttaggtttaaaaccttggatcctcacatttctggaacaaaagaaaggatgcatacagatcacacagaagtgtgatttcagttaaaccaatcttgactatttttatgtttctgagtcaagtgcttcaagacaaaaaaaaaaaaaaaaaggagttcttgtggtcacttgttcacgtagggaaagagcatttaaatggccactagtgcctaaatgtccacaggtgcttctgcattattcatcagaagtttcctc

SEQ ID NO: 108946 - DNA, 1051 bp, Homo sapiens
tcagtagatgtgccaaagctgagtgatgtttatcatcaagctttgatttgacggtaaacatgtgcagatcgtgtgcaaactgtcttcctaactgttgaaccccttgcttcctttgtgcactggctagtgcacccagggatgtcaggtgactttttcataagaagatggtaggttaattccataaaagcgcaattcaagagcccactttgaatacattttgaggtggaatgttgtctttgcagttggtgatttgaaaggttactttaaatccactgagtaaacatactaaagtaggtgagaggttctttcttgggttttgggaaagtgttattgatgtatgataattgtggctaaggtcatttcctaatcttcaatattaactacaagtttgtcctgtcctctgtagagaagtataagaattaatttgctgtctgaggaaataaaaatgataagggactactcacaaaacgcattttccatagcaaaagggcaaaagtgctaattgaatgtaggtaatattttcccacttcgaggaaaaaataatatgaactttgaatcgattccttatctacagatatggatccttatctacatggcattttattttgctcatccttaggacttttctcatcttttattaggacaggacctaccatgtttttctaataatgctggcctggccaaagtcatatagaactttcgaattcctttttacttgatgttgtgcccaggggctggccaaagttaagggtttagcctcttctggcactgagtagtccacagggaaatggacctctgactgagggctcattaatttatcctagtcagttttattttttaatataatttctgcatccaggtatagtttacaatgttcagactgtatctttagctgtcaaaggcttacggtccaatcagtttggggggaaaagctgctgagctttaagctgttctaaaagtatataatttacacaaaaattagagaagttggatagggtgatctatctctagtgaatgactgttttgttgttgttccaatttccagtccatt

SEQ ID NO: 108947 - DNA, 1017 bp, Homo sapiens
tgcctttttgttctatttgggccctccacagattggatgatgcccatacacattggagagcgcaatctgctttactctatctaccaattcaaatgctaatctcttttggaactaccctcacagacacacccacaaattatgtttaatcagatatcttggcatcctgtggcccagtcaagttgacccataaaattaacaatcacaagtggagccccttaaacttctttcagtgaaggtgatggtggagacagtgtgggagagtctgcaatttatcctgagtggtttttgctttctactttcattatactaaagaatgcagtgatttttaatttaaagtaacatctaagccttgggaagtagttcagaatgtggatgctgaaatcttactccaccacttacaggctgtgtgaccgtggggaagttacttagcttatttatgccttggtagcttctgttgtaaaatagggataataatagcacatacctcatagggttgtttagattattaaatgactccaagcatgcaaagcactgtgaatactgcattgtgagtacctattaaatgctaggcagatttagctattctttttttattattatattaatgcattcactatttcttacaactgggaacaattactcttgatccattttttagtatgccaaccttctgcagctggtgaatcttagcattagtggtcttatttaggtttttgactgattaaacaggattaatttctgactagtgtttaataacttctctgccaggaaagcctttgggttttttttgaggttttagtataagttttcaattgataggatccaggtgccctaaacttgagattttaaaaagtttaaaaaaaattaaaaattttttatttgtttggatacataacagttgtacatatttatggggtacatataatattttgatacaggcatacaatgtgtaatgatcaaatcagggtacttggatatttgtcaccttaaacatttgtcattctttgtgttaggaac

SEQ ID NO: 108948 - DNA, 1130 bp, Homo sapiens
agtggcgagtacctcctcttgtatctggcctttctggaatacacagtagacagggaatatctgccagttcctctgatcaggacaggatttcggctgcactggagtttcctcttcttggactttttcgccttgacttagcctttttcaccttgacttaccctttttcactttgccactagtatcagctttcttggcttccagtctcttcttagtatccagccttttaaagttttcacctgccatcttgcaagataagaaagcaaggtattgtttactatatgaatccctttgtattttattggtaaagtttaaagcgtaaataatgcggaatgtttgggaatatcttagctctttctcaataagcgtagtttcagattttctgattcaataaatattttggaaataatagattattattataaagttaaactgtgacctctgactagtgtttcctccttatggtggtcccaatctcgctgtgggtggttttctcacatatatgcactaattagtactcagccgaatgctagagtccgcatctatctccggagctcttctctaggcagctgtttcctctccagtaacctgtcctgtgaactgtagttgtcttggcctccctagactcccagccttgtcttctcaactgacagagaccactgatctcttcctaggttccccttttctgttttatagtctggaaaatctctccaggcagtaagctgaggcaaccataggcctacttcatttggttcctgtctctcagagatcactgttcttcattgcttgactccaaagccttgaaaactgttgttcatatattctgtttgtttcatgtgggttactcatcttggttggaagcagaagtctcttttctgacctattcttacatttttttttaacttaagaatcagcttatttagttgcagaaactttttttttttttttttaaacttgtccttgttgttactcatatatgagaatcttctctcccattatattttctagctggttactgtgttattgcatgcaggctatttattttagtatgtgaattttataactttctaccttactaaatttttaaaatttttatctttgattatcttgggttttataggttatatggttac

SEQ ID NO: 108949 - DNA, 1866 bp, Homo sapiens
atgagtgacagaaggaaatgaaggcactgaaggatttggtaaggcaagtgaaaggttcaggtatggggggatgggatgctagcaattagaaccaaggctcagaatctgagctatgagttggctttgataaagagccagtagcctttgagactccctcctgggttcagtgtgtcttcagaacctggcttatagatgggctaatcaaaatatgccttgttaccctccagctagggttgctctgtgacccagtgtaagtaaccctggactcagtgctctgttcaacctctctctctctccctgctctctatctctctggtctgagcacagaaccctttcattgccttagccaaaaatcaataaggttgtgctatgtgaactacaaagttgttgaaaaagttgattgtttgcctcttatatggtatatgagagtgccgaatcctaaccactagaccaccagggaaggtatcatatatggtatttgaaatgtttcctgtccacctctgctatgggcaatgctgacaaatttggcagaggacaatacttccctattctaaatatgccagttcttcatgtggcattttgtttaaaagcctcaggcaggcagataggtatttcagctatatggaatgatctgtagagtatatcagacctttgttatttggtaaatttcatatgaaattcaattacctatgaagtcactctaggggagtcactcatcctgagatacataggaaaaggaaaattgtcaatttctttttcaacaagggatttttcttttttaaaaaaggggcatgttgattttcttttgataatgtaaaatcccaatgcacagaagatgaggcaaaactctagagactgatatgggtagatggatagaaaagttattttagggcaaaccccctacccccaactcctgtagtaattgaaattattcagctaaagttcaggagcagctgtagttagatcactttaaaattaggatattaggatgaagtatatgtttttcaggggcaaaaatggtgctgtctgcctttgtcaatctctgtattctccagaatggaactgtgcacacagcaagtttctaaggtatactaaccaccaaaaagtctttattgtgtaagacctacaggggttgactggaaatagccttggagttggcctgctgcttccatctcaatttcaaatgccttcagtgtatgcagtattcttaagaatttcagaatttgctctgagagccatcttggagagagaataggttggtaaaagtggctgttgacttttgaaaagaatatagtttcccaaaagatgttatatccaggcaggccgtggctctgctgtattaggaaaagtccgactttcaattgtgttcagcctgttaggcacggaggactgccacagagagtgggcagccacgttcataattcaggtatgggtgccttgtcaggagatccatccattctagaagacatctggctcccccactcatgaatataggtaatgattctttccaagttaacatataacatagcaggcacttgatatgccagtgtcaaattaagcagaacttctctttttctaatgatcgactgatgttaggaaattattagaagtgaatagacagctgggcgtggtggcttatgcttgtaatcccaatgcttttggaggctgaaggtggtggattgcttgagcccaggagttcgagtctatcctggccaacatagtgagactccatctctaaaaaaattacaaaaattagctgagcgcagtggctcacacctgtaatcccagtcctttgggaggccgaggtggctggatcacctgaggtcaggagttcaagaccagcctggccaacatggtgaaacccca

SEQ ID NO: 108950 - DNA, 1096 bp, Homo sapiens
aaactagaagcaggagcaagcttgaggcatgtaaggaaggtgtttttatcatcttgttgtgtctctgaacctcaatttcctttttagtaagaagagataatactactttcttgcttacctcacaaggttgttgtaagaattactggtctctgaaagcatttgaaagatagaaaaggaccccagatatgtaagatggtatagttgtacaaataaggataatgtatatttcatatactttaatgaaaagaaatcatatttgttctgggatgacagtaaatacactttgacctagaactttggtaccatctgctactaatttcccccatggcctagtatagcctacatgccagcagtgtgcatgctgtgtacgaatgcctgatggaagggtagatgtcaacgtaagagcgagtcctagatttctgagcaggaagaaaccatagcaatctcattcttttataagaagaaaaaatagtcatagggagactgcataattttcttgaagacgtgtaacagatctgtggctggaattgagccatccaattcccagatcatgagagctgtatctacccttctcagtcatacagatttttttcttttagaagttgctacatttagatatttgtgattttgctcatgctatgtcatttgaatcctttgtacaggctgttttttttagggaggaaaatggagagcttcttgtggaattctcaactgctaatcattaatgggtacaattaatagagatagaccatgtgctttatctacaaggtgctggttggggatatgaagatgaataaaaagaacttagctctcttgtagtaacttctggtatagtgcacaaacatgcttatattactgtaataacagtaatactgtaatagaggaacattccagtggtacctgagtatggagaagtcagcaaaggatttctggaggtgacatttgaactgagccttgaaatatgatgaggatgatgtcaggtgtataagcaagggttgaagctgaaggagtagcaaggaccaggtgttataataaagacctggtaatccaggttaagaaatttagacattattaccaaaaaaaaaaaaaaaaaaaa

SEQ ID NO: 108951 - DNA, 1047 bp, Homo sapiens
atccaactgacttctttttgtgtcttcataggtaaaaatgattattaactctctgtggggagccaggtgctgaactttacaaataatgtaacataatccatgtagcatttagatccagtaaggatttcactgtatggtaatttactaggtagtagtgttgactctgtgaatccaaaggatgtttagacatttttcatttcttaggagaaaggttttagagttgctgctctgcaaaaccataggtgaatgacctttagttgtggaagctaaccctttaaagcagttgccctgtgtatctgccagaaaaataatagtgttccgatccttgggaattatatcagtcagtgacaggaggatggttattttttaaagacaaatacttagtctcagtatgtcaacttgcagcctgttgagaccatttttaatacatatatactcttgcttgagcttctaagaacccatctgggaaataatattctcataggtctcttattttggtctctgattatatttttgcttccttatcccttaccatttctcctaaattatataaatcagtgtagacatttaatgtctagcaactgtaggcaccatgtttctgatactagtaatgtaaaattttctcttagctagagaacaagttctgcataaatcatagtactaaattatttctaaattagattaatttatataaagtgataaaatgttattggtttcctattttatcatctttagtattcatgaaggagcaattcttttttcttttttccaaggtctttaacaaaattagcttttgaaaccatttttgtgctagtcgactatgaatgaggaggactattgaagcagaaaattaaaatacttttgatgtttttattttaatactaatcattaatctatacttcagcattatttctctcattgataaatttattgcttttaaagtatttctatcttccataatgtcttttctagcaaaagagctttgctacatttttgaaattcttgctatttgagtgacttatcaaggagcaagaattttggcagcca

SEQ ID NO: 108952 - DNA, 1102 bp, Homo sapiens
ttaacagaatcctataatctaagctgctttcacctttctaagattgttctgaagtcttccccaatttgatgacagacttaatgtttattattgctttaaactaagtttaagataacaaatttaaccttactttattaagcactttggtgtttatagtgttttttcaacgttcattatacaacctcactaaaagcccttgtaaagtagagagtgatttcattttacagatgaagaaagagaaacagagatgaaataactgcccaagttgatgtaactaattaggtattagcaatgtcagcatgaaaatttctgcctccacctttccaggttggttctcttgacattccagtggtgaagtgcccttagcagaggaggcgtgggaatggcgacttgaccctgtggcactgaggttctgcgttgcttttctctagcctcagccaagggtcctgttcattgctttatctctcatgcagtgtttgatttatgtattgttctgttgcaaatttattcgtattaaaaaatagtaaatatgataatagaaaaatcacgggagttagaagaactaggtttattttttcaagctttattttgtgccagtttttaaagaatttagatttaagtgccttaaactcattattattttcattattttagaatgcctttattcagagatctcaaaggctataatcatttaaaattttttctatgtatttttatagtcgtattaccaattagtttattactatattgcagatacttatgctaagggcttgatgaccattaacattgtcatacggaatcctttcaaggactttgctatagctattattcaacccattttatgaatggggtaactaaagcttgtggagattgtaaaatggtgacctaaaattcaaatcctgatctgcctaattccaacacctcactgttttttcttctttcaggctgccatctccgttttaattaaaaaaaaaattaacattctgaggcttaagttctatataacagtatttgctctgttgttgactagcagtgtacggtcttggacaagttacgtaatctttcaggaactcagttctcttttctgtgaaatgagcatgct

SEQ ID NO: 108953 - DNA, 1057 bp, Homo sapiens
cacctgcaactgaaatttcctgaaatgttaccagtgttgactagtttggatcttggactactaggagtgaggctgggagcacatatactggtcctgaaacctgctctctgatggtaggtttatttcccctggagatgggtaacattgagccctgaaaggtggtttgaaaaagttactgttttgatatgctaaatgtcattctagaccctgggaagacttgtgagaaatttcttagggcctgggggattccagctccatgtgtggagaagttgtatgccgtatatgttgccccgtaatgctgggcaaccgatggcattatgctaccagtgtgagcgtgtggctgccgttttcttcatttttgtctcattctgtttcccttgacagggcaatttggttttgatgctgtgccagaaatcttctgacaatgagttactggaacttggaaaaaaggaactgtgtgcagtaccgcaggcattttctggtggacaacagtgtgtttcatggtaagctgtctcttgtatttatgtagttggatcttttattttgtttctgacaggacttttattctagcactctagatgcaaatatggtataattgttggatggaaccaagagcttgagttaacttgtttatgaataattacccaagaagtcccattgcacttactatctccacttgtaaggaatgggccccacctcaacgactataatagtgttatctctttctatttcgtagggtagttggtaccagtgcctttcctcttctaccacactgtcaactccagtaatatccctttctgatgtttgtaattattttgggtgagggccatataattgttcagttaatatttgtggatcaccagtcaatgcttattaccagcatagcatggccttccaaattgagatgttagagggtgcttgtggccacctgctttagacacttattgaagagaagtccacccacttttattgctgtcctttagggctttcagacttatctatatattatgtcccatataacaacagaacagaagagtttgcagcactaaaccgttac

SEQ ID NO: 108954 - DNA, 1217 bp, Homo sapiens
agtgagttactgattaactgatccaaggcactcaaggtttctctttcatctgtcttcacttccttgttgctagtccacaagaaccaaacatttgaattcagcttcccacttccctcttctctccctcttcaattaagttgaagaggcttctggaccttagatctgcatggagtgctaataaaacttctgcagaattatttctgctgggaacttggaagatctacacaggtttttcaggtcagaatcctggaccagaaattcagtgagttgatttgctataaaatcatatgcaatgtagttctccagacatcctatttctttttgccaaatagctctttcttatctttgagtgatataggaggtattgaaaatttattttttaaagaagagattgcttcatagaacagtaatgtgttaatataaggagttagggttatgtgaagaccctctgattttttaatttatatttgagggggaaccaccttttcttttacacatacataatatctctaggagggcagggcatggtggctcacgcttgtaatccctgcactttgggaggccgaggtgggaggattgtttgaacccaggaggttgatgttgcagtgagctgtgatcctgccactgcactccagcctgggtgatagattgagaccctgtctcaacaaagaaaaaagaaaaaaatcttcagaaggatacacaagaattaagaagttgattactaagggacagaagtcagaggtaaacaattcaccatatactcttttttttttttttttttgagacggaggcttgctctgtcacccaggctggagtgcagtggcgtgatctcggctcactgcaacctccgctttccggattcatgcgattctcctgcctcagcctcgggagtagctgggactacagacgtgcgccaccacgcccggctaatttcttttgtattttagtagagacggggtttcaccgtgttgcccaggctggtctcgaactcctgagctcaggcaatccagccgcttcggcctcccaaagtgctgaggttacaggcatgagccactgtgcccggcctgtatactcttttatgccttttgaattttgaagctttcaacttaatacataaaatgaaagaaaaaataaaaacaaagaaagaaaaagagaatatatgggtttcaataataaatgaataaataaacgactgtctcttagctcctaactggtag

SEQ ID NO: 108955 - DNA, 1033 bp, Homo sapiens
taatgctgctgctgcctgactcctttttttttttttttttttttgagatggagtcttgccctgttgccaggctggagtacagggtcacaatcttgtctcactgcaacctctcccttcccagattcaagcaattctcctgcctcagcctcccaagtagctgggactacaggcacaagccaccatgcctagctaatgtttgtatttttagtagagacgaggtttcaccatgttggccaggatggtctccatactcttgacgtcgtgatccgcctgcctcggcctcccaaagtgctgggattataggcatgagcaactgtgcccggccctgactccttcttagaacataagaaaatggattttgcaacctttagaaattaaacattcattttcagtgaggtcccaaatattccaaagattttttgtgtgaatatggttttatttcattacctttctttgggataggataggaagtcacatcctagtttttatttcctgatttctatgcctcaatagctttttgttttaaggggatgttttatttttatttacatgaagttaacagagtatatttaaactagttttgtggcaagctcttgagcctttttcttttccaacttggcattgtgaattacagaatttgggcctaagtaattgtcttccagtgatgtcagatcttacaatagttatcactgtagttagttctgatggcctctaccagctcagccagcatactactatctttccagttaagccgtataaaagtgagactgatgtaggtcatcctgtgacttcatctaacttttcccttgatgatgtagtagggaaccctgattttgtggacaagatgagcaataagaaatgcagatcaaggggtctcctctcatgcgcagtcaccattgctgactattcttgtactccacttagacggtggcagtattaacacctacgtgaaggtcatgtattcttgggtggagaatttccattggttggcagcttttttctgggccagcactcactttttcagcttgtctct

SEQ ID NO: 108956 - DNA, 1033 bp, Homo sapiens
atctactggacagttcacagaaacttacttaaagctgaattaacagccttaaaaaaaggagaaggaatatggaaggaagactctgaaaaagaaagttacttagaaaaattcaaagattcctggagagaaatatggaaaaaggacagttttttaaaaacaacaggatcagatttcagcttgaaaaaagaaagttattatgaaaaacttaaaaggacttatgaaatatggaaagacaacatgaacaactgctccttaatactgaagttcagagaacttataagtcgcataaactttcgtagaaaagggtgaaacggtcaagaaatctagaggtaaccttctccaaagagtgaaatatgtaaatatatggacgtttttcattgaatcaaaatggaagttttgccaaatgatcaaagtgttagtccaatggtatttaaatattaaaaagagatgattattataagcataatgtcagaattaatttaaacaaattataattaatgtaatatgattttaggaaggatgaaacactttatgagaagttaccaggctgaatgatttacatatatagtgctaatgtgtgaagagaaagtttaactcttcacccactatgttgtttttagttattttgggctgccatattgaattttttgtttgtttgttttgagaaggcgtttcgctcttgttgcccaggctggagtgcaatggcgtgatcttggctcactgcaacctcctgcttcctgggttcaagcgattctcctgcctcagcctcctgagtagctgggattacaggcatgcaccaccatgcccggctaattttgcatttttagtagagacggggtttctccatgttggtcaggctggtctcaaactcttgacttcagatgatctacccaccttggcatcctaaagtgctgggattacaggcgtgagctaccaagcccggctttttttgttttgacatggagtttcgctcttgtcacccaggcaggagtgcagtggcgttatcttggttcactgcaacctccgcctcctg

SEQ ID NO: 108957 - DNA, 1374 bp, Homo sapiens
aggatcatcttcgtggaaatgcaaaaggaacaattaatatatatgctactggacattctagcaaggtaattgtagtttagttttaattcggagagcaatgataatcagtgcacaggagtataaaatattattttaaacagcgaaattaataatataaaatgccaaatggttgaaaaaatagaaacctttctgtatatttgatcatattttttttttgccttgtcaatgtatttaaagtttacttaaggtcaggaaattctaaaacaacttttctggccttgttatttgatgtatatcttttaaatttactgaccaaagcatgttttaagctgcaatgcagtagtcacgggtggtaaccatgtagtcaggtattgttattagtacctatcactgctgagctgtatttaaaattttggtacaatatataaaatggagaagagcttgatattcaggtactaaccacaactagtctgacattgttggcagttaaaatcttattttgaattgtaaattagttaaattttatgtggaatttgctgagaaaagaatatagactactgaaatgtcattttagttatttttcttatgaccacattgtacaaatgaatctgtgttaaaaagactattttaaatgtatttcctgcttttgtaagcattaaagatttataagaaaattattcaaactattttttataaaatgaaagttatgatttttaaacttattgattcctcttgcccctaccccctctttttggaagatattttgattccttataaacttttaccctaagcttatatatgttttctgtcacaagtgcttcctggcacacagacagccaatggaggggatcaaattcagtgttgtatgtatgtttatggcaacattttgaaaataaaaattaaatgtttttcttcaagtagtttttttttaattgctgagagaaaaaaacagtaaagctttctgattaagtaaaatttaaatgggcagtaccataatttaaaaaactaatactttaaagagagagacaaagatattttgtgcctttgacaaattaaatctaatagtggaaaaatgtttcttaattaagcactttactagtgaaaaagatctcacaatttatgccaaatcaggtactgtattttcatgtattaacacataaccttttgtttgaatactatagttttcagtggacagttgctattccaagaaaattaagcttttgagtactttagcaattcccagcgtattacatacacccagtgataaggttctttgcatgttttgtgttatgtattactctgactctttagagattatataaatcctccaaaagttagacgaaacaagatagtacattatgagtcttaatttta

SEQ ID NO: 108958 - DNA, 1432 bp, Homo sapiens
atccaaattttacacaataacagtccttataactttaatttttttcttgttggggatctaatctaggatcacacattgcattcagttggtatggcctttcattgtccttaatatccttgacatttttgaagaatacaggccaattatgctgtagaatgggcttctagttacatttctctcatgtttcttcttgtttgggttgaggttattcaggtatataagacaggaagatcaaagaagtaatgttttgatgtctgcagggaattatactgaaagccatatcatgtctctttatccctttaactgctgtttttaactttaattgctttgctaatctattgtaaaagtactattttttcttttgtaattaaaaactgactcatggggagatactttgaggctatctaaataatcttaatttaattcttactcttttttgtgctgttttaaagaattaatctaactatactttatccctttcattttattcaatctctcagatacgttttcccagaattacttttgaaacattagatgaacttaggaaattttattatggtcagtcagaaatcattaaaaatgtatatatatattggcagttatgcttcattttaaccagattgatttgggtcaattaaaggcttaagttcttttaaacctaaaactttcaaattggtaaatttggatttttgaccccgtttactataacacattggactttttgaagtggaaatttagttgtatttatagccatctaccatccctaccagtactgaattttcagttgttttcacttaatattattagaaaaccataaggcaaaatgtacctcgtataacttgactgttgtaccaggtataataatatgatgctcacttgtaactgtcatgggtcagtaataaaattgaggttcttgaagaacttacatatgcatggaggaaaatatttcataagtcacgaattaaaatacttttttgtttttatattgcagattggtttttcagcagcagatgctgtaacaggactgaaattggtagaagagggagtacccaaagaacatttagccttattggcagttccaatggttcctttgcagataatactgcctctgattatcagcaaatacactgcaggtccccagccattaaacacattttacaaagccatgccctacaggtaaaaatgaaataaaaccttactaaataagaaagggtaaaatgaggaacattcatcaataccactaatatctgagcgtagaattatatatatggaaaaagatttgaaaagcatcttttttcaatattatttatatgcacttttatctttttaacctcctaacaggtttagatacagcttctttcatatggtaggcacacggatttctgtttttgttgttgttgttatttaagctaaaatggaagtcaactcaatg

SEQ ID NO: 108959 - DNA, 1037 bp, Homo sapiens
tagcatcaaagcaatgttaataagtctaataagactactggctatcatctatcaacattggtctgatttgtgataattgtgttcataaaacttcttaatatatttcctggcctctctgaactattggctttttcattcttctgcatgtgcgagagatggaaaccctttgaattagggctttgtgactgacccattgtcactacttccttctttttatgtattttctcctcaaagcacaaagaaattagaaatatccttgtctgggtaccgtggctcacacctgtaatctcaacattttgggaggctgaggcaaaaggatcacttgagcctaggaggtcaaggctgcagtgagccaagtttgcaccactgcactgcagcttgggtgacagagtgagaccctgtctcaaaaaaagaaaaaaagaaataatcttatctgcaaacattgctgaaacctgtgtagtttcttcttcttttttctcttggtattggtatcaaggaatttaaattttagatggactgtgtttattaaaattggtagactatgctaaacaaatttacaattcttttgcctagaaaaatggaactacttaagtcttatataactggaaaacttttacttttcgcttaacattaattggaattttggtgacagtgaaaattatttttttttcagggcttgttaaacaactgttttaaaacagatgatgaccaaaaccctgctcaatgagaatagtattgtacgtgaaactctaaagaagtcattattcatctcattttgcagatggaattaagaatgcaaaaatagtggacatgccaagtgaatgctgttaataatatgtaaaattatttgattaaacatttattacttaaaaaaaagtggacattagcctcacttataaggataatgttattaatacattattgttcattcctttcgaaccagattccaaaatgctagaaattatgttaagatgttattttatactgggcgtggtggctcacacccgtgatcctggctctttgggaggccaaggcag

SEQ ID NO: 108960 - DNA, 2233 bp, Homo sapiens
tagagactgggaccacttcctgaagcgcgaggcaggaagttatatgctttttctggagtcctgtagagaaagtgctctctgccgcattgatagcagcgagagctggaggtgttgggtcgggagaccagccgttcgatcccgccgcaggtaggagctggtttccatcctggcaccacggcacacacctccagcctcgagcccggcgctgctgcccgggggtctccttcaggctctttgacgccgttccagggggcacctatccaggcatcctctgggcctctagccagaggactggctcccggcttcagcactccgggctgcagtaagaagtgcccttatcgctctgagccctgccaccatcccgtgaaccaccgaaaccctggtccagcgcgacagccttggacctgggactggacggatccaaaacgctcagcctcggccccccacagacggggctctgcatcgtctctgatatgtcacccaccatctcccacaaggacagcagccggcaacggcggccagggaatttcagtcactctctggatatgaagagcggtcccctgccgccaggcggttgggatgacagtcatttggactcagcgggccgggaaggggacagagaagctcttctgggggataccggcactggcgacttcttaaaagccccacagagcttccgggccgaactaagcagcattttgctactactctttctttacgtgcttcagggtattcccctgggcttggcgggaagcatcccactcattttgcaaagcaaaaatgttagctatacagaccaagctttcttcagttttgtcttttggcccttcagtctcaaattactctgggccccgttggttgatgcggtctacgttaagaacttcggtcgtcgcaaatcttggcttgtcccgacacagtatatactaggactcttcatgatctatttatccactcaggtggaccgtttgcttgggaataccgatgacagaacacccgacgtgattgctctcactgtggcgttctttttgtttgaattcttggccgccactcaggacattgccgtcgatggttgggcgttaactatgttatccagggaaaatgtgggttatgcttctacttgcaattcggtgggccaaacagcgggttactttttgggcaatgttttgtttttggcccttgaatctgccgacttttgtaacaaatatttgcggtttcagcctcaacccagaggaatcgttactctttcaggtagtgtatttaagctattatggtgttaggtttatttatccttttgaaagagtgtgtgacgttggagggaagctcattaatttactggaaatcattgtatgggagataactcaaggtaagttttctgtttcgtccaaatgagcttctttgaaatattaaagccaaaatgaatgatattagagcaatcaaatgatcactatgcggttaacagggagaggcaacccatcaaataacacaaccgagtccagggattcatgccacttgcttaatacacaaatgcacacttttaaaaagtgtggctcatatggttcacatttttccttttgtcttgttggttttaggtttctagctctatactttctaatccatttctacccctaccgttgtacccagaatccagccttctagtgaatggaacagggtttattcgttcaaacattattgaaccagctaagggacgggattctaaggcctctaatgaataaggcagagttctgcactcaagaaataaggaagatgaacattttaggagagttcagagttgccagttagtaactgcctttgggagtcaggcttcacattgcagataacatttgactttgttcttgaataagattccacgaggccaggaaatggcacaccagaatgcacaacacaaagtaaaagtgcactgaggcaggaaagtacaaaaaagtacaggacattgcctaaattgtggaactgggtttgggaaatcgtgctgagaaaggctgtgactaaattagtaagattttctttaattactatgggaaaagagtttaaagtttgtcctgtaagtaatggagggtaagttctaaaaaatttccctgtttctctgcatgagtaaaacacatgtaagtttttctcttttttcttttttcttcttttttttaattgagatagttgggggtcgggggggctgtctcactatgttggccaggctggtcttgaactcctggcctcaggt

SEQ ID NO: 108961 - DNA, 1054 bp, Homo sapiens
atcttgtctgcgtgtcgaggtccgggcgtcggggagggcatcagctccccgcggccgcgtcgctggcccccgcctcccccgcgccgctgtggggcgcagagcccgcgagcgcggcgcgagggtgggggtagggcggcgagcgggcttgtgtgtctgcgtgtcggggtgggggcttcctcggctcccaccccgtccctctgggaggctgggggcccgttgtggcgatcccggggcccgccgaaggcagggcagggtcggggcctcctgtgcggcgttggagctgggccggcctctggtcttcccgccaccccgtttcccgcctgccctcggcgaggcccgctccattccccccgccagccttgggctccgcggcggttaggccggttctggacgaacccctcggagctgcactgtcttccccctcccccaacgcccctgcaggcccgcgtgagggctggtggccccagggtcgcgcactccgttctccctccccgcttccttctcagagaggaaagggtgtgtgtccaggtcccgcccccgtccagcttgctccctgtcgagcttgctggtttgcggggtaacccgcttccccgcctttggggtccctccccgggacgcgagccgtgccagctcgcccgaggcctgggcagtccggagttccggagtgctggaaaagttgccgccttgacgtacccggcggggagagcacgtttgaccgctgctgctcatctctcctccaactcacttttcttagaccgttcctcttactttcgtcccgcttttgaattgggcaccttcgctttcacctctgtattaaaattttcattggcctggagttctttctgaccttcactaagtcagttttgccagcgggaaaccgtgcagttttgaattgcgatttacttcattaagatacacctcctctgtacgctgttgagggcctagctttaggaaaaaacttaattaaatttcattcggggggtgggattgtatacttcgaggtggatttggtgctctacgtcagatagtagtgccttgttcaggcagaatttta

SEQ ID NO: 108962 - DNA, 1127 bp, Homo sapiens
taataaacataaaccaggactatattttggcgcagctggattgtgtgctcatcctaccattagatcatgcatgtaagatatatatacacatgatcactatattacatagtcaataagtggtaagatttattaagtttaagtgtttaatatatgcccatgcatggatatatattaaaatcttccctttaaaaggggtattttgaattggtaactcagaaagtcctaagttttcattcctatgtgtttttggagctgacagtgatcattaatttttttttaagtactgtagctttaattttcataattaagactttgtatttgtattgatatttgcagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccggtagacttttcactaatcttttcatgaggagattgaacttagattgtggaatattttattattaattttcttgagcactgaatttttctacgaaaataagatatggaatggttttatgagaaatttcccatggctctgatttggggagaaaaaggaaaaatttaagctttcagtttaaaaagattaattttaattgtacagttaaaagaacttatcatttgagtattttatgttttataggatttgtgggtcagagttagatgtagctgttgtggccattcattcatttacttaaaagcatttcatcaaaggaaagtaggaagttggctagaatactccaaagagaagaaatctgtgtacaataagtgtttttgcttcctatcccaatagactagtttctaaagtatggagatttcttaaatctaatatatgggctaattttgacagcttgtacccttagaactagtcaaaataacagccagcttatgtagtttcttcctttaacaactatttttggttaatgtcatgctttctttttttttgaggcggagtctcacttggttacccaggctgaagtgcagcggcacgattttggctcactgcaacctc

SEQ ID NO: 108963 - DNA, 1023 bp, Homo sapiens
ctgtaaacaggcaaagttgggtaatgtatactttctattctgccgtcttttgttgtagagtattttgctctgagccatccagggccttcataataccttcagttgttgttctttgacctgctaggctctgagaagacctgtattttcaccatctctagaattcttacgtacttcttccattgataaggaaacaagtaaaacaaatccatgctaagtatcacagatagaaacattggtattatctatttggaagtttgtgcttattaacaagtaaatgctgaattgatagacttctaaacattgcagtaaagtacagtaaaaataattaaaccacgtaggatgacaattcgctgtgatataattagaatttgctacattctaccaaaaacaacgcaatttctggatctgtgttgtttccctcagtggtacaagggagagagggcatagaccttgtataaaaattaacagagattcttcactgattgttccttaaatcacagtgctattatcatctctggaggacctaattctgtgtatgctgaagatgctccctggtttgatccagcaatattcactattggcaagcctgttcttggaatttgctatggtatgcaggtatgtcagcaaatttgttttgaaagcttacttatattttattctgtttgtgagtcatactgtattagtattttctctctttaggatatttaggatacttagttggatgagataacttgtgcatgttacaactatgtgaattgccacactagtatggcagaactggcctgatagggaatctattttcaaagtagtaagtacactgtttcatgtaacaaaacactatccatttaaaaaaaccttggacatgcaaatttacataaaattttcagaaatagtacatagagctcctgtatacctttacccagtactccagttgttgacatttttgaaccatttgaaagttgcacacgtgatgccctgttacttatatttcctaaatattaggacactcttactgcataacca

SEQ ID NO: 108964 - DNA, 1539 bp, Homo sapiens
caacagagcgagactccgtctcaaaacaaaacaaaacaaaaaacaaacaaacaaataaaattggctgggagcagtggctcatgcctgtaatcctagcactttgggaggctgaggcaggtggatcacttgaggccaggagtttgaggccaccaggccaacatagtgaaaccctatctctactagaaatacaaaaaatcagctgggcgtggtggcacacgcctgtaatgccagctacttgggagcctgaggcatgagaattgcttgaacccaggaggcagaggttgcagtgagccgagatcatgccactgcactccagcctgagcgacagagcaagactctgtctcaaaaaaaaaaaaaaaaaaaaaatgaaaccatagaggcagagattgtgagaaattaattgtggttattgcttgagtcttttcagcatgaaaaaattttaatttgtgactattttctctataaaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggtaagcaaattattatctggaagtctacaaatttatatcaataatattggaatccaggagttagagtcctcaacacagcccttaaatgttctacagttttagagtgcttttccagttaccatacatatctttggtataaatagcacttttagataaagatttaagccaatagtgtttattttctttttgcttgttttgctcattttgatttttcattttaccccgtaggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaaggtattgaagaacctcagaaaagttaacttacatgttaggacttgtttaatcaaatctagtcttatggtttaaatgagcacaattacagttttctcagtatgctcaaggttgaaaatgttttttatttttacaattacctctggtgtaagagaggtctcagtataaatttttaaactattgattctgctaatttaatacatagattgataaattaacattttctagctactgttcagttctcttctagtcattcacttttaaaattatcttttcctggccaggcgcggtggctcacgcctataatcccagcacttagggagatcaaggtgggtggatcacctgaggtcaggagttttgagatcagcctggccaacatgatgaaaccccatctctactaaaaatacaaaaaattagccagtcttggtggtgggcgcctgtgatcccagctactcgagaggctgaggcaggagaatcacttgaacct

SEQ ID NO: 108965 - DNA, 1044 bp, Homo sapiens
cttaagatttttagtatcttatttgttattctggttcttgaaggagtccttcaaattgtaaaacttggatctgtccctggtaactgacatagcagaatggaggaattcacaaccttggggtggggtgggaaggaagccaataaaaagcaagctgatttgtgctgtagacttctggggaggctcaggaatttgaagcattgggttctttttgggacattggtctctgggttagcctaaaacagggattagttaaaaatctgagaagcagatccttttccttagcacaggagcaaactgtgctctccttccccatcagaacactgtggatgtattctctagaggggctaaacgagaggttctgggcttgagcctactaataccaggcatagttgagggtggaggtaagactctacattaagaacaggattaagtaaaattctctatgctgaatggtgattccctcttcctaccacttcctctgtttaactgccagaatgccaataggcaggagagtagatatgtcttctctgggtagttgaccaggtacaggaaagacctacaaattcactggcttttccacaatgaaatagccagctgccttgtcatcttacggtgaaggcctccagtagctaagttttattagcaaatagagatcttagtttttagtttcttgtcattaaataaaaagccaaggattgttaaatgtatgttcataaatattagttttacaagacactagggtgtgattccaacagctttgactccgtttaggagccggtgcttttgacttctttggggctaagcttcttgctgtggcttctgcttgttgctctggtgaagcactgaagagagggaaaacaatcagcataaattttttttttttttttgagacagagtcttgttctgttgcccagggcagaatgcagtggcacaacctcggctcactgcaacctctgcctcccaggtttaagcaattctcttgcctcagcctctgagtagctgggattgcagacatgtgccactacgccccactaatttttgtgt

SEQ ID NO: 108966 - DNA, 1051 bp, Homo sapiens
tggggatggagtctctctctgtcacccaggctggagtgcagtggcacaatctctgctcactgcaagctccgcctcccgggttcacaccattctcctgcctcggcttcccaagtagctgggactacaggcacccgtcaccacacccagctaattttttgtatttttagtagtgatgggatttcaccatgttagccaggatggtcttgatctcctgacctcgtgatccacctgtctcggcctcccaaagtgctgggattataggcatgagccaccgggcccggccaataattcttgaatattgatagtttattgaaatttgtaggcagatttaggggagatcaaaggactgctcttcagactgggaaagaaatagcttttctttctgtattttgacttgttatttttgattaaaaaacatgttataccaatttaaaacgcttctcccctttcctccagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaaggtacctttgtttttaatatcctcaacatgtactatttttgatgtgaatcttagtatttgtttttccttgtcactatatcaaataaccaaattagctaattttaatcctttttcttatgtggctgagagttttattgtatattgtcattatattgaccagtagaaactgttttatgtttttttgttgttgtttggttttttttttgtttttttgagacagagtcttgctgtgtcaccaggctgggctggagtgcagttgcacgatctcggctcgctgcaacctctgccttctgggttcaagtgattctcctgcctcagcctcctaagtagctgggactacaggggtgcaccatcatgcccagctaatttttgtacttttagtagagacgggggtttcaccatgttggccaggttggtccggatctcctgacctcatgatccgcc

SEQ ID NO: 108967 - DNA, 1019 bp, Homo sapiens
caggcgtgagccaccacacctggccactaattttgtatatttagtagagatggtgtttcatcatgttggccaggctggtctcgaactcctggcctcaagtgatccaccccactcagcctcccaaagtgctgggattacaggcgtgagccactgtgtttggcctcatgtacctttttgaatcgtgttagaggacatgttcattaaggagtttattttggagattggtggattttattttctgatcagtatttctaaaggactctaagagatttagctgaaagtataaacttttgcttttaaaaaaagttatctcttacaaggctgttttactcctgttgattatagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggaggtaaaagtttatgaaaactttttcataaagtagatacatggaaagtcttccattcttccctcctcttccctctaatattcacagaattgcataaccatcaccacatctaattttagaacattttccttaccctaaaaaggaaccttatacccattagcagtcactcctcgttctacctgttgttgtcattgtcatcctgcccccaccccccagctcctcctttcctcctttcttgccagccctaggcaattaccaaccactaatttattttctgtctctatagatttgcttattttgggcattttatataaatggaatggtacaatatgtggtcttttatgactggcttcttttacttaccgtaatgttttcaaggttcatccatgttgctgcatgtatcagaactttattcctatttattgccagataatattccatcttatgggtataatgcattgtatttatcctttgatcagctgatgggcttttgggttatttcc

SEQ ID NO: 108968 - DNA, 1188 bp, Homo sapiens
agtacccattagctttgcttattttttaattgacttatttatttttttattattgagttgtaaatgttctttatatattctggttacaagtcttttatcagatatacgacttgcaaatgtcttctctagttctgtgagttgtcttcattttctcaatgataacatttggagaattataattttggaacactagtatattttctaattgctttgtattctaatgagaattagatcagagatgatggattggtttaccctgatttatttatatttaaaaagcttatgtttaaaatgtgcttcaaagagaaataatacccataagatattcgtctaattccttataggcacttaggaacaaatactttaaaagatgcatttttagtaataatctgttagtctaagaaaagtggtaacaggaaaagccaataatttattacgctttgttttccatgtcatcttggttactagtttatattggttggcttctttcctccctgtagggaaaagtaatagaacctctgaaagattttcataaagatgaagtgagaattttgggcagagaacttggacttccagaagagttagtttccaggcatccatttccaggtaaaaattagaactgaattttgtttgattcatctttagaccttcatgttgaagaaaaatcaattcagacaattctgaaataatctgtcatctcagggaatatgtaacatgagagaaaggaaaggatggttagggaataattgaaatcttttgagtatctactgtatttacttcattttattaaatactcattttccattgtatctgcatttaagtgttacattatccttgggagtctggcatctgatgttgccatcagatgagaaaaccaagacataaagatattttaataatattgccacacagtcctagtagtagagctaggatttgttatattatttgtaccataccgcagtgcgttccatggaagatgtgaggatttaaatttagctctttaaaatccttgtcctatgtctgacttgtttgaatggatgaaccacttattctgtgcagagaattcctggcacaatgtaactaattcctgaacaaataatacttcatttgctgtcatatagaaaaaaattagaggtgatacttgtttaaagttaggactgcaagtcttaacctgtttttgttactagt

SEQ ID NO: 108969 - DNA, 1023 bp, Homo sapiens
gataccaaatacaatccactgctaaaaaccagtaaaatacataagatagtagtagataataaaagagtgaataccttatttcttaaaactgaaaaaatgcctctttggtttttctcagccacataccctattacagagagtcaaagcctgcacaacagaagaggatcaggagaagctgatgcaaattaccagtctgcattcactgaatgccttcttgctgccaattaaaactgtaggtgtgcaggtgagttgtgtgaattcattcaccagtgatatacttttttttttttttcttttcttgagacggagtctcactgtgttgcccaggctggagcgcagtggcgtgatctcagctcattgcaacctccgcctcctgggttcaagcactctttctactaatcttgaaataaggattacttaggaaaatgaaatatgtgagtatatataccaagtttagagaaataaggtaattttttatagaatgtttagggagtgaatagttaatggaactaaatagtcaggctgagattttgtagttttggaacatctatgaactctaaccaaaggtaaatattgaaagcaaccctttcctatagggttggcatgcttacttctgccttgtagggcagggatcaagaggtcatttatcctaggtgtgaaatatactgtggttttagaagtctttaactgcaggaaggcctccagatgagtaagttacaccatttaggtgttgttctcagcttgtgtattccctgtactagggaacacattctactgatgttgtgtttattctgcctttctagttgtaaaagaacatgagaataatatagttctcaattataaaatgctacttgcaaaatgactaataactaataagatagtatgttaatttctcctcttttttctggagacagggtcttgccctgtcgcccaggctggagtgcagtgatgtgatcatggcgtactgtagccctgaattcctgggttcaagcgaccctactacctcagcttcccaagtagctg

SEQ ID NO: 108970 - DNA, 1052 bp, Homo sapiens
tatcctctcctgtatacttgataatgattattacagtgtactctgtgccaccttggtggcccttagagttgtatgtttaagctgcagataatttgcagagcattggctgaaacacataaaatcacatgcttggatgccacagcaatgtcaaatcgctatatgttcttaagcacttgtggctcagtcacaaacacaacttgcagactagcacctgtttgtggatcacactttgagtagtactgagtttaagtcactaatattttaaaccttaataacttacacctatccctgcagaggggaataggttcattatataagattaatcagaaaccatcccatatacatggaggacaatagtgaaaatagtcaaattttaatttcaaattacaaatgtaagccctctaggactgctggacatgcagtggatgctgacttttctctataattttttttaataggtggtattaaagatggtcactgagattaagaagattcctggtatttctcgaattatgtatgacttaacatcaaagcccccaggaactactgagtgggagtaataaacttcttgttctattaaagtaccgtgtgcagtttaaattgattagaaatcattcccattattgacatgcagtactgtgaaaagagttactggagcagctacatcacatctgagttctccacagcaaaaatctacggcttaagagctgagttggggataaccaaaagggactgaagagtttgtacgggtaaataatcaaagcaccattgcctacactcagacagattgatactgcttttgcctttgcctcacttattctttatgtataaattcactgttgatgtctctgtgaatatgtatgaaggtgggtgaatttgggggtaattatgggcttctgtctccttaccagtttctaagaactgttagaaacgcccattatttaccagtgttacttactacttatatatactttttggagaatcagttttcttataagtaatcttatttctccaaagggtgaaaaagagatgaacatatcagataaaggtat

SEQ ID NO: 108971 - DNA, 3566 bp, Homo sapiens
agatcgagaccatcttggctaacacggtgaaaccccatctctactaaaaatacaacaaattagctgggcgcggtggcgggtgcctgtagtcccagctactcgggaggctgaggcaggagaatggcctgaacccaggaggcggagcttgcagtgagctgagatagtgccactgcactccggcctggtgaaagagcgagactcagtctcaaaaaaaaaaaaaaaaggaagttcttagtgtgtaattgaccatcagggataaatgggcttcaaaagtgttaattgtctccttacttacagtgagtttctagagatagccctgtctttcagaaattctctgacatctgcttgcgcaatgttataaccactttcccacactactcccctccagaaatctcattgatatgtggcgaggacacgccttagctatcaccccaatggatgcttctttcattgacccaaatccagaatgtaatggggaactgaatacaagttggatgtctccacccttggaaagcacatcttttgttcttactgaagtagtttaacaccaccagatgatcaagggatcagggtatctttctggtatctttttaatcactgaaggactttgacagcagtaatggtggcattgttgactcttaaatttctgaacgtttcacttaatggcaagtgaagagatatagaatcccccaaagagtgtcaagatgctaacttccaaccctatttttatgtactgaagaggcctcagtgtctcactgaactctaacctttttgtcagtgttcctcaacactggatgcgtattattacataacctgaggagttaaaaaatacaataaccagatgtccaattaaataaaattagaatctggaggaggtagaactcaagcatttacagttttgttttgttttttttttaagacagagtctcgctctgtccccaagtgcagtggcacaatctcggctcactgcaagctccgcttcgtgggttcacgccattctcctgcctcagtctcccgagtagctgggactacaggcgcccgccactacgcccggctaatttttttgtactttttagtagagacagggtttcactgtgttatacaggatggtctcgatctcccgacctcatgatccgcccgcctcggcctctcagagtgctgggattacaggcgtgagccaccacgcccggcaagcatttacagttttaaatctcccagtcagaataaattcttattgagggccatacctagcctgtcttcatcaaactcataggtgaatctttgtcaaacctataggagagagatgcaggccatagagatggtcttgctgaaggtcttatagctaaattagttcagatccaggaaccagattctggaactgattgcacctatattatgttgtgtgtcagacactcccaggacctgtttggtaataattaggacagctgacatacttgttgctaattttgagatctgggcaacaactgtgtaggctgttctttcaacctctttcttcttacttctttacttttccttcagagaggagaaagccacccctgtgctatagccaccgctccaattctgactctagctaggtcatgaaacagactgagctattattgcatcaacacataaatcctgtcatttgggtattattctttagagaactagagattacctagctgcaacctaagtttcctgaattagaatcatttgagcagcaccatcttaattggctcattaacatatttgtgaccaggcacagtggcgcatgcctgtaatcccagcactttgggaggccgaggcgggcggatctcttgaggtcaggagtttgagaccagcgtggccaacatggtgaaaccccatttctactaaaaatgtaaaaattagctgggcttggtggcgcgcgcctgtaatcccagctactcggaaggctgaggtgtgagaatcacttaaacccgggagatggaggttgcagtgagcagagattgcgccactgcactccagcctaggtgacaagaatgagactccgtcttaaaacaaaaacaacatatttgttcacttttgaaccctgtggtgtcttttaactttgttaagggcccttggttagcaaaattatgaaagtttaggaaatttggctattgagtatattaagtacaactacaaaatcctctgagttctccaggaagcctaaaccttgagcagtatcttattcaagtggagtatatatcttcaagaatacagatttttaaggtaagtagtttttcgtctttgcatctcctaagaccattgttaacaaccttgatattaaacgaagaagtgaatgtaaacctccttttgaacatattttttataaagaaatattttgttaattggagtaagtagtattgttatgaaatcactgtgtaattgttaattgtaaactgcaatgtctattttgtgttgtaacaatgttgccataaaatagctttgctaaatgtgaaatgactttaatcccttttgtcttcaatatacttcataaaggaggaaatgatgatttacacaatttgtcatgaagcttccgtgtttatgagaaattccaagaagtaagagccaagaggacagatattatcagaatatgggacataagaaattgcatatagtgtcaagggtttctatataacaacttaatttatttcccttgcatatatagtaggggttaacattttgctcaatgttaacgggggacataatggacataaaacattggatagctttttatttaaatgagctaaaggtgtgcgtatacacatgcacttataaaattaaagtcatatatgtatatacacacagacttatgtgacttattgcatattcatttacgtttgaccaaatcttttgtcaatttctcaagaacaaattaacctttatttaatacataaatcaggtccttttaagtgtttggaactatgttatcagagttgattaaacccatcaaagtaaatgtactagtgagtcatcaatatgaagattagaagaagtaatcactttgagaaactgaattccatagttactttcaggcagtcatattactgtggtttgtttcccttcaagtcagtgcccttgcctggccttctgttatctgagaagagtgtatttgagacaactatattttgaaaatttttttaccgttttagcataattcataacaaaagtattaggtttctaatctcgaactcctatatttcaaaactgacattctgtctcttaatactccttttatcaaaagctatattaagcaccacacagctgtttttgtttttgctttttgtttttttggtagattattagtgagttattctaatgaatttatatagattataagaaaagcagctaggaatcttatgttaacctcacttttcaagtagtgtgtcaaattctaaccattaattcctttttttatatttcagaatgccattccatatgtatatattactgttcttttaggtaatatgaaacctgccaaaacattcttttttaaaaaataacattattagagaaaactttttaaaattcccacttaattt

SEQ ID NO: 108972 - DNA, 1863 bp, Homo sapiens
gttcatcatagacaaacaacctacagggaaacagattggaaaagctattttcaatgtataaaaccaacaaactatttagaatattcagggaattctagcatacaattctaacttgcagcaagaaaaagtcagaaaacacagaatattaataagtagttaacagaaagggaaacttatgtaagcattatatctcttaagtgaatgtaatacgaaaaatgaatttagaataaattaactcaattttctcagaatccggttgacaaaaatgaagtcaggtaatgtcaaatactggccaaagatgtgaggacatgagaatcctcatctatggctggtggaagtataaatagtcattacagtgagccattttagcagtgcaaagttaaattaagaatacatagtgttcagcctgcttccggacgggcgaggagacttgtggtctggttctgggacttccctaatagcatggcgcctaaacgccagtctccactccagcctcaaaagaagaaaccaagaccacctcctgctctgtgaccggaggagacatcggcctctgcaggcttgctgaagaagggagaaaaagaacagcaagaagcgattgaacacattgatgaagtacaaaatgaaacagacagacttaatgaacaagccagtgaggagattttgaaagtagaacagaaatataacaaactccgccaaccattttttcagaagaggtcagaattgatcgccaaaatcccaaatttttgggtaacaacatttgtcagccatccacaagtgtctgcactgcttggggaggaagacgaagaggcactgcattatttgaccagagttgaagtgacagaatttgaagatattaaatcaggttacagaatagatttttattttgatgaaaatccttactttgaaaataaagttctctccaaagaatttcttctgaatgagagtggtgatccatcttcgaagtccaccgaaatcaaatggaaatctggaaaggatttgacgaaacgttcaagtcaaacacagaataaagccagcaggaagaggcagcatgaggaaccagagagcttctttacctggtttactgaccattctgatgcaggtgctgatgagttaggagaggtcatcaaagatgatatctggccaaacccattacagtactacttggttcccgatatggatgatgaagaaggagaaggagaagaagatgatgatgatgatgaagaggaggaaggattagaagatattgatgaataaggggatgaggatgaaggtgaagaagatgaagataatgatgaaggggaggaaggagaggaggatgaaggagaagatgactaaatagaacactgatggattccaaccttcctttttttaaattttctccagttcctgggagcaagttgcagtcttttttttttttttttttttttccctcttgtgctctgtcaccctgttcttgaggtctcttttctctgctccatggttctcaacttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctagaagctggagggtgctaggcccctgtgtagtagtgcatagaattctagctttcttcctcctttctctgtatattgggctcagagagtacactgtgtctctatgtgaatatggacagttagcatttaccaatatgtatctgtctactttctcttgtttaaaaaaagaaaaaaaaaacttaaaaaaatggggttatagaaggtcagcaaag

SEQ ID NO: 108973 - DNA, 1051 bp, Homo sapiens
gcactgcatgactgtcattttgaactggaaacgaacacagaaacatgaaaatgattggtttgttaaggcagtgggaaaggtaatttttttcctttcttttgacatctggtttgcaatggtttcttttagttcttttaatggaaacatataggtgaaagacagctataaaatattgctaaattttagaaatgtagaatgccattttgtttgttgcttttaaaattggttatcctcacttaaagcatattgtgaacttttccctaatgcataaacatttgtccaaaatatgatttaaatggctcctttgcattacatcacgtgaataaatcataattgatttaaaaattccccattgtgtacatttagtttgctgcctttttactattataaatcaaactgtagtcgatatccttatacatcatgtttgtgtggatcttaattgcttccttgagataaatactttgaagtaaaatcacatgatcaaagggtatacagatttttcatatattggtggattgtgttctgaaaatatttctgtgaatttatactctgaggggaaatgtttgagaggcgcaaagagcaagacgagggaccaggaatccatggtgagttgacctggagaaagactgggggacacctctaggagaggcctggcaagaaagggaggagaaggagctctcaggaagaaacccagggacataagcctcaccagtgacaaacacagcaatgtgagctgagggcaacacttcgccttaaagtgtagattaaagaaaatgatgcatacaaaaaatgttcattgacctcttacgggctttacaaaagtttctaaggtagtttattatcccctagtcacagaggcaggaagggaggcacagaaattaagtaagtttcctaccaccacgctaatgaaagtggcagaacacagacaaaaaatgatgtatgccattccaaatctcatggttttccactcaactttttctatactctgaaggagagaggttggcctgatgtcaccttttttatactctgtgatgaagcaggatgcccttcc

SEQ ID NO: 108974 - DNA, 1079 bp, Homo sapiens
tcttaaaacatggcaaatatttattcaatagatcttgagtgttaactaagggacatgtagtaagtaccctaggaactggaaaaccgtggaaaagcaaagacacaggtctgacctcagagggcttgcagtccaacaggagagacaggcagttatactacattatcataaaagatcatgggagggggaatacaagatgttcagggaacagcaagaaggggctcagcacacagcaggtgggcaatatttgtggaaagaacaaacaagtaaatgatgtatgtatattgtcctatgacttaaatttccaagcaagttatcaggccggcttttatggcgaggcctgggaagtcagttgccacgtataacactgcaatgcactcttccacagaaacaaaccatcccaagaaatgagctttgggaatactgcctgttcataggcagaggacaaccctggatccatgtactgggaaagtgttctgttgcctttgttccccctactcttgccccacccaggacagagagggggagagatgggacactgcctggagatagcctcaaaggcaccattaaattccctgatgttggaaggggctgcagtacttgcctgaatggcaccaaggttttcaatgagttgttcaggagtggatgatcccaggagcacagaactcacaccttcatttctcaggcaccacgctgggaggagaggacactgggtcagtttatcaaagcacttccaatcgttgattagcttataaacacctgctacagctgtttgttgcagccaaaatttattaacttctttttgtggaggatgtacagtgcttcctaggattaaaaacctgagcagcaccccctgttgtgtagaagatttgacagaatctgtcaaagcccagctgggaggggaaatgcaaatgcatagaggcgctggacaatggattgtaagattctctccagcacgctcagctgccctcaagtagaagcagaaaacacagatgcactgctgtctttcttgcttctccgctggttttccaattgctagcctactatatgtctcttaattaacactcaatgcatttgggttg

SEQ ID NO: 108975 - DNA, 2231 bp, Homo sapiens
aggtggaaaggggacacagatattagatatgtattacaatccaagccaggcaatagggccttaactagggcagtggagcagaaaagtggacctgagagacattttgggggaagatggtggtttcaagactgagtaactagaagtatattggtattgattattgagattagaaaccaaaggagaagtagtttggggaataagaagttgggagagaataggatgtgttgagtgtaaagtgcctgtggaatatccacctaggagtgactgagcagctgcaagtgcagctgtggagcttagtagctgccggaggactggagttgagggtttgtgagtcatttgcaccgacatgctgactgaagccccgggaaaggatgagctcatccaaggctagcatttactgtgagaagtgggccaagggtacacattacaccataagacaagggacaaaggcagactttctcactggaaaagtctgaccctgtgtggagactgtggtgaaatacaattctgacgaccaattctgaggtttcaacctcattcttcctttgttgcaatcctgctggccaaggtgaccttgtctccagtcaagtgctatcctcagaagccttagggtttggcaaaatagagctgccagcctgggaaacttcattctggttaatgttttactgtctgaagctgaaggaagaatttggtttcccactagctctggaatttcagtgtccaaacagctaatgtgttatttaaaatgagattgtaacaatgagaccaaaaacctagaaactggatttgttggatttttttttttgtctaaaatacagcgggttagccacgtgaggagaagaatccttcattcattacaccaaagcaaatctctataggaaagagatttaaacattaaaaaaatgaaaccataaaagtactcgaataaaacaagacatagtatcacaagaccagaattttcaagagaagccccactttgaaacattgtaaactactacagattttacaaacaccccacaggctactagttttgcaaacttgatgttacactgcctgggataggtggtgggttgggggaggtctggctaatgttgctggggctggctgggcattagtaaagtcctcccaggattgggttcctattgatctggaacttggggatggagtaggattttgctaggctgggatagtggtcagtttgtaggcagagggccactgttatcgccgaagctctgagtggttgagagcggctcaagattcagattccaggaaggtgtggtggggagtgatgaggcccgactgctgtggagcctggccttctctgatgggtgatgggaagcctcagaagggttttaaggcatgtggggaggagggggagaggcggttctcccaccttttaggtgggagtggggaggatggaacctgtgcaggtgaaggtgggctgcctgcagctgtggtttctcctcctgtctctcccatctgtcaggctctgatttatatacgccccttcgttcctgcacatcttaggcacgtggcatcccttgaagcagctgccttcccagcctactagaaatattttcttacaactgctggtgctccgtattttccatccttttgcagccagtgccaccactgctgggcacccctagtcacccagtctgcttttcaccatgttgtggggcccaatcacaactcgtcttgggtggactttagtgctgggtatgggggaggtgaagtagaacaggggaggattggtaagcccgcaatggtagcagtcttgctgcatggataatgtcccctttaggataggcaaagcctcatcctgctgccagccaaagccttgctagggaggaaatgttttgggaagaaaaattactcaagagttttcctctgaaatgtgtccccttccctgtcagctgccttgcctatttccacagcttttaaaactcagccctagacttgcctcatatgccatccctaggcactatgactgcccccaggaatggcagtgatctccctgtattagcatgataaaaatcctcaattcctccctcttctgccaagccatggtgtctctctttcccaaacctgcagaatccatccatttctctccccctccatggccactaccctcattcaagccaccatcgcctcctgcctggatgactgcccttgcccttcattctactttatgcatggcagccagagtgaccttcagacattcaaatagg

SEQ ID NO: 108976 - DNA, 6499 bp, Homo sapiens
atgccggagtcttaaaaatggaggcagttgtcctgagtgttcattctagtgttaaaccatgttgagactatgcatcttactaggctggtatcattgatcagtgttagaatgacatgtttcctggaactccaactcttgtgttttaaaaatttacatttaaacttctatgaaattagaaggtgttttatagttgatggctgcacttaatgtccttcccttcctccaaacttacagtaaatggaagagttattaagtcgatggtgtctgtagaattgaggaaatatggcatctgttagagactacagatttcttaagatgagcataagatgttaattagccttcatttagctcctttccggcaaaacttgttttctttggattagtatacttaatgaatataatgtgtcagttaccaatgacttacttaaagtgctgtccttagggttgaggggatgtgtcatctgactccagagtaggtttatctttttgggagacaaagtgtctacaaagtggccttcaacctttttgataatgacctacagtaaaaaatatgtattttaccttttgaccagataaactcacacgtggacacatgcacatgtttcataaaacgataattatcctactctgtgcgatgtgctgctgatgtttttctattctttcctatttcatttttttaaaatgctggtctcaactcaattaatttctatgggcattcgatccacttgattgagttcacatcccactaatgggtcacaacctacccttttaaaaactgctttacaaagttaattaaccaacaagaatgaaggctcccttattcacaggcatcctataacttccttttgcatgtgtgaaggggtaaaagaaaagatggatgaaataccagtaaattaataagataaactatcagaacaagtaaaatagaataaaaagtagaaggattttacaggcattaaaaagtcctcctaatgattaagcgctctttttttgtttgaattaataaagatggctaacaatagcctacttctgtgagaccacaggtaatttttgtcattgggattgtcttctgaaggtgtgatattgaagtctgaaatccgtaggctgtagaaagcctcaagcccaaggtatagccaaggaaactccacaggctgctaatcatggagtttgagttttaggtaagggccaagagaaagatatttgacttagctgctgatgaaaccgtgcgggttgccattaatgagtcctttcttccataaccctggttgcctgggaaaaatggtaacataaccagcatgatgttttcttcactatcatagagtgacatattttttttcagtggaagaaaggggacaattctgactaaatctaatattacaaacacattcttaccctagaacactcaaggaaaaacttgttttatgatgaactagagccatatggtacttaaaagtttttttaaatcatatttataagcttgtttgacttgtttctgtgtctgtagaatcttgtggaagaagaatgaagttgctgattatgaagctacaacattttccatcttctataacaacactctgttcctggtcgtggtcattgttgcttccttcttcatattgaagaacttcaaccccacagtgtatccttttcaaggttgattatcttttttagaagtcaagaaacagtagttcattttggttttgacttgtctggatattttagtggaaagaaaaactgctctgggagtcagtccattaaatagtgctgactttagataactttctggacatttaaaataacagctattggtttaagattcttttaagtttatgaattatgactgtatgataaagtattacaaagtagtctatgggaatctgtgtccttgcctccttaaaaaaaagctccaaagagccaaagcaaacctgtcatttttgatagcttctgaaataataagcccctgtacctgttatttttgggctctgggggttgggtggatggccaatgcagttaaataggttcattccagtgtatcttaatagtgtttcaagctgctgttaagttgagcttttgggcaagaatcagtcttctcttattaatttattaaagatgttatccaggaatgtgcagccaagattttaacaattggtgattatgatgtaataaaatatcagataccctccaacgtgtaccttctgggaatgctggagtgatttgctgaaaattgtagagttctgaggctaggagtagcttcgaacttttagaacctccttgctgttgcaagccaactgcagcaaaacactgatttgcagggaagacttatttttccattgctcttaggggaagaaaaggaaaacaaatctcttttctctccatgttctttgatcagctcttcgtgaaggttaaatggaattcagattattctttgtgatcatgtgttctaggtttctgtctaaagtgttttttttaaattggaacacatttcctgtgaatgttttccatttttttttggtcttctgtcttgcaaattgtgtttgcagacaatggggctgcacatcattatgattacaccaagtgtcaggaaggaagcagtacattccaaagagatgggctctttattttctcaaaaaaccaatttggagttactcatttttccataacattaaatttcttacaggaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcactgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcacatatcactgtaaggtacagttagggtaacactttagaggtttattatttttaaaaaacttttcttgaactcctggccaacatggtgaaaccccgtctctactaaaaataccaaaattagccaggcgtgatggtgggcgcctgtaatctcagctacttgggaggctgaagcaggagaactgcctgaacccaggaggcagaggttgcggtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttgatgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtagctgggactacaggcgcccgccaccacacccggctaatttttttgtatttttagtagagacggggtttcaccctgttagccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaatttgtattttccctacacttctttataagaatcctatgatgaagtacgtaatctttattatattattttacattaaccatcttttttttcaaattgttttattttttattttactttaagttctgggatacatgtgctgaccatgcaggtttggtacatatgtatacatgtaaccatcattttaatatctcacacatgtaaatgcacatctttgtagttaccaatcaaatgtatgtgaggcaatgaaaggcattgagcagttacagtaaagggcagacatcaggcctctgccagtatgtacctgctgtgccttcctgcctgccctatttctttgttttcagtgtgcatgccagtcactgctgcttctggagacaggatggaaggatacatgtatgtgtacatttatggagaaaaccaatttatagatgtatcagagctctaagggattctctttcacttccttgggactcccaagcagaggaattaatagattaggagggtcttttggggggttggtttaaattttcagggcgatagaggctaacttctcgttggccttcatgaattttcaatatatcatcttttcgctgacttatccctgtttgatttctgagtttggattaataactatgttttttaacttcaacattctcacaaacaatttctgcataaaacttcttctttaaagcttaaaaagaa

SEQ ID NO: 108977 - DNA, 1018 bp, Homo sapiens
aaattgggaatgaaacctttgccatttgctggattaggtatttcaaagtggggtgaggtggaggtttcatggatatatataagtgcagagtgtcagaacattataaaatttctcttcttttcattggtagaaatttggctgtttttatttccaccataaaagccatacgggatacagtttgtactgtattgattgaccttgataactgggaccagagcctctcattaagatctagcttgtttctctctgaaagaattccaggagatttgatgtaagaagaaggcttatcagcatttctttgcttagatgtgtatctctcaaagctctgtctacattcatttggaatatatactccatgccgcttaaaagtactttaaaatgttcatttatccaaggatggaaataagcagaggagaatgtgagattcattaacattcattccagagtgggagtgtggtttcttcttgatttacaggtgatctatcatttaacagttgcttggtctcaacatttctcttgtaggaagctcttcctgaaaacatccttaagatattgagaagtgctctcccaaaccacgttccctactaggaagaaaatgtcttctactaggcagaaccgttggcaatgagggcatttgggggtcctaaatttaaaacagaaacaaaaacaggatatgggtggactcagtaaaagttctaaaggctgtcaggcagtcctgactttatacactgatgtaactaacacgtggtcatattgggatctagggaaatctaaaggattgggccacttctttcattaaaagctttttgaaaatggttcttgtattagtcgattttcacagtgctataaagatactaccagagactgggtaatttataaagaaaagtttaattgactcacagttctgcatgactggggatgcctcaaaaaacttacaatcatggtggaaggtaaagaagcaagtgccttctacacaaggtggcaggagagtgagtgagcacaggggaaagtgccattt

SEQ ID NO: 108978 - DNA, 1403 bp, Homo sapiens
aaaagacagctctctgcccccttagcagccttttactttaggtttcagaattgatttcctcttaattgtgtgtgttttgttttgtttttttttagaactattttttcctctttccagttaccaatttgtgtggggtaacaaggtttaaaaagtaactttgtaaaccttttaaaaaatacattatttgaaactgactaaacgttttctttttattaataacaatgtcaattctaactcagttcttgagtgagagagctaaagatggagacaggtaaaaaaataggtaaaatcagttgcaatttgtgcttaacttgtatcccagacacccttgtagttgaagatcaagattgaaaactcctgccttgaatgacctggggctttctgtccatcacacccagcttaaattgtcctttggagtaaagttaaaataattactttaagatattacagctgttatttccacttcgtttaagcctagttttcgctcctgttatgtacttggaattgaaataatacatcatttactaatgccttatgaaatttattagttgaacagttagatgataggttaaaacaaaatgtagttaaaatgattcttaactaaattgtgttaatagcatttgactttattaaccacattaattcctaaactgtggaaaattcttctttttaaggggaaatcaaaacacgtcactaataaaccacatcttggacatttctcgaacttctcttttggctagtgcagtgtaataaacttggaactttctgctcagcttcttttcttgaaatgtgaaatatcattctgttgccagtacgaaatatgagtacggtgtgtttctgagagagtgtgatgttcacctctgtagcatatggaaactttttctttttttctttttcttccagagtagcacagaagagggaggatgctgtttccaaagaagtgactcgaaaactttctgaagctgataatagaaagatgtctcggaaggagaaagatgaaaggtttgactcctgtttaaagtatggccatcataaaagggggtactttgaagagaattttttgatttttgcttaaagaatttggattttggaattgtctgaggtaaattttggaattgtagtagtagtagtaatggaaatagtaatagctgacttttagagtttttattacaaccagatacttttatctgtgctgtacaatagttgatttattcctctaaagagtcctgtgaagtaggtactatttttatctcctttttatacctgaggcaacaaaggtacagaaagcttgagtaacttgcccagggtcctgaattagtacatggtagatccatgataagaacacaggcagtttaacttgagagcttgtacttgtaactgtctgctggaattgaggaggcaac

SEQ ID NO: 108979 - DNA, 1062 bp, Homo sapiens
ttcaacgtactcagtcctgggtacgcacagagggcactaatggcgtggggccagaagagcttttaattttggaattctgaagaactgagaactcgtgagtctgtcagcagctctgaagtggaatatcaataaagttttgttaattttttttaaagcaccgactaaactacaaatcccttctctctcctccaggtgggtgggtcacgtggcttgtcaggaatccggaagtctggcccgctcgcccaatcacgcccggaagcctatctagtggcgccaagctggccaatcctggggacgcttgctcttcgccaaaccgggtcccgcctccgcgcgccgcgctgacgggtcgttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctgtgagtgctgggagcgaggcgggttaggcaggccgccggctagtcgggctgggcggggacgtggcaggacccggcgagcagggaaggcgtgggtgccggccgggggtcggcaatctctccagctcccctgagctcggggaggcacggagcctcttctttgggcacagtgttgtcgcttgggattgtcctgtgcagcactcggggaggtcacttgttaaaagtacgcacgttcccgagctccaccccaggagaaggtggttaactagttctggggtggcggccccgaatctctatttaaacagacaaactcaagcatactgcctctgcccttttctatacaactgttgcttgccgttacgaaattttaaacttattacttattttgcataaattagttaggtgagaaacccatgaagtgacccactgaattataagtgcatctttacgtgagctacttcacaccattgcataattttcctggttttt

SEQ ID NO: 108980 - DNA, 1029 bp, Homo sapiens
tgccaccagacgaggtcgcctgccccgagccggacaggctggacaggctgcgcacctgcggcggccgactatttcgtgggccttgtacgccaccttgcagaagggaagctgtgaggttttggcgatagaagcgcatttacttgtgttttaaagcccacaaacgccgtagtgactaacttattcattcagcaaatgtctgtcagagcgtctattacgtaccaggcatgtagcctgaacttcacgcctgtcctcatggagcttgcagagcacctctgaaatacacaccacatacggaatggccatattttctgggttgtaaaatactttgaattgtaactccatatattgaatagattttcagtagtgagggaagaaacaatacatttagttcatataatccatatgtacgaaaaagaagtgctggtaattccagacatggaagtcagtaaaactaggagctaagaggtaataatcatagacattatgattctaagcctttgttaaacggttctaaaccagactgggtaagcgcaccagcaatgaatagattaagggtgttatctccttagcagcttatttcaaattgcatcaaggcagggccattaaactaaggtgagaatgatatgggcggaattcagaggacaataggtaaaagatgaaaatctttacatttaaaatcttattgagacaagatcttggtcagtgtctactcatacatagaattgcctagaagctaatatttgagtttaccatattactgttggctttctatttttctcatttgttctgtttcttttctgtccttttgtgccttcttgtagattattaattccactcccttgtaacaattaggttgttatacattctttatgcttttagtagtatttcagttatttattgctgtgttcaaaccacccccaaaatataatgacttaaaacaatggctcttttatttactcatgattctgaattctctggcacaggaattcagtcagggcatagtacaggtggctcatttctgctccatga

SEQ ID NO: 108981 - DNA, 3753 bp, Homo sapiens
ggccaacaggaggcgtcactcggacccgggctcggcgccggggtgtcgcgcggcggcgggcgggcaggctttggagcggcagttttttcggaaagtgcttttggccgggagtgccgcagaaccccagcgtcacgaggtgaggggtgtcgcggtgtgtcgcctgccgctggagaccggaggatgtgttcttctcatctttatttttctgttatgaaaactaattgaggagctaggttctagtggctttccccctccagccacttctccagttctctgcttcttcctcccagttttgtttccgagtttgatgaaagggcaataataggaaaagttgcgcgcgcgcgcttgcgtgtgtacgcgcagacacacatataaataaaatcgatttagtgtctattttaccttgattgggtttgataggagtggttagagagtgtgcgcgtggggaaagcacaggccggtttggtatggtggagagggaataccacaatctgtgccaattgtgccttgaggcaataacaccaaatgatgaataataacgcctggcttggctcctttccagttgatttatgtctcatgtcagatccctccttcttcgtgaagctttccctaacaatgccagcttacagtgaactctcctttttctgccttttccttttgtacttatcatgtaaatttaatacttcgttataaactgctttgtattttacttttctgaatttgatggacttcttacacatagatttatgactctccaattaaatttttaatattcacttttggggacactcagttttaccttttgttgttgacccacaaacaacaaagaactaagcatttaatatgtgcttttcttaactaattcagccaacaaaatatatatggaacaccagctgtgtgcattgtggtagctaggcactttattgggcacctaggatgcatatttgattaagtcatgggaccttgcgtcacagatctctttcagtttattggacaagagagaagaggattaattgctcatcaccattcctttctcacctggcacaatctcagtaaatgttttcaaatttcagtttttttcaaggggtctgattcttggaagaaaggactttttcgtctctttcagtagttgattaggaatctgaaatttggtgtgtgttttatattttttttttatttttctatagtatgccttcatttgctctttaaaaatgtatgtatgtaacttttctgaaggcaagaactaggaggctttttctgtgttaccaagttgtgcttgtcttctgacacatcgtgcagtggttgttgctaatggggcttctgttactaaacacacccttgtattccatcagaagcggtaatgtttttgggggttgtaaaagtagactcttaacattcttggatagtatattagagctttctgaatatagaaatgcttaacagactcctggctttctcccatagaacatttcaattgagagcccctgttacttgtgtatgttcttatacccttaaattgactcactgttttaagtttgaagtttatctttcatttgatgaacttttaaagaaactttttgtcaactcatgagataggtgatacataaacaactataaagagaaccgcaaagctgagtggaaatgtggtttccctgctgtcatcatctagatacagttatttctacctcccatttcccaccccactctaaccttatagtagaaattcttaacctagcagaattgcaaactcttatgtattcagtccacaaatgcatgccaatggcctgttgaaagactcttctacttttacctgctgtgtgcttttgaatagccttgggtgctttggagccttaatttctcgataaaatttaaaattgacttgtaaaaactaaatatagtataagaggaatggtttcagggaatcagtcaggacaaaaacaaaacattttaatgaatgaatgaaatccagttgctgtcagtttgtaaatgatcatcttccttcctttcctcgtaggatttttagactctgaggagcagttggagctaatccacattatggaaatggaaaccaccgaacctgagccagactgtgtagtgcagcctccctctcctcctgatgacttttcatgccaaatgagactctctgagaagatcactccattgaagacttgttttaagaaaaaggatcagaaaagattgggaactggaaccctgaggtctttgaggccaatattaaacactcttctagaatctggctcacttgatggggtttttagatctaggaaccagagtacagatgagaacagcttacatgaacctatgatgaagaaagccatggaaatcaattcatcatgcccaccagcagaaaataatatgtctgttctgattcctgataggacaaatgttggggaccagataccggaagcccatccttccactgaagctccagaacgagtggttccaatccaagatcacagctttccatcagaaaccctcagtgggacggtggcagattccacaccagctcacttccagactgatcttttgcacccagtttcaagtgatgttcctactagtcctgactgcttagacaaagtcatagattatgttccaggcattttccaagaaaacagttttacaatccaatacattctggacaccagtgataagctgagtactgagctctttcaggacaaaagtgaagaggcttcccttgacctcgtgtttgagctggtgaaccagttgcagtaccacactcaccaagagaacggaattgaaatttgcatggactttctgcaaggcacttgtatttatggcagggattgtttgaagcaccacactgtcttgccatatcattggcagatcaaaaggacaactactcaaaagtggcagagtgtattcaatgattctcaggagcacttggaaagattttactgtaacccagaaaatgatagaatgagaatgaagtatgggtatgtatttataacaacttgtagaactgttgttaaatgctatagagaaggtaaagaagctaaaagcttagtagggtggtttctttcagtagtaacaggttttctttttttccactattattcttttgactgtgctgtcctgatttttcatggtgggtgaatgcaggctattaactcaaccggacaatgaaagttttacgatttgaacaattcatatgtcagttcaacgtgcgtgtgactgagaagttgcacatacattaaatattgtgaatcaaatactgttttaatcacccaaggaaagctggcttttgaaagaaagtctggcgaatcttactataacataaataatgaatctcctaatttatctaattttaaagctctgcacattgagcagctgttattttttaaagaaaaatagtattgtcgagagatgtttgtgaccctcttcattttgaatggtataaacatcttttctgtgaatgattcagaagttcctcccatacttctggatcttttattagtttccttggaacttttcaccattaagtttatattatagataaaataaatttttccagaatttagggtattttttttttaacctggaagagtcctttaacaatcagtgaagggatgaatttatggtaaggtatgtttaatactcaaacaattatccttgagttttggtacacaagatgtgtgtatacacataactcagttcttttagtatggatgtctaagcagcattcactggcaggcaactggtatttccacatctgaa

SEQ ID NO: 108982 - DNA, 2754 bp, Homo sapiens
cctgcattgttgtattatgaggtagttgcagtgggtgcttgatttccaaatcagttttaatgaagtaaactaatgtttatctgacacttgggagaagaaaagtgtgagtgaagtattataattaccattgctcctactacattgttagtggtaataagtggtcctgtcctaggaaaatagcaaaaagtattaactgttaaattactagtaaagtgaagttctctgaagattacaggaagaaatgttgtaatatagtagatagctaagtgtcaaaaattaggcttttgggaagttgacttgtggtcattgcaacctggttttccttgtattccaaagcgatgttgtgtttcctggcaacaagatgcagataacggcatgttgagccttgctgagagattcacaaacaagctggagcagcccaggttcacatggttaccacattatttggctaaagctattaatctctgtggtcaggcctgtaaagctggtctatctgtgcagattgcgcataaccaggaagtgtgtgttcagctgtgtatatgtcgaagttggaaccagcagtctttggattcagaaataatgaatggcagttgtttatcccactgttttcagtagtttatatggcttggtaaatcattatcatattctgtatccataacatcttcattgtgtgatatacttggggaaagttcatagttctgggtctctagcagagatgaaagttcatagtttcaaactgtacagataaaatcttttatttagctttgcaaatgtattggatttaatacctaaatctaaattatatgtatagtgttcattttgttctcaggaatgaaattggaaaggaagttgaactagataaattcacaggacctttccaactttttagtcaagatgcttagatactaaaagcacattaaaaaaggatttcaataatacatgcttatttgttccttgtaatgaaattatgatgtaatcccactttgctttctcattttgcttttgtacatctacaaacgttcattgccaacatcaactgcatactagtgtgtatgtacttcccagatatagatgctgaggcttcttttttgcacacgagatgagccttggagaatttccaaattccaaatatacagttgagaaacaacattgagtgttgtgttttcgattaagaaaacagagtctggaacagtgtaggcactcatccttagtagacgatgacattggatggcagaattaagcagttttaaaagagccttgcacactgtggagtactgttgtggataattgaaattatggaggttgtgcaaatctctctttagcaaacaagatcaccactagtttcatattacattcattttaaattgagccagaacaattttctatttatttccacctgtcaagaagggacacactgcaaaccttattttggaggctacctgcaggtgcacatgtgaccaatgattatttctaattctgaatttattgaaagagagtggaggtgaagaggaagaggaaagttgcaaaccctgaatccattattaatttttttcagaggacagggtttttttcttttgggattaatgctcactgataaaagagggagctttagttgctttaaggcttaaggctagagtgttgtcatagttttagttgctgagtgattttgattgctaattgcccttagaagtctatttttaaactctgtccaagggacaataccattagatgacttcacagaaactctatataaaagagaaatgtatattaatgatcataaaaagcatatactgttacagtccctatatgacttgcatagtgaattagctaaactagagcaagctcctgactgaactctactggagtagttaaattagccaagttagctctggcgtgcacagctgtgatgatgtatgaactaactcattatgtgttattgataacactggagagaggagaacagctgaaacttactatgccttgtgactttttggtagttcttgaatatacacagctggatgagtttaaatttattttaaaaatttctgcctaagagaaagacagctccataagcaagaactgtgtttgaagtgactttcaaaatgtgtgccttgtgctttaggataaagcaatccaatgaattattttttgtacttctttatgctactatttacatatgaaataaaactaattggcttctgtctatactaacccagagaagttactggatctgtgtagagctgtcatggcaatcaatagcaatcatttatttattccctttttggtttttcatcaataagcagattagactttttgaagcagctgccacctggcttcaggttggggtcattcttttcctgatgtatttatggtaatgaaaatgaaccttgtcaaaatgatttataacttttaaatcagacagttggaggaaatagcttgtaaggttatgtggcattccctaaaaataattgcatgatacattatatattttatcattgagttgaatccaaagctcttactttttattgtaagtaagaaaaaaaaggaatacaagttgaatatcccttatccaaaattcttggagaccagaagtgtttcagattttggattttggaatatttgcatagtaccccagttaagcatctgaaatccgaaatgctccagtgagcatttgggtatcatcttggtgctcagaaagttttgggtttgaagcacttccgattttcagatttggggtgctcaatttatagtagt

SEQ ID NO: 108983 - DNA, 1052 bp, Homo sapiens
agtattatatttatgtagaaaaaattataaaaacgtttattttatccctttttaagggatgtcaaagtctatattcaaaaaattgaattaaccactatttgtgccttgaatacatgggaggcattttttattgtttactttgagataagatagaaacctctcagttttaaaaatatttttcttaacagaggggatatctactctttataaaaatcagtgattgcataatttaaggtagtataaggcatgctaccaatttataaaaactaacctgtgccttctatcccagctgttcttacagaaattaagtttcactttctcatcaggctatggttgagaagtatgtctcatttatagtgccttctgtgatcttaggacatgtgactaaacttgaataaaagttaaggctgtatgacatttctggtaccttcatgatgcaaaatttaatcccacactaccataaatagatggcagtgagatcttctgatctcataagtgtaatttttatttatgaaagattttagacttatccacattttattggaaagtgtttttgtgttctttgctttgatctgtagttgtgtaatagaaaacaaacaacaaaaaagccagcataacaatattttagtaggttcttttccttaagtagatactgtaatttgcttttagtggttgcattggggccggtggacttcattgtatggtattatttattaggggtttagcaaacatctagatgtattcaaatggctatgtcttagtatcagtgtgttttgagaataaactgtgttatgtttgtttagctccccacatgcttttggagaatatacaattaaaaagcttaaaaacagataatctttttcatttaggaaacttacctgcctctcttcatttcactgggttcacttctagaatgacttttaagactacagatgtctaacgatttatgaatcagacatgaggtttggcacacagataaatgtgatttcagacagcatccttctcactaacttgctgccttcttggaataagaatttccaagatgtctcagg

SEQ ID NO: 108984 - DNA, 1059 bp, Homo sapiens
aaccagttagctcttacaggcaggaagccaaggttctgaagtctaaccgatctggttaaaactgtacagagtaggattcagaaaactttgtatttaatcaacctatgccaaagtctgagttctatgttttatttctatcaccttcccacttaaacctgctgtacgtctggtaatttgtcttgttaatagcaccattatccaaccacccagaccagaaacatgggacacatcctagactcttttcactctcttctgccccacgtgtaattatccttcatgcagttaaattctaactcttaaatacttcagctcattcctacattgcctccttagtcctctttcatcatatgtctcttgtgcagttctaataactatacatggctgttcatagaataatattgataaatatcctaatatttagcagttgaatggtttttctctacctgtccactgccaaaaataaataagtaaatcattcttctataccactacaactggagtgacctttataaaggcaagtctggactttgttgtaaattcactggtgtttcctactgcccatagaatcaagacctaacttcttaacacagtaaacaaagctcttcattatctggcccaagccaacttatccagtccagttttatcccttatctctcatagatacatataccctaacctcccacatgaactgggtgtgcctcttgcacactattcttgtgtgccttgtttggttagcttctacacatggagtcactccgcatgtggtgtcctgcctcccattgtttgcctggtagctggacctggctcacattttatccactctggaacaactcccttgaccacctttcttgacaccttttccagcagaggtaagccatctgcttctgaccacctttgtgccacacttcacactatgctgcaaggtttccttttcccactagattggtgctctgtgtcattttgcctttttcattttcttatggccaaagcagagcccagtaccaaattaatgtgtctactttaaattactttgctttttttttggtctcattttcttct

SEQ ID NO: 108985 - DNA, 1092 bp, Homo sapiens
tgttataaagcatctaaattatgagaatgggcgtccttttcagcattttaaattagtgttgtatatggattcttatagtgggatgtgtggtggtgagatgtggaaaaacagaattgttaatatttcagcggttcaagttcattcttcccttaatagcaaaaatcagcagtctgttcacaaggttttgttttcttctggttcatgatagggctgtatcttagataaaacaatactgatggatttagccatctgatacaaatagcaagatataaatcctactgtacagtggctattacccatactcttttttggctgtccctcagtagagatgcctttagaccagatggggttttcatccacaaggattattgcaccttgcttttacagagacacccccaatctctagcactgtctctcttgctcagtttccaacatcctgtatttactgctttgactctaacttcatctgctcaatactgtaaattcctaaccttatatcttaaggctctgacaccctggacttaaacgtccacagtttgttgcctgaagtctctcacattgcttgttttacccccttataggaatttacaggttcccatttcctcatctctcagatacccctgtttagaaggtctccttttccaactagtaccaatcctgtctccacccgtctttcaagaagcaaagtgcttggagacctctttttccttgttcttacagctctttacttacagtgatatttcctgttatttaaactgcttctaagattcttcttcttgcagaaagctatcttggattgataaagtaaaacctcttaattttcctgacctttatccattactggatgccaataaccacctcctctcccatattgctgcatgtttattctttgtctcttatttcctgaatgtacttgccactggtgaatttagataggcagatgtactgcttctttggcttacattttgttagttattcctttcttaacgcccctggaagacagggactacatctgtttaattcttcgtgtattgcccagtagagcccaccatcacgattatcatacatagatgactcataattgctttctga

SEQ ID NO: 108986 - DNA, 1538 bp, Homo sapiens
atttttcccttcttttattctgtctttgatcaggcaatactgtgtattcctgtattggctcaagtaaactgatggcctctgaaaaaaaggtcaagcttgaagagaaattttctgtctatgtttagtttctacatatagcatcatagtaaaactgactccctgattggctgaggccagcccactgtagagtggagggtgggcttattttgattgggttaggccagtggtgctgtggggttaaatcaatcttactataattccatggcctagaaattttggtcttgattagaaagggcatgtaggaaatggatgctgtggaaacaaccggcaataaatatgcttttactccaagtaaagcaagttttgaaaattctacaacaggctatgctatgtatttttaatgtccaatgatatttttagatatttctgttttacaaatttattaacaggtttttgggttttttttgtttttgtttttttttagaggacaagaattttgggcagatttgaatgccatgaacgtgtatgaaacaactgaatttgaccaactacgaaggctgtccacaccaccctctagcaatgtcaactctatttaccacacagtctggaaattcttctgtagggaccactttggatggagagagtatcccgaggtatttacagattctttgttgacaagtacatttttcaaatttatttttttcttcctgtattcttttattctttctttacaacaatgactaggcagaactatgcatataatcaaacagcttatgaatataaaattgagtctcattgatacaagaaaacttttctctttttcttaaaatttatttctttccattaatttgaaatccaaagatagcataccactattatcagataaataaaatgctttccacagaatcttgcattatagagatgaaatattttgacctgttgccgcctgtggagtaattttcacgacatgagaattggtataacttttgattatatctggctcttgggcttatggagattggatcaagtgttacacttagcattttagaagcccaatggaaacaatcactcatgtctctggaagaagtacttgaaaatgtttattgagctgtggtcagggaaatcagttatttacaattttctcctatgtgcacttgcatccttagtctgagacagtgataatagcccttcagtctcaaagcaaggttttaaaatgatgatggtttactttgcttctgaatgacaattctgagtcatttaaacaacctcaaatggactttagagattaatttcacattccaaagatctgactttttcaatttaagttcatttccagcattacaaaaggggggaacaacttatctaccttacttttatttttaaagacaatagcaaaagaaaaaaacctagtatgttaattattgttaaacacaatattaaactaagtaagtttaagtaatcactagtatctaccttccaaagagaatacaaggctgtttaaaatgtactctcagaatacttggtaatcactagttatc

SEQ ID NO: 108987 - DNA, 1069 bp, Homo sapiens
ctcagaatactcagactgttcctgtgtttttcctctgagaagttttttgggtttagagcttgaactttatataccaccaccttttcaaattttatttatttatttatttatttattttgagagagaggtcttgctctgttgcccaggctggagtacagtggcacaatcatagctcactataatcttgaactcctgggctcaagcagtgctcctgcctcagcctcccaaatagctgggactacaggtgcatgccaccatactcaactaatttttattttttattttttgtggagacaggatcttgcgatgttgcccagtctagtctcgaactcctggcctcaaacaatcctcctttctctgcctcccaaagcgtggggagtggctcacaggcgtgagccactgatactggccaacatcactatctttaattcctcttttgaaaactcccttaagaaatatgaacgaaaactctctatgatattattaaggctcaaaatagaataaaatagttccctgggccccacatgttttgtaaggtggaaatccatgccttatgaacagggagcatctttccaccctacatacttggaagggaaaaaaaatcttagcatataaagggagttatttagactcactgtactttattgaaattcctgtgaggttaacttttgcctttggttaattttcatttttaaccatgattattaactttcctttttttttttttttttgttctgttttctcctccatagtctgtcattcgattgattgaagaagccaactctcggggtctgaaagaggttcgatttatgatgtggaataaccactacatcctccacaattcattcttcaggagagagataaaaaggagacccctcttccgctcctgttttatactgcttccatatttacagtaagtgtcgagtatgaagttgcaatatttactctcattttatgtaaatgcattcctgaatactagagataaaaaataaataagagtctaccttggttagtactcctagaatgtgaaattccaaattagtctttggattttaattcctcaacaaat

SEQ ID NO: 108988 - DNA, 1026 bp, Homo sapiens
cagtcaggccatcatcaaggcaaaaccctcccaccagtaaaattactatgactcaccaaaggctcagatgattgttagtgttttttagcaatgaagtatttttaaattaaggtataaatattgtttttttaaagaatgaatgctattatgtactgaatagactatggtatagtataaacataacttttatatgcactgggatactaaaaaattgtattactcactttattgtgatatttgctttattgcagtggtctggaatagaatgctcaatatctactaggtagtcatatattgataatatgggcttacaagagaacaaaaatagttactctttattttcctttttcttttaaaaattttctattttaatctttctgtctaaaactgataatcaggtataaagtaagagatcagcaaatcaaagaaatattaaacttcagtgagaaaagagcagagaaatagccagtccaccagggtgggatgggtaaatgcagtgatcctatctaccctagagtgtggggctgaaggacctagtagggagaaagatgaggggaattggttccaaaaagcatattttagaagtagattccagaggctatgatcttagccagggaaaatgtttctttttaagtggtttttgttttgttaaatttttaaaacttttttatttttttattttttattttttatattttttaaaacttttttagagacagaatttcctctgtcgcccagggtggagtgcagtggtatgatcatcatagctcactgtaacctcgcactcctgggttcaagtgatcctcctgctttagcctcccaagtagctgggacttacaggtggatgctgccatccccagctaatgttttctttttttttctttggtgtagagacaaggtctcactatgttgctggggctggtcttgaactcctgtcctcaagcagtcctcctgcctcagcctcccaagtagctgggattacaggcatgatgttttgtttttaagtgttattaaatgcaaaggata

SEQ ID NO: 108989 - DNA, 1033 bp, Homo sapiens
ttaggggtttggtggttcagtgctttcagctgaaagaacatttatcccatgcagtcacctcatggtcatgggaatgcctggcacagtttctttaatcccccctgaaaaggataaaatgaattaatttgtatttcatcgctgaaactgatttagtaaacatctttcaaaatggtaaggggaaggagggaaagtaataaaaggtgagtttggattctgaaatttcattcttcagagatccttgtgtagaagctcaattccctttgactccctctctagagaaggctggtgtccgtctgtgaaacatgcagtatatctttggaatacccatgcagtgaatacaaactcattctcagaaaataaaggcacatttgtaactgcgcttgaaacatatttttttaacccatggctattagagtgttgaagcccatcagacagatgtgtatatgcatttttatgttttaggcaagttaggatgttggcttgttaaaagtaagcatctatgggttggaatggatgttaaccatatacatagtccagtttaatatcttagaatggataggatttatttatctcggctcatcttcaagcatatgttagtaataatggacctccatcccctgcaaaaaaggaaaagctatatttgaagtttgcattttatggaacgggtccatagtagtgatatcagaaagaaaaggggcagaatctcttctgttgtcacggctaggtttgctgtacaggctgacagtctaaaacctctagaggagagtgtttgcagagaatcttacctttttctttcaaaccagaagcctgtgttggtaacttcaagccctgataataatagaaaacctggtgggctggggacttacccttttctttgcaaagctggatagagggaggagctattaaataaaaataaggggcttatattctttgcttccccgccattcctccagattagtgatggctttttaaggagttatagatatttgagaatctgattaaagcagtcagacctctcttcaggaaagtgtac

SEQ ID NO: 108990 - DNA, 1141 bp, Homo sapiens
tgctacagaggacaaggactgttgtgccttttgttgtgaaggttggagaaaccagcagcactttaaatctccccctgtacttaaaagcacctcggagattcagtaagccctggatccacccatccatccaggactctgtctcacaaagagactttgaggcacattgaattgaaggcacagtcacttgtagaaggtgggggttagagacggcagtcatgcttccattgttttagcttcttgaaagtcatctcctaaaagactgtgtgttgatgataatgcggtggtggtggtggtggtggtggtggtggtggtggtggtggtggtggtggtggttgtggtggtggtggtggtggtgatggtggtgtcaggcaaaactaggttggaatcctagtatcctgtcgatcactttctagccttgttttaaaaaatatatatataaattgtgaaacatatggaactgaaaagagtatgaaattagaaactatctagatgggcctggcctagattcaaattctgtcttcgctctttgctagctatactcgggcaaattatttaatctctctaaacctcagtttcttcatttgaaaagtgggaataaccaagtcatcttacagggttattgtgacaattagtgatattgtatgtaaaatggctggcacatagtattaattggttatgattatgatgagagagatggtcagctatgctctttggagatgagacacacaaagttgtagtctctgtgtcacaaagctcttatgaaaatttcagtttcctaatacattttggcacacattattacttccttgtgaccagtatgtgccaatgagtgttatagcacctggccctgaactaggtctcagggtcaggatttccttgctctcttccacttctctttttctccatttcgaaatggccaaggaatatgatttaaatttaagcatttaactaggcaggaataagtaacttaccaaagctgctgcttatctaaaatcattgttcaaagtaacagacatgaatttaaaggctcacggatatgcattctggtatctagagtttatagtaattagctccatcttaagcacactcaaagctataaaagttgaatagtattggtggttttgtttctatgtgtgatctt

SEQ ID NO: 108991 - DNA, 2853 bp, Homo sapiens
atacattccagagttttcttcacaggaaggaggcccacagaaggctaataataggttattcatgtacaggcgatgtttgctccaagcctttttttttaattaaatagatagcattttttacttttaaaataagcacttaagctatacagattataatattaagtagacactgatatagatcactataatgtgaggtgtacttatttcttaatgttttacattgatgtttcttcctctccattttaggacacttggtggggttcccacacaagctcctccacctcttgaagcaacttcatcatcacaaattatctgcccagatggggtcacttcagcaaacttttaccctgaaacttgggtttatatgcatccatctcaggacttcatccaagtccctgtttctgcagaggataaaagttatcggatcatttacaatctttttcataagactgtgcctgagtttaaatacagaattttgcagatattgagagtccaaaaccagtttctttgggagaaatataaaaggtgagtcagatgtatgaaaagttcaagacggccgggcgcagtggctcaagcctgtaatcccagcactttgggaggccgaggcgggcagattacgaggtcaggagatcgagaccatcctagctaacacggtgaaaccccgtctctactaaaaatagaaaaaattagctgggcgtggtggcgggcacctgtagtcccagctactcgggaggctgaggcaggagaatggtgtgaacctgggaggcggagcttgcagtgagccgagattgcgccactgcactccagcctgggcgacagagccagactccgtctcaaaaaaaaaaaaaaaaaagttcaagaatcaagagagctttattgtagccagtgtcaaatgaggaacataatagtaaacatttgcacagaatttatgttcatattttctgtgtattgactgacatataatcctcataacagacataagtaggattattacaatttatatcctacagagaagaagaaactgagtcacagaaagcttactttgctgcaggtcatgcggctattatgatatggtgctggaatttgaacccaggccgtctggcaccagaggccttgctcttaatccctttactgtggtgcctctcaagtcaacaaactaatgaaggacaaatggagggaatacatttagatttcaggaatctcagaatctaagagaccctcagattggaggaattaggcaaggagggcatcctgaggaaaaacataggagaactcttaatagatttaagatgaaagagaaagcaagtgaatgattggtggagaaagaaggaaaaggccttttctacagtggaaagataagtttcaacttttaataggatctttgatggcattttgcccttgataactcctcattaaaaccataaagagaagtttatgactacatcatgcctgttaaattgacctgtatttcatccttctgaattctctgtctgttctttccattaggaaaaaggaatatatgaacaggaaaatgtttggccgtgacaggataataaatgagagacatttatttcatggaacatcccaggatgtggtagatggaatctgcaaacacaactttgaccctcgagtctgtggaaagcatgctacaatgtttggacaaggcagttattttgcaaagaaggcaagctactctcataacttttctaagaagtcctccaaaggagtccacttcatgtttctggccaaagtgctgacgggcagatacacaatgggcagtcatggcatgagaaggcccccgccagtcaatcctggcagtgtcaccagtgacctttatgactcttgtgtggataatttctttgagcctcagatttttgtcatttttaatgatgaccagagttacccttattttgttatccaatatgaagaagtcagtaacactgtttccatttgaaaaatcttggtactgctaaattatttgatatgaactcaatccagcatttgtagcaggttttgaatgggtgggactgggtggggaacagcattggacattaatagggcacttttcagacccattttttaaagtgctagaaaatgctttttttaaaaaaaaaatacaagttttaaaatgaccacttactctttaattatttactaattgctagtgtactcagtgtggaaaagactacagattacacactcttttcattcacacttgtacatatagacagcaatgttattaggagcattaaattaaaaaactgaacagcctaatttaaatgtggcttgggcctggtagaagtttgaccaaatggaatggaggctgtgagcaatgtgaggattctatttatttatttacgtttgataaaacttactggaactagtactaccatgcgtattccctgtccaaagcatcactgctttggtatagtataagttcatgaaattctggtgggtagaaagaaatttttatttctatcagcagtactaaaatgtatcagccaaccagagaacatcagtgactttaacttctgcagagtttgccccagaattcagagttctatttagaggaagttaaaacaacaacaaaaaacaaccatttgaaaaatttttgtcaccagcaaaacttttcactaattagtgatatgaaatgtgatttttgtgttgttaaacttcagctttggaaaactcagtctctttcattatcatccattccaatttgaaggagttgggcagctaatttggttaaaggcagtcttgagggttagaagtattacttccttttcgggttccagacctagcttgtgactgaaagttttagaaaaaggaagtacatctatagccaaattgata

SEQ ID NO: 108992 - DNA, 1873 bp, Homo sapiens
taaagataataagacacaaaggcatcttaaaaagtgatctgagcagcttctcgttctcgcctgcctgcccgctcgctcccttgcttgctcgcgctttccctcaccctctcctcgaggatggaggggactctgaccacagcctgtgactgggaagggagacagaggcagcggcggctcaggggaaacgagattgcagtggtggtagtaggaagatgtcgggcaaggatgagcagcaggagcaaactatcgctgaggacctggtcgtgaccaagtataagatggagggtgacatcgccaacaggggtacttcggtccttggtggaagcatctagctcaggtgtgtcggtactgagcctgtgtgagaaaggtgatgccgtgattatggaagaaacagggaaaatcttcaagaaagaaaaggaaatgaagaaaggtattgcttttcccaccagcatttcagtaaataactgtgtatgtcacttctcccctttgaagagcaaccaggattatattctcaaggaaggtgacttggtaaaaattgaacttggggtccatgtggatggcttcatcgctaatgtagctcatacttttgtggttgatgtagctcaggggaccaagtaacagggaggaaggcagatgttattaaggcagctcacctttgtgctgaagctgccctacgcctggtcaaacctggaaatcagaacacacaagtgacacaagcctggaacaaagttgcccactcatttaactgcacgccagtagaaggtatgctgtcacaccagttgaagcagcatgtcattgatggagaaaaaaccattatccagaatcccacagaccagcagaagaaggaccatgaaaaagctgaatttgacatacataaagtgtatgctgtggatgttcttgtcagctcaggagagggcaagcccaaggatgcaggacagagaaccactatttacaaacaagacccttctaaacagtatggactgaaaatgaaaacttcacgtgccttcttcagtgaggtggaaacgcgttttgatgccatgccgtttactttaagagcatttgaagatgagaagaaggctcagatgggtgtggtggagtgcgccaaacatgaactgctgcaaccatttaatgttctctatgagaaggagggtgaatttgttgcccagtttaaatttacagttctgctcatgcccagtggccccatgcggataaccagtggtcccttcgagcctgacctctgcaagtctgagatggaggtccaggatgcagagctaaaggccctcctccagagttctacaagtcgaaaaacccagaaaaagaaaacaaagaaggcctccaagactgcagagaatgtcgccagtggggaaacattagaagaaaatgaagctggggacaggtgggtcccatctccccagcttgctgctcctgcctcatccccttcccaccacaccccggactctgtgaagcgcagttcttcttctccacctaggaccgccagcagagcaggggtctccctgcccccaccccagttccccaacccactcccttccaacaacaaccagctccaactgactctggtcttgggaggcgaggcttcccaaccacagaagactactttaaatgaaaaaaagaaattgaataataaagtcaagagtcaaaaaaaaaaaaagtgatctggactagactaggcaaattactagctttgtgctctgatacattaccatttgaatcccttttctaatctctgatatggtaacaattggaaaatggatttgctttttggatcaatgggcaagaaaaggattattttctaaagtaattacctgaatgtttggcaacattgaatataaattttccctaaaaaccctaaact

SEQ ID NO: 108993 - DNA, 1015 bp, Homo sapiens
tatccaacaaaggatttatatgtagaatatataaataactcccaaaattctatattaaaaatatccagttagaaaataggcaaaagatatcagtagaaatttaaccgaagatgatatatagatggcaaataagtacatgaaaaaaatgttcaacatcattagccatgagcaaaatgcaaaaccacaattaaatacaactacacatttattagaatgtctaaaattgaaaagactgaccatattaagtcttgacatggatcagagaaactagtttactcagcactgctggtaggaatataaaatggttcagccattctagaaaataattttgcattttcctctgaaactgaagatgcacttaccacatgacgcaacatttgcactcttgagcatttatcccagataaatgaaaatctgtgttctcaaaaatacttgtatgtaagtgttcatagcggctgtagtcataatagccccaaattggaaacaacccaaatgtccttcaatggatgaaagacaaatgtcctatgtccatatcatgtaatactgttcagcaacagaagggaacaaattattaatatatgtaacaacttgaatgaacctcaactaaattatgctgagtgaaaatagccagtcttaaaagtttacataagatatgattttgtttatatagcattcttgaaataacaaaattataagtgtagataacagattagtggtagccagggattagggatgatggggatagtggtaggtttggctataaagggatagcagggatcagctttgtggtaatagagcaattttgtattttgattgtgttgatatgtaatgaagctacatttatgatagaattgcatggaactgtaacacacacacacacacacacatgagtgtgtatacaattggtaaaatcggagtaagttctgtggattttaccaatgcaattttctagttttgatagtgtgctacagttacacaaaatgtcaacaaggggagaagtgaggtggtgttaagt

SEQ ID NO: 108994 - DNA, 6572 bp, Homo sapiens
attaaaaacataataccccattggaggggaatctggattaactacccactgttcccaccccccccaacttttgaaaaattttggccatatagaatgcatgaaaaatcagtatgatcttatgaggactttatagtactgtaaatcttaggagcactttagttgttttgtttgtttgtttgttttaccagtcaaatagcagtgggagattgtataccaactttagtgacactgatattagtaagttctgataacccactaccatcggaccagcctggagcacattactttggccagtggaaagtctcttggagagactttgaggtttgtgatgacaaatcatgctatcgttaaagttaaatacatatatatacacacctagaatataagcagaatggaaaagttggcagggatgaattcaagaacattagagtgaatttttttcattacagaattgttagttcctttaggaacttagtctcgtagatgtatatatttaattagcataacttggacagcacaagattaatgctttaacttgtttgcaggagtttaaaaagctggtttctgttgccaatagttggttggaagggaaaatggagatgccacaaataaaattttttggatgtgcaaaacagttttgattttatttcttacaaactataggactccaagccccctgatccttgatcagaactacattaacaccaaaaatcaagttatcaaagcagagaggagggtgctaaaggagttgggattttgtgttcatgtcaagcatcctcataaggtgagttgtagagtacagaaattgggttcgtaagtattaggacttttctaaaaattttattttatatgaatttatgtttctatctgagtgttaaccttggttttaaaaagcattcttttaaaggttcaggcttcatcgaaaaacattcttttggatgttgagatttatcagtaaaatgacagtcaaaaatgtaggttcaaatcttaaatcttaattgtgtgctcatagagaagttatttttgtttctgtggttaaagtcccagtttttccacctagaaaacagagatgtaaagttcctcattccaaggaataaatgtgtagctacaaaagtatctggcacacttatcatcatagtagaatgttctaagtgtgttggctgctcactgttaccattattggaaatttgtttctcccaacatctcttagctttcattatcaatataagccatagagtgagttacccgggtcaggactacctgggttagaaatgtaccttgggaaattaggtgaaataatctagcacggtgcccatcacatagtaaagtgccaatgaaaaatattcttttaattgccttttttcctgtacaattttgaaatatgcttctaaacataatttatataaaatctagtcatgtagcagttcacattagaatcttatgtacatttaaattggtctgtattatcgatgcacaattagaacttgagtctaacattttcaattacttttttcattgaactctactccgaaagaactaccagtatactgaattgagtttttttcccttgtccttcagatcattgttatgtatttacaagtcttagaatgtgaacgtaatcaaaccctggttcaaactgcctggtaagtcacttttttagatttctttcctagccaggaaaacagaagcagaaataaagtaagtttcgttttccctttccaaaataatgagataagtttgtttggggcttttcgttgtttttttgttttgtttttttaaccaaaaggtaaataatgcttatttctgcttcctgttttcttggcttgactaattacttttaatggagaactcaatttaactttgttcttttttctactctttaattaaagggtagtccatgatggtaagtcatagaactctgccctctgcacttcagcccatgacctcaggatggcctgattggctaccctgctctccagccaatccagtgcaagctctcatccgagattcactgaagtggtccatatccatctggcagcatcttctagttctgtcggggtgtcaaaaggatttgtatatttgcttctagaagtaactatttgacatgcctatgtatttaatgtatacttgtaactatcaaaatgaatagttcatttttgatagatttgttgtgcagccattatgaattaaatggtttattaggagtttgactaaatttttatttttagtgtgtatagcatgaatactaccaaaggagacgacaaacttgcagcttaaaatgggcaccagttcccacactggcttaatttatataactgcttggctgtattgcgggtaataatattagaagcaagaagcacttcatttttaaaagagatgttactataatattgcttaaatgctttagcacttggacttcttgagatgcagatgtgtgatttggagtgctggcttatttaaaggtcaagccaaggagtttgtggttcagccacaactactgtttcctaagactattgatgtgaaggacttagtgaagtaatttttatattctgggcttcccagcaagatgtcctttttatgactgccatgcttcttttggactcagtaaatatttgtaatgttagaaaagtctcattatttttataaaatgcatgacattttaagtatgtgttgcataaaatggattatagcagttctcatggtttaggatttttaagaaatagtccatttaatttcagcttaaccttttaaatgatctgtaaaatttctttgatagtttaggaatgttgtggggagggttcattaataaaagttcagcaattttttaactgaaatagtttatctcttttacctagtcacaaaaaaggtatgtaaacaaggccattatatgtgtttattgctctttatttccctatctagattttctaagtatcttagctttcttaatataagtttaacttggtacttactgaaaatgcctttttacccctgttaacggtattttgagcttttgaaaagaacttggttgacactgcttttattgtggataaaggagagatggtcagtaattaatggcttgaagtattattggagtggtttatcatttctgaaactaatcgtgtcagaattgactttgaaaagcattgctttttacagaaatatattaactttttaggagtaatttctagtttggattgtaatatgaaataatttaaaagggcttcgctcatatataggaaaatcgcatatggtcctagtattaaattcttattgcttactgatttttttgagttaagagttgttatatgctagaatatgaggatgtgaatataaataagagaagaaaaaagaataaagtagattgagtctccaattttatgtaagcttcagaagaactggtttgtttacatgcaagcttatagttgaaatatttttcaggaattacatgaatgacagtcttcgaaccaatgtgtttgttcgatttcaaccagagactatagcatgtgcttgcatctaccttgcagctagagcacttcaggtaggtgtatatttcccattttgttctgtaggataaatcacacaaattttcggtggttccaatacagatttagcaaaaatttaatttaaaacattctgttcttatggtttagattccgttgccaactcgtccccattggtttcttctttttggtactacagaagaggaaatccaggaaatctgcatagaaacacttaggctttataccagaaaaaaggtattctctatttactcgtttgtgccaacatgctaagagtccaagctactctaaggaagaaatactaacttttttttcctccaacagccaaactatgaattactggaaaaagaagtagaaaaaagaaaagtagccttacaagaagccaaattaaaagcaaagggattgaatccggatggaactccagccctttcaaccctgggtggattttctccagcctccaagccatgtaagatgtatttagaattaaaatgacttgggggcactgaaagtgtgtctttattagagagcttttacatttgaaagttgcatagagaaaaatgatgttaggaaactgctgctatgttctctcatggcagtcaaccaacatggaagcggaagcatggtactttgagttacatttagaaacaacttttggccctctgttaaatccagtagttaacatgttgttattatatcttttaaaagcatcaccaagagaagtaaaagctgaagagaaatcaccaatctccattaatgtgaagacagtcaaaaaagaacctgaggatagacaacaggcttccaaaagcccttacaatgggtgagtatacttgggctggaaaactggcttgaggaatcttttatgtgtttactttttaacacactaagtttgtaactaatatgtcatgattttttgaagtgtaagaaaagacagcaagagaagtagaaatagcagaagtgcaagtcgatcgaggtcaagaacacgatcacgttctagatcacatactccaagaagacagtaagtaaatgttttcttagggaagcagtcttatttggagtttttaaaggttattgctttttctttaaaaattgaacatagattattttcaaagttaggttagaattaggcttttagtatgaggcaaattatgagaaatgagtttggagatgttctggacatacagtatcttaatggcattctgttatattttctcccatgttttttggagaagtgtaggagctacccacaaagtgcttgagggccatagtattgttcataatgtgaaaacttctttttttttttttaatttcagttagaaaatgtgtttcattaaccccttattaataaccaataatcaaattaaccagtcaatgaatcttctttagttaggcctgtaattagattgttagctcttcgtggctcttcaatgtcttttgaacatgtgggagatacttaataaaaagcatagctctaggacactataaaaattgctaattactccccttggaataaagacataagaacatttgcttaagatttaatatgttatatataggcttgggcatacagcagtgaggggtggggagattttgaaaagttctggtttgtcatttatgtagctggtagttttgttttgaacctgttatgagcaaccaccggaataatctgttccccatagaaactgaacctaaacttcaaatttttattatctaagctataataataggcggagtcgatctggaacatacagctcgagatcaagaagcaggtcccgcagtcacagtgaaagccctcgaagacatcataatcatggttctcctcaccttaaggccaagcataccagagatgatttaaaaagttcaaacagacatggtcataaaaggaaaaaatctcgttctcgatctcagagcaagtctcgggatcactcagatgcagccaagaaacacaggcatgaaaggggacatcatagggacaggcgtgaacgatctcgctcctttgagaggtcccataaaagcaagcaccatggtggcagtcgctcaggacatggcaggcacaggcgctgactttctcttcctttgagcctgcatcagttcttggttttgcctatctacagtgtgatgtatggactcaatcaaaaacattaaacgcaaactgattaggatttgatttcttgaaaccctctaggtctctagaacactgaggacagtttcttttgaaaagaactatgttaatttttttgcacattaaaatgccctagcagtatctaattaaaaaccatggtcaggttcaattgtactttattatagttgtgtattgtttattgctataagaactggagcgtgaattctgtaaaaatgtatcttatttttatacagataaaattgcagacactgttctatttaagtggttatttgtttaaatgatggtgaatactttcttaacactggtttgtctgcatgtgtaaagatttttacaaggaaataaaatacaaatcttgttttttctaaactgcttcaaataccttatttaaataaattattaaaaaggaaaattttaatagcaaaatggctgtactggttttctgacaaacttattctttcctccattagatggtagtttgagattattaaaatgcaattcttaactgcattgtgagctattgtaagtcttcactgtatatatggaaaaagtaaatgggagtcgcccaacaatgtgacattaaatgttatattttagcactaaaccaaaaaacctgatttgcttttgaatggtgtcataaggtaattttgagtcagatttaagtactatttctgaaatgaggtaccctattgaatgaaccaaaacttagtaactattgagctttaacagttctgtataatttaggcatttaatgttacgatttttacgtaggctaggagaaaatgtgaggcccctgaacttgagtggttgatagaatacaagctgatcacaaagaagtgaagttttgatgaaaaagccggaatttctatccagatgaatgttttcaagttactcacatttactatttttttcaacat

SEQ ID NO: 108995 - DNA, 5227 bp, Homo sapiens
cggggcaggtgttgtttcatcgttttttctactccaaatctttcgtcaaacacagtttcgaggtaagcacagcggaggcgggtaaaagggatttcttcatccggaaatgggcagagtaggggtagtgtcagcagccagcttttccagaaagggagtggtttagtttaggcctttgtacctacttctcactcgccaggaagtggaaacctttagaatgtggttcaaaatcgatcacgagcctaagtgccctcttaacgaaaagtacagttttcaaccaaatgcagaactcctgtaagattgagtttgactctggaaccaaaattaagatgagttaaacaacaaaaagtatagtactagcatagctggtagacttacggcatagagatgtcttctctaattttactaaaggttgtcccaattgtgttctaaattttattcttcaaagtgagtttaatctaacaatggcttttgtggctcatgggttctttcagattgttgctatggcttgtattaatcttgcatcaaaaatcgaagaagcacctagaagaataagagatgtgattaatgtattccaccacctccgccagttaagaggaaaaaggtaagattggcattattgaacatagtatctcttgctactgctgtaccgtgcaccagtcatcaaatcaaaacatctttcctttcaagtgaatacggatgcaaaagaaaacggactttaatttaggtgttaaagttcatataggaacactgatacttaaaataatttgaaaaaagaaacataattaaccggttatctaaagtttgtagaggcagttgcatttatggacaatcctaacagtgctgtgaagccaggcctgtggcttaagattaaacaagaaagggagtacatttggctcaagtgtgagtgtattctgtaagttatttttcctctcccctctctggaagactgaaggctggaagtttaaacactgtagtttaagttaatattgtggcaaagttctgtgtagattatgtttttctactcgaagtcccagttaattctttatcaattgaggttggcttttgttagagtacttctcaacattgaactacgataaatcgaataataccggatctgaaaggactgcaggatgataaagtttgaagtttgaagtcaaagggattaaacaggtattttgttttggttagatacagtctcagtgagtgggttagaaaattaacaagtaagattgattgggttgcatttagatagggccatttatttgatgttgtaagaaaatacagagactgaaatagtatctcctaggtgttgtggtaacataattttatgtggacctatgtgttcctgtgaggcagtaccaaaaagtttgttgcaggacttcctgcatctacaggtgacttccagtacatgctgcagaatgatatatttggtgtagaatagtttttgcattcactctttaaggaattgtagtgatgttagacaaattgtactgagtttgaaaggaagttattaaaaggattataagttgttctgggggttgggtatgttggttagtgctgttagtattctatatgagtagtccttattggctgaatctgtaagttggcagtaatggaactattcagacaagcaaatattaaagcaactttaagatgactagtctattctgtgagtctacagacagttcttttttaaaaaaagagtatcctagtcaaaaagtctgcaacagttttcctacatactttttctcccccatcttttctcattcaccttaactgtgtccagggatagagtactttttaaattctaaaatatcttttagtttgttgatgagtccctgggaattgggaagatttcaaattggtctttggtatggtctgaggttaaatctgtatttagatacctggctgattcttcaggatgtttaaagtaatgacactaatacaaggctctatctttagtcaaaggtttctctttgcttaaaggaaatggttttctagtattctttgaaccattgagccaactattatgtaatcacatgattatcttctgtggaattttcctgtgagactagtttacttcgttgatgttagaataggtcttaactgtaaaaaccatggaatttaaaataatataatctcacctgattgttgtgtctgatgtaactttgttttttgggtcattattacagagaaactgattttgtttcaatcttagaagtctgattatagcaaaatttaaaaggagttgttaattgcatggaagcctttttttaaagcaggatgtaaaagtgtttctatgcatattacaagtttactcaagcacgtaacttgtatatgttattaacttcaactcttttttcccttgcaaccgactatacagcgaccagctacatttaccaaagcctgggtgatgtggagtggtacatagagatgaagctgtcgtcatggcaacagtgagtgaagtatcgaaaatccccaaggagaagccagtgctctgagaataggtcactggaatcggggactaacaggttggccactggtgaaccatttagaaaaactcctgtttcttgttataagcttttgtctttgctgtccaagttattagaactatagctttgtatttatttttgcataggttaatgtcattagaaagtactatcagtattatacattggttaggtaaagcatatcacttgtcttaatgatgctatttgttttaatctagtttattcataactttaaattgtagtgtgactttgacaattacagtggagatacattattcatgttgcttgtaggtcattggtctcttcagcctggctacacattgagaattagcagaggagctttttaaaaagtaccagtgcttagtccccaacctggattgtttggcctattcctccttcagttttttgtggttcgataattatcttttaagttgacaataaacagctaaatttagaggggggattgctttttcattgttctagtttccaaatatttacttttgagatgcagcgtattaaaattttcaaagactggtttaaccattctcattagtaaatacaatgtattttcagtgtatccatagataataaaagttggataggtaagaattggaagggtgttaagtgatgtcatttagtctaccacctttctacagtataattctgtggctctacaaggtggccttcagtttgtttaaatacctataaaggatgtttctacttttaagtaggcattacaaatttttgtatattgcttggcagtatgcctctttgtaaactaccaatctgttatagtctcttgaagacttggttccaatatttctcagtctttgtaacacataaatgaaactaaccatgtttggactttgtaatttttgttgttgttgagttatatgtcaattacataatcatgctaaaggaaaatagctcctctaacaaaccataataataaacttctaatgaccaaagaccaggattttctaaagctgaaaataattctcgtataaatcagaaaaattggacaatagaaacttaaagcagagattgagttagtttgtgtgttgataatgaaaattatttttgagttttctctgaatagatgaagacttcttttttaaagagattttcaaatgccacctcctcaaactttattggcaaagaaagtttacctgattggggaggaagaaattctagcaggccttaatttaatgtgcttgttgcaacagaaggtactaatgtatactttgagactttgtttactgctgattgatggagatatattttttaaatttatgatacaaagtaatctctaccaggtagttgtaaattacgtgtgcaccgttgatttgtgaggtagaaccaattctgaacaaaataaaggtatctggttttaggttatatacccacaaagttaactttgaaaattgcaggtaataaatagcaggattaagcaagaagttaagtatatattgaattatagtaaataatgggtttggttttcttaaatctattttgatgtcattggcattttgacacaaaaacaaagaaaatggcatcattaagtctgatttgggactaaatagtagctataattcaaacatatttagcttctttagtgtaattgcaagaacaaatgaattatatcaccatttgaaggcagttcttaaagcaggttatcttaagaggtatagataatttttattaacaaatggagaaaaatgagacaactatgttttcataaaattacattttactagggattttgatgataccgtcttctgtctggattgcaaggggttaagagttaaaatggtgtgtgcagctgtaacactggagctattttatctcttaatgacagttaaggagagccattagataacacagccataagttaaaaagagtctgaagttggttttacttttttccaaatttcctgtgatgataaaacctgatcatagaccttaagatctttggaatatgtttatatgtatgtatgtatgtatgtatgtatgtatgtatgtatatatatggagagagagataggttgttttcatgagaattaagtttgacttattttccaaagagcaatttgtagcctactgtcctgataaaatggattcatcattacacgttaatattagaaagcagctcaatgaggccagctggtggcctcattcctcataggtgtgaggaatgaaaccgagggaaggccattttaagtaacagctgtcttttatcttgtcagcgctgccagtttttgtttagtaagcattccagtttctgtaataattttaaatggaagaaagtaaggaaaatgtatgataactgactttttactctgatgttaccataggggtaatgaagttcatcgcagattgttttctaaccttcggtgcatgtattgaaatagatttttgttttaaaaatatgagattacatttttctggatctggtgtgcattggggtagagaggatgactgtcttaaaaatagatcgtgtattctgcctagagcaaagactcttaagtcttttggctgaaaatgaactgagtatggacaaaaatattgaagtattctacttgtaaacttaccgtataatcagtgtcttgataaaatagtagtttttgttggttgaatctaagaatgtgttggacttgggtaaatttcagacatgaccaacaacaaaaaacaaaagcccaattccttaacctttcctga

SEQ ID NO: 108996 - DNA, 1235 bp, Homo sapiens
aaaaatgagtctatatctgtggatggaaggaaaaaataattttaaaaaatgataactctgtcctattctttcagggtcaaattccagaaaaatcatactttggaaattcttttctttctcttttcctccccccgccgccccacccccacccccaacacacacacacctttttttgagacagggtttcactctgttactcaggctggaatgcagtggcatgatcacagctcactgttgcctcgacctctctgggctcaggtgatcctcccacctcagcctcccaagtagctggcactacagatgtgcaccaccactaatttttgtattgttttgtagagacaggggtctcactatgcagccctagttgctctggaacttctgggctcaagagacccgtccacctaggcctcccaaagtgttgggattataggagtaatccacagggcttgtctgtgttaaccttgtttctgttactttgaggaaggttgcttttccaaatgtacctacttacaaaacatcaacattaaaatgcagattgggaaagaccgctgggcgcagtggctcacacctgtaatcccagcactttaggaggacagggtgggaggatcgcttgagcccagaagtttgagcccagtctgggcaacaaagtaagaccatcccccctttaaaaaaaaaaaaaaagaaaaggaaagaaaaagaaaacaaaagtggaaagggtaagacctagtcacaattataaaggattcaaagtttggaagagtgaagctcatgtttttttgtttttattttatttatttatttactgagacaggacctcactctgttgcccaggctagagtgcagtgacatgatcaaagctcactacagctttgacctcctaggctcaagtgactctcccacctcagcctccccaatagctgggactacaggcacatgccaccaagcccagctaatttttaaacatttattttttgtacagacagaatttcactacattgcccaggctggtcttgaactcctgggctcaaatgatcctgctgcttccacgtcccaaagtgctgggattacaagttgtgagacactgcacctggccaagccacccccgccttttttttttttttttttttttttttttttgagatggagtcttgctctgtcgcccaggctggaatgcagtggcacaatctcagctcactgcaacctccgcctcccgggtccaagcaattctcctgcct

SEQ ID NO: 108997 - DNA, 1050 bp, Homo sapiens
ttacaaaatttaagattcatataaaacaaagaatacatctgttttcatcagctatttctcaacttttattactgggatttattttaaaaaattgttttgcccagacagctttgttttactaagcgtgatttattactctcccatgagcccacaaaaagtgcgtgttcctgaatcaaaaataatgaagaatggaaacttattccttttacaattgacaaaatgatcatttaaaatatgtaaatatgtttaaattctaatagggtttttataatcaatgggtagaaaaatatattcaattaccccaagctgatatacagaaaaattgagacacaatcaaaaaataaaagaaagaattgaagaaagtgacttttgtaatgctattctaaaaatcggctcaaagttggagaattatctacctaagagagagattaacaaggtttttatttatttattttctgctttgttccacaaaaaaaaatatttcaggcagcttgcctcttgatgttctgttaaaagattattgactcttagcttttgaatatgattaacatttgatgtctactttcttggcaagaattttacatgtattttatgctaatattttaaggctaaaatagcattttcttgtctgcgtggcatactttttaaagaatgaaattttttaattgtaaaaatatcttggaatttaaagattactagatagcttgacctttactggcttccgtacttcaataacagcaaatttttgaagaattgaagactgcaatatttttacttcagaaacaggaaaagactgaaaaagactgaggaataattacaaatagaaaatgatatagatatctagatatctaaaataatgagctaaatttgggttcaggtcacaaagaaaagtttaagttgtatagtgttttgatgtaatcacgtaactgcttttaaaggagaaattggctttcttggtgaaatgttgaagatatttcaattctaggtaaagttttttgcaagttaccaaaacactggctcacatttgcttatattgagttggttttgggg

SEQ ID NO: 108998 - DNA, 1101 bp, Homo sapiens
gaactggcggctaccactgttgagatggccacaggtcacattgttcctgagggaggaatcctgcagattggccaagaaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaagagagagttgagaccaatctttatttgtactggccaaatactgaataaacagttgaaggaaagacattggaaaaagcttttgaggataatgttactagactttatgccatggtgctttcagtttaatgctgtgtctctgtcagataaactctcaaataattaaaaaggactgtattgttgaacagagggacaattgttttacttttctttggttaattttgttttggccagagatgaattttacattggaagaataacaaaataagatttgttgtccattgttcattgttattggtatgtaccttattacaaaaaaaagatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctctactgtaaataaaatattttataaaactagctcacgtcatttaattataaatttaagagatgttttggagcaaactcgtacttttctcttttcatttaaagtaggcaattagttttcagatactattatgtaaacagcatggttaatattgttaggaatgagcaactatagacttgttttaagtttggcttcctataaatcataagcaagaaatattatctctgccaagtcaattc

SEQ ID NO: 108999 - DNA, 1058 bp, Homo sapiens
ccgcctcccgggttcaagagattctcctgcctcaccctcctgagtagctgggattacaggcgcacgccactacacccagctaatttatgtatttacttattttgagacagagtctcactctgttgccaggctggagtgcagtgccatgatctgggctcactgcaacctccatctcccaggttcgagagattctcctgcctcagcctcccgagtagctgggactgcaggtgcgtaccaccatgcctggctcattttttgtatttttagtagaaacgggtttcaccatgttggccaggatggtctcgatctcctgagcttctgatctgcctggctcagactcccaaagtgctgggattacaggcttgagccaccccgcctggctgtagttttttaaattaaaataaaaattactggatcaaaattagattgagtgatcaaccaactaaaagattaaacacgacaaaagtatatttttctctcacgtaaaagaagtccgtgggcaggcagctcagggctggctagatggcttcacaatgaccaggaacccatgcttcttctgtattgttgcatggggtctcctggtctaagatggttgctgaaattccagcccattaccatattccaatcagacagaaggaggaaaagaatcacatataatatttcagcgttggtcagaacatagttatatggctgcatcaagctgcaagtaatgttgaaaaatatagaatttactctgagtggtcacatgttccactaaagctaggattctgtcatttagagaaagagagaaaatgaatatctgggaacaattagaagtccctagaactcctagctagacttactgctctaacagatgaaatttctacttttttaacccaagtattattttattttcttctatttgtttgttcttcaccctaaacatgtaattacttaaaaaaattaaaagttttcttatattaaattctgtcagcatatgagtttgcatttatctcggcctgcaacatctggcatcacttaaacatgtataattcgtgttgcagcatgtaaaggaattt

SEQ ID NO: 109000 - DNA, 1069 bp, Homo sapiens
cggctccttggccccgcgcagcggcccgctctccagcacctcccggtacgtgatcgcctccttcttctccttcactttctggtcaaaagacttggagacgaacgccgtaagttcttccatcgccgccgcacgtcagcccggcgctcaacctctgccagcagagccccgctctttttttccttcttctttttttactgctccagcccccccaataataacacatcaatgggacaggaggtgggggaggagagggaggaggagaaagaagaagaaaaagaggagaagaaagaagaaagaggaggagaagtagaaggagaaaaagaagtaagaagaggaggaggaggaagaagaggaagagggggagaagggtgaagaggagagggaggaggaggaggagaagagaaggggcgggggctgccggagggaaatgggaactgatgcttccctgccggagcgcgcttgttcaatgttaagatctttgacaattcttcctgcggagagttcagatctgatagcgacgctgcgcttgaagtcccactatttatacttcctaacggcggcctcttgttttgagtaaattacctcccctcgcaactcggagtgagcccccttcccgggtagcagtcgcgcctctaccgggggttggggaggggaaaaggagagaaacagagagagagagagagagagagagagagagagagagagagagagagagaagaggagagagagagattggagttcgggcgggctggggctggagtggtagggcagcacagggggaccggagggggcggggagagaaggccggtccccggccgctcaggttttcagatagcccctgccgcctgtgctcttggccattaatccaggattgacaagaatccctaattaatttaattaggcgtggattttgcgttggtgtcacgacttagttaaacactggggagctggatagaccccgcggggtggggccaagaggaaactgacaagtgcgcagctcttagagtcagtcaggtatcccgacactgcatccttccctacagccttgcttcgagtcagggtgcctcgc

SEQ ID NO: 109001 - DNA, 1154 bp, Homo sapiens
gaagttatgtgtatctctcatttcataagaatattaaaaagatgtgtatgtactcgagtggaaatttagtaaaatttatgatttttactgctttattgaggacattcttaattgaaattgcttttttttttaaactgtgactgtatggcagtgagggatacagtgactactaagtataatttggtgcctctgccttgatttgtgctaaggtgccagcagttttgtccactattacttttgcaccatcagtgcaaaagtcagcacaatgaaaaaggtaaataatgttttagtgttacagtgaatatagttttgacttcttgagtcccctgaaaagtgttgtagagatccccaagggtctacaggcctcattttgaaaatcgctggtactagaatgtaagcttctatagggaaaggattttttttttcttgtttattgatgtattgcttatatgctatcagtctgggatgtctttcgtatcttcagtataagattacttatattttgaatctgggttgtctgttgtgatactcttcttttcatggagcacactgtcgagtaacttcatgaaaaggggagagtgtggggtataattttgagaccttacatgtctgaaaatgtctttattctaatctcgtagcagaacagtgatttggctggatagagattctaggttgagattcattttctcagcattttaaaggctagtctccgttgttttctgtgttgtgaaaacccatatgccttttattgtgctacccatatttttttatctttagaaatttctaggctcttctgtatattcctggtgtctaaagtttttatgagatatactgggtatgtctttttagaaaaatcattgtcccagggacttagggcaattcatctttcaattctggaactttgaaacaaggacttattctgtcacccagactagagtgcagtagggtgattgcagctcactgcagcctggaccttctgggctcaggtgatcctgctgcctcagccccctcaagtagctgggactacaggtgtgcaccaccatgctcagctgattttttgtagagacaggggtttcaccatgttgcccaggctggtctcaaactccctgggttcaagcaatccacccacttcggcctgccaaagtgctgatatt

SEQ ID NO: 109002 - DNA, 1051 bp, Homo sapiens
ctgaggattggggaagagtatcacctggctgggtagaatggagggactcagggacactattacataaattcaatcaattttttttttgtttttagcctcatggcctcattgtgcctgctctggtatctggtgtcttaaattcctgatcctttctgatttttgctatgtgaatttgcttttctcttgttggaattctctacagttgcctgataataagttttcttagctctaaattctccatgtgtttttcacttgccaaaagtttgttgacatatctcatgttcctgttgttttctagtctctatcctttcaaatttatactttttaatttctttaatcttattttggtattttttaaaacaagatagcaagatagtaaaagctcatcttaatttaaatggttatttgtttgtgaggaacattcttaaatgattaaaggtaaaaacaagaaaggaattaaaagccaagaaatgaaattattatcattcaattgtgtacatatttcttaacatggatataagtatatgtgtgtgtgtataatatacacacatacatatgtgggtatctatttgatatatataatggatatatgtatatattttatgtataaatggatatggacacatgtgaatttatatgtatgtacagatataccttatatacatctgaattatgtttgtatttaaatgtatgtttgtatttacatatatatacatgttgtatatatttataatttcatagtcttttttttttttttttgagatagagtctcgctctgtcacccaggctggagtgcaatggcactatctcggctcactgcaacctccgcctcccaggttcaagcgattctcctgtctcagactactgagtagctgagactacaggcgcatgccaccacgcccagctactttttgtgtttttagtagagatggggtttcaccatgttgatcaggctggtctcgaactcctgacctcaggatccgcccgcctcggcctcccaaagtgctgggattacaggcgtgagccactgcacctggccactttcatagtc

SEQ ID NO: 109003 - DNA, 1006 bp, Homo sapiens
ttttgtcattagggaatgtgagaataaaggaatagttggttgattactaaagaaaatgtcatataattaatgagaaatataacttaaaatatcagataattgatataaagaactgctctcagtcttgtcaagaagccaggcacataaacaattttactttgaataagacttttaaaaattttacaaagttttataaaaagtagtacattgaggccagaaatggtggctcatgcctgtagtcccagcactttggaaggcttgggggaaggatcgctggagcccaggacttccaggttgcagtgagcaatgattgtaccactacactccagcctgggatacagagggagaccccatctctaaaataaataaataaatgaaataaaaaattaatatattgcatttcatccattgtgccaccatgttagaaataatattcttcaaatttatgcttatagaaatgggacgtcggtcatcagatactgaagaagaaagcagaagcaagagaaaaaagaaacaccgtagacggtcctcctcgagcagttcttcagatagtagaacatacagccgaaagaaaggaggaaggaaatcaagatcaaagtcaagatcttggtccagagatcttcagcctcgttcacattcttatgatagaaggtgatttttgtaatttttatttatatagtaatgaggataacattctttaaaattcatgtttttgtatttttaattttgctagataaaacatttttcttttactagctatatatttatgaaagtcccaacccagagtttttttgttccaccaggtccagtccgtgggtctagtgtcctcaacctttgtctgttcttagtaggcaaatagatagaaagtggtgtagtttccttttttaatttaatttaattttttttctagtgcatttatttatttatttttctaatgaattattttttattttattatactttaagttctagtacacaacatgcaggtttgttacatatgtataca

SEQ ID NO: 109004 - DNA, 1007 bp, Homo sapiens
ctagttttgtatttttagtagagacagggtttcaccatgttggtcaggctggtcttgaactcctgacctcaggtgatctgccctcctcagcctcccaaaatgttgggattacaggcgtgagccaccgtgcctggccttaattttaaatttttttagagacaagatcttgctctgtcactcaggcgggagtgcagcggtgcagtcatatcttttggactcaagggatcctcccacctcagcttcctgaatagctagtactagaggcatgtgccaccatgcctagctaagtttttttatttttattttttgtggagacttggccttgctgtgttgcccaagctggtatcgaattcttggcctcaagcgatcctcctgcctcggcctcccaacatgttgggattacaggcatgagctactgagcctggccttggtttagttttcataccatataatctgatgatatttggaaagattctaagacccttaataccttaattagtactgatccaatcactaagttatgaaccagtcatatgactgttcaagagaaataacattttaatttatctctgtttgcttccaggaaacagtgagacagtaaaaatcagatgattctttagaatctagaaggtttttccttaatgctcataataaaaatttttatagcagtgatctttgattatattttatttcagacgcaggcatcgatcaagcagtagctcttcttatggctccagaaggaaacgaagtcgaagtcgttcaaggggtcgagggaaatcctatagagttcagaggtctaggtcaaaaagcagaacaagaaggtatgccttattaagtatttattgctttgtaacaaattattcccaaattcagcgatgtaaagcaacaatcatttattttcttataattatataattttgattgagcttagctggcacttatttttttctcacctggggtcattcatgcagttagtcatctgatagcttgattggaactggatggtc

SEQ ID NO: 109005 - DNA, 2467 bp, Homo sapiens
ctagagtgcagtggcgcaacctcggctcactacaaccttcatctcctgggttcaagtgattctcctgcctcagcctcccgagtagctgggattacaggcatgcaccaccacacccagctattttttttttttttttgaatttttagtagagacagggttttaccatgttggccaggctggtctcaaactcctgacctcaagtgatctacacgcctaggcctcccaaagtgctgggattataggcatgagccactgcgcccggcctatagtgtaaatttttaatgttttttttttctggagttttccctccaatttttttcttcacatggtagccaaaatgcaatgcaaaatgcaaatctgataggacctcctttatttcagtggtttagaataaaacccaaaatgttgacaaggctttaagtccctttgtgatctgactccttcctgccttttcaatcacatctttccaatgctagtcatacttgtagtgtttaaacagttttcttttcctgtctaaggacccttgaacatgtggtggttgcctctgctcaaaatgtacttttctcccacccatgatctgtaattaatcttttaggtctttacttaaagacatttccttaggctgggatttccttaggcagaattttagcaagcatggtaaagcagagcccactttgtcaaggaaacatggatatgcatgcagtcttactcattttcaacgtatagattgagctgtaagcttgatcataatcactccttacttaatttgcatttctaccatgtagaaactaatttgaaattatagaaggtggcattacagacaagagatagcatggaaagagctctgaatcagcctgagtctcagtatcttcatgtataaagtattatgctcattctagttctaatttgattcgaaattacatgaaaataagtttcataatgtatattatttaaattattttaaaatatcatttttaagttttttaaaaaactaattagatgtacctattattttgccatgttaccatgctctaaaatagttataattaaatccgctaaaaggaactgaacaattacattgatgctattgcttgcttggtaaacttctacttgctcccctacagagctctagtttgcactgagctaaattcttattctgttgtatatttgtaatgaaaatgctttttgtatgtgagtttttgtttatctgattaatagctttcagaggtggctgtgaggtcttatagaggtacagaatttttagggctaaaaggttattttatactatttcttttaggtgagggagctaagactagggaagataaggtaagcaagtaatggtggcagaaatggttctgttcagtgtgtggtgactttatggttttctttttgcagagtgttttttcttttttttcctttccccctccagtttttcaatgggtgtggagatcatgcaggagcaatagagaaaacgagaaaattgtggacgagcaaaactgggcaacattgttcttggacagatagtctgaaagtgagccgtttgcttgaggataataagttgagtgtaagatgggtcacacatataagtacaagaggttatcaattcaagttctaaaaatctgctctgttcttgtaaggacactgttaaataaatgtgtgtttctatcgttctttcatttacctgaggtagtccattttaataaaatttatccaaaataaagaagcccagaccatgagtctaaccatgtatgcagttaatttttattcaggtcactatttattttcattatttcctcaactggaatgagcagcacttttacactgacatgcaaaacagatggatttttgattattaaacctattgaattaataagctcatttaaaaaattgggtattctcccctcacctcactttctatttctcagtcaagttgctttaattaggattttaatgtaatgtgtaatctgaatatggcaaaaagtgaactgttaagtattatttagaaatcactaaatttttgaataaaagattcagtgattaatattgaataaaaggttttatggagatatataatactgacccaattaaatatatatatatatataataacactattattttgctattttgctttaagatgatgcccttgcagtttttaggtattttaaatcagttttaaggctttaaagtcaaaattcattgtttagatctaaaaggaatattgtaaaaattaattagttgaccttatttccaaaaattagtagattcagaatactgaagttcttagttggcagaagaactctattgtctagtgacaaaataggtgactttttctttttctttttttttttttttgagatggagtcttgcacctgtcgcccaggctggagtgcagtggcaccatctcagctcactgcgacctccgcctcctgggttgaagcgattctcctgcctcagcctcccgagt

SEQ ID NO: 109006 - DNA, 1007 bp, Homo sapiens
accatgcctggctaattttcgtatttttagtagagacagggtttcgccatgttggccagactggtctcgaattcctgacctcctgatctgacctcgtgatctgcccgcctcagcctcccaaaatgctgattacaggcttgagccactgtgcccagccctagatgattttttcatagacgttttttctcaggtttttaactgcagtgccattttagtgtttcacatcttgactcacattggagccctttgttgcccagatacaattagggaccagatttccacctgggatggcaaccacattgtggggacctctagttgggggctcctgaattgactgaatgtaccctttgttgcttagctaagttagagctacttttctgtttttcagctaagtttccatgttgtgcagagaggggctatgacctcaaatcagctgagtggatgatctgtccatgttcaatttccatggctcctcttcactggtatagataaccagacagtgactgcacttctttatgcaatatttagcacagtatcaagttggagactttcatatgtgcttttggttgaggtgattttgttttggcagtaccaaatttcttgctatttcttgtgcctcatttatgcagcgtgacggaaagattgagagaattctatgtggggtgtgctttgtttcctgggcagggcccagcccagagtttaccaaggtggcttgacataagcactactattagatttaactaactactaagcagttttattgggtggctccttgaatgtggcaaacacttaaatgcagtccctgctttaaatgaacttattgtcataagatttcctttttattttttctctatatctttgtttacttattcttttccatcattgtgttataacaaactatagaaaataatgtttcctatattccatgatgtattcaggaggaaaaggataattcattaagttaaaattattttccccaagtcattcctgtgaaattgcagaattgt

SEQ ID NO: 109007 - DNA, 1065 bp, Homo sapiens
ttttggattagggtctgttttatttttgtggtggtatattttcttctctctctctttttttcttttcttttttgaagtggggtctcactctgtcacccaaggtgcagtgcagtagtacgatctcggctcactgcaacctctgcctctcaggctctagggattctcccacctcagcttcctgagtagctgggaccacaggcacatgcacaccaccacacagagctaatttttgtgtattttgtagaaacagagtttcaccatgttgcctaggctggtctcaaactcctgggctcaagtgatccacccgccttggccttccaaagggctgggattacaggcgtgaaccactgtgcccaggtatgttttctaaatctagctttaggtggttattttagggaattgcagttgtgaggcacttattgctaaacttaaatgggcaaaatgttaatatttcactcaagtaaatcctttttatgtttcataagtttgtgcagaaagtatgaaaatgttgttagaaaatgggacagtgttctagaaaaatggggcagtattttaatgttattttgttggctttcatctgtatatttaactacactggtaaataattagatatattaatatgtgctagttataactagaaggaaaatgttactctaggattcctgtgtacttcagtttcttcaagcatatggacataaccaagacagccatgcacattggggcttggcttcacttgctgttttttggatctgtggtacaactacgtcaggaacctctggttagcctctttgaaggtaagaaactagggagcaaaggcgagacattctagccaagttccctaaaagctgtcagtctacctaccatcagacttgtgagtgagggagggtatcgtagacctgggtttagcaaagtcagattaactgttttatgcctgtttttgtaaataaaattttattgaaacacagctacactaatttgtttattgtctgtggcttccctctacaatagcagcgttggatagttgctacagagacctcatcccccgctctccactgcaagcctaac

SEQ ID NO: 109008 - DNA, 1054 bp, Homo sapiens
tcatgtggaactgcatgatggcagcacaggtagctcagactccaagaaaaaaccatccttttttgccagtgatctgggaaaagttgctcctgggagccagaatttaggagtaaccccagaaaagagagaaccagagaaagagatcctcttattctgtgtatgactggcacaagacctggactcacccttacactgcatgtgagtggagagattcaaaggagcataacaaaagctttggaaactgaactgacattggaactacaacccacagaatgtgaggtagaacttttgatctaaaccaaactggactgattgcttgctaaaataaacaacaaaatcaacattctacagagcattttgctagtatacacagtcttacaacatgataaacaaaaggtccactatataatccaaaggtacttagcatacaaataagcaggaaaatgtgactaatatttaagggaaaagacaatcaacagatggcaactccaagatgaactggatattggaactattagatgatgactttaaagtagctattacaagtgtgtcctccagagtaaaggtaagcccttctgaaatgaatagaaagatagaactttttagtagagaaatataacctgtaaaaaagaaccaagtagaaattttggcactgaaaaatacaatatctaaacaaaaatacaaagaatgggctcagtatcacactggagatgacaaaggaaggagtaaacctgaagatagataaatggcctggtgtggtggctcacatctgtaatcctagcactttgggaggctcaggcaggaggattgcttgaggccagcagttcaagacaaggctgaaccaaatagacagatcctgtatctaccaaaaataaaaaaattcagccaggcgtcattgtgcatgcctgtagtcctagctacccaagaggctgaggtgggaggatgacatgaatcctggaaggtcaaggcatgagcaaaccatgatcatcccactgcactccagcctgggtaacagagcaaggctgtgtcgcttcaacaacaacaacaacaacaa

SEQ ID NO: 109009 - DNA, 1055 bp, Homo sapiens
atttaggaagactgatgagtgatgccaagcatctgtgtgttctgtatcttaaacatgagaaacagattggaaagtaatagctttttcacagaattttggtaacatatgggcttatctggatctaagaagtctttgaagatctttgaacttgactaaatgacttaacctttggcatagtgggtgggttatatgcttttttagaggggaggcactgactttctgcatttctcttttgctttttttccccttcttcccaattctacctttaatatcttttcttaaaaatggggagaccagagatgatgattgggaatttgtaaggttgatatgatgagaattccaaaatatttagttaaatggatctacttgtaacaagatagggttaaatcttttgataatattttagaaatgagtctgtgtaaatctttattttctgttttatagattttatttgaaaatgatacggccatcagatctcattggcagtatgtcgtagttgaaaggatgtggacaaacctgagattagatttcagttttatcactcattggctctgcgacctctgaacttttaagaatccagttttctcaaagtaaaaacaaaacaaaacagctgtcccccaacaggagaaaaatatccaaaacaccaaaggagatgattacaacagctatttgtttgaaactggagaattgagtgagataaagtacatgaatatagcttgcatgcttcttagcacatagaagatccttggtaataataggggaaagtgttatgccctatcacattgctaaatgagacatatactaaacaagcatattattatacatattttagagcattaactattatagtaaaggggagattggttttgatttttatttactagctttgcattctcatagctcaatagtaaaacttgatatgagttataggtccaaataaatgtttctggcattttgataagatatattattcaattgagcaatataactagaattacatattaggaatatacaagcaacccctctttacaaacacttgatctgcagcaagtaga

SEQ ID NO: 109010 - DNA, 1042 bp, Homo sapiens
ttatattggaacaattagaaataagaaataaggttgaatagataatggaagcaaagattgtagagaaaaggaaagccttattcttgtagattaaattagatacattatttgaggagatgtgaataattaagactagatttgaacctttaaggcaaacactttttaactgcatcataatttcctataaagttagcatatatatttccctcatattaagtgagagcatttacttataaagaatcatattcaggtgcttgcttcacgtggttatttatttctgagtccacaactaaaactaagtagtttttttcagataatttaaaagagtatttacttttcacgatacaaattatacactaagtttatttaacaaaatctgcttactgtaggtccaggtcaagacctcgtctccgttctcatagtcgtagcagtgaaaggtccagtcacagaagaacgcgtagtcggtctcgggatagagaacgacgtaagggcagagataaagagaaaagagaaaaggagaaggataaagggaaggacaaggaattacataacatcaaacgtgggtaagttggagcaaatcttatctggtaaggacttggtgattccatggcgatgttcaaactaaatttttgttctctgaggtttttcttgtggcttatttgctataagagtagaagaaaatggaataaaaagagagaatacagtagagaaggaagaaaggataaatcaaaatagttacctcagatttttactgtggtacattttcatttctatttttatttaataataatataacaatattggaatcaatataaacagcaatatcaaagtttagtatgtaagtagaggaaaatttgcctaattctgtaggaaagtttcatactctgtttcctttgttatgagtatgaacttaaaatttgtagactacttagtgattaaaaatgtctattaccatattgtaaagctgttagcggaaaagtataaagttgaaacagaaggaggggaccatgtgatttactattgtttaagccttttttagtat

SEQ ID NO: 109011 - DNA, 1226 bp, Homo sapiens
gagtttgagatcaagtgatatactgttgtttaaacgttcctagaaaatagaactgaaagaattttctgtacactgtttttccctgatcagcccagaaatctcattagtaaaagattgatcccttcttttctccctctctcttcgttcttactttcccacctcagcatttcatctatttagaattatatttaattatcttcacagacaattcctaggccttaattaagtttattttagtgatggtttcattagctgtcttttttccaggtggctttaaaaaatttgtggagagagagagaggaaaaaggattcacaaacatttaaattaggacttatgtattagttcattgtgattgtgcagtgcatgacaagtgttttagcttgtgctaagtaacctaagtgcttcttcacatgggaaaacaacctatgtgcaaaagtaacagtatttagatagatagatagatagatagatagacagagagacagacagacagacaggacacaaagtatatatttataaagcacaaaaagcaaggacagtaagtacagtaatggtaaagcaaggtaaaggttgtttataaattgggaaaaacaaaacaggaaagaaaggaatgctcaagcaggaattaatgagcttaataatgagggagagcttttttatacttttgagaaaaaaatgcgagatcagataattctgaaaaaccctttttaaataacagctaattatagttctggaaatacctagaacattaaaattgtagaattcgtcttataatgtcataaattggcctgctaattttatttatctacagatttaggaagacctaatataaactggaaaggtctcaggagtttctagggactaaaagatgcctttccttataacactgtgtgaatgattaatataagaaagacatcgagtcctgtctgaaattttatcaagaatgtttaatgacttttaatgttttatatttataaaatttagtttctaagaatattttctcctttaaacactgatacagatttttcttttttgttttccccccaaattttaaaaataaatatttcttatctttagaaaatttcattttttaaaagtgaaagcaatttattaagaaagtaaaggagtaaagaatggctactccgtagtcagagcaactgtatttctttttttctaatttgtaatttttagagacagggtctcattttgttgctcaggctggagt

SEQ ID NO: 109012 - DNA, 1045 bp, Homo sapiens
ttaaaaagctgtaagtattataagcagtgtgaataagaaaactagtaccatgtagtaatcatactttatagatatatgttagttatggctttaaccttggcaaaattccagtgtcttcagttttagagtttcatgtaataaattcctgtcaataaggggttttgttttttattccctctacctagtgattggtagaagatgttgggagtgatttgggaaagctggactctgagttttgacagcagttacatacttatagagtctgtcatatttttcctaacctgttatttatacagcaggaagtaatttatgctaatttacccctatttgcatataggttatagagttctgtggtgcagagcatgcttagaactccttttaagtgtctgtttggatcaaagcagggctgtgtgatagctgttgtctgacaccaagctgtgtggtgttgttttcattaaacatttatcacacttccaatgtgacagcaggcaactttgtgccaggataacatgtcttcatgcaaaatttattgaaaaagacgaagactttgtaaagagatcttgttgcctttcaccagtggcgaagggtaaatgtttggttcgaaagcagtatatcgaaagtatacctttaacacatgtcattatagcatgcaaaaaaaaaaaaaaaagcttcataccgtcaattttgttaagcaggtaaacaaatacatctttatatacatgtgtgcactggaatctttttaaattaaagtttttacagtttcctcataaaccaaatgaatattataacatagtggcccattgtgttgttggccattttatattacagcaaaatttaccacccaatttctattctgtgggtttgaatatttggtattagttctgatttaaccaaaataatctaattttttagaaaagatgaggtcaagaaagggaacataatataacaaaaaacattcagcaaaagcaggagacaaggatttcctcagtactccaaggtaaccacctttcttttatacattatatcagtacatttaaattatcac

SEQ ID NO: 109013 - DNA, 1081 bp, Homo sapiens
ctcttttttggtgattgctcgactgtgaaagctttagaatgagagaaggtactttaaatttcctttttcattccacaggaggctgaggaattagggatatgtgaagaagttagaggatgggagtagcctcatgctggactttttagtaagtttcattacatggtctataaaaaatttagtggaccctttgcaagaggtattacaaaaattatgttagcattaacattcaggaataaaagggaaagagtactgagttgtagtgtaatggaagacccttgtctttggaccggtatggaatgcacagaaaccttcaaattctgactcattatgctttggagctactgagggatgattgtttttaaaacggcaaaaccatgcctcatacaaatatacatgaacacttgccaaagatattacttacctaattaatgagaaaataagtgagacgttacaagtagctcaaaggatcaggagtagacacaaacgtaggctaccaaaaatctagccatgaataacgtaatagattcaaaactagcttcttccacataggggaaggaaatcaattacacctccactggacaaaattcatttgcctgtttatagaaaagaattatttgcattgctatcaattatctataatctatggagtctaaaaatacctcagataaggaaaggtgccctagacaatatacccggtagtcttttttgatcatctcaagtcatttacagtttttttcctgtgagaaggcaagtaacttttttgaactttaaatttattattccataagatggagataatggtaatagagaagatgttaactattagaagcagtgtgtgtcagaagactagtactatgtagtagcagctcaataaatggtcatcattttattttttattgataaaacagttttaactattggttttgtgattaccagtttctcaactatcattcttttttctcacttttgtgtctttttaaaggttgttccttcagtctgaaatactttcttctctacttttcttgccagttgctattcatctttttgggttcattttaaatttcatttattttgtaaagta

SEQ ID NO: 109014 - DNA, 1389 bp, Homo sapiens
taatctgatgggtgacatgatcagattagtgttttgaaaagatcactccagctgcagtgtggaaaacagattgcagagggataagtaagagtggatgcggagaaaccagataagtagcacagtaatctaggagagatgtaatagtagcttgggccagggatttggcattggagatggaaagaagttgctgaatttgagacatatttatgtatttaatgataggtttgatttggtaaatgagatgcagatgttaaggataaccattagttttctgatttatatcattggaacaatggtgagactttttactgagcaaggattacattggaagatggcagggtatcatacatttgctttggacatactgagtttgaggatcttttgggactttcaagaggagaatgaaagtagtcaggaggatatattgtaggtgcagaactcaggagagttttaacatggtctcaggttttcaattccgttttattcttaactctttaggtattttacttggaccttgatgactacagaaacctataaaggggaggctgcagtaacccaagcaatatcttccatatggcaagattaaatcacagtgactgctggatgtgacccatgggccacaacaaagataaatgcattgtgccatggattactttggatgctgttaaaatgtgtctggcactattgtagttactggagattgcaaagatgaataagacacggtctttgatctcaagaaacttccatgtagtttggaagccagacacacaaataatgataacaatgtagtaagagtgctgtgacagaagatgcccactatactaggggagcatattgaaaggacacttaatccaaaattagccagtcaaggaagattttctggaggtgttgacacttaaaccatctggaagaatatggaagaggaagtgagaaggaaagggaaaaacagaaggattaaaaggagagggattattatatgtttaggaaaccatttttattcctcttttttggggagtaattacctttttattgttagacacagaaaataccttctggaaacaaggtgacatcaagcattgttggttcttcctttttttcttttgttttctttctttcattctcctcctctttttccttcctccttttctgaatagatgatatatttcagaatggaacattatataagggcttacatacagtacagagtcttatttacatcttttcccccatccactcaattcctattctttccctaaaaatccatgtaattacatttattagttttttagttatccttctagggtttctttatataaaattataggcaaatacaaatatacatttgaaaaattccctttccttttgggatctttagttcattctggctaa

SEQ ID NO: 109015 - DNA, 1053 bp, Homo sapiens
tattttaaaaagactattgtttgccttggtccttttaatctgcccatgaggaattcaagctgaatgatagggagctgtgaaaatccagttagtgtgagctgtaatctttttactggctttaaatagttagaataccatgcagacaccctgcagataactgaatcaaaacatacagtaatcacctaaacatggattctgcctttgctgttagggaaccatagtaaaaatcactaataaccatttactttgcagaaaagatatttggtcatgatatcaaataaaatcagggtttgatattaaaagccatatttcacaggtaggcaacccagtattggtgaaaagtattgatttctgaaaatttgatattattcagtatttgtaatatcctctgactataatagagtcaggaaaacatctttataaaaagagaatatttataattctttaatctttagtcggtttctacttcagatcttgctaaaggaaaacaaaacactagtaagataatcaggctttggaactataataaatagcaagaagaaagtgtgctgctcttttcttataaaagaaactggttccactaatgcagtttattgaatttagatagcaaaatattccctaataactttgtcaaatggtggtctatttttctagctttataggctgctttttttttaagttgaaagatggatttctcatccattagattctgcattagagtgatgagaaacatggtatgcagtatgccgatgctgcttcctaatttcattagctttccattttctaatactgctgttgataatattctagtgaagtttataaaataaaatagtctacttgttgaaaccaatattctagtgttgctggtatgattcatgctacattaggagttcgtaagtcattaataatcttttatgtttagtgtattcttctgaacagtaaacttgaactcctttgttttgcaagatttgtagggcctactccaggacaaagatttcataaagtagatgcctttcctatgcttattgctttgcctcaagcagttttacagag

SEQ ID NO: 109016 - DNA, 1336 bp, Homo sapiens
taagaagtatcctttctggctaagtaaatgcctataaatattgtgatagtagaaatacggtatattcaaatctctttcaaatgaggtttttgaagtaccaatcttgataattttcatcttccttttagaaaactagtctttttgtctgtcttgacaatgatactgagtttcctctgcctcagtacaaaaaatattttttacagatcatcatggtagatgtatagcaagagagacctagtctagcctgtttccctgcagatgagtagagtgtgaccaccagaggttaagtgatacatttttccaagatagctagcagggtgagattttgatattttaagttacgtagttgtctaagtaactcttatcttattgaagacaggtatgggttttgtatttagagattttgtatctccctactatgattaacaccagtatatattaaatacatatgtattaatcagtaaatacaaggaattttcccaggattttaagtttcaaccaattgctctatgccctgttgaacttgctcccccttaatgactgattaaagtactctcccacttttcattgcctcctgttcagttactgctgcccagagccagagagtttgtttgtcttgttaaaaagtaagatttacaccccttttggtttggaggcaattaaaagttataaagacggattaaagtagaagcatcataggtatattaatgagttatttgggactttctcacagatttcaccaaaagaattgtgagaggaaaaagaaacttacatctaacaggaagagaaaagttttaggaagaccaaattgtgagtaaacctatacaagcccttagaaacatttttacattcagtagaacattaattacctttaaaataaggactacttgatagcattatatcagtcagagtccaacctggaaggtggaaaacacactagagaatggtacaaaagaaaacattgagataacagatattaagtaatagaaattaggtacccattctagggaaatgagaagaggttagtattatcagcacatagtaacttagggaatggcagaactgagacccaggcctctaatgaagcaaaggtgttacttcactagtgttggtacctcaagggcttgtgggagggtccccattgcgctaggccctagacttttttgaggaatggatactgtttggctgctgctggttcctctgagggaatggaatgggtctggatctgaaaggacaggtgaaaaaaactcttagaaattagaactaatattaaagagttatttccttcaaagagttgttggtggggcaactctgacaggatcagcaagtaaaacag

SEQ ID NO: 109017 - DNA, 1339 bp, Homo sapiens
taaggcaatagcttagtaatcagcataataaattgccatttttatccctttacattagagtctttccatctttcttttctgaatatgtaactgttgcttatatccattggttcccaccttggttcaagagataacaggtggatgtttgacattgctgagtaggtctttctcaatctgtgtgccctgtgtctagtgtaatataatgttatttgcacttttgtccacagtgactccatggtaaagtacatgactcagcatcccctttcttacaaatgttaggggtgtgcagttctgagtcccaggcttattttcctctacaagtttttattgcaaaaacctctactccttcttgcccttttaccttccctcccttttctgtatccacccagagtttcatctttttagactgtccataacaggattgatttgtagtttgtgcatactggaacccaaaatgatgttgaaatgtatatgttagtaaataaaagacttgtagaattttgtgtaaagggaacttaaggttgagaaatattttcatgtattagcgtttttggccttttttctgtactgccccacaaggagaaaaaattaagttaaatgtaaattaatttaatattatttataattaaatgaaagagaaagtaagaaaattaaatactaagatataagattttgttgggttggtttagctttggaggacaaaaaccatggtaatatctaaggtttcctttatccctcctcctttaaccaattttcaactgcttggggatgttattgcccctattcagaatacatgctgtatactatataaacacactgtgtgttaagagacttgtgtcctagtccaagctccagtgctgaatacaaactcagttactaaatatggacctccttgtcctgccctcttccctctgcccccaagattagacgagtggttttcaagcttttaaaaattgcttctttccgccgattttcttcctttgctttctaccgttccttccctttctctcttccctactccttttctcttccctcccttcatctctcttttcctccatctttgtcttcctcccttgatttttgttattgactatataaacctttgtgcaaaggaaatcttattgaggatcacatgatataaaatgaataaaagaagagccttggtggtggtaggtagatacactgatactcttttactgtcctgccaaacaggcaaaggtagtttgaaaaccactagtctagaagaatcatatgttacgattcagtaagttgaaaggctatttggaaagcattggagagaaatgtgaattaattttctagaccagggatcagaaacttt

SEQ ID NO: 109018 - DNA, 2869 bp, Homo sapiens
attggacaaggtctaatatggtccttttatttttgggtctcaacttttatgtttttaaaattatagtatgctgcattgcctttgatcaaagcaacaagcagtaatatattatttcttttgagtcagagtattattgagacatgctgactatattgaagttttttagaaaattgggctggagggaaagtgaaaatctgtagttttacatgtctatttaattttcactttgttatttcccaaatcattcaagagtctattactttaccgtacttttaatacagaattactactaactcttcaagcacaatataaaattctgaatgaaagaacaaagaaaagtgaaaaatagtaaaacagcatgaaaaatagagacttattaaaataagacagtaggagtgagattattcttttacccataggctaaaatgtcacttgttgttactttttttctgttttaatgttttgaatttcagcactgatgatttatctctatattaatagaaagctaattgaaaacagcttgctatatgtttttgtttagtactttggctttatgtaattttaccagcatatgttttgctaaattcttaaaatagtagtctaaaatctacagtgcatttttgtgatttatatttactttaaaaagatatatatttaaaaccataaatggcttagagaaataaaattataactgatcaaatcttaacatttagtttaagtaaacttaatacattttatcgtatctaacaaaaagtagtcccatatttttgacaattcttttttcttatcagttccttttcacaaaagtaaatatatgggaaattataagaaaagcatgttacttgacaggtggggatagtcaccaccatactcacaagaacatctgtgaacacgttgcttgaaattagatgtttacattgaaattgttgactatacgctttctataaacaagtatatagaaccttgggtttcagtgtccaaggacagtgctctagagatacgtagaagtgaactatggcttgtattataacacctgctcaatatcttaagttagtattgaactttaagaatgaagtcatgttttagcctatgtctggggagcacggcataattttagataatcttgccctcctcagagagaatggtagtcactgaatctaaccagataatgcttggcaaaatgatctactcataaccaagtaatcacagcacttcaggtgagaagctgggctcagtaactcatgcctctttacaaaaatcagatttatacttatatgacatgtttttactacccatgaagatattttaaatgttttggttgtccttggagtggtgttgcatgaagctttgagcttcgtcctcagtgttagaaaaagaatgtttctaattgactaaaggaaacaatgttgattgagttactgaatgaataattaaaaaacagaaatggaatccagtaaattgtgaccctctcattcttttcctttcagcaatgtgattgtgaccttaaaaaaagacacaaactgactgttgcaagtgagaagggaaagacataaattcctttccaacattttcctattacttctttgacactatcatcttcagagtagactcagatattcccaccaccagtggttttttatttgtttatttgtttttatatcagtgggccaaagccgtctatattttcctgaaattattatagcatagttaaacttagtaggaagctatcagtttggtgtctttgtggttactcttagatattttctagtgattgcaattgtcttgttaacagcaggtctgaagtgatgatcaaaactggagaaactgattgttatgagagttaagaaaaacattaggaatctgagttaatgaaataactcatgattatctaagtttaatacaagcacttgtgtagtatcaaagtgaaaagaagtttcctgttttgtatttagagtgttttaattcgatcttaaagcatttaagcttctgcaaagcattaattttggcattcttttcatgataaatgctatgtgttttagagaaatcaatattcaaatttgcttcaaagaattcatgaagagaaacataatgaaatcttgatatattatatacaaaagacaacccctgatcatttctttttatgcaaatgagtttgatttagacataattccccaacatcaccatgaatttccatctgtgtaaccctgatgttcttaagcagtctgcagttacctcatgctctgggctatattcattctccatgtatggaaactgtgactatcttaacactttagatgatgatatgaataacaattgtttgttgatcttattctctatctccctggataacctgctgtctgcaaaggctgaataagtggcagatagcttttgtcatcccttatccaagctgtacacttgtaaggaagagcagggataatcgcctcaatctaattaggggttaaaagaggccatgactgtgatgtgacagtgagacaccttactgtagcaatcctgtttgcattagaaaaataaggttgtcatattgattattcaaattggtttgtatcagccaagtctcaatggcttgtattgcagctgaagcagttgaagatcccagctattcacaagaagacctgtgctatagcatatattatattgtggcttgtttgataatttggggttttagtaatgaagacagagtttaatcgggagatttaaaggttaaactgataatcagaaactgaagtttagcttccaccttgtgatagcaatgattatgtaaattttgtagtgatattttaggtctctaactgaagatatataaaaaacattatttagaacttctttagtcatttgatgattcatgttt

SEQ ID NO: 109019 - DNA, 1005 bp, Homo sapiens
ggcccagaaaacagatttcttattttacctgttcttaaggagttattcccttattttttttcttttgatatcttgaagatatcagaacaagaacaacaagaaaacatttcttggcttctaatgtaatttatgaagaacttcttttaactgaagaaattgaaagcaaatatttactatgttagtagatatccctgtaagttagaagctgtatttctgtagacagaagattttgtttcctggtatcagtgtgagtaatggataggagcaactgcatacatgattcaagacaccaggttgcttgttggaacccgcttgtgactctcggtaaagcttttgtccaaggcttgtgctattcctcaaacactcttcattgctgttccaatggttgacgtgtaggagatccatcatactccctgctgcctttgctgctgtgtttgcttaaagctaaccccagggatctaataagggaaggaggctgcagcagggcagcttgaagttgaaagatcaaacatttctacctcccgagttaaccatgatcttggaacccgacaaaaggatagggtaccccaatgatagggtgactttagtgtcctcaccctgtatggggactgattcacaatactaagctctaatggaattgcgctgtgccagtagctttgtgtttgtagggttctttaggaatttgtaatgtcacagattggttttacatattgtagtcatgtatttcaattgtaatttattgagcataccataatatgctcactgtttacttgctgtgttaacatgtttggtactaagggtttaaaatttggaataataaggtttccttaacattattgtcattttataatatcatgcaagctttttagaaatttaatagatttaagcatggcatttatgttttaagtttcctggttttctgctatagcttaaattttataaggactttaaaatatacagattcattataatttatttgcaatgacaaagtttagactactaatc

SEQ ID NO: 109020 - DNA, 1011 bp, Homo sapiens
ttggaaacattgttcccctttactaaaaaatggtatatataagaataaaagcattgtcttatataactatgagtactagcttttgagaggttaaaaaaaagaacctgtttttgtgtttttatcttctgatattagtggaaattaatttgcaggttttaatcccctctgtcattatgcttctatttatattcaggaatcatctcaatgacgtatagcaatttcaatgcattgttaatgtataacttataaacctggaacttcgttttattagttcagatagtttttattattggagggttaatatagttaaaacttgcatattccatttagtattaaatgttcaaggtagtaaacatacctggccctagtctaagtcatacacattttccattcataaaggtctttacacatacatatacacacacagattcatcttcttgtggaaataagctaaatatcttttatttgttatttatggattcaaaatgtaaggtcctgtaagtctattttcttttttcttgtaaacagtcatattttcttctgttgtataaatcttaataaaatatggaactcacggataaattatcccccattctatcgcaatggcttttcagtatgaatgttagcactgaggcctatttcctgtaatacgaagtctagccattcagaacatgtattatattgatatgatatattgagaacctttatgaaaatgtcagtgtgtttataaggtctgattaattggattggtaagcatccccatactgaataagtattaccctaagtctactttctttgagttaaaacatgataataatcttggagggaaaatatgtagaaccagttgagaagtaagcagggacatttcttaatattcaatctttggattccattcattctctctccctctgtctttctctcactcttactctctcaggctctctttctcatcgtagttgcttgagtcatgtttgctaactgtatctttgtgaaatgtatagttgtttttac

SEQ ID NO: 109021 - DNA, 1121 bp, Homo sapiens
tgttatttgtctgttaaaactagtctgcagattatttcatgaatatcaaattaagaaagttaaagtgcaataatgtttgaagacaataagtgatggtgtgtcttgtttctaataggataaacttttttgtctttgctttatcttattagggaattatatgtcagtatataagacatactgtgtagtataataggtttaaaataaattctttaaaagaggagtactgaaactagctctgtagatttgtctggtgcatgtgatgaaacctgcagctttactgggatgatggcaatgctctgctggtttactttcaagtagctgggtttttcattttggcaggtacagactttttaaattgggcttcgctttaaaaattgtagggtgggaggaggacatcttaactatgtcatgattatatttagaaaattatggggacaaatctgggttagcctgaggaaaactgcctctgtctccacagtaccattttaagttcacataaaaggtgaaagctcctggttcagtgccatggcttcatggcattcaatggttaatggtagtggtattaacactggtatgttttgaaattgaatgttagataaaattattagccttaaggttggtaagctagcaatcaatatgctagggtgggaagctggtgagccagtggccattagataaatacctttcaagtgtgagcttagaagtcaatcttaaaatatgtaacaataacactaatttgtgatcattatgaaacccttcagtcacattgctggggggtggggagtagttgactgtaagtacatcattcttagtctattcagttttaaaaacatcttgggttacccactgtgtgtattcccataggctacagaaaaagtcatacaagtgcatggtttccaaccatatgtgttttctgcagttatttctcttgttcctggccaaactaccctaaaaatccttaccattccacaaagttgggccatcacttgtgtgtccactttcagtgaaagtataccaccacattgcatttctgtttccatcacggcttccaggagactaggctactgttttccaggttgagtttgagtgtaaaggaaatgtagacaaggaattgtccaatt

SEQ ID NO: 109022 - DNA, 1054 bp, Homo sapiens
attactgacaatcaagtgccagactattgggagttttctataagggcaatgcatttgaccttggtatccacagatttaatattctgtctattcaaagtgatgtggcctgttttatgtgacaatttgtaacttttgtgtggcatgacttaaagcctatgttctgagaggatgctgtgaaggagtcatgtaacttagccaatgaataaagcctactaactgctcagcactgtatctcacagtggctttgttttttctgatgttaatgtattgaacaatcctcatcaaaggtctgtgtagtaatggtgatgttgacaataattagtaatatttgctaaatgcagtatgctgagcactttacatgcattattgcattttcaacttgggacatttgcaaagatcttagcgcttacccattaaatgtcaggaaggactgtaagtttagagattaagaaattgttatgaacatagtcatggtgggagtttaattggttcttgtacaataaatataagaatttgcagattttgagaagaagagaatcttgttttaggtagatgaatggatgagcaaaattatggaggtgataatgaactggtttgagaagagttacatattggcagaaaattgttagccaggtaaggtagattataaagcaggcaatgacaagaacttgggatatgaagacattgatgttagggagaaggtattggaggacttttggtggttagtgataggagccaaaactaacatagacaaagtggggatacattattgaagagttcaccatttctgtttgcctcgtgcattgcaaacataactgtgttcattatctctatttcacattctccatctctaaattgaattcatctgtagcttggataatcacataccaaaattaggaagattctatttgtattaaattacgtagatggtataagggtgaaaaaaaatgtagacaaggtttttaaagtgaacactagaggtaaaatcatgtacataaataatttatgattatagacaacaggaaaaatgtgagctgaatgtagacccagaata

SEQ ID NO: 109023 - DNA, 1464 bp, Homo sapiens
ataatgtcaagaataaaaaatctgcacatgttcaatacagatgcacgttccccgccccccccccccccaaatatttttgatctgtggttggttgacttcattgttgtggattcacagatggggaggactgactgtactagccttggtttgacaacacagtttttaacatctaaggcatagataccatattttttcttgctttttttctgttgatgatgtttatgttgttattgtttttattatcccctcagaatttatcatggagctaagggagctcagcaaataacatttctgttgtacttctttcaccttgacatttcaagtctgtttctgctataatttctcttatgtctaaaagacctcttttattggttcttttacatcagatctactgatgacaaaattttagttttcctctgtttgcaactgttatctagagcatgacttcagaaatattgaactctcttctctttcccctgtagaccctttctgtgaactctgtttacttgactggttttaagtggcataactgatccataccagcttaagtgttcagcttcccattggaataagccaagtgtgtatcataagtccttggctgtttaatatatttaatttgaacttgtcctgacatagtggatgctcactaatatttgtctataaaactaaaggatcttaaaaagataacaaaacacttaaattttgttactatggtagacttacctgtgcaaatgatttataagttctagagctttatttattaccgataataatcagtcagatcaaaactacttgtaaaatgcaaacatctgaaaaccatcattctgaactatagtaacataagaatattcatttagagccactaatttgcaaggtgttcgccaatcaagagaaaagtgctaagaattctaaccaaacctgagaagcagaaactgagaatttcaggaagatctttgtagatcagagtactgacattaagcatttttaaaaattgagttaaaatgcaaaaatagaaattatttttgcttgcttttcccaacactgtaccttcttgcaaatagaacataagaatgtccttatatcaggatatctgtagtgttctattggatactagccaaaatttatctgtctttctatctttctatccatccatccatccatccatccatccatccatccaagatttgatgtttgaaaatgagactgactttcatttataggtattacagttgaaatggatttcaaggcaattaagaaagctgaaaattatatgaagatttttttttttattttgaaagtgaagtgcagtcaattggtccattattaggctgttgtattgaaccagtatttactgagtgacttctatattgtatgctgattatcttgttaatctgattttgaatgtaaggcgagaaaaatttgagaaatatataactgaacaaagaccattagtaaatagtagag

SEQ ID NO: 109024 - DNA, 1029 bp, Homo sapiens
ccaggtgcatatctgttcataattgcatgtcattctgatggggaaattacttgagagaaaccaaagtattcatcctgctttctgagtcaaaaaactaacaaaagaaatattgcattaattttcaaatgatgatattacatttagtgcctaggacccatatatcaaaatctgaaaactgctcagttactgtatgcgcttaatcttaatggtatctgtggatgtcaagggcatggaggaaattaaatcggaaagtgcagatagacctaagaagacattatctcttgatgattgcagttttgataggtatttcagtgaatttcattttcgcagaatggtggaagatgagttagccaccagattttctcatttttcttctacatgatttatgtgagttgagtataaaactttttatgggagtgcagttaccgaagatgagaggtaaattaatgcactgggtttccatctcagcttcatgcacaattgtcagagctgtacatatgtaatggtccccatcattattcagggttgtttacattcaaaatatgtaatgaaatctgttcagaataatgagggaaataaaagtttagaaaattgtaaaggtcatgaagtttgagaaatgatgcactgctcccaaaataacatttaggcaatataaattacattattatgcaccaactctgccttatagagacatgaagataaagtgctttcgactagtaaaatgctgttagcgctctctgaagtatgagaatgtgtaaaatgtttctgatttcatattctgttttgtgcatattgtgaaaaaatatatttaagggatcttgatgtggtatctgcttttataaacctctaagttttaaacatattttcaagtcctcaaattaattcattctgaaactaatttttataattattggtctgattttctattttttgaactatgataaaaataattctagcatttaataaacgtttaataaatgtttttaagtggaatcttagtgatggaaatgacagaaggccaactagaat

SEQ ID NO: 109025 - DNA, 1090 bp, Homo sapiens
aatttagcaaaataaatgctttaaatgtaatcatcaaactttaatcacaatatttcctacataacaataaacctaagttcaattttttaaattggtttattcaaaaattaattatgttatttggtttttcgcaggaacgaatacaaatcttgattacatagcttttgtgtgttacctttaagggagttgtaatcaagtactaactgtaaataacaaatgtaacatggttagctgtatccaggtttattctaaagttaagtgtagcatattctgagagtttgataaatttagagaagcaacttttaaaaatatgttttaaaataacacaaatcaatactagttgaggaacacctgatttccatttaaagaatgttatataaacattaaatataaagtaatgtagtttagaaaattttgaagtatcttaaaaggtaattgctaaaatgtctcataaattgttattcccagatacatggtactcatatgtcaaaatttacaatgaaatttctgtaacatcacttttaatgcaatgccaatattacttctttcttccctccttcattcactcaatcacctttgttacaatttataaaatgtttatactaatctactctcctcgtttgtcagtttctaaataaatgtgtatttcaagaagaaattttacagtgacaaaagtggcacttattaaaatacacgtgcttgcttttgtcagtcattgatatgtcattgatatgtctttcttatatctccaatcaaaattaatcattccctatactgaactaccataccaacttacagtacctctctaacagtgttaagaattagaatactttatgctcattattatatctatatcttacctaccatattaaactatgaattccttacggttaaactcatgtttgtactgcttatatagtcccttagcacctggtatatcggttgtaaaaagtatatgctaatttttttcatttattggatgaatattttaaatgctccagaacagcgtattcttcaaataaatatttattatgaatagatgtataatctaatttttaaatccagcctttaatatttagatttaaaaatt

SEQ ID NO: 109026 - DNA, 1015 bp, Homo sapiens
tatatcctcacaaatttatcagatctagattatatgtatggccatatattatctgaaatatttattgccgcagtataatgctaagtgtattgctaacaggtcattctttaccttttcatttataaaattggcttcagttttagttttttattttgatgaagcccaattgattaatttgtcttttatgtactatggttttggtgatgtgtttaagaattctttgactaatcccagattatgatttttttcttacattttctttcttttgaaagaaaaattaaaatggaggagttagtcttaaatgtaacatgtaaaaccataaaactttatattttatggcttttatttatataaaatataactttatattttatggttttacactttacatttaagactaactcctccattttaattttttaaataaggtgtaatgtttaggttgagattttcattgttctaaagaaaatgagatcagtgtcatttagtaatttccctaattacattggactaactcactggactgtatgttctggataccatgtactcttcaagtgctgtatgttttatttctcaaggtactataatgctgtgacttagattttagataccatgttcacttgcatatagacattaaatactttacttttttaaaaatatataagatctatattttctgagtgctgatattttactttgaatcttaatgtgctcttcaaaaatgtatataacttattcaaacaataagttttaatgagtagtacaatagtcctctcttatacatggtggatgtcttccaagcgtccagttggtgtctcaaaccatgggtagtacaaaaccctgtatctatatctatatttatctatctatatatctaatttatatctgtatctagatacacacacacatatacacacgctatattttttcctatacatacatacctatgataaagtttaatttatagattaggtaagagattaataatgataataaaatggaacaattataataa

SEQ ID NO: 109027 - DNA, 1008 bp, Homo sapiens
gccaagatgggaggatcatttgagcccaggagttcgagaccagcctaggcaacatggtaaaaccctgtctctacaaaaaaatacaaaaattagccaggcatggtggcacatgcttctggtcctagcctcttgggaggctgaggtgggacattgcttgtgcccgagtgaagtcaagggttccgtgagctgtgattgcgccactgcactccagtgtgggtgacagagtaagaccctgtctcaaaaaaaatagaaattacatttaaaacttctacatctttcccagcagttttaacaatacctatagtagtactacatcagagaacattttagctgttaatcttttgtaagtaagtcattgtagagaaacagaggatctagctgtctgaaaaacatttagatgctgatgtgctcattttaactgctgtttgatggattttataataaatatactaagatgttacctagcttcaaaagcagaagatatatgacataacctgactttttacacttaaactttaagacagcgcttgacagaaaagacagtaaaacatgattatttcacaggggatggagggaaaacaggaagtttaggtaaggactcctttgtctccatcacttttgctgttgcctttgtttgtcttgatagccccattccaaacattatctagattttctgcaaaaacgtattatcatcttatcccaaatgtgtccatgggtctaaagaatttagaagagagatttttccaaaagatattttttatcagtatgagaagacaatacctgtaacacaattttctttgaagccttctcaatattttacttttaatagaattgacacatgcacctttaaaattatatttctaatgttataagaaaagatagaaatttctttttgtacatatgtggtaaaacaacttataaaatctctgcataacagtatttcattttctgcatagtatctacaacctttggattgtaccttatagttttcaaagcactttaataaat

SEQ ID NO: 109028 - DNA, 1062 bp, Homo sapiens
catgagctgattaatggagtttggtttcatagccattattcattcacgaacacctgatatctttcccataaacaaattgtgtttgtccaaattaagaaattaaatgaagcatttgatgagtttatgattgacccttctaactcagagcccattagtcattgtcgttatcatagaaaactctttgactaatgtgctgtctaaagaagcatgtggatttattatgacttctgattaatgcttgctgcaagccaaactactagattataataattttttgattctcattttagcagtcattgaagaatttcatctctgatgaaatgcgtttatgtcccattagatttagggatgattacaagttattgagtggataaatttttaaggtattatatgttttagaaaacatacagtatatgctttaaaaaaaggcattttttaaaaaagctgttttttgtcttttaactttgtggacatcatctttcccttttaaggtaatgagcctattatttagattttatgaactagtacttattaatttattaagaaatttaaataggagaagtacatgtatgaatttataacacttgaagttcaacttatcaatttaaaatatttattttaaaattgtatgtaatcttgtttaatacattttagttttgacaacaaagtaaatccctctttgcccaatttattctcattataaagtaagaacaagatttccaccttaaaaaaagctctttaatagacgaatatagctaaaccactgttaacgtaggtcttgtagtgagatacctgctagaggctatattatatgaccaacacactattattatgaaactaaggacctcaatatggccaagctgttgtttaatttgtattggggggaaaaggcagtttaaaagatggaaacattgattgactttcatcagaatccatgttattaacagagtttacaaggcagaaatgtagggtttatagtctttgttgttaagtaaattgacttatatgcctcttaaaatggggaagaggtgagcagcatgcatgttcacaggaccataatgt

SEQ ID NO: 109029 - DNA, 1051 bp, Homo sapiens
ttccccctttctactactttttatatttggcctattaaaagctggacgttttaggcaaatcagaccctcatcagtctactttttataaacttcgtatgtccatatttatactggcaatgatctgaagagaggaagtataggcacagtatcatcaatattcaaaaagttaaggcaagtatatctttaaaatttttctttaaatggttattatttatataactgttggagctgacagatgaatgactttaagagttgtattatagatctactaaacctaaaaataaactagtagaatattttctatgtaattagtccaaaagctccaaaatcagaaaattaatagaggcagaattattttatgtccctcattatctgttgcttagtgtagtcattcaccattttgtatattaataaacattaatataagctattttgtaacagtttctctttaagttagaatataagaattaaagaacatttgtcatttgctgactcatacttctatcaaaggtacatgctgtcaggaccaattagttatcatttatacttttctctgttgtcctcattggttggatctagatttgcctttaagctgtatgtatgttattgatattttctttaaagacttcagctagagccagatgataaaatgagttgtgctgtccagcagatacatttacaatattcagctgtttgtaggtgatttttctaggctataacaaaataaaacctaaagtatcatattcactctgctgtttttatgggtgctaatacactttgaataaaaccctcagttactaagcatttttgagtcccaataagacagtcccatgacattagtggtatctttataacctttttaacttctagtttctctgacagagctctacaataacagcaatgggtttgcccttggcaagcaaaaactcattctgagaggataataggtatttactatttagatagctggcaataaaatttctctcaatgagattttcctgagaaactataaactgattaaattactttcttttaatggactggaaaagcg

SEQ ID NO: 109030 - DNA, 1033 bp, Homo sapiens
atagaatatataatattataaagcaattattgtaaatcagtacttgtgttacaccatccagatcaacaaacactttgccagcacctcagaagcccccatcttctgatagttcctgtcagaactatcaccttctcttttattatgttgagcactttcttgcttttctttgtagtttcactatgtattgctaagtactacagttaagttttgcttcttttgaatgggaatcatacagtatgcattctctgggtgttctgtttctcagtgttgttcttaagattcatctatgtgcatgtagctgcagcatgttcattttgtgctatataatatttcattttatgaacatattacaaactttttttaaccgaaatttctgctgttgatggacttttgagttgttgtcagtttgatgctaatatgaataaggctgctttgaacattcttgaaaatgtctgtgtcctggcacaggttgatcttctgtatactctatacctaaaagtggaattgctgtgttgtagagtatgtataattttaaatttactaggcaatgtcaaatttttccaaagtggatatacgaattaatttttttcaccagtagtatgtaagaattcccattgctctgccttctcaccaatacttaatatttctagacttttttatgttagccaaacttatatcattctactttctcttttttttttgtttgtttattttttaaggcaaagtctcacaatgtcactcaggctggagtgcagtggtgccatcatagttcattgcagccttgaactgctaagctcaagcaatcctcctacctcagcctccagagacactgggattacaggcacacactaccacacctggcagcattttaatttatatttctccagttaccaaaatggtttaccagcttttcatgtttattaggcatttggattttttattttatgaagtatctacttgagtgtttaggccattttagtgtttgtttgtttctttttccttattgacttgaaggagctattggtatatcctg

SEQ ID NO: 109031 - DNA, 1075 bp, Homo sapiens
catcaatctgcttttctgacagcattttatttatgttagagaaatctctgcttcacatgcaaattgttttccttttttcttcctttcctctcctgtagcttttatgtagaaatcagaagtttcctacctctgtggaaaaaatcacactgagatttctctaaggaggcaatatagtaaagtaggaaaagccattataattttctgaaaaacggttttcactatggaaaaaaagatgagacatacgagtgattaggtcatttgcaaattttatagtgcatctgaatgattgggtagaggaacttaaattagctgattacacactgtatgccagggtgctgtatgtttaacactttaattcatttgatcttcagaacatacctatagggagaatattaatatcaaaatttttatacagatttattaatcagttcttatttattaatatatatcctatatattattttatcctatatattatttgaaggattctatagcaaagtaataaaatggtgatatgtgacttattaaaaaaaatcagaaaaaaggaaaaatatacattaattagtcaagaaaggagaaaaataaaacaaaattcacatatcagaagagcctatcaaattgcttttacttgtttcgggtttcctgacaatctaagcccaaagttgattgtcaaagagaactataagttttgcagaatagcttttcctagaagggaatcacatgagacttcatatatgtgattttcttaataagtaaaaagtggtaaacacacaagtgttatcttttgtggttattactatctttttatcatcatgatcattatcatcactatgtgatgtagtatataacatcctcaagatcataattgcaagaaatgcaatcacatgtgtcacacacctcttaacttttattgtccatcaataaaagccaaggatatgaccattaaaagcaacatagtaaagtaaagtctgttcagaaaatatgctccaaagagatagcactctcatgggtctgcttgaatctagttaaaacctgttctatctggagaaacagggagaatacttgtttttacaat

SEQ ID NO: 109032 - DNA, 1098 bp, Homo sapiens
ggcaagctgagacaagttagtcatattagaaccttggtacattttcagaacaaagaagatcagtatggattgactcataaggagtaagatgatcgagaatggtctggatggagctgttaagaagataggcaaagaataggtgattcgtggccttataagccatgataattttgaggttttgctttttatcctaagtcaaaaactattgtaggttgtggcatgattagaagtcattctttgagatccacctgcctaagaagaatagatttgatggtgatggtaaatgttatggtagtggtagtgggaatgaggttatcacaaaactaattttaggaaggctagtaagatcattgcagtaattaaagtgaaagattctgatggactagggtagtggcagtaaagatggaaataagtggactgatgaaaatattttatatgttagatgtagaatggataaaattcaggattaatggttgtgagaaggtgaaatgatacaaacagaaaaaatgggcacccagagaatttgagataatagaatattcttaatgaaactataaaataaatatgttaaaatgattcaaggcataaaagaagaaatagaaaccatcatgtacaaacacaataggatgaaaaatgcttaggcatgcaattggacccgaattttaaaacttccttgcctgcccacagaccttaccatcataaacaacaaatggcagagtttataggtcattttgcaaatttttcttagaaaaattcatagctaagtaactttgaaaacaactgagcttttgctgtgtggttcagacattattaaatgttattcatccctatccattcctaccctcataatagaagcttttttgatgatacatatgtttggttttcatcagaaattgattttatttgatgtatataaactaagtcgggagaagtttcagtttttcttttttattattattattattattatactttaagttttagggtacatgtgcacaatgtgcaggttagttacatatgtatacatgtgccatgctggtgcgctgcacccactaactcatcatctagcattaggtatatctcccaatgctatccctc

SEQ ID NO: 109033 - DNA, 1012 bp, Homo sapiens
taaggtcacttaataattttgtgaccctgagcaattgttaaacccctctgtgcctcagttttcttaactgtaaaatgagtatgaaaaaccatagagaaccatattaaatcattcattgaatcagttaatacatgtaaaatgtttagaaagatgtctggcacatataaagggtatataataaaggctgattattttagtggactgcgaattggcacataacgtgtattataacctagtctgcctccctgtgtggcaaaggctagaaagcaaaaatctacatgtttgataatcttttgtatctaaaattctggatatgagttaggtcccaccagttatgtgtattcacatgcagtttttttccacatggaattttgaaaatggaagtggtgtggtaggctatctacttgctgcttcagctgttgctactagcgagcacagctatggagacctgaggtatttctctagcagtgtgccaaacatctagccactagctttatgcaggtcgaaaggcaggtgcactagtagcttcttgatttgcagctgtagcaggttattcttgaacttctcagttcaaatggcagcctcctgatttctcaccgccctgagaggtagagggagcagcgccctagcaagctagttctgcagtgttgatttaggcatcattattagaggcacagcccagagctggtactttcagcccttctaataattttattattcatccaatttctggtgtttaatccacttttgtttaaaaaaatgtttgaattaaagagaaagcctgaccaataggaaaatgatatacacattagggcatttacactatgaaatattatgctgctgttaacaaataataaattaactctccgtcagttaacctggagagatttccatgatacgttttggagtgtgaaaaacaaagtacataaaatctatggatatgatttcagttatagtaaaagcaatagcaaaatttatgtatgcgtgtgtatacatgtcttgtattttatac

SEQ ID NO: 109034 - DNA, 1019 bp, Homo sapiens
agtctgagaaaatataagggagtgtggggagttggtatggggttattgccatttgtagtaaagacagcatagtaagttgtaggaaatgaaaatggacactaactatggatgctgactaaggaggagcaatataaaaacatccatgttaatttctaaaatattggtttttggtagagtcaataaatagcatgtatacactgtttcatagggagcctctgcagcaaaaatagaaaaaaatggtcaaatgtgttataggttgttacaaaattaattacagtttttgctattttaatggcaaaaaccattaaaatagcaaaaactgcaattactaaaaatggcaaaaaccgcaattacttttgcactaacttaatagcaacagcttagcaaaacaacagaggaagtaggatgtctataagcatggaatagaaatgactttcttggcgtccagggtgggtagtgaaggaagcgaagcctagaggggacagttagccggggagagtggaagaaccaagggactggaacttgtgtacaagattagtaaaagatgtaattactttggtaaatgaagtgcttaatagtagatctggtatccgaacaggatcatgaatcattagagcaggtctgaccacttgttcgttatgctctttggtgtcaaatttcatggcacatctagtaagattcagtatccctgtttgtaaaatgggattgccacctttttgagaatacaaaaatttgcagaataaattaaatcacatatgaatgccatgagttcttcctttattcacacttaaatcataatattataaagcagtcagaaagacaaaaagaacattttttccagatttccttaatagtcaatgaggagtttatcctaaggactcaatttaagtaattgttcccttcaagtgaactcagattctttatggaggacatactgattgttggtaaaattttcaagtgtgtgcttttaagattaattattatctatactatttcaacataattcaaaagattttcta

SEQ ID NO: 109035 - DNA, 1174 bp, Homo sapiens
ctaaatataaactattgttgttactcagaattgcaacacaaaagagtatgacgattattcttttatctttcatccctttagtgacttttatcaactcaaaaaatatttcctgaatattcactacatccaggatactgctctaagctgtatgaaaaatcagtcaaagagaaaatcaaagcccatatactcaaagagcttacattctagaggataagggggagacagaaaataaaatgaaaacaaatcataaaatacactaaattcaaataagggttattgttttcacatcctgtgtgaccttaggtagtccctttgaaccaagtttccccatctgttaataagtatgataataatctatctactatctaaatatgtagttacatagtgcgtatgaaaccattttatagactttataaaatattagttactgcttttgtttgtctggtttttagcacaatttggcatactcaccatagtatgcacctttagggatgccgaaatgaaagatatggttctctgttgctctcaaagaacttacagtcaatttaggaaaacatggcaaatgaacctgaaatggtagcagagtacatgatatagtaatgtatagttatgggctaaattgtttaaggttactaaatgagacagagatttacattaaagcaagatgtatattttttctgttttcactagattgacgttattgaaacttcagaaactgtattttgtgtgtttctatccaagatgagtataaaatttattttacttggctaagttttctgtgttcttgtagtaacaattaaataccagcacagaagcaactccatttgatcatattattactattacctgtgaggaaaaattatttttttgagacggagtctcgctctgtcgcccaggctggagtgcagtagcacaatcttggctcactgcaagctctgcctcctgggttcatgccattctcctgcctcagcctcccgagtcgctggtactacaggtgcctgccaccatgcccggctaattttttgtatttttagtacagatggggtttcaccttgttagccaggttggtctcgatctcctgacctcatgatccgcctgcctcggcctcccaaagtgctgggattacaggcgtgagccaccgcgcccggccagaaaaattattttctacaaatac

SEQ ID NO: 109036 - DNA, 1096 bp, Homo sapiens
tgagattagatgttggatgttacatgtaatctgcacagaaatcaaattatttaacctctaagcccacaataccccctcctgctggtttgctgttaaatattcagtattttcttgtcatgaatacaaatggaggacaaattagaatctacagacagctgacctgagcttcagattagagactggggggcttgtgctattttaaatgttttaattatcatactcccagtagccatttgaaggacacacataaaatcattttcaacaaaagaaaaagaaaaagctcatcctccttcttcctcttaatatgaatgtttgactgtgattacatttgcacttccattggacctatgctaatttactgcattaaattaggtctattagtggtagtaattttttaaacactaaacattctcagtaatattttcagttggtgtgtttgccttgttgcaaggatgatttgtatttctcatcttatttcatagacagtagatcttcggtgtttaagtataaagcagatactttatttaaacaacagatctggtaattcccattgaatatggtaaaaatatatgggaataatggactaatttagatgtgataacatgtatttgcattagcaaagaatagagaacccatgtgaaatgagctgaaaagatcattctgggaatgaaaaatatttaatgtgtgacagtctgagatttgtctttaaatattgatgcttacttgaaaactttcacaatttaaaggggttacagattacagtgttgtattcattgattaaataaaaatgtttataggtatttatagagcaaggaaataaatgtaatctttaaaaagacaaatttaagtttgttcatttaaaaagtaagtttatattaattttattctcaagaatatattattctggtgcctacagtcttgaatttgcatttttttgtttcttttatatattggtataatgttgatttgattagttacgcctgactagtaagcagtgaaacatttttatatactcttgggaaataaatttggcagaaaagcagcatgagtagatttaattatcactctgagaccttttccttttctagcttagtga

SEQ ID NO: 109037 - DNA, 1714 bp, Homo sapiens
attcaaaagtgcttgcttgactatttaacagccatacagattatcatttctctaagtatttagcaatactctaccacatcctcatcccttttttagaaccattacagatattttcagactaagaaaatgcaaatatattgtattactcttttaaatgttcattcctctcccagtctacaagtgttagttgatctaatgactaattgataaatcacattctaatgtcccttacctgacttctagtgttgactgagcagcattgacctcttacagttaatggttgttcaaagggagaggtcattatggaaactggatcactgccttgctatttcattcacatccttctgttggcaaaatcccctatctcttccaggcaccatgttaaatgctagggctgtgaagataaattaggcaagcttcttgttctaaaaaagtttgcagcctattgagggggagggggaggaatatgtcatgtgcataaacatgtataaaacaaagtagaaataagctccagtaaagaaatgctggtagactgcttgtgagaagggagagattacttgcagctgagagaattggggaatgccttgaggaaattgcttacatttttcaaatctgtcagtatgaacaagcttggagtaaacatataggtggtgggggaggtgggagaacattttttaagtttatattaaatgcctttaccagtgctagaaccaaaacttaggttacctaattttagctccacaacaaccctgtgaattatgtattattcttattttataaataaagaaactggacaagttaagtgacttcctcaaggtcctacagctaataaatagtagagattgcactggaaaattattttcctagcattatactcagagctctttttactgtgttacaaccaactagtgtagcccacacagcaactggatctggatcttccaccgcagcatgtaactataccagttacatgtttcccaaacctggcaaacatcagaatcacttgagagttgtttttaaaatatctcgattgcaaacaccttatatttttcctaattttgaggagtcagcccaagaacctgtgtatgttcttaaagtttctcagctgattcttattttcattcaatactgttgcacagataagcacttggaaacaactgctttaagcagtagagctaaccaattacaaacatgatttaccacatactacaagaatgaatatgtagtcatgtacctatattgaatcacattcttttttaaccagtaactgatttaaatattcaatttataatttggaagtgccatgatttccgatcagaatatttctggatctctgaaaaatagcaaactatacttctttgataccatgacacactttttatttttcacgtgttttaacatctctgaaatcaagatgcatcttacaattaacgtcatcttaaaatcactgttcgccggatagcagctgtgactcttgatgttattgtctatttgatgaacttggttgttattcctggccacatgaaaggtcaactaagtcctcaactggctatcaggaaaacatttaaagatcacttgaggaaggaatattatccctgagttgtgatccgaaaaccttcactggcaccttctgatgaagtcaaaaaagtgcctgaataaaaaactggccaggcagtggctcatacctgtcatcccagcactttgggaggctgag

SEQ ID NO: 109038 - DNA, 1053 bp, Homo sapiens
agatagggactaaggattgcagtgctaagaagtacacccaggtgatgccgatacaattggtctggagagcacacttcgagaaccactggaatagaccttcattatagtaaaagagtaatagggacccatggaaagacagcattcactgagatagcctgagtcttctgaaaatttaccaccctttcccagagttggccttgtggcattatggacatgaacactgttttacaaaacatgctgaagactgccctcatccatgatggcttaacatgtggaatttgcaaagctgccaaagccttagacaagttccaagcccacctttacatgtttgcatccagctttggtctgtgatgagcctgtgtatgtcatgttggtggtggccctttgtgctgaacaccaaatctacctaagtaaggttgatgaccgtaagaaactaggggaagagataggcctcagagagggaaaaccctataaagtcattggttgcaattgtgtagtagttaaggactatggcaaagaatctcaggccaaggatgtcattgacgagtacttcagatacaaaaaaaataagcaaataaaaattttggcttatggaaaaaaagagagagggtttaagtagagatgaaaagcagaatataaaatagaatatatactatgaaaaaatttttaatttaaaattttttaattgtggtaaaataatacataagaaatcttaccgtcttaaccattttaagtatacagttcagtagtgttatgtatattcacactgttgtacaacagatctccagaactttttcatcttgcaaaactgaaactctatacccattaaactataactcccccttccccctcccccctagcccctggcaaccaccattaggagtgtacctacttttttttccataagttattggggtacaggtggtatttcgttacatgagtaagttcttcagtggtgatttgtgagattttggtgcacccatcacctgagcagtatacactgcaccacatttgtagtcttctatcccttgcccccctcccactcttcccccc

SEQ ID NO: 109039 - DNA, 1052 bp, Homo sapiens
cctgtgctaaccctggtctgggtgttcaccatttcttgcccggacttctgtaatagcctcacaagtaactggtttctttactctcttacattagagtgaccagcggtttctctactctctcgtattagagagtgaccagtgttttctttactatctcttgtgctagaaagggaccagtggctagttcagactgagtgctctgggaaggtctccctaaggagctgacatttaagctaaaatctgaataacaaggagggacttgccacccaaagagcattctagatggaggaaacaccttctgtaaagattataagctaaaaaataaatttcaaatgcttaagaaccctgaagaaggccagtttggcaaggggtagagatttggttaaagagtttagcaggagccagattataccagccttcgtaagtaagagcataaaatgtaaactttattctaaatgagttaagaggccaattaaaagtgatgctttgaatttaaggggtgagagagaagaattgaagatgtggcatatgagtctaaagtttgggaaagatgttaaggctagagctaaagatttgagggtcaccagcctacaaatggtgtttataactatatgttacctagagagagaatatagataaagaagagaaaggagcctacattgagccttggagtactctaatgttagaggtgccagtagagaaaaatgaggaattgtgaccagtgaggaaaaggaaaaccagaagtgtatgatgtcatggaagccaaatgaaaaaaaagtttcaggaatgaagaagtggtcacttctgttgaatgacggactggagaagaaatagaaatagaatccttctattaaggtcagccttgagtagtttcaaggacagtcaaaggtagtttttaaatactctctagaaattcttatgagaggtaaacaagtatcttccacttttccaaatttaatttggaaaattaaattggcccattctattttgtagcagaatttcagagtggttgataaccttttggacaagatcaggttttcttaaagcttaca

SEQ ID NO: 109040 - DNA, 1045 bp, Homo sapiens
tttaaaggatcaaagttgtacataaaattgataaaataagcacgtaaaatcataactattaatcatgtaaggttatcaaagattgaaaggctacagagcagcctagtgcaatgggaagcgtagaggatgtttgaagtactaagacttggtttcatatccaaaatctagctctaatagtatatcttaaacttagaaatgagtatattacgtattaccaaaaattaggatcaagtgaaacatgctaaggcacttgcaaacacaacaaatccctgttcctacccactgtatagtcagatcttaactgcttgcagataaaagttctaaataagaattagtttgatttgccaatgaactctgagagagcaactggaaatctcaaccagaaatctccaacacctagcctagcacctggcataaatacatgttaactaaattaatttcctatttctgaaccccagtgtttttattggctctgttcagagaaattaaggcacatggggccatagactattttctctaagcttatgagccgaaacataatatgcttacaagaagagacattagaactcataactttatactgactaatgttcaaatacaattatgttaggtatccatttgcttctgacatcacaaaagaacagatcacaaaagacttggacttaagctgtctgcttttccttgcataataagtcccctggttcagggaatccagtcattatagaatttagcctaactgcttctaatccatgtaggactttttattaaagatgaaaactagtaaagaattaaccatgagaggaaataaaagattaattcaagtcagtcatcaccgtatctatatcttaagaagttaatagttcaaaatctttttttttttttttttttttttactggtagaagacttctgaatatactcgccgcttctgaatatactcccagccccatggtgttaggggtaggttgcaactatgtaactccaagctgactgggctggcaccaacatcatcagcactgctaacatcttccagcaagttttagttca

SEQ ID NO: 109041 - DNA, 1106 bp, Homo sapiens
caatttaaaacatttttatgtctattttcatacaatagagctgaggtactgtaaagctgaaaatgtaaatctcctgtgaatctttcaaattttaatttaacatgcgtttacaaccagtaaaatgattcccacattgaaacaaaaaagctatgttggtgtattttcatattgtgagtaaggcaaactggctttctcctatctgctctgtcactttgttagttctgaagtgatctttaaagaaacacaaagataatgatgtttttctgtaatctttctccttctttcctttataatttttccaatgctattttgttaagcattggttttggcaagcctctatgataacacttttatttgtattaggagctggttgtatgtccaaatttaaagctacaaacactgcaagctttagacatcaagtactgtttgtgaggtcacctctgacatttaatactaatgatttcctttacaactccaaatagagaatatgtttagagaaaaaattcaagtggtccaacatttcattcatatgagacatcatcctgaagtcagaaataatgtcttttggttgggaattagtgactgtgaaataattctagtgaaattaactaagacctatacagacaaatgtagttttcatattgacattgaagttggattacacagactagtacccattatgactttcctttgccatattaacattattatatatgtaattaataaaaaatttatctacttgtatgggatgtgttaatattaataaattagctgggcaaagaatcttctctcatttcacatgctcaattagtacattgcataattaaaatctagaggagctttcattgtataaagcatgtgggactatttactcttacatggcactctgacagtgcttggttttattatgtgggaagatatattcttccaaaggtgggagtattggctgtggtggctgctacttgcaagcatttcattctcatctgattatttctcacaagagaaaagactggtttcagctgtcagggacacatcttcataagagccatctttcccacaaatagactagaacttgcacaagactataatcattataaattgtgatt

SEQ ID NO: 109042 - DNA, 1594 bp, Homo sapiens
ttctacatccataaattgtattaatggctgtataatatcctgttgatgtctcctgatggttatttttcctctgttatcaaataagtagttttaacttcagagattttaagtacatgtttattatctttttaaaataaaattttaagatggaattacttgttaaaggctaacattgttttaatacatgtttccaagtcaccctctgaaaatattctaccaattcaaattccacccaaaagttcaaagagatatctgcctcccacagatatcttggttaacaccaaatcctatcgggtttctcatgtttactgacctaataggtaaaaattggcctgtttccattagcacttcttttgttattagtgagattaaagtcttttcaattaccatatactttttaaaataatttattcaggagagatatattgagcatatactacatgttaggcataggaccagatagccctggataatctgtggtccttgcgttgccattttgttgatttcctttgaacttttgatagtttgccaccacaactcctaaaaaaatggggctgtgaaatagacattcataaatgtagttgcccattttatttaatcttattcttacatattatcaggccattcatatatcctaatggaattactatgatttattttaaaacttgctttcctaatatttgtttgtgaagtttaccctgacatcccagtttttattggactctcttatgataaactagcattttcattctgtagaaatgcttattcttccacagtcaatacactgggttttctactaaacaactctttctcacttggtactaattgttaatttttccctttaaacttattttcaagtcaacgcctccaagaaagcatgcattgaaaggtaggaagtggtgctaacaggagaatatgctataaagcttcataaggtggcatttatcttggtgaatatacagtagtctgaagtcttactggacttttattagtcactacacttcaaaatgatcagaagatcagtgatagtctaacaatgaataaattcacacttgactgaaatatagaacaaagggacagtttattactttagaaagtgatatcccttcctagattctaaaatatctatatctgcaatataaggcaaggattcaggatgcccaagaagctgaattattaatgaggagattacttagcaaaaggaggtaaattatcttgtggacccttttatccagatcatggaaggatatgatggactatccctaatgcatagcaaggatttaactctcttgaggactgagttacccatgatcctagtttcaacatatttttctcctggacagttttatacactttgatataaagtttgtatccctaaaaaaaggcttttgtatgctggccaccccttcagttggtaccgtatttgtttagctgtgttaattccactaattaagctagggagcttttaccagaaaagtggctattaccagtgacatgctagacattgtgtctcctgcaacacatattgatttaactagttttactctctgaaatcgtatttcttttgtctgagtaaatagagaatctgatagtc

SEQ ID NO: 109043 - DNA, 1081 bp, Homo sapiens
aaaaaataacctcaaaaacattgattctattgaaagtcactattgtaaatgaacattttatatgaatttgcataattttattattaataacctgtctacttaaaaggatttgtagcatctgaagagtttcagggttttataaacgactctgaaaacagaaattttaggaataatgtttaggtatagttccctaatagtccaaataaactagtactataataatactctctatattaacatcaaaaccagtcacttgatttgatctgaagaagacccataacattctagtcatccagtttgaattctatggatcatttcagaatgcccaaataatctagggcattattggttttagtaatgtagcaatctggtacctacaggaggaggtacgaaacttgatgtataactaattgattggcttaatgttggcaagattacacacaagggtcaaccactgactatagaagtatcacaggtttgggggcatagcatctttattgaaatctaagccacgagcacccaaagacttaaggatctctgagtgagtcacttattagtctttgtaacgagagtgggataattgtacctaaaatggacgaccgttaggaccctctaggggtgactttttttgggcggaggtaatttttcaagtcacttctcacttgagaacctgggtgtgcctttgactacaccatattggtagtttagtatccttagtagaacttacagctagtgttgttacttatttgaactctctggcaataattatttatatttgactcgactgaatttacaatttgtttacctgtagggtcaactttcagtggatccaaatggacattcattttgttcttcctcagttatgacttattccaaaataggagatgaaccgccaaaggtttttcaggcctcaactcaaactcgtcgagctccaggaggagtaagttttctataagcattcctaaagttttataaagttaggggatgatagactgtctagatcaaattttaactattaaaatttaatctggtacaagatggtggggggacaggagggaggtgtgggggttgggggtaaggt

SEQ ID NO: 109044 - DNA, 1024 bp, Homo sapiens
aaataattagagtacagtaaaaactacactgaagagtttaaactttgatttaggtgatactttgtcaagtcattgttttgaacttgtattttactgtatattgagtaaggataaaccaggttgcattaaattgggaagattttgtgttatatattttatcattttcttctgtaaaacttgatatgcagaaaagtagaatgtgatgtctattataaaaccagagattttttttttctcattatagtggactgttttagctcttccggttactggtagtacaaccttgaccttaaacttgcctatttcagtatatttatctactattctgtgtacattttaaaggtatacattagtcttatttgccatttgaatgcaaatgtatcagagctctttgttacctaaaaaaatattttaaccattaatcatatatttttcattagtccttcatatattaagttgaatatccttaaagcaccaaaatatttgctttcttagtcagattgttcgatatggtgagattccagctgaattaagggcggcggccactgaccaccggcaggagctaattgaatgtgttgccaattcagatgaacagcttggtgagatgtttctggaagaaaaaatcccctcgatttctgatttaaaggcaagtgctttcaaaataagtcttatgttaacaacaaaaagaagtcgtttgttttttgtagggaggggacatgatgcttttatgtatgggctttattaatgaaatctcaatacatttatttaacataattggcttcctcaaaaaatacttgacatggtatacttttttttaagtgagttatgtaataacttcaaatgagaaaagttattgaggacccttaaattattggggacctgattttagtctctattagagccagcactccaaagagtgtcagttcattttattcatttgttggttgtggccacagcactattgttggcctcttccagctgctagagctaaagctccactacgtattctctaaggcctgctcag

SEQ ID NO: 109045 - DNA, 1016 bp, Homo sapiens
gattacaggcacccaccaccatccctggctaattttttgtattttcagtagagacagggtttcaccatgttggacaggctggtcttgaactcctgacctcaggtgatccactcgcctcggcctcccaaagtgctgtgattacaggcatgagacaccatgccccgccagtacatgccttttaattccatagaaataactttagaaccttgaggcactgtgttgttagtactgcagctccttcaagtaatgagttttctgtttaaagtaaaatcttgtctattgatatatggtttaaatgaaggccttttaaaaatacgtcttagcatggttgattattgtattggttctagctaattcactatagaattcaagcagagagattctgccacgcttttttatatacaatgtgtgtactgtacagtttactttttagttaccacatctttatttgtattacttgcaaatataattttgtgttatttgtttttttaggatgttgaggaagtatatgccggagacatctgtgcattgtttggcattgactgtgctagtggagacacattcacagacaaagccaacagcggcctttctatggtaagccatttaatttcaaagctacttatcactagaattttaaaagtctgtgtttttatgtagtgcatttaatacttcagaaaaacaaccacagaagttttcgttgagtaccacagtcatcaagttagttgtggctctttgaatgttggttatagctctttgaatgtcaattagacaagtgctctgtaagctaacttacctggtttttcatagtaaaaaggaaaacttggaggatccacaatcctcccaagtttagcaaggaggaaatatctccaccagatggtacctggacagtgtggctctgattcctccaccctgagacctgcttccacacttggggtgcatttctaattgttaccactaacatcaagctagtttcagtggagtgctacttccttattaactcagtagccagaaagtat

SEQ ID NO: 109046 - DNA, 1055 bp, Homo sapiens
ctgtcttgctgctactaataaaactctctcaacctttttgttctagaagagggtttgaggaaagtatcatagttaaatctgacttgactaacccgaaagattaagagctatgattaccgtgatgctttttgaaagtgcagtctagatactgtgtattaacaggaagtgtttcactgaaatccttggctttgccttgcttttgttatgcttcctagtctctatgttcccagagcatgcaactaacaaagcacagttattaggcaagtttgaggcaaaggaggcctgtggtttgcatctctcagccaaatcaaacaactttttagaccagttactgttgctttggactcttcctacaattcttcaccttctctaatcttgattgtacctgacctcccctttgaaatcccaggtttgctattaaatacaaaatgactataggaatactgttaatccaattatgaattacaatactttcgataaatattaaccccattaatagtgtattttatagaaactacttaccacttgcttgacagtttgaatttttaccattttataccatgtgtcttcagtagaattttgccatattatataaccacaggcaacccaggctaaatgtagaacgagcgtcatttctggagatacatttccaaaattgtctggtaggagacacatttatatgataatcatatatatagtattaaccttttaaaacaaaatctaaattctaaatcatgtcttagtttccttcgaatgttgtgcaaaaaataatttaattaagctatggatctataaaatttctgaggcctcttttttgttggattggattagaaatgagtatttttgcaaaagcctgtaagtttctaacatacttagcaactaacaattttaagcacagataattgagattgattttaagtttgaatcaaacaaatggttttcatgccatatttatatacctggaatattttgtgcttctagcggttccttcatggacttaagtctttgataaaatgtgttgtcttcttcatctggattctttccagtttctcctt

SEQ ID NO: 109047 - DNA, 2125 bp, Homo sapiens
tttttgtttttaaccttttaacttagaagatcttattaacaggttataattttggtttcagtggtggagcatttttttgtcattaatgtattctatttcaagacaatattttgtgattcacacactttaaattcttatatccactaagattaatgtagatgaaggagaacttagacattttacagcatatataacttacagttttgaaatgtcaagaaatattttgtgctatctgcgcagccatgttattgtgttgccaggaaaaactaacttaagtggtaggagctccacaagtatttgttaagtgactgaattaataaaaattgcaagctcatcaaatggtactctttaaatatgtgcagtttattgtatatcaattatacttcaacaaagctattcttttaaaataattagatttgaaaaaatggtgaattactctttaattctagttcttactgacgttttgtaacactagagctataatgtagtgatctgccaatgaggcaaagcagttagaggtatgcagtaggggctcaagacacagctagtgaataaacaccaattttggtgggggttttcttttaaggagtttcttagttttgcctttccgctgcttcctcattgtaaaattaagatcatgctgtctctatgatgggttatgagtaattgagttgagttgagtaattcctgaagatgaggttatgagaaagtgattgttagcattctaagcattgctttcaaaccagcttacgcccttaactaatatgcttttccaaggaattgttcatctaaatgccacgataataaaacttaaatagtaaagttgtactatttacaatagcaaagatatgtaatcaacctaaatgctcatcaatgatagactggataaagaaaatgtggtacaaacacaccaatactatgcagccataaaaaagaacaatatcatgtcctttgcagggaggggcatggatggagctagaggccattatctttagcaaactaacacaggaataaaaaaccaaataccacatgttctcgcttataaatgagagctaaattgtgagaacatatggacacatagaggggaacaacacacactggagcctattagagggtgaaggatgagaaggagaggatcagaaaaaaataactaatgggtaccaggcttaatacctgagagatgaaataatttatacaacaaacccccatgacataagtttacctatgtaacaaaactatacatgtacccctgaacttaaaagttaaaaaaaaaatagtaaagttgttaaacatttttaaaaaattatttttgaggggtgaaatacagcacacataaaaacgtacacttctgaacacaaatattttggggttcttgataatgtatctgcaagtaaaatccactcactccagaagttgtgttcattcattaacaggggtttttagatgcctgcgagaagggccctctttctggtcacaagctctctgggctccggtttgtcctgcaagatggagcacaccacatggttgattctaatgaaatctctttcatccgagcaggagaaggtgctcttaaacaaggtatgctgggtccgggcaccttagcctgtctgttttcctgatagatcatcatagcctcagaaggcaacactgttttcagtcttcttcacccagagcactaggctccacagggaatattgtaggtagtgggcaaatctttatggacttgagatcaaggtagattattatgttctctttcttgcaaagctaaaagactactgtattctcctacattctctggggctttctttcatgtatttgaattcatagataatttataagttctgtttttaatagggaagactgaaatgttcagaattctaggaaatttttaaaaggtatcttaactacagtcttatttctagtgacttattgaaatgtcaagaaatccataaatttgtaagtaatctcttcattatgacattgtatgcttttaggcattttgaggatggcaaagtattttcaaagaatttggtaaaccttattcacaatgcagatttcttgcaaaactgctaaaattgtcaacatttctcacagagtaatatttgtatttaaatgctgatgaact

SEQ ID NO: 109048 - DNA, 1283 bp, Homo sapiens
aaattcactcattagaactaattagtcgaggagggtaggtgtgagctaggatatgatttaaatttaaaatatttctaattacattcctgttgtcataattattgcacttaagctatactgtctctagaagaagcactgagtaaatatataagaaaaattgttagttttggtttattataaacaaattgatgcttctggaaaacctgtgattatatttaaacaaaatattacccttgtcatcatttctgtgttttgctgaaagcctttatttggagataatgtaacaaacctgaggcggaagtatttgtcactatcacaacttccaaattaaatgtaaatgtttgacgttttattatattctctccatattgttacatttaaacattagcactttagcagaaagaagtgttttggttatgtattaaatgggataaaaataaatacagacacactgagttttagtgtttaaatggcccaatctagtccggaatccttattttgtagatgaaaaaatttgagacctggacaaattgtgtttttccagaaggcatatagcttctttgaggtagagcaaaaactagaaacttgatcttctcattctcaatcaggtgatgaaattgttcagactagaaaaggaaagacagatcgtaggcgtggcttgattcttgcttctgagtataggaagggtaccctccacgtcccctcctgccctgtgacaaaaattattttcttataattaaaaataactgcctgccagggaccacaagaaagaatgggtttatccagcctggccaacatgtcgaaagcctgtgtctactaaaaatacaaaaattagtggtagcagatacctgtaatcccagctactcggaggctgaggcaggagaattgcttgaacctgggagacagagttgcattgagccgagattgccccattgtaatctagcttgggtgacaaaaaaaaaaaaaaaagaaagaatgggtttaccttggtcaaatttgtaacagttattatctttaaccctgacgattttcagagagaataaataactcagctggataatttagatggtaaaggacttcatcagatgttgttttaagacccttttgtattattctctgctatttaatgagttttaaggataaaaatatgataatggaaataccaatattaaaattaaatgttggaatttccatttagaagagtgactgttattactacaggaaaaatgagtctaggtcgaatattttaaccttgccgtttgtgtttgtacctttgggaaagc

SEQ ID NO: 109049 - DNA, 1144 bp, Homo sapiens
agtttgtgggtattaagagtggtcaaagacgctggggagggcagtgctgggagaagggcagcgcgcgtcttggcgaccccagcgcagttcgaactactccggagtctggtgtggagccgagagggagccccgcacttttctccccgcggagctgcgctgagtctgaaataggtgtacgcgtcagcggggcaggaaacggaaagacagtgcagtaattggtggaaagctggaagtgggcacctcgagggcctcagccccacgaacacagtcacccaggaaaagcgaaccgcgccaggccctgtcatcgaccgctgggtccgtcctcccagcgctcgcggccgctcacatgggcgtggccctgcgtgacctgccggggcgtcacgtgagctcccggagtcatgtgaccgccgtcttgacagtgttccacgggcgctgcttcctgcctgggtttggagttgtcaccactttcccctctccgtctcctgcgggcgcaatggaggaggaggatgaggaagcgcgggcgctcctggcaggcggccctgacgaggccgacagaggtgccccggccgcccctggagccctgccggccctctgcgaccccagtcgcctggcgcaccggcttttggtgctgttactgatgtgcttccttggctttggtgagccggccgggtgggttggggctgatctttaaggaattcccgactttctcttcgaggtagatcgtcatcgtggtcactggtgccacggggcctcagcgcagcttctgtcttaagctcctgggcctccttattttcccctttgcgatcgattccagccacacctgtggatgttgctagttactccgcgtccggaacgtggaggtcgagggactgagctgggcgagttttgtggcactcctttgctcttcagtaagtcccaggggctagcgactcgccctagaggcgatagatatgaaggtaactccagattttcaaggttcctcttttggcacacgtggtcggaggaaattcagaaagctttaactgttcctaaacaacttttgtttgtttggttttaggtgagacaggggcttgctctgtcacccagcccggagtgcagtgttgtgaaagtggcttactgcagcctccacctcctgggttcaagc

SEQ ID NO: 109050 - DNA, 1085 bp, Homo sapiens
ataaatggttaaaaaaaacttgccctttacagaaagaagaatgtaactactttccactttagattgtcatattttgatttgttagttgctaaacttaactgtttggaaaaaaatagttttattttcttttcatataggatatgcaagtgaataccacgaaattcatgctgctgtatgcctggtattcttggcccaatgtagttttgtgtttctttggtggctttttgatagaccgagtatttggaatacggtaagcttgaaaagaaactatgggtaaatcttacctgattgttagaaaaatacagagctagattaaggtatttctagaaagagctgaataaacttctgtattaactaataatttgcttgagttttttaaaaaaatgatttttatatctctggagttggtttttgaaacgtggtatttcagttaaggtcaggactagtaaatgctgatggtataaggtaactcagttatccataggaaaattatactcacccttgggatcaggtaaaccaggttctgaatcttatcgttgccactttctcatcttcctggctgttctgagctgtttgcagcttcctgagcttcagttctctcattgccaaaatatagatgattcctaccttgcaaggtggttatgaggattaagtgagagatggatgtacagtatttggcacataggtagtatgtgcttcctccagccccggtgagattttctatttctgcttttcttggggtgtaaaacattttgtgaccacttctgttagaggctgagcagggaataacactataaggtttgccactgttcatccttattattgtgtgtatgttgttagtggaactgaagaggaatatagactgggaatattttcagaaggcaaagaccaagatgatgaaaggtcttcaaaccatgtctggtggataaagattaaagaaactttaagagtttacacctggggactaacctttaaaatttttgaagagttaaaatatgaaggaagaattaaatttattttttttgatctcaagagagagaattagcttgaaacttctggggaacagattccttttaatatgagga

SEQ ID NO: 109051 - DNA, 2846 bp, Homo sapiens
gaaaaccaaagtgaattattactaaaggactttgtgattactaatactaatgtaaacagaaattaagattttttttttctttttctttttctcattctcattctttctttcccaaacagatggggcacaatcatttttagctgctttgtttgcattggacaggtaaggaaggccaaaacattcattgattattgacagtgacttctaaattcttatctaattaattccattggcaaagctgtgtttaattaatgcctagcttaattaagcagaacccataaatgcccatgtgatataatccatagtctattttaagccttgaaataaatgaacattaatattttaacttcacagatttattaaggagaaatattaaaactattgtagaagttgagatttatcatgttccttttgcttctctttaatactttgaatttactttttcattaatttgacatgaacttctacattataggttgtttttgccctgggtggaatatttaatgctttttggctgatggaatttggaagatttgtatttgggtaagttatgcataatttaatttatcctaatgtattattgttttagtgttcatctatgaaagatctttaaaaaaccttgtctcttctggggaattacttcaaatctttgaaacctagcttcatatgcataagagtatttcttagttgtcttagttttcctttaaaataagcaacaattttgaatggtcctaatcaactctgtgtggggtttgagtattaaatagttctctggaaatgatatttttcccaggcattttgcctgttctgttgtattaaagactatgatttgaaccacatttagaaaagtatagaccatcgatttctaggttggtgactgatggacatttcactctttcttagcaagtgatgcgagggtcctttcaaccctgtccaagagctttgcttgaatgagcacaatatgtgtaagctgactattctgtgtgaattcttatagaccagttgttctacctgaattgcattgtctgttcagtaagcctattctgagaccagccttgggcttgctgccctgagggacccagatgacagaactgactcagttttaaaagcataacttattcaagctttgcacaggtgtcaggagcatgtagacataggtgacataccccaaaaagtaaccgtcagtgagagagaaggaagaagaatgtatgtaaagttatgacagggattcagaaacagaaatgtggtcagaaatggccttacagatgaagtaggccttgacagaagtacaggatttggattattagaagagagggaaaatatttttgggctaggacagagtcacaagaaataagactatttcttatttgtcttaagactgtttcttagtccttaatactgaggtggcctcggtgtaaggatatggaggaaggaagctcctaactgaaggcccttggaggagaatcgtaaatattgaaacttactgaaggaaaattaaaacccaggaagtaggagagtgttgaatatggaaagtgaatgtggggattgattgatggagagctttgcatattgttctgaaaaatgtgagtttttatgttttcacaaagcatggaccacttttcccacatctgcattttatataatatcgatggtaatgtagtaaccaagacgactccttttgttgcctatcatggttattattgcagtatatcatgtgactcccacacttagcggtataaaactaccatttcattatgctcatggactttatgggcaggaattcggacaaagtgtagcaaggacagcttgtctttgcctctagtgtctggggcctcagctggtaagattcatggaagggtgggggctgggatcatctgaaagcttattgactcacatgtttggcacctggactgggatgcctcaaagactgggactgctgactggggcacttacatgtggcctctctttgtggtttgctgtctcatagcatgggggtagtggttcagggctccaagtgcgagtgtcggagtgaaaaggtgatgtcaccttttataactgagccttgggatcacactgtctcatttccaccatattctattggttgaagtagtcacaagcccacctggattcaaggggaggggacagaggccccatctcttgataggagaagtgccaacattttaaacctgctgcattgctaactgtagtatttctttaaagttgtgacttctggtttttttttttttttctatttttaggattggtggcgagtccttagcagttgcccagaatacatatgctgtgagctggtttaaaggcaaagaattaaacctggtgtttggacttcaacttagcatggctagaattgtaagtataatgaaaagcctgatgaagccaaatggaagcaaaagattaaatcttatagttctcttaaaaatcacaggatgaaatgtatttgtgtatggtaaattagatattaacttttatggatttctctagaacacagcatggcatttaccttgagtaaagcatttctaaccttatttcatctagtaaacagtctaaaatggttgtgtacattcattagttcaaagaatctgagcatagggagagatcctgtaagttttgttgtctaatttcttacccatttttggcatccctgctagaacctctccacatacggctgtccaggttcagtttgcaatatttccagggattgcaagcttgctctgtgatgaagcagcccacctaccttaatgaactttatgaagcgtaacctcacatagcgatgaaacctccatttacaagtagcttttactgatggctctgacttttgctctctgtag

SEQ ID NO: 109052 - DNA, 1466 bp, Homo sapiens
gagagtactgcgctttgggaggatggggcacttgggctgccagagggcaggagcgaaggccgtggactctgggaaaacatcggaaggaagagagatgaagagcctaacttggcttcatcattttttccctggtgtccattgacaattggtgcttagactgaatgaagaaatgaggactacatcagtagctgctcatcagttttcttcagtctgtattctgcattacaggactagactagttttttctagtcttttccttttaatctttaactttgaactgtgaaataatgcagtaaaagctactactgtttgctgagtatttgaatgtactcttcctcttttgtcccgatttagtaattgcagatttttctcgtgtctttatgtgacatccctttcagttgctgtttttgctgtttatgtaatgtacttctccttaggaaccttctgtttggttctcttttcaaagtctgtttttcttttttttttttttttatttagggggtataacgtgtattctttcactaatctgtgccttggctcttgcctacttggatcagagagcagagagaatccttcataaagaacaaggaaaaacaggtaagtctaaatgaaagaatgggacttaggggaattacggcctttgtgagattttataatgagatctaagttcctaatgaagtgttgtaaaaccaggtggagcttaagacatgatttttattttttatttccaaattgatttccacttttctaaatttttagatgtattttcttttccccttaaatcttttggcagaatttacattctcgattgtatatttgcaaaatggttattcttggaaaggagcaggaaaggtagatgccagtcttagtcttaggttttgctttttcttatgtctttgtaagttatcccagaaatgatgtttgtgtaatttactagaaaagtatttttttaagttgaattgcaaagattaatcacaagattttaaaaaataatcttgactatagatgaaagctccttaggtatgcaaaattatgctgatagtgtcttccctttcttctctaaggtgaagttattaaattaactgatgtaaaggacttctccttacccctgtggcttatatttatcatctgtgtctgctattatgttgctgtgttcccttttattggacttgggaagtgagtattctctatgtttccattatttcttgtctaaattatcatgagagttcaatcacataaatgtagtttttaaagcagtaaatcttgcttctctggttatagtttatattttcacaggaattactttagatcctgggatatacattttcttttagcttaaggtttagtattggttttatacttttattattcttttgaagaaatacctgtattactccactctcatgctgctaataaaaaactgccccagatagggtaatttataaaggaaaaagatttaattgact

SEQ ID NO: 109053 - DNA, 1051 bp, Homo sapiens
tcgtcatccagcctctggggtagcgctgaacctggagataactggaaaagtcagtaaatctatttaagatactgttgtggccacaaaagagcctccagcaagagggctggagtaagctaacccagaagaggtccttgctgacattataatctccctgcctgtttatgtgaggcttcttagtgagaagctgagtccagttcctggcacagaaaggcagaggggggaaaccgcacctgtggttgatattcacatggcccttctttcattcagcacaaaggtattgaatccacattgcacttaatgagacaagctcccttacctttgagcagtctagtagtggaaatagttatgggataaaaaccaatccaaaatctaatcaagtcatccctggtggaaaacatctctgaacacaaatagtatatggttcacagatactaatatttatagtgaagtgttagcctatgtgtgaagacttttgaaaatgaaatgtgtctttatatttcttccattgtagcatgcagtccattcagaatcttgggttggccatcatttccatcattgctggtatgatactggattctcgggggtatttgtttttggaagtgttcttcattgcctgtgtttcttgtgagtattccgtatgacaacattttgtttcttttactacataacagaatgttcttatttttacttaggcatagctcccagatttgcctaattctcacctgtgaattagaatttcatagctggtgactttctagccctctgaagattcacaggcattttttaggagattcctatccttaaaggcagtgattgagttggtttcatattctgttttaactatttacagtttaaaaaaaaaaagcattttcccacttaaagtggaacaatttgaagagtcctgagtatatccttaatgtgactatgtggaaacgttggtgtgatttaggtgtgagtactcatggttattcattaggcagttttaactgatttttatttttagtccgtaatttagtttttacctgtaatttcattggtttgaaattgg

SEQ ID NO: 109054 - DNA, 1333 bp, Homo sapiens
atatactactagaaataacctcatattaattgaaacctcagaatattaattaaaaactcagaatatttttcaaattttctacattgatcttttgtgacttttaggatcaagaagagttaaaaaattgctcagaaaaaaaatgtgtagcttagtatttgctattacatgtcttgtaatgcttggttttcattttataaggcaggtgagcttcatgtttttttcttcctctttggtaatttattgcgttatgttttgcagatgagaagttaaaatgaatgtgtcatgagaatgggcttaacacatcgttggtttgaaaacttccatttttaaaaatttagagtttagtcattagaaaaaataatggactggaaagttatatttatatccaaatatacctatttcaaagtgtatttgtgaggcctgttttagcctgtgtcttttgtattgtgtgttgctaaagaattctacttttagtaggctaatcaacaatgaaagggttagaaaattgctgtggaacatccaggtgaacttcaggaaagacagtgaaaaatggaaaacgttggagcttctgttgagataatcttcattaggtatatatcttagggatacagccttttctttatcttatagcaggaaaaaaaaacttttgagggaaatagaagggctgcgttacacaaaataaacaatggcattgtcataggccttccttttactagtagggcataatgctagggaatatgtgaagatgtttttatgaagtctctttctgatcacgaacaatagcttgcgctctactctgtagttatgtggattgccgagcaatgacccttttcaatttcttatttctgtgttactgaggaccctaatcacttagggatgtaattttatagtataaactttctgtacagtttttcttatagtctaataagtaaaaagtgtccttcaaattatgataattgcctatgtacatggataaattaaaacactgcacacggagtacttgatgtcttcttttgattttaaaaaatacaaaaacactgattttaacttttattcatgcagaagattatctagaagaaaacccaagtcagaataaagagaacttgcccaattacagtcactgaaagattatgggggtagctttttctccagagtagaactttaagtaacatatgtggttttttttatattaagtaaaatatgagtatgaagcttctctgacaaactttaaatactttttaatatttttcagccttaacatattatttgttaaagtcaaagaatgcagatattttagacaagatattaaaccaatgtatttagctgattatat

SEQ ID NO: 109055 - DNA, 1119 bp, Homo sapiens
acccctgtaatttacaaattacccagtctcaggtagtatctttatggcagtgtgagaactgactaatacatgtgtcattattgagttgttagttctttaggctctgacgccatatgactgtttcagcacatgggtgttgaatacctcacaagtgggggagagtgcaggaagtccacactacttctgctggaaggcccatgtggcctggcctcttgccttgtctctccaccgcctctgtgccccagccacagtgagctgcttacatgttttcaaatgggttgtgttcctttccctcccagcggctttgtccacactgttccctttgcttagaatgttttctccaaggctctctagaacctgtttttacctgatttataccagaaaaccttagcccccagcccagaaccattcttcctcatggaagctcttccagatccttcagggtgtattgggttcttctaagttgctgtgatcttgcagttttcctttttagcttacctcaacttaaaataatgaagaatctctgataatgtgggtgtgggtgtctctctcttccttaaattggaagctccttgagggcagggactgcgtccgttttgttatcgatgattatattgatagtgcctagcaaaagtaggcacaaaataaatatttttttgaatgatatataaaaagagtaaattagaataacccttttggaggatgaattggcaatatgaataaaaagacctaaaagggggatggtggtgggctaaatgccttttggcttagcaattccatttctaataacttgtcctaaagaaaccatcagacaaatatacatgtaaatatattttaagaaagcgtcttcactgccagattttataatagcctaaagtataatagaaagccactctaatttacaataataggggatttgttaagtacatcatattacatacctaaagtgaaatattaagtagtcattaaatggttttgttagagaacatattgacatggaataatgttgatgacattttcacacggaagattcatagtggtgccatttttataaaaacaaatatatctgcatgatatgtacaccagtgtctctgaatgatgaatttctattggcttatt

SEQ ID NO: 109056 - DNA, 1101 bp, Homo sapiens
caagtctagcaatatttagcaagtagggagatttaattgtataaaggaagagtatagatacttccaaaaatgcaatttcacattgttatgaactatgtgctgtatatcccccccacccccctgcaaaacaaatcctttaaaaagaaagccaccatgagactggggtatttattttgtcatcagtaggaaactgtctagattaatacttaaagataggggtaagaagatcatgttcctcaggggtcagtgctatttataggattttaatctgtaaaggcaacatttgagaaaggacatgattgaaatatttgaatcaaagagtatgaatagacaggaaaatatttatttgcagaatttccaaactaattcttatattattagccccgatgctgaaccttaagtcgtggcatttagagtaataaagaaatggctggcaaagggtttgtatttcatctttattacatgaattacatgcaggtcacatgcaatacacagatgctctcctatttaatcacctgaatataactacatggagatatttaacagccctgtggggtaaagggtcctggatacagaacatctggggtttgtttctggccctatctctaaccaactttatgaccacagattcctcatgaaggagcccagacacttgatcacagtgtttggcaaatagtaacaattaattaaatgaataaataatgagtgaactaaaaagctacttccagcttgaagactatggatttcattctagaaacaatgagaaatatagtataaaaatgtctccgaatcttttcatcaccttccttgttgggtgatacaaagttggttcctccactaattaaaaatccagatctatctctattagacaggttggccttcttggatgcatggtagctctcttttatttctgtagagccaatgggttaatcttaacttactagtctatacgtgtagatactttggagatggattctatgtacacctaaaattattttcttctcactttcacttacagagctatattttaatgaaaatatgtcctttaaaaaattaacatattaaatgtttttattttctagcaaaccacgagattatatt

SEQ ID NO: 109057 - DNA, 1479 bp, Homo sapiens
ccttccaagttcaggctgtgggtggaacctgttgctttagctcacgtttcccttcccctccgggctgcacgctgaggatgacctcagcgaggtgtgtgtaaggggaatggagggtaagtgcgagaaaggactcctgcctggcaaggagacaggggaagcgggtaggggcgaatgttctaaagggttgggcgagccaccagagactctttccgccacctccaatcaaggggaccttaaaggaggggaagaggtagatatcaggtgagggtgcccttggcacatccgctgcctttgcttccttagatatttcaggtacctgagtcaaacctatgctggcgttttcaaaaacgtacgggctgcctgagtctggcagctaatctcctttggaagaaggttctattaaatgaaaaataccaacacttggaaaaacatagatgcatcacagagcgcctactaaggatttcctgtgaaccaaccattctgacctgtaagaactgggaaactaggaaatgcccttttctctgtggtgattgtgaaaaatattacttaattttataacaaatcggagagaaccaatttctctgaacttccagatttgggcctgttgctaattgttcccagtgaattctagcctggaccaaatgaattccctggcgtggcacagtccagatggaagaagaggggaatgcatgggattcctaagtagggagtggctgccaccctgaggattcttctaagccctagtgggatgtggtgctgagatcctttttgaagtgatttctgtgaggcacgactctcctgtgctaggtagacctgagccagggaaggtaatctaacctttcaactcctctggaagcagcaatcttaggaataactggaaaaggggccttccggtctggccagctgttttgtaaaacggtactgatgattatttaaattgtcttttatggtaacatctgtaaacagcctgtcttgtgctccaaatacggtttgattttgagattgctgtggagccctgcctgccactccagcggggtggaggtggccctgtgagtaggaagatgtaagtaggaaacatttggtgtgctgggaattagatagctgtttttcagttcaccatatgacatggcatggcttagatcacaaaaagctccctgctctgtggcaggacacaggtagacagataagtactgatcacctggggtgatgagagagagttgtggtttcattccaagttttgaatattaggacctcctcagccacccacccagactccctctgagctctgggctcatccccctgttgcccagatggtccatgttcagggaatgcaaaataaggcctaagaaaaatgtttggcaaagtaagtctagtgccaaaaatgcatggcatttcaaagccaaatataaacatctttgaattacctgtacttttaaattattttccgaccagataatttctggatcagatgggaaagta

SEQ ID NO: 109058 - DNA, 3903 bp, Homo sapiens
ctcctgtatttgaatgggttgattttcctcctctaagactttcttcctttatgaaacccgagttattgttgacctgggggaacggggtaaatggacctgtcaggataagggaggggttcttccctcggtcgcctgactcactccctctgctgtgaatccctccttgttttgataacggagccacttacagtttcttcccggaggctactgcctcaattcaggaaagccagacagggaggggtgctggagtggaaaagagggagggaggagaggagggctgcatctataataagaagcactggcaggttcacacttgtctcaacatcttttttgcccctgagagaagagcagataaatgacttaaaagaaaaccatcatgaaggtagctcccctgtttagcactgctttgagataaagcaacagttgtaatttgaaatcattaatgatgaccctaattagggctgaagggcgtagttgaaaggagctgctttctgtgtgtggcagctgtgtggcaggtgggaaaatgcttgccttgcgggtgtaatttttgcgacaccaggaccccggggctcctgaaaattgggtgcatgcacttctgacttcaggggtgaggatggtaactgtgtttcacagagaaattgccatggttctatcagagagcgcccttggctgacagagcctgctggttagtttcccttgggaaactacttaataaattagcatactcattttaattccagctgtttaggagtttaccatggccattaacagacgtggaatctttccattacagtcaatactatctcttataccttgcaatagaaaatatccttttcccactttgtgcttgagaaaaatacctcattaatacctgggcttgaacaatgagtgggaaataagcaggaggttagtttgctattgcgtgacatttatacattccaggaaaatttagtacttgggtatacatgcaaagttagggtttgatggtgacaatgagctccattattcaaaagttgtggaacaaattgtttttgagcacccatgtatgtgctgtgtgccagggatggttctgagtgctgtagttacacatcagtccacatggggctgaaattctggtgagggaagggtagggatacagactgccttccctccaggaacttaaaatttgatggcttacctagcaccacctcatacccccacccccaacgcatcttctggttattgtgaagactatgaatctttccttcttgggcagtctttgaaaccaatggtgtatcctcacctagtgaacagtttgcatatttgcatatttgggtttctttccttcacttccagctttcctggaaatgccccttctggtcatttcctctacaagttacacagagaaatttagatttcattgtgtcaaagcaaggatgtatacagaaaaaagggagaaggaggtagcatttgaggttaatggtggattttttcatgttttggtttgtgtttgaacaaaattactagtcagtgttggtttagaatactgtttttcaaacagtaagtttcccatgaaatcaccttagcatttaaaaaaatgaaataaaatagaatgtatgatagtgtattgcagggagtcatagtaaagttggtaatttttaaaactttagttttatatgtatggtgggttgcaacataaagtttacttctcactatgggtcgctgttataaaagattgaaaagcactgatttaaatcctgtttagtgctgcctggagtacgtaagggaatttatgaccatgaggacagaaaccggagaagaacaaaggagccgtgtggaagagaaggcctgccttgaaggaactgttcaaatccaatgatattttactcctctttaaaatgtcttgtatgaatatatttaagtggcattaatacacaccactaggaatggggtatacaatgaaaaggggatagcttctcttcaccaagtaagcctattcctacttcagggcttttgcccttctgtaacctctgcttggaagcaagtgtctggttccttctcatcattccagactcagttcaactctcaccagctcagagaagctgtcccccaccacccttcctaaagtaaagtaacagcactgcaccccaactccagcactcctggtgtattgttttcttagtgcttgtcactatctgacattatcttatttagtcctctatttttggtccctctgaaatgtaggcgggagttcttgcctgttttttaactctataacctattgcctggaacatgcctgggatggagtaggttctcaaatattgaatgaatgaatgaatgaatgtttatgacaacaacacaacccatacctaatccaactcccattttacagttgagaaaattgaagcccagagaggttaagtgatttgcctcagacccagtgagaaacttatgaacagggttttgttctttcttgtgacaccagactagttccccgcccccttttttaatgcttaaaataatttgaaataaaaggaaaggaaggagctcccacctccctgaaacttaaagggtttcctattgacaagtctcttattgcacttccttagaattaaggacataagtaaactgggaaatcatcaaaacccccttacttatgagtcttcttttgtagacagggttttgtattgttttgtttcaatgacatactattgggttctgcagagcagggtagtgacagaatccatgtctcctcactccacatccagtgctctttccttcctcttagttgtggtgatgcacgcagaaggatgactgaggtctcaaaaatgggatgacaatcagctatccctaattcagataagattgagaggcaaatttaaaaatgcacaatgtttaggtgggatttaaaacctagcactgaccttcactttgcgatgggtttagaaaactaatctctctcttggtatctgtggaggatgatgagcttggatgctgtcaggaactatctttggtgtcacagcatggaagggcctggggagtcctgatggaaacactctagtgactggatccttgctccatctcagagctgggggctcaagacagacctccagcacctggtccagccctccactgtgatgtcatcacctgggacagccatatccccagtagttcgcattgtgcctggcacaaataaatgcttgaaacatgcagagagggtgaggggctctacccaaaaaccagaactactcccagaagtgccccttccatgggcagcccctgctcatctggtgtcagtgtgcttctcacagtcctgccctgggcttgtattccgtcttgtgcgtgaacactcttaataaattcaagggccatagatggagtaaagaaaggttctggggttggtgcctttgatgtcagattaggagtcctgcttgcagaagttcatgtttctcttaaattcttatcttcttgcctactctaactctggtgcacaggactggacagttttccctcttatgagagcgggccacaaacagtcggctttctctcttctgcttctccaggaccttagtgcatcactgtagccctcttgctcctgttcaaaaggctctgtggacctgttgccaagtggggtgggagggggggcactgcctcagtgtactcttcctcctaaatggaatataattacacatctttttctctgtgtttgtccctgaggcttcctgtccttcatgggacgtgttcctccatgtctagcctgttccctgtctctggagactcagcctattttgacgcttttctttaaaaatagctttattggccaggcatggtggctcaggcctgtaatcccagcactttgggaggccaaggcaggcggatcacctgaggtcaggagttcgagaccagcctggccaacgtggtgaa

SEQ ID NO: 109059 - DNA, 3903 bp, Homo sapiens; identical to SEQ ID NO: 109058

SEQ ID NO: 109060 - DNA, 3903 bp, Homo sapiens; identical to SEQ ID NO: 109058

SEQ ID NO: 109061 - DNA, 3903 bp, Homo sapiens; identical to SEQ ID NO: 109058

SEQ ID NO: 109062 - DNA, 1025 bp, Homo sapiens
tccgcctgctcagttcaagtgattctcctgcctcagcctcctgagtagctgggattacaggcagccaccatcatgcctggctaatttttgtatttttgtagagacggggtgtcaccatgttggtcaagctgatcttgaactcctgacctcaggtaatccgcccaccttcgcctcccaaagtgctgggattacaggtgtgagccactgtgccgggcctgaatatacactttcatttctcttgggtaaataactagaaataagaacggcttgatcacgtggtaggtgtatgtttacctgtgtaagaagctgcctgtcttccaaggaagtactattttactttgccatcacatgatgcttaaatcactgaaagaggtttccccttttcccattgctctattccatctgcatcctgctttccaggacacctcccttcaggtggctgggtggctgctccctccctcttaagagaaaacaacaagagagcaaggagatcacttgtcacatccaaccagtctttactcctgttgtttaaaaaaggaaaggaatcatttttaaattagagaagagctctagctgtagactcaacacattttaagtgcagttttattattttttagtgcctctgacaggtgcattttcctcatttaatgagaagataagaacaattttaattgacacgttaattgaaagcaaattcttctgacgaagttatttccaaagtacttgaaaataatgtgtctttttatttgtttatactattagctagtagcacactttttaaattacctacatttcttcctagaatggtactaattataggttattttcaatgtattattctgtaagaattacagcccagttacttcttccccatcaatgacacactactaaagtagcttgaatggctgagtagtttatttccttagttacttgggctatgtttaaattacacaagtgtctgtttttgtagactgaattaagatgtctttagtattcctacaaaatacagtaaagtttataagttt

SEQ ID NO: 109063 - DNA, 1025 bp, Homo sapiens; identical to SEQ ID NO: 109062

SEQ ID NO: 109064 - DNA, 1025 bp, Homo sapiens; identical to SEQ ID NO: 109062

SEQ ID NO: 109065 - DNA, 1025 bp, Homo sapiens; identical to SEQ ID NO: 109062

SEQ ID NO: 109066 - DNA, 5639 bp, Homo sapiens
gcagcctggggcacagcattgaaaacattctgtgtggaatgcagctatcacttattcctgttagttagagagcatgacatgacagtgttaaaatttttttttctttttactgtaactggaaattaccagggtgaaatgtattctgtgtttcaaccttttaccttgaaatatctagtactataatgaaaagttctttgcctactttcctatttatgatgatttttgcttaagagctgcaaaggctgctctgtctactggcatgtactctagacttcaaagaaatatggttaggtttttgtctttgttgtttttttttttttttaaattaggttgcaggcaaaccacatgtaaacaattcttaaaattttgaaaatataccattagttctggggctatctatgtgtatatacaattaagttattattggatggagcattgtattttagaacagtctttgaaaatgtagtttgattaaaataaatctttgcctaccaattagtttgtacatagtggaccttcaagacatcctcaggaaaattttcaggatgcacatctaaaaaacagaggcagatatcctcatcacacttgaagagcttcttgaacaactcaccactggcatcacctcacctccctccatcccttcctgctctgcctgcatttccagttccagactccttgctggcattcctgacagaaatcttacacctgacaaaaatcaggccagactcatcaatttctgattttggttcccggctcttttggtgacatcataactacttttttttcagacagtctcgctctgtcgcccaggctgcagtacagtggcacaatctcgactcgctgcaacccccatctcccagtttcaagcaattctcatgcctcagcctccggagtagctggtagtactacaggtgcccaccaccatgcccaactaactttttagggatggggtttctccatgttggccagactggtctcgaactcctgacctcaagtgatccacccgccttggcctcccaagtgctgggattataggcgtgagccaccacgcccggcccataactacttttatcttgaattctctcttgtcttcttatgggtatgtctcttaacagtccaactatcttaagtcctccctcccccttaaacacatattacacattccctgaagtgtagacattttatatacagttgttatctggttggttaatgtattttgtgccagcctttctctttagttctttaatttactcaaagttgctacactataaactttcttattagtgctaaagtagtaattccaggtcctttcttaaaagcttatccaaatgctgtgatgttgcatttgcattttatttatttatttattttttgagacggaatcttgctctgtcgcctaggctggagtacagtggcgcaatctcagctcactgcaaactccgcctcccgggttcaagtgattctcctgcctcagcctcctgagtagctgggactacaggtgccagccaccatgcccggctaatttttgtatttttactagagacgggatttcactatgttggccaggctagtctcgaactcctgacctcaagtgatccgcctgcctcagcctcccaaagtgctgggattacaggcatgagccactgcgcccggcctacatttgcactttaaaatagaaatttgtttttatttctggacctctgtcgctgaagagatgaatggtcttgttttcttacttttgaaaatcggtccttagtgttttaatgaaaagggcgtttgcgggtgcttttccttagttgcttgatgctccctgtgctctcagcacaaatgcactttctactgtcacagggagactattttgcactaaacctttgtagaaattcaagtgtcaattgtgaaattgagcattttcaatagaagggtaataggattttagagatagacagggattctgggagatcatctcatcaaatgctattttcaaaggaggaaactaaggtctgtgaagattacacatcttcacctaacttcctcagcccaagcctgacccagcctcaagtcacccgactcctaattcccacttttaatgacctgtgcccccacttcagtgcttcaacagatgccacctttttaaattgttttttttttcttttaaaaatgaatgggtgttccccaaatttaatttggagtacagatccagtttcataatttaagagcttccaaaactggaagtagattctaatttttatcatttgatagaaaagatttcattttgttgatttttttctttttttaaacctatgttgtcagaacaattataaaattgctttcttccttttaaacttcagctcatcactgtgtatatttctagcaacagaacagtgctctccctggatgatagaaagctagcggagagaagatctctgtgtggctcaccccacaagtgaagacagattttgttctatctaaagagtaccctccaaaaggagaaataacaaaaccaagaaaaggctagtaggaaagtatttgtggggttcagaagcagcccataaaatagtctagattaagatgcctggcgtagttagaatatgtgtgagaacttcttattccgacttgtatgccacttacttgtacttagaatttaaaaggcttgctgatttgtagtgtttttgagtgttccctggtgagagcaagaaatagaaaaatgaatataaggacagggaaatacatttggatttttatttgtgtatttccccagttaaatttgtagggctgaactgtccttaattatttgtttcatatccaggatagttgtaataataatcattctccttcacttaccaagtctctcttaaaatctgcaagagctctccttgtttctcagatggtcttgcttctttttgttgtctgtgtgtttgttttgtcttagttttggctactacttcccttttgtgaataattatcttcctgtcttctgaaaatggaagataaaaaaataataaaataaaaagtaattgttgccctttatatatatctgttaaataattatgtcaagcatgttctccactgatccttatcacttgtctttatctgttctcatttatgcatatacttaatctaattttttctctccactgaccgatttttcaatatttgcatcattttatgttattttcatttttttcctactcttggggtatatttcccgtaaagtgtaggtagttcaaaagatgatgtttaggctaggaaaagcccaggtggtaggaatgatcccaaccagtgttttgttcagccccaggttgatagttttttaaaaggtacttgtaaacccatttttttgcttcctctaaccaatatgaggttgtattaaagccaaacttactgaaagctaaagttaccaactttcttagtctgactttgtgtatcagattttccaattattgccacttgtatctgtacattttactgatgcctctgtatctccacccaaacatttcatatgtatgtgtaatcaaataacctctttggcttatccatcatcagcaatatcacattaatcattttttttcttttttttcttccatttctcagagtctcttcttagtatttatggttcatgaaagtgactgtgcatctttcttccttgggatattagcatagtagacccaaacaaaaagcttcaatttttatggattccaagaagcagtgcattagtctgcagctgatttctgcaaattcatcaattcaagagggttttattgcccatgtctgagatgattgatcccttcaaaactctgccgtatagaaataaatgtcttagttattcacagagttagttttttgtttttgttttacaaagtattacaaaaagcttctatcaggaaagtgtgtggggttgggcttttccaggtgcagaggcaggtgattctccatttgccacaggttgctggagctgcttttcaggatgcttgggaaagggcagaaaccctctgcagcctcccagccaggcctgcagacagcggatggtctgtctgtgcctccctgggcataccccagctgattgggtcatgctgttgcccctcagcagcacacaccccttgcttcctcctctgagatctccccactgtggtcctcagcctgcctgtttcgcctttctctcctgtgcaggttaccaattcaaagtccctaagaaagtggctcatctagcacagggtgcctctggtggccaggaccccctgccaggcccactcttgtactgtttgttgttggagagatgagggcaggcactccctagccacccagctgtgccagtgttggcctgctcacacgtgggttgtaggcgtgcctggaacaaaacaattggtaagtcctggcagctcctaaatgaatgtaactggattctgcttccttcttggtttgccatatatggagagaactttgctttctgaaaaattttaaagggaatgaggtaatttcctcataattcctaagatctccggcagtgttgtaaatttagatttgaggttagagtactaaaaaataaaaacaaaagcagaaaagctgctgtgctctgaaatgccagggtgtttttaatgtcaagtccagcagcataatagcttttacctcttttccccacctaaagaaagagtagtgttaaacttatttccaaaataaaaggagtctgaacctctaggaaactggtacagtatcatcttagaaaagaacctaaatgctaatctacactcataaaaataacatgttttcaaatagtttcagaaccaattcagtctcctgtttttctcttcatgataccagtagctaaaaattaccctacttaatgaaaattgcagacaattttttttctttatgcagtcttacataatttttggtccattttgacctagtctgacattttattttgaacaactacatcttaagtgttctgtcttttttttttttttttttttttggaagatttattgtgaagagcgaaagaacaaagcttcaacagtgtggaaggggacctgaatgggttgcccagtgctctgtcctttttgtttccactctaaaattggttcggcaaggagtaagagagtagaccactggcattttatttttgaacactcgaattgtataaccagtaatctgttagagttgttatccatcttacagtgaccccatcatctgacccaaatagcgtttaaaataagagctcgttctagaagaacaactttaggcagcagtaactttaaaacattttgaatacctgctctactgtggtatagtgatctaaatattagatttatttttcttgtgtctcatatagaaactctaaacaaagcagatgaacagttgtgtctgtactaacacgtgactaaaacctctatagagttccagtgtgctgaaagccaaattaaagttctctttttttagtaaacaatcacactgggaatgagaatattagagctaagagggaggccagagcaagggtggtaaacgcggatgcttccagaggtcacatagataacccactggagcagtgggcccagtgggagaggaccatggtgtcctggaaggtatgtcccaggggtaaaggggcagctgctgtcacttgccgcctgacttcgtgccatgccaga

SEQ ID NO: 109067 - DNA, 5639 bp, Homo sapiens; identical to SEQ ID NO: 109066

SEQ ID NO: 109068 - DNA, 5639 bp, Homo sapiens; identical to SEQ ID NO: 109066

SEQ ID NO: 109069 - DNA, 5639 bp, Homo sapiens; identical to SEQ ID NO: 109066

SEQ ID NO: 109070 - DNA, 4212 bp, Homo sapiens
tgagaactatcttgactattacatattggcaaacaactttaaacatacatatacatttgtgagactaacaaatatctgctgtccagaatactgcccctaggctaccagttacccatcttgctcctaatccaacctcctcacttttcatatgagaaaactgagatccaaagaggctaaatgtcttacctgaaatgaggataagttggggcaaggtgggaccatttgccaagaggtctggtgagattgtagaagtaagaaatcttaaggaggaaaacccatgaaggagtgttgctcttatttattgacaccagagtagctttttttttctcctttcaatgcttaaaataatgagaaataataacatccaaaggaaaaaaacaagacccactacacacctctatttcacttaatttttatacacatcccattacttagcatttacttttctctttcatcttcaaagcagttcaaaaattgatttgttatttgtagtcagggaactgtgtcatgatttattttttattatttattaataataaaaagggaagaactccttaagaacagagtatctgaaatataaacacacacacatatgtggcctcagctgtttcatctgctagaaattcatctgagaccacttaattccaaggtgtggtggtgagtctttataaaacttcttgttatacagaatctaatgaaacttcaatattgctcagtcatattgagactttatttaattttagctgtcgtacataatacagtggaggacctgttgaaaatataaaggttgggactcttttttcctctttggaactattggctctaagtacaaagttaacatagattccaaataaactaaacaattttaggaggtttattcacttttatttagaaaaacaggaaacatttttttttttttgagatagagtctcgctctgtcacccaggctggagtgcagtggcgtgatcttggctcactgcacccgcctcccgggttcaggccactctcctaactcagcctcctgagtagctgggactacaggcgcccgccagcgcgcctgccagcacgcccagctaattttttgtatttttagtagagacggggtttcaccatgttagccaggatggtctctatctcctgacctcatgatccacctgcctcggcctcccaaagtgctgggattacaggcgtgagccaccgcgcccggctaggaaacattttttatattagtttttttttaaaaaacttattttggaataattttagatttgcaaataaattacaaagatagtacacagagttctcaaatatccttcagcagcttccccttatgttaatatcttatatgtctaggatacatttttcaagctattcatttttcaagaaatgaacatttacccaatactatcacctaacctacaaactttattgagatttatattggcctttgaaattaaaaagggtatactaaaactattcgacaactgtaataagtaatatatcctcacaggctgtgacttgaggagggaggggagagttaggttcctccacattctacactgcccctccataaagccatcccaaacaggcatgaaatttaagtaaacatggtgctaatatatttgctatgtaaatgcttttgaagacaagtctctagcctcctcttccaatcaggttgccttgcctctatccctcctcggtggaactctggtgctgtctctggagaagacagatggagtgaaggggcagataaagagagaaatatgtgcacacacggcctgtggagggtgaatctccagtgagggggctgttttgtgagttcttaagtgtagaaataaacttgcccacagtctgctttccatctgggctgtggacagccacaagttctcacttgttatttgctctctgatatccagattttttattgttttaaagtaggaaacaacttttcagcttggtagtttacttctttaaagttaagtttctggtggaattgtgaaggctctatgaatgtccagtggaagtcctgggagagggtacattataggcaactcacagaggtgtaagcaacctgtggaacaaatgccactcaggatgtgaaaggactggggttaagtcatgaggaacagattagaaatggcatagaaaagggtttgggactcttgcaggagtggaaaagggaagggagattggcacatcaggatgttcaatatttgttgactgattgaatggtcagaatttcaaaaactaaaccactaatgggcaccaggcatagttttgttgccaatagaaggatgtccccggccaggtgcagtggctcacgcctgtaatcccagcactttgggaggcctgagtgggcagatcaccttgaggtcaggagttggagaccagcctggccaacatggtgaaaccctgtctctaccaaaaaaaaaaaaaaaagttagctggtcatggtggcacacacctgtaatcccagctatttgagaggctaaggcaggagaatcacttgaactcaggaggcagaggttgcagtgagccaagatcgcaccatggcactgcagtccatgagactccatggactccatctcaaaaaaaaaagaaggatgtccccatgactcagtgaattctcatagagcatctggttttgccaacaggatcggtaatttccttttgtttaatttttttttaactaattatgtgttcaatatattgtggattgtgatagcactaactcaacatttctttcaggaaaattgtgttttctggaccacagtaatttgaatagctccttcaacttagatattctcttgaagttcattacatgctgtgctggaggatgggacatattggaaataccctcctctatattcttaggttcttcctcctatgatggatgttcatgggttttggtacccagcatgagttacccttcctaagagctcccagcttccgtttgggggactacctcttccgcgtcatgtgtgattttggtggaagagtaattacaagtagctgactcatgttctgggaacttcagctccagttccttctcctcccctggctctgctgcaggtagaagagctcccgggaaatttatgtctagagcatttgcagcaaggtcctcagggacagtcggaggccctcgcagtgttgactgctgccaaacccatgctatgaagggaccatggctgtgacttctgcttcctgaccttgtttctacttgtttccaaagtgctgctccagtgtctgcctcctgttgattctgtgggtttgttagccagcattggttttaattgcttgcaagtcgggaaccctaattaataacagtgggcagtctcttgacttaggactcaagttcaaaccatgacagttgaagacccagtattaataaatacatttctcttgcccaatcattaaatatcgaaggtgtaatggaccttaaagctcatctggcccaaacccctatactttcctccagtggtgaggaaataaacacaccaagtgaaagagatgttcaaagtgtcataaatgtaacatgccaagttggcatcctacatagagacatcagggttcattcgtctcggcatcttgtccacacaccctcaccgtactcctttacctctgtgacccatagtgtccacttaatgggatgggatgacagggcagaacctagggtggcaccagtgaccttggaaagggtcacagctaactagcccccatagggattcgacctgtgactctggtggtgttaataccaagattcagacactgagctgaaatgtcagcgtctagctgcatccacaggtgtgcctgtgtgctctgatgccagctcagatgcgtccacttgatgaggctgagactgtgcatgaggaggtggttatcagcagctccaggaatcagatcatcatctccttatgattattgggataaaaacaactagttttacagcataaattttatatttttaatgtgaattaaagattgctttctaaccattccttatcttatagaaactgtttttgtgagttctaagtgtagcatgtctctgagttctgtgggggtaaatgttctgaatccattttggagcaagagttatttatttatttattgagacagagttttgctcttgttgcccaggctggagtgcaatggcatgatctcggctcactgcaacctccacctcttaggttcaagcgattcacctgcctcggc

SEQ ID NO: 109071 - DNA, 4212 bp, Homo sapiens; identical to SEQ ID NO: 109070

SEQ ID NO: 109072 - DNA, 4212 bp, Homo sapiens; identical to SEQ ID NO: 109070

SEQ ID NO: 109073 - DNA, 4212 bp, Homo sapiens; identical to SEQ ID NO: 109070

SEQ ID NO: 109074 - DNA, 1041 bp, Homo sapiens
atccagtaatgaattagtgttaaacttctaaggctccaggaacttcttgagtattttggtttaaagtagttggcatatttgagggtttttctcccaggtctactggaagctgtgagctgggaatatagtaaaacagaggtcccagcctttttcctgatgagttatttgtgatttacctgaagctttaggcgcactaacccaagatgaagtaaaggcgttgtaatgccaggtgccaacagaaagtcaggtattctcatgccagccacatgagcactccaccccggggcttctttctaaaacccttctgtgctttgcaggcaggtccaaggaggttagagaaacccctgcagtcccccttccatcccatatgtgatgattggattggggagtcttggttaggagcaaaggataattaccgtgtcagagcacgaccaatgaattgtaacaagctgaggtaaagtttaatttcctcttccacctaccgcaatgaaaagctgttgaatgtcaaatatggtttgcacctttgaagtgaaaatgttttctgccacatgtcatcccgttgagcaagtctacacctgttcatctggtcatgggttagcagaaagaatgaaagagagaaactctgtgcctttgagcgaagacatttttcagtacttattactctgtttcactttccagctttcaccttctctgcagtttttctttcatcttgacactataaggaatgcatgagccttccctatggaacattgtagatcttgtttaaatggtaaaaacatctccagctcagctgaccagttcattagaatagctatgtgctacacaagaaacatgaaatattttgtcaggtaggaatctaaggaatcctggtgacgtgggctttcccgtcagtcgtttgctcttttcccttaacttaagccttgtgctgctttagttatcctgtagaataaatggaaaagtaaatggttttattttattttggagacggagtcttgtgacgcccaggctggagtgcagtggtgccatctcagctcactgcaa

SEQ ID NO: 109075 - DNA, 1041 bp, Homo sapiens; identical to SEQ ID NO: 109074

SEQ ID NO: 109076 - DNA, 1041 bp, Homo sapiens; identical to SEQ ID NO: 109074

SEQ ID NO: 109077 - DNA, 1041 bp, Homo sapiens; identical to SEQ ID NO: 109074

SEQ ID NO: 109078 - DNA, 1152 bp, Homo sapiens
atacacctaccaatggcaatgcacttaaaatgccatatcagaacagttgtgcaacatctcaatttgatagtttttctaagaagcataaccaagcttccataaatgtagtgaaagcttttttcatattaaagacatgttatcgggagatggaatgtttccttcttcctacataactgaacagtgattaaatattgactaagagccaggagttgacagccattggcctcaccctggtaaatgctgatatatgatgctgaatgtaaatacagagccatcctctcagggccatagttttgttggttttttttttttttttctgttgggagatggggagccagcaagttgtagcttatgcttgaggtgtcagattcaagtgttgcaatagaagtgtgtaatttgaaacaagtaattctttaaaaagccacccaactgtcaaaagaaaaatatatttttctaatcaatctgaataataaacagaatgctagttagaagttttagcaaaacatccagggtacccactgaatgctgctgtttgtagaaacaaaagagctatccatcactggggcagcttatactttcatagacaacgattgtttggtttatatgaaacaaactggtcgaaacatcagatttattttggggacatgaatatatgtttgggaaattttaaaacatcttatttttgttgtatgtgtattttcttttttgttgttttaaacatctatttaaaatatgcagttgatattttccctccctctatggggaaaatcaaagataataatttttattacatttctttctgttaataaggttcattataagatcttattatttttatcccaagatttttaaaccctgcaggaaatacctggaagacttactcaacagctgtttgtagtgccatgaagcaaaatctgttaattctttattggttagaatgatttaaacataggtctccttttcagcaaatatagcaatctaaaaagtctgcttttttttccagcaagttttaatagacatttcctaacctctaaatcatctatgatacccttattgtgatggtcatctggacatcaacattgctatcttcaaagtataatgaaattaaaagatacttttaaagattattatagttctcaaattattcaaatt

SEQ ID NO: 109079 - DNA, 1152 bp, Homo sapiens; identical to SEQ ID NO: 109078

SEQ ID NO: 109080 - DNA, 1152 bp, Homo sapiens; identical to SEQ ID NO: 109078

SEQ ID NO: 109081 - DNA, 1152 bp, Homo sapiens; identical to SEQ ID NO: 109078

SEQ ID NO: 109082 - DNA, 1158 bp, Homo sapiens
tcaatgactattcttccttgaaatgtactgagaaatggatttcgtgctgctgaaactgaaatgagaaggaatggtcataaatcatagtttagtttcgcacctttagtcagataagcagtgaagtgactctgagtcaaagcgtgtgtgtgtgtgtgtgtgtgtgtgtgtgtctgcgcgtgtgcactgtgtgtgtgtgtgtgtgtgttttgtggtgtgattgtggtctgtgtgtagtggagggatggttaatagaaatgaagcatcacagctggaccagccacagcacgtagaatccttccctggggcctcagtttacaagacaaataatttagagtaaccccttccccctttaaaaagccgaatatttttgtaaaaattaaagtgagcactgaagacagttttgaagacaaagaagaactcacagtaagcgagtctgagtaggtgcgtgactggccagctttggtattgactggcaaggagaagacttgttgagggttgactttgggtctgattagataccagggatttgacctatgtaatcttatttttgtcctctcaacaaactttgtacccctttttagtaaaaagatgagaacattaaaacctaggaagatttagtaacttccacatagctggtaagtggttgagttagaattccaactcccaggtgacttaatttaaaattgacttcaaagtagctcccatatggactgaatataggatacgagcctctgcctagccttcagtcctttttgtttggtttaggtgttggttgtctttgtaaacactggaagctgctgagtcatctccctcggctttttccatcacactttaccccacatacattcatacacacttggctcaagcttttcggttctttctctggacactagatgactgtcagccttacctgggccctgccccagaggctgccccagcatctggtaggagcttagtgagcggaatggattcctagtgaaataatgaatgtctttccttgtattctgtgtttgaaacctccaggatagcaattccatctgctatatgaaataagaaaaagtaaatattctttggttaacctttgtcattcgcctacttaaacctcaatcacatttctttgaaatcatgccagatttgtggagagcaaattgccaggta

SEQ ID NO: 109083 - DNA, 1158 bp, Homo sapiens; identical to SEQ ID NO: 109082

SEQ ID NO: 109084 - DNA, 1158 bp, Homo sapiens; identical to SEQ ID NO: 109082

SEQ ID NO: 109085 - DNA, 1158 bp, Homo sapiens; identical to SEQ ID NO: 109082

SEQ ID NO: 109086 - DNA, 1050 bp, Homo sapiens
tcttagttttttccttctctaagggaaggaacactttgcagcttaacagcattttcaaagtttcaaacaggactggctactgagttgaagaagcattagttggcccttaagtcctcccctctggccactgttgtccacttcacacatttggaccaacttccctcatctgagcctgaatcctattagccagcactgaaaatctggcatggtttcaaagaaatgtgattgaggtttatgtaggggaatgatgaaggttaaccaaggaatgtttactttttctgatttcatatagcagatggaattgctatcctagaggtttcaaaataatcttatcgagatgacttttgacccgtcttcaatagcattacaacaatccccgcagcctggagactaagctctgctgctgttttgagtgagctggccccacagagggtgtgacgtgggagtagagatgagtgtcggcctcaaagtctgctcccatctctcaggaaagcaccttctttagattaaggtattggggctgacactaaaatagatgatatttgaggctaagttttcaatttcactctttccagaaaaacaaagtactgatagggatctactctaaaagctggttttaaatacaaggcgttacagaagtgccaaatgcagtcactgcacttaaaatcatggcctgtggatagaaacaaagctgaagagtggcctgccgagtgtagagcgttctttcacttgtaagaaattaaatacagagacactcaacacaattcctggatgtgatttcctgttggttcatctacacactctagaagattcctgaggagaggtttattgcccaaaggaattcagtggaggtattttcaggtttggctgatttccaagagccccctctcagggccaaattatccaattccctttcttggtgagttcaccacacttcattcattcaccaaaaatatgcatggagagcctaactactacatactaggcactgagcatacagtgctaaaaataaaaaaagataaaatcctagtcctaatgtaggatacatgc

SEQ ID NO: 109087 - DNA, 1050 bp, Homo sapiens; identical to SEQ ID NO: 109086

SEQ ID NO: 109088 - DNA, 1050 bp, Homo sapiens; identical to SEQ ID NO: 109086

SEQ ID NO: 109089 - DNA, 1050 bp, Homo sapiens; identical to SEQ ID NO: 109086

SEQ ID NO: 109090 - DNA, 1010 bp, Homo sapiens
actacggtggtgagcagaacaatcctgtcagcctgggaggggcagtccatcctgtgggcagctccactgaaaggtgagcagtcagtaattggaaggaactggggatcccagccaatgatccaaaacaggtgatttaattgctgcaaccgctcccaccgccagaagggtcatattctcagttcctgcccaaggcccccctctacctggactttatacttggattaagacaggggcaactttggaggaatggatgttttcagttgaaagctttggtatttactgggctgaaagagtgctcctctctgctcctcagactctactcagcagctgggctcaaagttcatagaaattggaaatgcttttagtgaatcattaaaatgttaccttttacagaaactttttattggatataacttatactgtttttatgaaagaggaacttgagcagcattagaatgtgttaatgtatgtccttcatatgctcggtttcctttcttggtaataatttgagtgaagttacaatctttctgtaaaagactatttccagctgggtgcagtggctcacgcctgtaatcccagcgctttgaaaggcgggcggatcacttgaggtcaggagttccagaacagcctggccaatatggtgaaaccccatctctactaaaaatacaaaaatttagctggccatggtggtatgtacctgtagtcccagcgacttgggaggctggggcaggagaaacacttgaacccaggaggtggaggttgcagtgagccgagattgagcccctgcactccagcctgggtgacagagcgagattgtctcaaaaagaaaacaaaaaggctatttccatctttctctgcacattgagaggacctgactttgaaaaaatacttatacatttcatattttcaaaatttttcatgtccacttagaagcatttttttcccctaagctttggctttctgcctttatcattgctattttaagatttttacatgaaaaatgggatttg

SEQ ID NO: 109091 - DNA, 1010 bp, Homo sapiens; identical to SEQ ID NO: 109090

SEQ ID NO: 109092 - DNA, 1010 bp, Homo sapiens; identical to SEQ ID NO: 109090

SEQ ID NO: 109093 - DNA, 1010 bp, Homo sapiens; identical to SEQ ID NO: 109090

SEQ ID NO: 109094 - DNA, 1046 bp, Homo sapiens
atcagttgtattcacttatctgactataaaacagggtaatattagtgagagaggaatctgttactgataaagaacaaggaaaggaatccattaatcccttttgattatcatacagattattccccagtgattattagaaaatacttttatcttaatgaggaaaaatctcaatttatttttaaaatcctggaaaatggaatgccgggtaatattcttatttaacttttgacattttttaaaaagtcatgttctatttggggtatgaacgtgtgtgcccataataattattttcatctgtgtgtgtctatcttgggcctagaaaaaaaatgactcattttcttctaaagattagaattccatgggcatctctttttggtacaattcctttgtttgttcattcctggagataatggagttggtactgatagtgccctccttgtattgtattcagctcagttcaatgagtctttattagggggcctgtcaagtgccaggctgtgcctcaaaggtatggaggcagaggagactcaggcggtgtggaagagcatggcttggggcataggacagacttggctttgaattccagttctaccgcctaagagtctcaccctgtggagctcagttgcttcatcctggatgtgaggatgaacactggtactgcaaggctgttaaagaattgtatgtggtaaagcacttgacaattgtctggaacataataaaggcttcataaatggtaacatgttgttattattttgataatcatctatggtttgggtacagactttttagtcattgtaaaatttaatagtagagtttttgtttgcttagatatctgtatttcattcacacaattagttggcattttagttgtttattagtttttagtcattggcctagaaggaaatggctacagttcccttgctcatctctagtaaggatttgaagtggctggattgtcatttataaggttttaacaagagaatttttaaaaattcaaatgctttaaccatttttcaggcctttggttttcatatttacttacaagt

SEQ ID NO: 109095 - DNA, 1046 bp, Homo sapiens; identical to SEQ ID NO: 109094

SEQ ID NO: 109096 - DNA, 1046 bp, Homo sapiens; identical to SEQ ID NO: 109094

SEQ ID NO: 109097 - DNA, 1046 bp, Homo sapiens; identical to SEQ ID NO: 109094

SEQ ID NO: 109098 - DNA, 3058 bp, Homo sapiens
cttcatttgggtaggttagaggaggagaatcttgagctgggtcctgaaaaataattagaaatttgccaggaggatgtggaaggagatattccaggcagagggaacaacgtgtgtaaaattatggagacaaggaagagcagtttgctctggggaccatatggccatggagtaggatgtgttgacggaagccaatagtaagagggaggctgtggagcaatgtttctccagggttttgctgcatcagatatatattagtagcatttgatgtgcagattctgggcctctccccaggcataatgaatcaaaatcactgaggttagagtttggcaaactgcattttaaaggaagcaagccatatgaatgtgtaagaactaagattaggtgaaccacagacaaggatggaggcaaaaagtagatcatagcaggccttatgtatgctaaggtgcttggatttgggcagagccactgcaggtcagatagatcactggacacagtgtagaagatggaatgaaagaggtttgttggggagtggtgtctgatggtggtgagaatgcattctagtggggagatactagttttaagaaaaggtactcccgaactaagacaagttgggggcagtagaagagagaacagcagaaatacaagccatataaagcacgttgaatcatcagaagctagggggagagggaagggggaagcattgaggaatcggaggagtgttggttgttgggctggcacaaagtgactgcttggaactcagtgagtctttgatgtgctgcttgcaagggagacctgccagggaggagtgatcatgcacccagccttcccagatttcccagaggaaagcagcgatgtaaaatgtgaacatagcgtgactggagcaatgacatctgcaggtgacagggagaaagccatctgcttagctacagcccccctctcctgacactttttagttcatgatcatgatggtaaaaaaatttggagttttgatttggggcataagatgcaatgcaaagaattgagaaccattgtcttacagcaaagtactgacctattaaatatttgggggtgacagaaagacctgacattgaccatggggaagtgaagtaataatcacccttggagagtatcaaggcaaaagtcatgaaagggaggtaaaactaaaaccatatactctgtatgacaggaagggaaatgactgaaattttctggacaagcaccacagtgtctttcttcccgatgatgtcatttggttagaacaaggacttaaccagctactgaattattacagttttccatgactaactgactttttctgttatgtttggtcttaagctttctgttgcccaggagatccacatctacatgttcaacctcaaacccttcacaattattttttacataaaggactgtgttttttgtttgttttgttttgtaaaatcctctagattaataggaggcaacagtaccactcatttctaaagcatactatttataagttggtaaggttgttgcatgcttttgaacttgaatatttattttgtccctcttggaaacagtatctagcacatcactgtaaaacttgattttattgaatgccctttagtttctcttaggttaaaatgtggagcttatacagtcacttgtaatttcctcagtcttaccttcagattcttcctctaaaggatttttctttcttcctttccatttttactttaaaatgaattaagcatgataccaacttcatgcagtttcttattgtgaagaacacattggtaagattgaaatgttattagtctaattctgtgctatattttgaaataaaatcttctggaacaaatgtaaatctaatgattagaaaatgtcacttacatttctcaaaaaacaaacttacaagcaagcaaatttaaagatcttttttttttttttgagacagtgtcttgctctgttgcccaggctggagtgcagtggcacgatcttggctcactgcaagctctgcctcccaggttcacaccattcccctgcctcagcctcccaagtagctgggactacaggtgcctgccactacactcagctaatttttttgtatttttagtagagatggggtaagatctttagtttttatttgcaattctagaattaggcaacacctcattctatggaacagaatgagtattccaataagctgagcagaggaagttgactttatagagaggaaagggtggaggaaagcaggaagaggcagcagaaaattgattgtttgtttcagttactttctttgcaaaggttaaagcagagggggcttccttatgccagctaaaactggcctgtttggtaatttggctgttatgtttctctgctggtttcttgaaaggtcagatgaacaacttagtttcaacttggtggcatggaacttcagcatgaataactctattttggttttggtctgttgggtctaatacaggagctcagttcaaaccaatggcctcctataaattttatataacaattagtattacacaaactggaaagctggctttgcggaataagagcaggttttggaaatagctggactggatcttaatcttttctgtttctgctagccatgtgaccttgagcaaattacttgacatctctgtgccttaattttgacatctgtaaaatgggagtattaatactacttaatttcacaggctttttaggaggtttaaatggcaatgtgtgtacctggctcaaaattactgttagttatttttccttatctttttcttcttcattatcatgatttactttgttttcataacagccaaacaaggccaggcgcagtggttcacgcccgtaatcccagcattttggaaggcagaagcggggggatcacttgaggtcaggagttcgagaccagcctggccaacatggtgaaaccctgtctctactaaaaatgcaaaaattagttgggcgtggtggtgcacacctgtaatcccagctactcgggagcctgaggcacgagaatcgcttcaacccaggaggcggaggttgcagtgagccgatatcatgccat

SEQ ID NO: 109099 - DNA, 3058 bp, Homo sapiens; identical to SEQ ID NO: 109098

SEQ ID NO: 109100 - DNA, 3058 bp, Homo sapiens; identical to SEQ ID NO: 109098

SEQ ID NO: 109101 - DNA, 3058 bp, Homo sapiens; identical to SEQ ID NO: 109098

SEQ ID NO: 109102 - DNA, 1906 bp, Homo sapiens
gctcctggaattttccaccaagttatcttccacttggggcctcatgtatgcaaatgagaggagttgggtaatgaagagggagagggagacactgaacagggcaattatttgacctacattcctttactctggtgttcaagaggctttattcatatttgtgtgtgcagtcctttgtaactgtttgcaaatttcgtctcctcagacattctttcttcctgaggtaatagatgtgcacaccactggggcactcagacacaggtatgctgtcttggcttctctgttagaaaggaaaggctaaggccactacgcagcacagtgaaaagaagcagacttcagggtccccagacttgcatttgaatcttaaccctgggcaaattacttcacctcgctgagcatcaacttctctctcatctgtgaaataatgaagtagaggattacaaagaggatggcactgaacctggcacacaaaatatatgtttatccaataaaagtctccttgctgccttcttgaggagtgccagggatacgggtgaccggggatacaggtgtcttgtcacaagacggacaagcctgctggccaactgacagacaatccaacaggtttaagtgtgataataagggaatatgtgtaagtgtgataataagggaatatgtggtagtggtgagaacgtatggaagacttaagctgagacctgatgagtgagttaggagcttgccatacagtctggtgggagtgcaagagagagcctggcacacagaagtttcgtaaggctgcctaggacaggagggatgggttggggccagattaaaagggccttctcagcctcattttaaaatttggactttatcctaagaatagtgagaaacttattgcagcattttaagtggagaagtgatgcaacagatttggattctagaaagataacttaaggtagatattagatttgaggggtagctacaccattgcctggggtctagttcagttgggacccccagttgaagtcctccagatgagagatgatggaggactgatcttggaaggcttccaggaagaagaaagtagtgctttcattcattcacttattccccacatattaattgagtatctattatgtgccatgcactaacttcaaagggtatggtagtgaacaaaacaaagcccctacctcagtggagctacattcaacataaaacacagatgagtctatgagtaaatgaatgtaaacaaaacacagataacactctgattttatgaccaagttgatacccacctccctgaacccacctttagaaggagaagtcgagtgtaattgagcagttattactcaggcccacctctccaatgcgcagagatctctggggatatctcttaccaggataatgtcacacctgctccagcagccctttttggggctgccccctccctcactaacaagtactagaagggaaccaattcaaagccagggtcggaaactcagacacttaaaggggcagaatattgttatgagctttatggtacacagatggtatctggagcaagaacgtgaactttgcatcaagaccattgggtctgaggaacagtgacctcaatagtaattgctgctctgtggctgcatgacagtgattctccacatggggcctttactgactggtggcccgtgaaggtcctagtgacataaggaaaagctaaccatgccagatctttcttttgttgttaagggcccatgacctgcagtttccctaacattcatttttatacagggcagaggtatgtgtgcgagctcagataccttaaattcatatgcctttaatacaatccaggcagatttctaaatgagggatgcttccccacaaatggagagtgaaagtgggccagcctaaaaggacctccatagcactgtgcatg

SEQ ID NO: 109103 - DNA, 1906 bp, Homo sapiens; identical to SEQ ID NO: 109102

SEQ ID NO: 109104 - DNA, 1906 bp, Homo sapiens; identical to SEQ ID NO: 109102

SEQ ID NO: 109105 - DNA, 1906 bp, Homo sapiens; identical to SEQ ID NO: 109102

SEQ ID NO: 109106 - DNA, 1443 bp, Homo sapiens
aaatgttggcaactaagtctgtttttttttttttttaatatgcagtttttaatcatctgtgggctggattcttcctttatcttttccaaggctgccttgtaaaaacgtccactgctggcatctgcttttcttccttttcactccccagtcctgggtcctttagtctctcattatatcaaatacgagtgactcaaatttagccaaaattttcttgaatttatggaaaagctatatacaaaagtaagtttctgtatacaagtattttatatcaggaagaattttcagttggggatggtaacagttactgtaagtaagatatggttataaatgttgtttctctaaggggagaaatttctgatgtctagtcaatttacaaacctgtgttctagaacataaacatttgtttgtaagtaaaagaaagaaagtacatgcagatgcattaaatccatacttacacccagtatatatgagtacataatatacttttcttgggaattatcagatactttttcctgaatcaaatgatgaagactatttaaagtagaaaagagagaaaaccagtctattctgcatggacattttgttatcacttttatggtaagcagttccataagtgtgtgcctctgttttggcataataaaattttacattacttcttaaattaagtacaagttttgaaaaggaaaaaaaattaacctcctgttataatcaaaatctttcactttctaaaaatcagagtatcttcttttaaagggagttatttattcaataaaaattctatatttctatataccttacaattttttaaaattctggtacacacagtatccttataatcactttttctttctatttatatccttaaaaacatctgcacgaggtaggaaaaaaactcagattttaatgaaatcataaaaacaaaagaacttgatgcagcccacagcacctgctaaccatacaatgtgtttacagttgttattgctacaattaataatatcactattgtcattataagtgtgattgacagttgaagaaactaagtcttaaggaagttaaggccaccatggttataaaattagtcaattttagagactaaaccttattaaatcacaggtctatggacttaaaatccataacctttcatttataccaataaaaaacaaaagaacaaagagggccttttgttattgtaacacctttatgtgctgggtgcattgtccatattagcttatttatttatttttattttttggcaggtactgtatgaggtttcattttatagataaagaaactgaaaaagaggttaagtcacttaccaaggtcacattgcaagtaaatggcaaagccaaaaaaatgctcctatgtctgaatgccaaggctcctgatctcctggagtgcattgtatctaattgatagttgcaagtaaccagtattttactttta

SEQ ID NO: 109107 - DNA, 1443 bp, Homo sapiens; identical to SEQ ID NO: 109106

SEQ ID NO: 109108 - DNA, 1443 bp, Homo sapiens; identical to SEQ ID NO: 109106

SEQ ID NO: 109109 - DNA, 1443 bp, Homo sapiens; identical to SEQ ID NO: 109106

SEQ ID NO: 109110 - DNA, 1045 bp, Homo sapiens
ttgctaccacattttccaaagcttgcctttgtcccctcggtgtatacttgagatgccttcagtcagatgaaaatcatggaaaaccaaactaacctggcttcacagtgatgagattggttggctcctggttaggaaaggcttcagaatgtgtttgtttcattggcccaatggggcatcaccaggaatgctgttattttttttctttaaacttctctgctctgttttttgccgtcagtttcatttacagctatcctcccacaccttccggttgccaaatgattttcctttcctttgagtttattcatcactgtctagggagagggagaaaaagaaatggtcacttccaagaactctctcaaaagagccaggaactattttcccagtcatcctcagcagatttctcctcaatctcattggcccaaatagggtgtggtgtttatccttgaacccgtaagtggagccaggggatgggataatgagccacaagccctaccacctgatcaacttcccccaagcacctgggctttgcaggaggaattgaaggtgctcaaataaaagttaaggtagttactaaaagaaggagagtggtgttggaagagcaactacagtgcctattagactcctgctgttctgagaatcagctccaacccactcctagcagcacccaaggaactggggctcctagcctgactcacaactcttggaagctgctgacccctagtgtctgaggaaagcatcggctctagaatccagaggcatgggtttacctctcatgagaatcacagcggctgtgacacactcacacacacaaggaggttgtaagcaaattaaaacctttagaagtactttaatgagtaagtgagtttaattgaaagtcttccaaagacactgtaagacttaggcctccctcaccttgctgatcagcaacctcagaacactctctgtagtccttttcacacctgtaaattgtcatccacagtgtgtctttctctctagacagagggtgtgctttttgagggtggggcctaagtgcaaaacacccagc

SEQ ID NO: 109111 - DNA, 1455 bp, Homo sapiens
catgcttagtaaacacttgtatgagtaaacgaaagacccaactgttgttcagctctcctttcctctccccttccatagccatggctttctcttataaatatcagctctaccagcttaattgtactccttttttttttttttttttgagagggagtctcgctctgtcacccaggctggaatgcagtggagcgatctcggctcactgcaacctccgcctcccaggttcgagcaattctcctgcctcagcgtcccgagtagctgggactagaggtgcctgccacccacacccagctaatttttgtatttttagtacagatggagtttcaccaagttggccaggctagtgtcaaactcctgacctcaggtgatccacccgcctcggcctcccaaagtactggattacaggcgtgagccaccgcgcctggccaattgtattcctaataggacaactaagcaatcaattgtgttttgaagctgcatgttatacgaatgggaaaatattccaacaaccccaaatacacatctaagcagctgcttttgtgttgtggaatacccactatctggtcagtagagaaagcagaattttttattataagcagatcaacattgctactgtgaattctttgagcagtaggcaaagctgtgttagaatgggttcttctttggtctgtatgtggcaggtaacaggacttctcctgtgcttcatgatttgggttaggaagagagaggaaaggcaacaacatggtaattataatatagaatgactcaagacaagaaagaataggtttttgttttgttttgctcttaattgacttgtaattcaagcgtgaaatgtggcagctttcaggattggagaaactttgcacaaacccaatattagaagttaactgccattagctgtggagggcaccaaaggacagagaggatttctcaatctgggagctgaaggcgagttctggggaacagcagcagccacagctgtagaaatcctgacagctgttcagtcttggcaggcagggctgctgctcacactggagaagctgcggggcttcctgagcagggccctccactcgcgtggtgcctgtaagacctgctctggagtggaggcatgcaccatctttcttttccccttttcacagaggaggagaaaaatgggcagataagtatcatagcggtcaggtaggtcatgggatagggaaaaaaatcaatcattgaaaaggagtgactggaaaaccacactgtaacattgtgccctaaagtattgtatcagttttgccagcctgcacttgtctcttaattatgtaaactaaatgctatgtgttatcaagattgtcattattacaattttgttactttgtagagaataaacatagataataaatattagttctacatttcagttgacagatttcacaattttgcttcagagtccttctttgggatacatcgccttct

SEQ ID NO: 109112 - DNA, 1087 bp, Homo sapiens
tgtcactgcagtgtgagttgtgaaggagagaagcaaacacacaggcaagtgtttacacctgctgccttcttaagtcctcccaataaccctgtaaggcaggtactacttctcttgtacagaggaggaaattgaggcctagctaagttatgcagtgtgcccaaagcatagctaaacagtgtggccaatttttaaatccagatgtttctaactcaagagccctgttcttcttactataccaaatggctcagccctcaagttgttgtcttagaaataaaaatacaaacaacaaggaacatttgttcagcttagtgtttctcaacagagtaagagatagcttctctggagcccttatgctttcactaaaaattcaattgttttgtttttattttgataagaacccattaatattaagcatattctggttcatcaccttataagcaaggactgctctgtgatataagtaatgctggttctatctgtgtttacattgacaccaaaaactgtttctcaacccccagagatttcaagctaatttacccaatatccattcttcccctctaccttactaacagaaccctaatttgcctggaatcagcaatagtcctatgcttctcagactcccttgcagttacaaatgttcatgtggcaaggttttagctcatgatatctgagctattagatggggcttcccagaaagatccttaaagtggctgacttttaagatagatagaggacatatcaggtattaagctggtaagagcaggtgctacatttgatctcagacaaaaggtcaagaagcaatggtcaatgtctttctcactctccagtctttctcctcatctagccaggaaggaaggtgagatatgaccatgagggcaagaacacatactagcgtggtggaggcaaagatataaggagtctgggtctctaatgactacaaaaaacccctcattataccagcccagggtgtggctgtctgcagacacttcattatatacaaaaaataagctaattacccccctctactaaaaatacaaaattagctgggcgtattggcacatgcctgtaattccagttactcgggaag

SEQ ID NO: 109113 - DNA, 1494 bp, Homo sapiens
cttcttaactaatttttattaaattgggggcatctagttactgcagttgagtaagtgttagccttacctgggaagctgtaaatgattattttgccctcaagtgcagctggcagagtcatccatgtccctgaggcacatctgcagagtgagtgggcccctttgagcctgcccaagccacagctcacagtgaggagggaagtgtagcccaaaggtcttgccaggcttagctcacaaggtggcagtcacttagcatccaggaaagcttcattcattgtcttgaggtgagcaagtggccacttgaccagctttcccacaggtagtcaatagaactaatgacagctggtcacaggcacactcctgccctcgatcccaaggccctaaagtgagagaacttctcgagaatttcattcattccaatattttttggacacctactatatgcctggcactgtgccagatgctagatgggcaatggttgacgtgatacatatggcccttgctctctcacggagcatacaatctagtggagcaaatcaacgttacaaatcccacaaattagagggaaaaaaaaacagtatgctaagtgaatttaaagcaggaccttatttagacagggggctaaggaaaaacctccaactttaagcaagagaggtgactcaggtgaaggcagagggcttacaggttgagaaacagcttgtgtgagggccctgagacagttgcaggcacgagcttggcttttccagaaaactcaaaggccaccagtgtgcctagagctgtgtgagcaagattttgagaggtgcaaagaagtcaggagggtagatcagggccaataacataatgctggataacagcattagagatttaggattttatcctaaatgttgtggaaaaccgaggagtttgaaaccaagatgtgacaaaatctgattatgtttttagaagtatttttaattcacaaagggtaaggtttaatggagggcaagcccttaattttttgtatcactttgggaactaaatcaaggagcatgaaaccatcaaaatgatcgaatcaggggcagccgggtgagtgagtggggctaaatttgtgccatctgaaattagggtcaaagttctgatggcttcagttgtagtgacagttctgctgcagaaatcccgtctgtcctttggaaaataaatttgattttaaaaacctcaaaacatagcccaagtagcttaaaccatcagtacaagtttccactgacatctgccatgcaaatttgtacttcttcagccagttgctcttcctcacagttaacgctggaaatcagaggccatgagaagaaagcaagtgtggatatttgggcatggtagatggtgttcattttcctagattttaaaaatttgattgaaagtcaagagtgaaaacaaaccaaccctaaagtcccttagcatcatctcagataaggggagaagagagatgttggaatgaggtaggtaggtttatctaagatgctg

SEQ ID NO: 109114 - DNA, 1001 bp, Homo sapiens
acctaataagaagtgcagtcaagtccagaaccaggtctttgatttgatccaaaattttatcaactctagaaccatcaaagatggcctagattgcaactttggatgaattagcattagtgtaacctttatatatatatatacatatatatatacatatatacgtatatatatacgtatatatacgtatatatatacgtatatatacgtatatatatacgtatatatatgtatatatacacacacatacacatacataccaatgtagctgaagatttatgtatttatattacagttattaaaggtattattgaaatgttaatgagaaaatgtatcgtacttttgacatttttttttcataatactatcccaaacagattaaaaaacacaatagtccactagagggcacctttcttcaacatcacggtctgttctcttccccagtactctattaacctggttttaatcagccactatcgcctcggagcattgaaaagcttttttattgtcagagattccatgtactgctttagcaaaatgcatttgtattggtaggcaaggctatctgtgctgctaagatacctggaatgataaaggggaagcatgacccttattcccctacacacatacacgcatgcacacaaactttgtgttagtttgagcttagcccttcttgacatgacaacccaacttatttttatttggaaagtcttgccttagccctggcaaatttatactacttttcactttttctgccactgcgttctctgactccaaatgctggaaaacagagagtaaaagagatggtctttaaatgttgacataaattggggacgaaacgatgtagacttcacccagatttacctatccgtcagttgctgtttttctacagcatgtgaatttcagttactgttgggcataaaatactatgggaaaaataataggattgtgtccaataaacaagtactctggcagattctattgaaatataaaaccatctcatt

SEQ ID NO: 109115 - DNA, 1040 bp, Homo sapiens
cttggaaagagatttcttactggtgcagcctctgattccacatccttgccctaggggttttaacctgcagcagctccaaccaagcagctttagggaccagatcaaggccacccagccatctgtgctcctgtatcttcccctatcgccaccacaacttcctctttactcgacattaatttgtaactttactcaccatatcttcagtcccaagactgaatgaatgcctgccagacactcctgacccagttcttctagcacctggcccttattttctattcaccatcatcagtttctccctttgctggctcctttcctgctgcccacctagacatttgggtctcccacatcttaaacatcagctacattggcaacctctccaagctaccagcctaatgctctgatttattaacaagcttgttcacaaactctcaactcagaccctcaacttcttagccacaaccacccagcttccacccctaacacacgactactgaaattattcccttggcataactcgtgacttcctaatagtccaaattaatggcttctggttgtttttctcctccgcgtccctgcagtatttgaagaaactaggctctgtcagcgttccctctcttcttgtcacttctcactgtgttagttttcattctcttctcactttgttgactatgtctcctttgcatccccttgctctctaaatgtgggcttcctacccttatctgcagtctcattttccttagtttcagttaccatcggtcaactgtggtgtgaaaatattaagctattttgagagagagaccacattcacatgactgttactacagtatattgttataattgttctattttattacctgttattgttgttaatctcttactgtgcctaagttataaattaaactttatcacagatatgtacgtatgggaaaaacatggtatgtataaggttcagtactatcttcagtttcaggcatccgctaggggtcttggaatgtataccacatggataaggagggactactgagttagttttctatttc

SEQ ID NO: 109116 - DNA, 1171 bp, Homo sapiens
acttgatgtacttcaaagtaagttgcagacatcagtaagtgccctaaatactttagcctgcatatcatcaatttgagttcatgtttattcttgtttattcttttggggtaaattttatgtacaaagaaatgcacatatcttaatgttttattcaatgtgtattgacaaatatacacacctgtatagccaaacacttaatcaactcacacagcttatgccagaaagtttcctatgccccttccgggtcagttcctgacccaggctattcactttcaaaactgtatgctcgatggcctgaggatgtaactttttactattatatttattgtccaaaaccccctttcattctattgttgctaattgccacaattgaaaaaaaatgcttttctggatttaaagacacaatagtttgtaggtggcagaaacaatattttaataaggaaataatctaatttttcttcccttaaaacataccttgaattgagttttaggtagacccacgctgcagcttcactcttactttatgatagattttgatttcaagagcagcctcagttggctcagtcaaaaggggtttatttctccaagtctggtgggtcctcagttagtattcgtcttagtctgttagggctgctgtaataaaatatcataaactgggtagcttataaacaacagaaatgtatttcttagagttctgaagactgagaagtccaagattaaggcagtgtctcatgaggccccgtttcctgatttatagatggcaatggcatcttcttactgtgtcttcacacagcagaaggggcaaggtagctctcttgggcctcttttaaaaagggcatggatcccatttgtgagggcttcaccctcatgacctaatcacccctcaatggccccaccttttaataccatcatactggtgattagatttccacatatgaagtttgagggcacaacattcagaccataggagcattgttttctatggaacacacttatttggtatgaacccagaaaatcatgtttgtttctttgttttccttgctttgatggctttttgttgttgggcatgccacaactttcttagaccttggtttccatatctgaacaataacagtgtcaggctaaatgatctcttgaggtcccatctaaatttgaaactcaatacttttta

SEQ ID NO: 109117 - DNA, 1343 bp, Homo sapiens
caagtgtttctcataaggtcagatttcacaatggtaaatatgtgcaggcaaaatagtacatttcacaagactcaaggcagtggtttctcagctaagtaacgtgtgcctatgaaatgtatttatatactttgtcttgcttaataactagaaatttgtacttacagatttatttcatagtattttcattttatggtacatttagggccatagatcctaaatattgagcgtcatgcttcacagtaattctttccacgagaaaggggtcagagatgctgagaaaaaaaccaacatgtcacttacacataatacagaacttgagggtaggggatgtcaagtatccatagagagcctaatctacacatggcatggctccaggtgattgaattactataataattaaaataactctctcttttccaagaatctatttatttttgaagggcaaactactataagattattccatatgtcttttcattaggttgaacataaaagcattgtttttgtaggttgaaaattggtcaaatatcagcaatttcatctggagagaaggggttatattagcattctacttcttccaaaggaagataaattgattttattttacatgagctgcaatatataacagtgtcattatgtgtttaatagttttgaagtatttattgcttattttcacaataaaattaagtgtattggttgggtaataatggtcaatagattttgcatctgcatgggattttatagtagaactacctacatgtgtatgttcttttgaagtgctctctctttatacatagctcagcaaaaacagaaacattaaccttgaagccaaatcttaatcccacttagaaaccttcattttagaacccagctggcaccacatgcaactagattcagaaaaggtgctttcttgaagtccttagcttgatgtttgtagtcactgatgatatctgcagttgaatggctttcggaaacttccccaccattttacaaggacttacttattttttaaggatgatattgcagtggttaaaagcaaatttcttagattagcatttttagtcagttgatagaattcatttgaaatattgattccttttctcccataaatgatgtatgccaagatttcttaatgggtagtccatgaatgggggcttcaggggccattcccctgaaaattgcatgcacatttttgtgcttttgtatagatgtacatcattgttgtcgtggttgttattgtcatcataattacagcaataatagccttctatgtgttctacctacccctgcccttgcccacactccatagtctattttcaacacagtttccaaaatgagctttt

SEQ ID NO: 109118 - DNA, 1031 bp, Homo sapiens
tttgatggggaattttttttctatagttaatagtgctgaagagtacttggtcttcattgttttgcctgtttaaagtataattattgtctgccttgttgagatatagttctgtttttccaaagagggagtaacctttgaaatcaataaaaaaattttggagataaatttatatgcattttttttttagctcagatgtctgaaaatctaatttatatgctttaccacaaaaggagcacaatgataagagccccacatggaaaaaaaaaattagcagggcttcattgtgggcctgatctgaaatagaaatttagtacaagcacatcatttctatttaaagtagcatttgggcctcaaacttcatgattcagacttcgagtgattttaagaagtacatatgtgaaacatattttaatccaaaggtctagtatttattcttggaaaggatggtggtgatggggggtgggaaggaaatggggcatctctatggaaaatatcacattgcattgatgcttgcttgaaagtagagacaccctattcatgcacatacataacgcacaaatatataaaatcttggggaactaatcacagttttacatacagaagcccaacattaatagagccctatcccattgaagtcatatcccattatttatttatattctctataacaagggaaagtttgaaatcttggtgtacttagtattcccctgtgcactatatagaagcatcagaaactaccaaacttcctgaaatagaaagtaatttgacaaaactgcttgaattcaaaagaaaacaaccatcagagaggcctaagtgacaatcagtgtaggaaagccattaatggggaaagaacacacagagaaacataatgaggacattaaaattggttccacttggaagctgtgcgatggtcatcagagtgaccacagttgagtttctcgtgcttggttttagttggacaggaagatttacaactatggcccacgatcttttagatgtaggaaaatgtgtgatactctgtctactcccag

SEQ ID NO: 109119 - DNA, 2227 bp, Homo sapiens
ggatgacatcatcagtcaagaatcctcattggatatggaggggaattataaaaaggtaaggggggagagctcttttgtttataaacaattgaaccatttttctaactggagaaagatcacccttgaggagtggccaaattccacactcagtggctattgccataatatagtcaggaaaaactaaatgcacagaatcaaatgcattaagctaggaaagttctttctgcttttcccagcttatgttcattaatatgttacagcagcaactaaaacacacatgttgttattctgaagttgaaaaaattctattatgcatttaactgctaggcaggctttttatgtgaaggaattttttaaaaattattgacatatatttacagttcactggcaaaaaaaattactagaatgtttaacctatttttccaattttttgtttgattttattggcaatgaaaaatatcaagttttagttaacatgtttggggtttttaaaagttgatacagtatctgttcatcttttccctgcccttttttttgaaagtcagtaaatatattttgagaatgttttatatggtaatgttctggtaatcacaggcccgagtaaaaatagctttagttatatgggtgaggtcatgaaattaaactacaagtatatgcttatctgtccacagaagcctaaaacacacactatgtccttccctcttcattatttgccacaagtcaagtgtagttcacaacatggcataacatgaagaataaaatcccttccatcatgggcctggaaatgaagacctctttacctcagaggcaaatatcagttaatgatagaacagtaaaacttgctacttaatttttaatttgatcaaatacatcactaacttttttcccaggaatgacatatagaaagaagcttctgtcgtgatagatccttacgtatagtaatgtaaaatatggtagtttatatcttatatacatatatgtgtgtgtgtgagtgtggggactgttttaagtatatactgtacttcctagaggagttcacaacagcttatgttctttctccacaagctgaaacttaaatatgtgaaagcggtttcagtaacctgccatgttgccgtttgtgtttttcatcccttgtgatccccaagacaggaatgagcaccaaggtgatagttcgctgagtctcataaccctaacacttcccagctgtccgcttctgccggaagcgatgtgcaaaagatgcttgggacactctgccgtaagagtcagattgcttatccagctctgcagaacaagtgtagccatctcatacttctgctattttcagtgtcaaagaactggtcatggtgtcctttgtcagaccatttctcagatagaagaggataggtcagtttgcacttaggaaaaatgaaacataccattgctaatgcattaacaatgaagtcatgactgttctagttttttcctacttagaaacagagggaacccagatgcctggaataagtaagcagtgatacaccagcaacctgagacagggctgactaaagctacagacatgtacggctcaaggagctttaaaacatcaacaacaacaaaacagaattgcactgtgtaacccattatctaacaaaggcagtagaatgccgcatatgatttcagtatctgataggttagtacaaaaaaactgcaagatgaaacttctagatgtgtggagtgctcagagatcagttcattatgttccggatcttaaacatgagggttgttctcttgtcattccggccttttaaataccttcctcaggcaaagtgttttcaaatgtttatgtgtatcgtgattattatgaagacttcattataattatccttcttttttaaacccactctttgtaattttactatgagctagtgaaacagggcaacatacacttttttaaaaatatgaggaataagaaaatagttacctagtataaaaataactttccctaattagaatcttccttttctaattttttcgctaatatttttcctgttttgttggctaagtagaaaattaaattagatgccgtaaagtggggctctgcaggcttttttgaccttgcattcatcagtaagatggttttgagtccatgcctgtaatatacatatattttattcagaaatagcacccaccactataaaatacaatgtgtgtatgtaaaacatatacacaaatagatattttagagaataaa

SEQ ID NO: 109120 - DNA, 2227 bp, Homo sapiens; identical to SEQ ID NO: 109119

SEQ ID NO: 109121 - DNA, 2227 bp, Homo sapiens; identical to SEQ ID NO: 109119

SEQ ID NO: 109122 - DNA, 2227 bp, Homo sapiens; identical to SEQ ID NO: 109119

SEQ ID NO: 109123 - DNA, 2227 bp, Homo sapiens; identical to SEQ ID NO: 109119

SEQ ID NO: 109124 - DNA, 2227 bp, Homo sapiens; identical to SEQ ID NO: 109119

SEQ ID NO: 109125 - DNA, 2227 bp, Homo sapiens; identical to SEQ ID NO: 109119

SEQ ID NO: 109126 - DNA, 2227 bp, Homo sapiens; identical to SEQ ID NO: 109119

SEQ ID NO: 109127 - DNA, 2227 bp, Homo sapiens; identical to SEQ ID NO: 109119

SEQ ID NO: 109128 - DNA, 1083 bp, Homo sapiens
gggcccagggccgggccagccgctcgcttcgctttgttcctcaggggtgccgtctctagtgttgtgcatccaattatggtgaaagattagggaggaccctgtgaaaaaattaaaaggctggaaggaacaatatttaaagtgaagccacagctgcgcctcatgttttttttaaaaggtgaatggaaatgactgcttgagataaactgcaataaacaggaacacagaatgccagctgccattccagacaagctctctgccctccccacacaattactgaggaaaaacagccgtcgacctccattaaccctcacgtcttcctgcctgtgagggctgaatacgcttgaagaaccatgttaagttaccgaagcctgggacctagccccacctcagccacctgggaaaaatctcttccgctttgtgggccaggttctccttttcttaaaaagaaagaattagcctggtcggtcttagatgttataaatataaagcttcctggctcgtggttcaggtttcttatcatatcaccccattggcacacctcggttagccagcatggtcagggaatgggctgtttcaggtaactagaatttccggtgaaatgcaagtgtgttagatgtattcttgttctcacacacacatgcacacaaacgtgcacacacatgtccccttccatgtcatggtcatcttctacagcactctctacttggtctctttcccttctcctcgctagttgccttaggcttccagctctcctcattttcgtgtgtgtgtatggcttttttaaaaattgagatataattcacatacataaaagccacctttttaaagtgtacactttgatggtttttagtatattcataaggctgtgcacatcgtctaattccagaatttttcatcaacccaaaaagaaaccccgtacccatcaggagtcactcccaaatcctttcttctcttagcctctgacaaccgctaatttactttatgtatttataaatggacctgttccagacatttctggctccttttttctccctttctccattcttctcactaccttccccaccccttccttttaatattaat

SEQ ID NO: 109129 - DNA, 1083 bp, Homo sapiens; identical to SEQ ID NO: 109128

SEQ ID NO: 109130 - DNA, 1083 bp, Homo sapiens; identical to SEQ ID NO: 109128

SEQ ID NO: 109131 - DNA, 1083 bp, Homo sapiens; identical to SEQ ID NO: 109128

SEQ ID NO: 109132 - DNA, 1083 bp, Homo sapiens; identical to SEQ ID NO: 109128

SEQ ID NO: 109133 - DNA, 1083 bp, Homo sapiens; identical to SEQ ID NO: 109128

SEQ ID NO: 109134 - DNA, 1083 bp, Homo sapiens; identical to SEQ ID NO: 109128

SEQ ID NO: 109135 - DNA, 1083 bp, Homo sapiens; identical to SEQ ID NO: 109128

SEQ ID NO: 109136 - DNA, 1083 bp, Homo sapiens; identical to SEQ ID NO: 109128

SEQ ID NO: 109137 - DNA, 1017 bp, Homo sapiens
ttcaggtttaggatgttatttcctgaagtgtgttcctgagaaccctagaggccccccagattttcccacaaaaaatatagtttgttaattaaatagattttgaaaatgcagaaaacacccaatcttccacttgtaaatttacgtgcagattagcatgctgaaggcttcttgcttcagagacaccacaatgctgctagtaaggtgggctgggccagaggcaggaaggcagaacctggggaggggatgcaggaatgatcttggtgtgtaagggatggggccatgccatatgccgaaaaaaagggtggaaaggtcctggggacatattagatttgaagatagatgatacctacccatgctgaacattttgctctttatttcattactgaatgcccctctttgttcttgtccagattggggaattgcagtagaacagggcacatcaggaaaggctgagcattggtgttcagagtctgcaagtgctcagtggtctgttctaagatcatggtggcttgcatggcatcattgaaagtcattgtgagcctcatctgctcaggcacagcgggtggcagtagggaatttagcaacagatgaggacaaaaacttcctggggctgaatagcggtgagtttctaatcacatttttactttcatctggggcttgaatagcttttctgcctgatagtgatgagccctgttcctcagttgccctttgtttttgctagcaatactaattttagatgttgtacttttgttttatgagggtatttcccaaggctgttttaggagtggacatggttctgcctgtcataagtgcagccagacagtggtgttttgagtcagcctcttccttttcctgtacccttgtctgtttctcaccctggagcgtattgggcttggctggattaagggggctggtggaagacatatttgccttgcaggtataattcctcagagaacaaaccgcccttgaaaccacacacacatatattttacacatgtgggcaactgaaagaaaatt

SEQ ID NO: 109138 - DNA, 1017 bp, Homo sapiens; identical to SEQ ID NO: 109137

SEQ ID NO: 109139 - DNA, 1017 bp, Homo sapiens; identical to SEQ ID NO: 109137

SEQ ID NO: 109140 - DNA, 1017 bp, Homo sapiens; identical to SEQ ID NO: 109137

SEQ ID NO: 109141 - DNA, 1017 bp, Homo sapiens; identical to SEQ ID NO: 109137

SEQ ID NO: 109142 - DNA, 1017 bp, Homo sapiens; identical to SEQ ID NO: 109137

SEQ ID NO: 109143 - DNA, 1017 bp, Homo sapiens; identical to SEQ ID NO: 109137

SEQ ID NO: 109144 - DNA, 1017 bp, Homo sapiens; identical to SEQ ID NO: 109137

SEQ ID NO: 109145 - DNA, 1017 bp, Homo sapiens; identical to SEQ ID NO: 109137

SEQ ID NO: 109146 - DNA, 1154 bp, Homo sapiens
tatgctttgccagtgttttctctttttctgagaaaacatcacatccatctcagggaagaagtagacccataagtctttgtgccacattttatcctctgcatggtacccaccattattattagtctgaacaccttactctttaatgtggaaaagtgatgagaaaaagcagaaagatctggtattaggaagcatggacttggatcctactgctcctgcctaacagtatggtaacctttcatctccctcagtttcctcatattcaaagcagaaattgttggagtatgaactataatgctaccatctatcacagacttacattaccacaggtcaggtacagctgctaagtaatttacttaagttttctcatttaatcttccagcacctagtgagatcctttacctctggactgggaagagttttccaagcacaaaagccactgacagcatgacagatgaagcaagctattgacttaactacataacatttacagttgaaactcaaaaggacaaatactctactataaaatgtttaaaattctcagacctttgtaggaaaataagcaaagctaggaataagtaattcagagaaaagaaagtacagtcactaaaaacatttaaatatttactctcactagtaatcaaataaattgaaatttaaaaactactttttgcctatgaaattttttaaaaaacttttttttttaagtgaaaatgttcagtgttagccaggatgtagtgaaagctgcaccctcttacattgctggcgggcatgtggattggaacagcttttttcgagagcaatgtgacaaaatgtgtcaagagcctcaacaaatgttcacacttagctgatctgctaattccacttccaggaacttatcctgaggaaataatcagacatgtgggcaggcatttatgtaaagaggctaatttctggtcaggcatggtggctcacgcttgtaatcccagcactttgggaggctgaggcaggcggatcacgaggtcaagagattgagaccatcctggccaacatggtgaaaccctgtctctactaaaaatacaaaaattagctgagcgtagtggcgcgagcctgtagtcccagctactcaggaggctaaggcaggagaattgcttgaacctaggaggtgaatgttgcag

SEQ ID NO: 109147 - DNA, 1154 bp, Homo sapiens; identical to SEQ ID NO: 109146

SEQ ID NO: 109148 - DNA, 1154 bp, Homo sapiens; identical to SEQ ID NO: 109146

SEQ ID NO: 109149 - DNA, 1154 bp, Homo sapiens; identical to SEQ ID NO: 109146

SEQ ID NO: 109150 - DNA, 1154 bp, Homo sapiens; identical to SEQ ID NO: 109146

SEQ ID NO: 109151 - DNA, 1154 bp, Homo sapiens; identical to SEQ ID NO: 109146

SEQ ID NO: 109152 - DNA, 1154 bp, Homo sapiens; identical to SEQ ID NO: 109146

SEQ ID NO: 109153 - DNA, 1154 bp, Homo sapiens; identical to SEQ ID NO: 109146

SEQ ID NO: 109154 - DNA, 1154 bp, Homo sapiens; identical to SEQ ID NO: 109146

SEQ ID NO: 109155 - DNA, 1048 bp, Homo sapiens
attaatgtaaatggaaatatttttaaggtctcctccaatatctgtagctctagtttatcaagaaagatagacatggaatcaagggtatattcacacattcataccctgggataagagttttctttaaagcctgtttcagaccctaggctaatgtcaggccagcatgttgttgaacattaatcattaaaattcatgttgctatctactgattttatatttggatattcagctatactcaacagttttctgcctgttgaggactttggtgagaatctcttttgtctgtgatatggattgagaaaaaggttcactgactgtacaaaatctgcctggcagatatggggatttgaaatgaacttgttttaaataaaggtgtcaagtgatgtgattctgttttggctggaccatcccaagtgccagccttgcatattcggaaaggtggtttgccctaattaaggttccaagcagtacagttgcaagtggttagtgaaataaaaggcattcttgcttccctccataaccttatggttactttcttaaagcttggttttgtgctagcccggcaaaaaataagaactatgaaagcagtctttcacatctgtaaaaaaaacaaaaaatctgtataaaagtagtctttcaccttatggctgtactacacacacacacacacacacacacacacacacacacacacacacatatgctagctcctagtatgatgcagtttcattgatacatgctaaaagggggtgctatatatatagacagagataatcactaagtgtgtacagtagaaagaatgcttatggtgtccaaggattaaaaagtgtgagagaaaaggagagtagagatgaggtttctttgaactagttctcaaacctgttgaaattaaatatctggcactagagcctggggcattctaatgcagcctgttgaagctggatcttgggaaccactgtcttagctgtactttgctgtcatgtattttattctgtgctgtctagtacagtatccactagccacctgtgatggttgagctcttgaaatg

SEQ ID NO: 109156 - DNA, 1048 bp, Homo sapiens; identical to SEQ ID NO: 109155

SEQ ID NO: 109157 - DNA, 1048 bp, Homo sapiens; identical to SEQ ID NO: 109155

SEQ ID NO: 109158 - DNA, 1048 bp, Homo sapiens; identical to SEQ ID NO: 109155

SEQ ID NO: 109159 - DNA, 1048 bp, Homo sapiens; identical to SEQ ID NO: 109155

SEQ ID NO: 109160 - DNA, 1048 bp, Homo sapiens; identical to SEQ ID NO: 109155

SEQ ID NO: 109161 - DNA, 1048 bp, Homo sapiens; identical to SEQ ID NO: 109155

SEQ ID NO: 109162 - DNA, 1048 bp, Homo sapiens; identical to SEQ ID NO: 109155

SEQ ID NO: 109163 - DNA, 1048 bp, Homo sapiens; identical to SEQ ID NO: 109155

SEQ ID NO: 109164 - DNA, 1081 bp, Homo sapiens
gaagttggcacttggaagcttctttgatgatggcccaggaatttataccagctgtagcaaaagtgggaagccaagcctttcctcccggtgagtgttcttttgagttgaatttctgatatgtacacagtggattctgtcacttgactattctaataaaaaaaagcctttaaatcttctgtagtttttttttccccctcgcataatactgccatctttatttgggttttagacagacccttccccacttgtttgtcggtttctttgttgttgttgttgttattattggctcatttcccagctacttgaggtcagatttttatattccattttttttctagccacaatactgattctgtacactgatagaggaatcaagccacactcctaagcaagctgacttatgattagagacatgtggcagactaccaaatttcccattaagcagtcccagatcacccagaatcacccccctgacacatttgattgcaataaatactcgtaactgagaaatacaattcccgctttgatcattcaatgtttattacagttcttaacctgtccttctggtggtttttctttatcttaatttatttcaggatatcattactctttatcataatttatttcagaatattattggtcatttgcgtagcttctaattccaagtaagatatttaaattataattttatccaaaaaacagtgctataggccagagtttctcgaactttaatgtgcttatgaatcatctggggattttgttaaaatgaagactctgattcagtagatctaggtggggctcaagatcctccatttctatgaagccccagctgtgatattcatgctgccattccataggctactttgattagtgaaagtatagacagtctgaaaaattaggcattacaaatacgggtattccaagtgatgaaagcatgtagaatgtttttactaagatgatagtaactgatcagcattctcatggtctcccctcactccccaaatgtctgtttcctctcagtcttccttttggctaaaagcaaatatactctgttaaaatactcagttattttaccatctta

SEQ ID NO: 109165 - DNA, 1014 bp, Homo sapiens
tatctggacaggaaagtcctttttgttattctttttcttcagaagtatgctgcctgttacggctttttttattcctccacataaactttaaataatataatcaagttcaacaaaatactctcttggaattttgactgtaattgcattgattctatagaccaatttaggaagcattacattttctcattgtctttctatccatgaatatggtctgtctcccccttatttagatcttattaggtatttcttaataaggtttagacatattacacatctcttgttatatttatttctttcttaataaggtttagacatattacacatctcttgttatatttatttctagatacttgctattctgataaattctcttcagtaatgctttctcatttgctgctggtgaacagaaatgcaattaactttgtatactagtattatattcagccactttgttattactcctattacttctctactctcctattatttctaataaagttgtctgtagattccctgggatttttaaagaatgatatcatctacaaataatggcagctttatttattcattttcaattctcatgcttttggtttctttgtcttattggattggctaggtaccctaatacagtgaggattagaaatagtagtagttggaatccttagctaatttctcatattaaatgaaatgtttctactgttttcccatttcagatgatgttaattttatgtttcctttaatgattctctttatgagatgatgttccctcccaggtataacttacaaagaatttttatcatgaatgggtatttaactgtatcacatgctttttcttcatctgttgagttgaagaaaaagtacaatttcactctgttaatctattatatgaattaatgaattacatttatagattttcaaaatattaaaccatgctagcatacccagtctaaacctaaagtggttagggagtattatattttttcagatactgttggagtattatattttttcaga

SEQ ID NO: 109166 - DNA, 1014 bp, Homo sapiens; identical to SEQ ID NO: 109165

SEQ ID NO: 109167 - DNA, 1014 bp, Homo sapiens; identical to SEQ ID NO: 109165

SEQ ID NO: 109168 - DNA, 1014 bp, Homo sapiens; identical to SEQ ID NO: 109165

SEQ ID NO: 109169 - DNA, 1014 bp, Homo sapiens; identical to SEQ ID NO: 109165

SEQ ID NO: 109170 - DNA, 1014 bp, Homo sapiens; identical to SEQ ID NO: 109165

SEQ ID NO: 109171 - DNA, 1014 bp, Homo sapiens; identical to SEQ ID NO: 109165

SEQ ID NO: 109172 - DNA, 1014 bp, Homo sapiens; identical to SEQ ID NO: 109165

SEQ ID NO: 109173 - DNA, 1014 bp, Homo sapiens; identical to SEQ ID NO: 109165

SEQ ID NO: 109174 - DNA, 1032 bp, Homo sapiens
ttatttttcatttgttttgctttctgcccaccaataactaagtataagacactaaaagctgtttataaactgtggttggggctagttggcatgcatcatctgcttagagagcccttccctgaccaccctattaaaagtaaacgttctcgtacccatcactttgtccggtcttaccctgcttatcttcttaccctgatttgtttgttggggggggtgggggggggcttattataacctaacgttgtagtatatatactttgttctgtctttctctagctctaaaatataagctctaagagagcaagacttcgtctctattttgttcaccactgtaactattgcctaaaatagtatctaatacataatcactaaatatttgttgaataaatgaatggtgaacttcactatagaatggctgaataaggacacagctctttcattgggatgcatctaattgaaagtatctaggagtcttttctcttgggctatgaattgcgactgagagaaaccctccaacctcatcttgaggcattttaaacctggctgccaatgttttaagactctagcaggggaaagataggaactgtagcatataaaattttacttaatttccttgatttcagtaaagcatctctttgccacctcagctgtgcctgagcatgctccagtctcaacctcttaagacaataaatttcctgattctgccaggccacaggtggtcagggcagatagcagggcaagagggtcctttcaggtgttaaatcaatctttgtgttcggtcctacttcactcccctactttcagctgtatctgagcatttcgaggatcctgcagtagaaatgcatgtgcttcctctaccagcctcccctgtgggcacatggtagattgaggtagttaagtcaaatactccccacccatctgcatattatcttctaaaatttcatcaaaatcccttgtgtgctgttgtttccatttcctttttctttgtgcatatagatttgtaccttctttttttctttaatattattttag

SEQ ID NO: 109175 - DNA, 1032 bp, Homo sapiens; identical to SEQ ID NO: 109174

SEQ ID NO: 109176 - DNA, 1032 bp, Homo sapiens; identical to SEQ ID NO: 109174

SEQ ID NO: 109177 - DNA, 1032 bp, Homo sapiens; identical to SEQ ID NO: 109174

SEQ ID NO: 109178 - DNA, 1032 bp, Homo sapiens; identical to SEQ ID NO: 109174

SEQ ID NO: 109179 - DNA, 1032 bp, Homo sapiens; identical to SEQ ID NO: 109174

SEQ ID NO: 109180 - DNA, 1032 bp, Homo sapiens; identical to SEQ ID NO: 109174

SEQ ID NO: 109181 - DNA, 1032 bp, Homo sapiens; identical to SEQ ID NO: 109174

SEQ ID NO: 109182 - DNA, 1032 bp, Homo sapiens; identical to SEQ ID NO: 109174

SEQ ID NO: 109183 - DNA, 2134 bp, Homo sapiens
ggagtttcaactgttcctgtgagcgtgagttcctctcagttgtctgttgggttttagccccactggatttttctagatgttgctatctcctaaagcacttcttaagagtgacaagttgttaaatgaaagctaggcttacaataatcccataaagacatttcatgcctaatagtgcagcaaaataatatttgatgttgcttcataactcaactaattaaatttgacttatactgaaatgtggcaagtagagtgtcatttttttcttcaaaatttgctaatccacacattatcagccctttacaaactgaaactgtataacctttgtcattttttctatttaaaagtgtttccgtaaaaagttttttaaagcttaaaatgaaatgagaaaaatgaattatctatttttgaaataaggtttctaagaaatattagggttagtcatattcttgaagaaacattttttctattattactagtatgatactttcctataaaatatgttttcattggccaaactaattatcagttagcattatgtttcagatgatgagcttgtatagcttagtgtaattaaaggaatagaaacaggcttagctgctgtgggaacacaagatagtctttattaatagatatctgggaaatcttttattttttaaacattacaacctgacctaacattgtgaaggaagttttctctgccttctccttttaccttttctcagagtaaccacgaaataaatttgattctcacctctcttcttaccttaccccaagagagaacttatttacatacatatacatataaacacagtctttttcataaagtgtgcaatgggatgatgtgacctgaaataggctataccattttctccaaaggctgaatattatgaaaaacagaaattccccagagaacttttgagcagctgctttgaataatgattactgtttacttaactcaaccattccaacatcacccaatcaaaactcatttctttcttggccttataggtttattggtaaatggctgagacaaggccaataatggacacctgccatctccttttgtgtttgggctggagggcaaggagtggggggcaccctaactgggagctgttatcaactggaccaataacagtgaatccagagagacttcaaagaaataggattcacagggactttaaaagtgaggaactgagaatctgtatatacaatgtgccacgaatcacaggtcgaaccagcatcattttgccaagaaagtcaatcatccttttgtctctaacagtaataattgttgtatgattttctggaagaagtaagcacaacggttatatctgcccagcgttaatgaggaaagaggttgtctagttccaactcagtgaaattgcctgtctgtggcatctttcttgaaataatagatgcatactgtagcaacctatttataacatgcaacatatctttaacatttcatattagtctcatacatatatactaaagatttgctttaaaaacccttcatataagtatttccaaggtgtgtgtcattgcaaatggtagctaatgatgacttcttttttttcactatttgaaaggccactgggtagtctaaaaaaaaaaaaaacaaaaactatcattttttatgcccctcctctaaggattgcttccagtattcaaaaatattacacaatttcaaaagtgaagcaagatttgaagtagatcttttgaggagtaataagattaaaatggcaaaacaaatctaattatgtaagcaattcttctccttcacaaacctgaaagaaaagcaaattggtatttgtgaaattttctttgtctaataaatagtctcactttacaataacaccaatgaccctggtttaattaggtgcaattaattttatgcaagctgaatttgacatcttgctagaggcataaccagctgtaccctgtcttatgaatttttttttatcaccaatgagaattcaattgcctgagctattgcaaaagagggggaggcaggaagaaaaagaccacagggctgcattttatatttaaaaatggctctagtagacagctgaatgtttaattaaaagagtttctaggaattatttttcattggtgcatcatctttgacaagcta

SEQ ID NO: 109184 - DNA, 2134 bp, Homo sapiens; identical to SEQ ID NO: 109183

SEQ ID NO: 109185 - DNA, 2134 bp, Homo sapiens; identical to SEQ ID NO: 109183

SEQ ID NO: 109186 - DNA, 2134 bp, Homo sapiens; identical to SEQ ID NO: 109183

SEQ ID NO: 109187 - DNA, 2134 bp, Homo sapiens; identical to SEQ ID NO: 109183

SEQ ID NO: 109188 - DNA, 2134 bp, Homo sapiens; identical to SEQ ID NO: 109183

SEQ ID NO: 109189 - DNA, 2134 bp, Homo sapiens; identical to SEQ ID NO: 109183

SEQ ID NO: 109190 - DNA, 2134 bp, Homo sapiens; identical to SEQ ID NO: 109183

SEQ ID NO: 109191 - DNA, 2134 bp, Homo sapiens; identical to SEQ ID NO: 109183

SEQ ID NO: 109192 - DNA, 1078 bp, Homo sapiens
ttattacctggtttgtgggctgatagagttaagtactgcaatcatgccaccacctacctgaggtacagcagctgagatacatccctattttaggctgggagcagtggctcacgcctgtaatcccagcactttaggaggccaaggcaggtggatcacctgaggtcaggagttcaagatcagcacagccaacatgatgaaacccccatctctactaaaaatacaaaaattagccaggagtggtggcgggcgcctataatcccagctactcaggaggctgaggcaggagaatcgctttaaccctggaggcagaggttgcagtgagccgagatcaccccattgcactccagcctgggtgacaagagcgaaactctgtttcaaagaataaaaaataaagactgcaaaatgtaaataaccatgcttcatagaatcaatgcaatcttattgatccactgcattctttttcacgactgcgtagaattcaaacagtcacaaactaaatcatgaaagccagtgtttttgagatgaagcttaccatggaaccaagcctaaatggtggccccaaaatgtttctaaacatgaacataaaaagtggtaaagcagtgctttaatggtcaaaagaataaaagaatttgcaattaagattttcgcctacttcaggaatatgcctcagaaacacacacaggcactgactctccgctgtcatgttttttacccagtccgcatgaacattttcaaaggtctggaaggggaaaagtatttcttctctaaccttcattgcctcaacagctgaaactcatcagcaggtggggtagataggtgtttaaactctgtctgagctgagcagaataaataggcagcctggctttaaaaatacaaacagttaaatttatatcaattacgttagagtctgtaatttactgcagatccaaggaggagaatgaaatcaagactggattgaggagggatgtcaacagttgaatcagagtccatccacagaaatgttctcttataagaaaatatgtttcttgctgcccacggatctcccaccacctccagcaccctgccaaaaacaaaagtc

SEQ ID NO: 109193 - DNA, 1078 bp, Homo sapiens; identical to SEQ ID NO: 109192

SEQ ID NO: 109194 - DNA, 1078 bp, Homo sapiens; identical to SEQ ID NO: 109192

SEQ ID NO: 109195 - DNA, 1078 bp, Homo sapiens; identical to SEQ ID NO: 109192

SEQ ID NO: 109196 - DNA, 1078 bp, Homo sapiens; identical to SEQ ID NO: 109192

SEQ ID NO: 109197 - DNA, 1078 bp, Homo sapiens; identical to SEQ ID NO: 109192

SEQ ID NO: 109198 - DNA, 1078 bp, Homo sapiens; identical to SEQ ID NO: 109192

SEQ ID NO: 109199 - DNA, 1078 bp, Homo sapiens; identical to SEQ ID NO: 109192

SEQ ID NO: 109200 - DNA, 1078 bp, Homo sapiens; identical to SEQ ID NO: 109192

SEQ ID NO: 109201 - DNA, 1040 bp, Homo sapiens
tgccagctttttgttttggttttgtttttgttttgctttctttcttttttttttctttcttctctttttttctaccattaatgaatttgtttcctcctttttaaagtgctctgacatctcaagacggactttcctaaagtatcagtgttgtgatattgtgtaatttaacctctctgagccgttttctcatatgtgaaacagggttcacagtgcctgcttcatgtgtatctgagggttagacataaaatagtaaaatgcctggcacttagtagatgctcaaaaacagtaacttttaatttcagaatacagattacttggaaattacttggccttatttaacatggaagtagataacatttgctgcctacgagagatggctgttttattcctcgtatcagaagaggcctcgttctggtctttcattcatgctagagaacatttcagttgaaaatgcattttcccaacattaagatcctataattccaaatttaattacatgaaagtggtcattagtgaaggaaatggacactgatgtagaattagaaccaacagccgtctgaggaatgcaagtatttatagctctctggagattcgggttaggatacaggggcgatgtttctccaaagaaaagctggtgagtgatagtttcccttttctattagttgcctaagtcagtgaggagattctgtggctatgtggtgccacagaatggccggtgtgcttaccagccatcatgtgaacatgtacagatggaagggtccagaactagtcttagaagagcaagcagaaaaaagaaagtatgcataagattaggaggagaaaacccagagagggtcattcacactccaactacctttggagctgccttcatcagcttctgctgaggaagccgaacacctgagtcctgtaaggtggggatcaggacaggatataaagagacataatgtcctccccagtcctctctttggcatatagttggaaactacccataacttctctgggcacataactactggagggtcagcttttctatctctctc

SEQ ID NO: 109202 - DNA, 1040 bp, Homo sapiens; identical to SEQ ID NO: 109201

SEQ ID NO: 109203 - DNA, 1040 bp, Homo sapiens; identical to SEQ ID NO: 109201

SEQ ID NO: 109204 - DNA, 1040 bp, Homo sapiens; identical to SEQ ID NO: 109201

SEQ ID NO: 109205 - DNA, 1040 bp, Homo sapiens; identical to SEQ ID NO: 109201

SEQ ID NO: 109206 - DNA, 1040 bp, Homo sapiens; identical to SEQ ID NO: 109201

SEQ ID NO: 109207 - DNA, 1040 bp, Homo sapiens; identical to SEQ ID NO: 109201

SEQ ID NO: 109208 - DNA, 1040 bp, Homo sapiens; identical to SEQ ID NO: 109201

SEQ ID NO: 109209 - DNA, 1040 bp, Homo sapiens; identical to SEQ ID NO: 109201

SEQ ID NO: 109210 - DNA, 1050 bp, Homo sapiens
aaaagaagtcagcgtggccgcagaacaacagaatttatgatcagactttcttctgagtgaaaatacatatatctggacattgtaaactttattttgctttgtgttttgtattgcgggttattttacatttttataatctgtgtatccagtagccagacccttcttctcaagactttattcaataaatagaaaatgctacataatcctagattcaaattagggtttgtctttaaaatgtgtctgtttttaatttgctaacagcttttttcccaccatcttccaatccatagaacttgagtattattattaaaagggggttgattttatttttttagaccgacagacattaaaatttctaaacctgcatggaatcaaagggtaacctgaacatattagatttctccaggaaaaaaatatatatgtgtgtctgtgtctgtgtgtgtgtgtgtgtgtgtgtgtgtgtgtgtgtgtgtgtttatgtatgtatgtatatccaatggataaaagtaaaaaggtggcaaatcccagctcagtagaagaacaaactgcctaatagaccatgtgttgtctcagagagttgattctacatcagggattattgtgacaggacaagcagtattagagtaagtgactttagagagtcatttcacctctaaaattctgttccttttgtttagactttcagtaaatagagaatggagagcaactcacatgtacaggtcacttgccctgcactaagctctgaatgaactattttaatccttcctgcataacactgggtttgctactattcaacccattttatcgatgaggaaaactgagggtcatagagcttttgtaatgtgcctggagaaagaagtaaggattcagaacctaagttcagctcactccaagcatcttcagatgatcagagtggggtgtgttgctttctaacccctagttctgggcctggctcccccttgcctgtgccatgagggtagggagcaaatagagctgggcagattgagggaatggctgcattttcttacaggggttgtaagctgggatttt

SEQ ID NO: 109211 - DNA, 1050 bp, Homo sapiens; identical to SEQ ID NO: 109210

SEQ ID NO: 109212 - DNA, 1050 bp, Homo sapiens; identical to SEQ ID NO: 109210

SEQ ID NO: 109213 - DNA, 1050 bp, Homo sapiens; identical to SEQ ID NO: 109210

SEQ ID NO: 109214 - DNA, 1050 bp, Homo sapiens; identical to SEQ ID NO: 109210

SEQ ID NO: 109215 - DNA, 1050 bp, Homo sapiens; identical to SEQ ID NO: 109210

SEQ ID NO: 109216 - DNA, 1050 bp, Homo sapiens; identical to SEQ ID NO: 109210

SEQ ID NO: 109217 - DNA, 1050 bp, Homo sapiens; identical to SEQ ID NO: 109210

SEQ ID NO: 109218 - DNA, 1050 bp, Homo sapiens; identical to SEQ ID NO: 109210

SEQ ID NO: 109219 - DNA, 1039 bp, Homo sapiens
ttgcccgaggaccccattcatcttgattgacaggactgtaaactcaaagactcaacacatttttattgtgcaccaactatctgtttggtattgtgctgggtgctctaacatggggccttaaattatttttcacttaccatgaaactggcgaggaaaaaactcacagaacattggaaaatcctctactaagagttatttatatgtggagagtaatattggttgctcatttctccatgtgaagaacacataagactactttctgttagcaaaatcagacagttctattggctgaagccaaataacaaacagctaagtagaactagtgtcctgtttgtttctgcccagactgcagagtgggatgaacttgcagatatgctttgtcaacgacagtggcagtgataaggacagtgatgctgatgacagtaagactgaaaccagcttggacacccccttgtctcccatggtgagtccaaacagcaccagctgaagctcggtgttgtgatttccgggccatttagcttcttttctgttgtaaggtgaatcaggaacaaacatttcagagattaaagaagaaaagtttcttggaattgcatgctcctaaaatttgacaatgattaaaaagtcaaagttgtaataaaatagagatatataagctttcttaaagttaataactattttcatattaaaccattagagaaatcaccagcctgggcaacatggcaaaaccctgtctctataaaaaaatacaaacattagctgatcatggtgcctatagtcccagctactcaggaggctgaggcgggaggatcagctgagcccaggagttcaaggctgcagtgagctatgatgacacctctgcactccagccggggcaacatagtgagaccctgtctctaacgagagagagtgtattagttcattttcatgttgccgataaagacatatccaagactgggcaatttacaaaagaaagaggtttaatggacttacagttccacatggctaatgaggccttgcaatcatggcggaaggcaaggag

SEQ ID NO: 109220 - DNA, 1050 bp, Homo sapiens
gggatgataatgcctgtgtcagagtatgattgtgaggattcagtgagataaagtattcaaagcacatagcacagtgcttgtagcatggtataaattattaaatagtagctgatactaattttttccatgtcattgatattattgatgttccttgataattcatttgtggctataacattgactcacaacccatattaaagacgagtcaaaaagcttttgatgctggtagtgttgtgttttgatgccagttgcatattaggtaatgtagtgtggatgtagggccccacattgggaaagacacagactgggaaagcttttaatcactgaattgcagtgggtgggtgagtgggtcttttaagagaaaactgggtcttaacgttcagtgtgtttgtggctctgttcactcctccatttcttctcctttgtatcttcagctgccacacatgcctcatataagtgaatgcttgatgaaaagaagtttaaaacccaccgacctgagagacatgactattgggcagctacaagtgatagtcaatgatctccattcccagatagaaagtaagtgtaagatatgcttgaaaataggatattcaatgtaaaacattatgggataatgctgcttccttggtccaactttttcatacaacatttcattgggttcctgtgtgattgcaaggaaaataagagaatcacaaggctcttttttgttgctgttgttttagctgtaaaatgttcagaagctttaagaatttttcaagattcacaatagttataggtcccttctatttattttaaatccccagctcctagcacagtgcatgtacctgacttacaacacctgtttctggaacacagttcagtagttacaagtcatttgctatacaagtatactttctactttagttgtatacacattcatcgtaggtatcatcatcatcaataaaatcaaattagacacatttcctaggactccaggtggtggagtatgtggaaccaatatgtgaaaattacagggtgacaaaatacagacttttcttcccagaataaaga

SEQ ID NO: 109221 - DNA, 1091 bp, Homo sapiens
tatgagccaaacagggaaatgtgaatactaactgaatgttttagtaaggattgatttattttaggtgtgataaaggtgttgcagttatgtgaatttaaaaaagaaaagctggccgggcgcggtggctcatgcctgtgatcccagcactttgggaggccgaggtgggcagatcacgaggtcaggagatcgagaccatcctggctaacatggtgaaaccccatctctattaaaaatacaaaaaattagctgggcatggtggtgggcacctgtagtccagctactcgggaggctgaggcaggagaatggcgtgaacccgggaggcggagcttgcagtgagccgagatctcgccactgcactccagcctgggtgacagagcgagacaccatctcaaaaaaaaaaaaagaaagaaagaaaagaaaagcctctgtcttttagagatacctactgaagcatttacagataaaataatgtgatagctggaatttgctttaaaataatccagtagaagtcggagagagaaatgattcaagcttggccatgagttgataattgttgaagctagttggatacatggaaattcattaaactgttttctctgcttttgtagcagtttgaaaattttccataataaaaagcttaaaacttcatattggaaaaacaattctatgcattaagggttcagatatgtagacactctactaagtgacagtataaaaggctacacaagagcacactggaaaaaatgaaatttttccacaagatccaaataaaaaaaattggacatattcagtgccaagttaacacattgaatattgttttaaaattaagagaaagggtcaaacattttgattaagaaaccatagattcacaggattttttaaaaaaattctacaactgcattttaattttagttgaaaattaattactagagttgctattctttcaaggactaaaagcactttctgatattttaccactaaaacatcttccttagacttttaaacactgaaattgccatctagtccttttcaggaatagatgaaattttagacctctttgtgtgatttttttttttggggggctctctttt

SEQ ID NO: 109222 - DNA, 1091 bp, Homo sapiens; identical to SEQ ID NO: 109221

SEQ ID NO: 109223 - DNA, 1091 bp, Homo sapiens; identical to SEQ ID NO: 109221

SEQ ID NO: 109224 - DNA, 1091 bp, Homo sapiens; identical to SEQ ID NO: 109221

SEQ ID NO: 109225 - DNA, 1091 bp, Homo sapiens; identical to SEQ ID NO: 109221

SEQ ID NO: 109226 - DNA, 1091 bp, Homo sapiens; identical to SEQ ID NO: 109221

SEQ ID NO: 109227 - DNA, 1091 bp, Homo sapiens; identical to SEQ ID NO: 109221

SEQ ID NO: 109228 - DNA, 1091 bp, Homo sapiens; identical to SEQ ID NO: 109221

SEQ ID NO: 109229 - DNA, 1091 bp, Homo sapiens; identical to SEQ ID NO: 109221

SEQ ID NO: 109230 - DNA, 1037 bp, Homo sapiens
tagaaggctctccaaagaaggaacacctcttggcacaatgatgtaaggagttaaccacatggtctacaacaatcccagagaagctcgaaaacatatgtagtgataataatgctcccagcacctaccatagacctcatctcaatgtgtaatgctgggtaaaataattgtctaatgctgcaatgatataaaaaatagttttggtagcaaaataaatgctggaaaaatatgtttaagctttcttttttaagacttacgggcagcactgttttgtatgttttacatattatattgccttatccctagccaaaaacaaaacaaaacagtaagccttctcatactctttgaacatatttgcctgcatctgaaatatcacaataacactcaaataatattattgccatctaaagatgtattcaggcactacaccaccagcaattataaaacatcccttttttgttagtttaagaagtttgcatgcaggtgttaagattatgggaaatcggtggtgaaatatacaatcagggcctacatttttttaaaaaaatatataaattcttgtaaactatgatttacctgtgacagcagagatcttttctctgtctctcagaatagtattgtcatttcttttttggcaagaagaagaggcccctcctcttctctctaagtgttaggctaatacttaggtttgcagtgtatgtttttataactttcagatggtgtgaccatcggaaacagggcaggcaaaaccatggagttaaaaggagaggagtcactaatttaaaggtgttggaggcattctttgaattggagcagtcctaccatgggccccaggggcatgatgtccttgcctagcctgcctcttggtgggaagaagcttctacatctgctcttggctgcagaaaagtaactttcctcattggagggacctgaggatacttaaacatccctaaaggcagcagccccagagtcctgcagccagatctcagaaggcggagggggtggctgtggggactgctgggacatgtggtccacctctt

SEQ ID NO: 109231 - DNA, 1037 bp, Homo sapiens; identical to SEQ ID NO: 109230

SEQ ID NO: 109232 - DNA, 1037 bp, Homo sapiens; identical to SEQ ID NO: 109230

SEQ ID NO: 109233 - DNA, 1037 bp, Homo sapiens; identical to SEQ ID NO: 109230

SEQ ID NO: 109234 - DNA, 1037 bp, Homo sapiens; identical to SEQ ID NO: 109230

SEQ ID NO: 109235 - DNA, 1037 bp, Homo sapiens; identical to SEQ ID NO: 109230

SEQ ID NO: 109236 - DNA, 1037 bp, Homo sapiens; identical to SEQ ID NO: 109230

SEQ ID NO: 109237 - DNA, 1037 bp, Homo sapiens; identical to SEQ ID NO: 109230

SEQ ID NO: 109238 - DNA, 1037 bp, Homo sapiens; identical to SEQ ID NO: 109230

SEQ ID NO: 109239 - DNA, 1003 bp, Homo sapiens
ttgattctaatctatttcactgtcagtaactctgaacttcagtttgcaggatgctgtagctattgattgaaaagcagtttggatctctctacatgatgctaaataattgtattaattgttttacagacatgctgaaagtcagcagaagcacatggcagagaaaatgcctgcaaagtgaaaagaagccattcaaccagagaacaagctagaatttattttgcttctgtggttgtaaaaatgctgttgctaaaggtggcgcagaaacaaatatcagtgttagtcattgataatgtctgaagcttaatgtccagtgattggcctttgcttcttaatttattttaattttttacttgtgccacttaatatcaggcattttaataaaatattgttacaaaaaatgtacagtactgacaccaccacaaatcatggttaataaaagagagtagttttaactttatttttatttgtttagagattttaagttggaacagtattttcccattgactacttttcattcttcactgtagttttaaagaagaactgtaaatgacggtgctatacaagtcaaaaaatacatgcctgcctcgtagtgaagttgtagctctccgtaatatgtatattttactcagttttcaacattttgtgaatgttgactacctgaagttcctttttagatgtgctattaacattctgttggattcagagggttccttgaaagttttatgtataaatatgtaaaataaaaattaaaactttgtttcatatcatatgtctttttgctcactaacaaggcttatactggcttaacccttctgcaactaaattccccaccaggaaacttttatcagtgaaaaaacaaattgctccagaggacacacaagtggcaaattgcccagaaaattatgagcgtgagtgcgtgtctgtgagtatgtgtgtgtgagagagtgatccgaagaacaccaaaggtcagtagcatcagagcctgcacttctattattgctt

SEQ ID NO: 109240 - DNA, 1050 bp, Homo sapiens
gattgttcaataactgaggaggtatttatatttatttgtcttttattctaatatttttaccatgcattgaacgcaacaggagggtatttcagcaaattcacgacaaggtaatcgtcttatcactttttgtaggccattaatggtcaggaaattgcccatactctgtcattattgtttaataaatcattaaattatttcattaaaaaagaaaaacaggtatggtcaaacgaggaagcatatgtgacataaaaaacatgaaggatatcttattttcactatttgagaagaatatattttatttttagtactgtggcataatatataactttttataataataactgtatgcattatgtagtatagcttttaattgtatcattcatcacagttatatgtaaaaataattgacatgtatatgccataccatgaagcatatgatgttgtgcactttctcctccatttttcatttggaatacattccacaacatgatccaaaacataagaacttacgacttgtaactcgtttaaagccattaattgtgcagtaatgtgctacaggattcaatcagcttctcttaagaaacaagtgtcattgtatcagtttcctgttctgtgacacgccctttaaaagtaaaagataatataacatattttaatacattgtgtgtaatgtacatatgcatattgtctatgtactatatacacattgtttataatattgttattacagtttgtcattcacctgaaaggagaaggaaaagtacgaaaggtttctctgcttgggaaaaggtgaatgttgttatatcaagaacgattacacacatggatctcatacatgtttttagaacattgttcttctgattgaagaagtctgatgctcctgaaaaatcttaaaatatctgacttgtattgaagaaaattatttaattaaatttttaaaggctggttgaaaaagtctgacagttctgagaattttttaaatgtctgaattgtaataaaaaaatggtttactttaaacttctaaaaactaatgaccttgtgactaaagaa

SEQ ID NO: 109241 - DNA, 1062 bp, Homo sapiens
taagcacattttattttcactgacttctcaagagtagggaaataatggtcctgcatattgtaatccatctggaatgcaaaaaacatgattgattttctaaatttaggtgctagatatataaatatgtatattgtgtatgtacagttggttctcctgtatctgtgggttctgcatctgcagatgcaaccaactgcaggtagaaaatgtatttttttaattttttgaaaatatttttaagaaagaaaatataacatttaaaactgcaaattaatacgttatagcaactatttacataacatttatattgtattaagtgttataagtcatctagaggcgatgtaaagtatatgggatgatatgcataggttatatgcaaatactacaccactttatatcagggagctgattttgacctttgcagggggtcctaaaaccaatctctatggatacctagggatgactgtagtgtgtgtgtgtgtgtgtgtgtgtgtgtgtaatcaccagttgattacaagcaatttgttatgggtgttcaatatcataaccaaggggaaaatgtcttcttgagatagaatgatagttttaagaggccattaattgctacattctgcaaatgtgagtatgcttcaaccatggaaaatgggcattggcaattatgtcaaagggcatgaaatgtactctataaggaaaacaagattcaattgtaaaggccagagggaatattaaggaaacggactcagttaacaatttgaaaggcaatatgctaagtaccttaatgttgtactttttgtatacagtttctctcaagtggaattaataaaggaaacaattcaaagctgaaactcatataaacatgaatatgatgtctagatttatacaatattctgatctgacttttattaaaaattttatgaattgtaattaatttgggtttccagcttgagagaaataatgatgtatgttgagttttattttgagcaacaaacattaaccatctcttcaaaagtgtaagtttcctaaaccaatcaatagtagaatatttggcaagttcatatctgacct

SEQ ID NO: 109242 - DNA, 1036 bp, Homo sapiens
cttcttaactttgatgctctctttttctctaatcttttgatgctctctttttctctaatcttttggaagtcacacagtctatctgtttactcttagttactttggagtaaacaaaaatgtcttacactatctaagcatatttcttcttttttttttctattgcagctccaaatagattgggagaaaatcaaagccaaaattgagatggaaattacaaaagaaagagagcaatcatcaagcagccaatccagcaagagtataggtttaaagccctaaatgccatgcgtatctttaagaaattttatcttttgaaacacgttctgattaaccaagggtaagcatgttttggttgctaaagaaaaaagcataatctttaaccgagtataagtacttgctgtgtatttagtgtaaaagtacatgcagaaagatgaaacacaaagtaattgatgtatttctatcttttatattttttagtccaataattagcaaaatattactatgtacttaagagatacctgtgtagtgtcgattatatgtcagttttttgcccattacttcatccctaaatcttcagcatgaacaaatattaatgtcgataataaaacattggactctttgaaatgtatgttaccattaatttctatttgacctctaaattgtaaaatgcctccaaaagtttatttatagaacaaaaatacatgaggatggatttgtacaaatgtataaaatgccactatttatacaccaagttcatagcagcattactggaatagcaaaagatggaaacagctcaagtgtctatcatgaatggataaacaaatgtgctataatacatacaatggaatattatttagctttaaaaaggaatgaaattctgataaatactacctcaggataaaccttgaaaacactatgctaagtgaaataagccagacacaaaaggccaaatatgatgccacttttatgaggtaccagcataggcaagttcacagaaacagaaaggagaatagtggttgccagggactgcagggaggag

SEQ ID NO: 109243 - DNA, 1098 bp, Homo sapiens
gacattattggatctttggacaaacattgcatctttgtggtgtactttaacatagtcctctgtcccctgaattagttgcatattggttgttgaatctaggaacttgattagatttaggtttttttttttttgataagacttcattatagtagtgttagatgtttttgtaatgactggctgtagtggtttttcatggtattttttgtgatgttagtagccattgatgatcattgcccaaatctattaatttgagcttacaaaatggtgatattctatcattccagaaggatagaatttgttagatgctaaatacattagattgcttttaatatccctgaatctctatatttgtttaaatcctctagaagggaacagattttgttttgttcatatgtgatattccacttgagaagcatagtcttgctggtttatgcttctgtctttcatgtttgaatttgaaaattgcctgcaacctaataaggtacagctcttgaagagttataggtaagcaagttatctgtttgctatccactttggacatttggtagtagtctgttctcaaaaactgaagttaagagaggtagaaactagaaactctaaatatgcatgttaatcctttatgtgcatattaataaaaataatttctgatctcagttatacaaagtgatttcgcttcattcaagttatgcaaaaatcatattttgaagttataacatctttttatataacttccttctatttaaaatacatggatttattccagccttagaatctaatgtcacatttgtttggttgccaaataaccattttaaaactagagacatactgttcccaaaacccttagataatttggagtaagttccctcctaaatgtggagaagaaacatttttttacccagtatgtgcttttagagaacatttaaaatagcacatatcatttgaatgtttacccttagccattgctattcaatcgatacatattttattataataataataatgacaatgatagataattcttaggatctagcatctaaatgcaggattagacatcatattctattctttctacataattaaatgtattgatgtttcata

SEQ ID NO: 109244 - DNA, 1041 bp, Homo sapiens
tgttctgtctgtcttaaaatcaactcttgattatctttggaaaatatttaatcttgaaatatctgccccgttttattacaggagctgatctccccaactatcagttagataaatcattgctaagcagcccctaaaaagaaaaacactttagaagtaatgctaaaataatcatctactttaaaaaattattttacagactgcaccttatttgcgtgtatgccttttcctccactaactctaaaaattagggggcttactggagatacggagaggatagttctgaaagcctccctcaagagtttagggaaattctcagactgggagcttagcttagctcccaaagcaagtgtttgtgacaaatataggttcttcaagacttctccatagttctctggtattctggaactttgagttgaatattttacaataaggccacaaatttgtaacaccgtattgatgacttatggagaatctcacttgttagtaattaatctttttctactccaactgaatgtactgtaattcaattcagacactgattactcagagttagtgcgatgccaaaagttggctggacatggtggcttacgcctgcaatcccagcattttgggaggccaagatgggtggatcacttgagctcaggagtttgagaccagcctgcgcaacatggtgaaaccacatttctacaaaatatacaaaacttaggcaggcatagtggcacgcccctgtactcccagctacttgggaggctgaggtgggaagatagcttgagccctcttgaggcagaggttgcagtgagctgagatcacgccactgcaccacagcctgggcatcagagcaggaccctgtctccaaaaaagaaaaaaaaagttaaggacaaaggcctgccaagactgacctcacttcagatgccagcactagttttgtgggggtgggggttcccaagggcacttgcatttctgaccaactggctaaaaatttggggaccccatcagcccctcaagttcaataatttgttagaatgactcagaactcaggaa

SEQ ID NO: 109245 - DNA, 1047 bp, Homo sapiens
aattaataattactaaatcagtaattagtaatcactaattattagcagtaatttatttattttgctttgtccatgtatttacttactgaaatgattatcagattctttgcattagccaagattagttgcctaccagtttgcttactcactgcttccttccccttccctccttcatcttctggatttgaacgtgggatttaatctgaggtagagaattggctttatgaaaattactgagaaattcagaatatataggagtaataaaacttattttaaactgtggaacaatttttattatttaaggatgggtttttctgtttgtaaatgttctctttacccaccccgatctttgattcatgttaccctataaaaacaaaatgatctgtttgttcatttattaatccatttattcaataagcatgttcatggcttacatttatatagtattttagagtttacagaatgcttcacagaaatcttttcatttcaacccaacaataacattgggaggcctgcaggaaaaataatcatgttcatcatattactgttattacagtttctgtttttctggtacctgctttataacaggtcttttgccagacaaaatgtaagtcatcattatccccattttacaaataaggaagctaatgcttagcaggttaagcttgttaagatcaagtgggcaggcacagtggctcatgcctgtaatcccagcactttgggaggcagaggcgggtggatcatgaggtcaggagatctagaccatcctggctaacacggtgaaaccctgcctctactaaaaatacaaaaaattagccgggtgtggtggcaggcgcctgtagtcccagctactcgggaggctgaggcaggagaatggcgtgaacctgggaagaggagcttgcagtgagccgagattgtgccactggactccagcctgggcgacagagcgagactccatctcaaaaaaaaaaaaaaaaaagaaaaaatcaagtggctgacaggtggtgaaaccatatttctaatccagatatgtctaacaaaaagcta

SEQ ID NO: 109246 - DNA, 1086 bp, Homo sapiens
gtgagactaaacaatcgcaattgtttttgtttgcccaacttagaattttacagtttccttagaggcttctttggcttttggtttatccgtgtttcattaactcagaaaccagagatcatgttgagtcatgattgttaaatctacaccttgacctgctggtgctgttttcctacagtagacttatttgccctaccgtctctctgaacctcagcttttgtgggacatgatagcctgtagtgaaaaagtttcttaatctgcctcttgcctccaggaagcagcccagtggataattctttccaaaagagatccttgatgtctctgttagaaggaagtgcctaggagggaaagcgtgcaggtacaaagggtgaggcatttctagtgtcccaaagttacctttgtttctctcctgccactctaactttaggatggggtataaatttggcttttaatagtcatcaaagttcaaaagtgtcttaattcttacaggacattttatgtcttgtaaaaataagagctaataatagagtaatattgaagatgaaatgagataatatatgtaaaacaaaaatgatagctattgctatgattatgattatagctataggattaaatgagtgttttgcaaatgtgcaaacagaatgtttagacttatgtcaatctgaggagtctaaatattgtgatcatatagaagaattaggtgatgcgaatatcaggaaattaatcctggagctgccctgagttgaacagagtaataggtgtattttaaaattcagcacagaggccgggcacgatggctcacacctatcatcccagcactttgggaggccgaggcgggtggatcacaaggtcagaagttaagaccagcctgaccaacatagtgaaaccccgtctctactaaaaatacaaaaaattagccgggcgtggtggcttgtgcctgtagtcccagttactcagaaggctgaggcaggagaatcacttgaaccctggaggcagaggttgcagtgggctgagatcacgccactgcactccagcctgggtgacagagcaagactcttgtctcaaaaaaaaaaaaaaaaaattcagcac

SEQ ID NO: 109247 - DNA, 1025 bp, Homo sapiens
tggctcatctttgtctctccttcagggcctctagcccagtgccttgcctttaatatattaataattagttgaagaaaggtacaaggagaagatcaaagtaccatgtgccaatgcaaatcctcaaaaagaaggattcgaccttcctcttattccttttgcctgtatcaattgcctctatcttcagtattcataattcatattattactataaaaatttagaagcatgggcaggtctattcaaatattctgttagcccacatatccagattttaaaatttggataatattgtcactagattactaataattcggtatattatactttttctttattctgtttatttattttaaaattataaaactttttatttagataatttaaaacacacacagactagtatactgaatccccatgtactcatcacccagccccagtaatcactagttcatgcttaagcctgcccagtccatgtcctatctactttccttgctccccaaattcagacattgtatttcatttataaatattttagtatatataactaaaagataaggactctgttttaatataaccacactaccattatcatattatataataataataataatttcttaatattatcaaatatccacaaagtgtttaaatgtccagttgtttcctacatgccacaaaactttgtttgaatcaggatccagttttacatattgcaatggctgatgtatcttttaagtctcttttggtctgaagagtccccttctatctctgttttctgtcctgcattttgtttgttgaagaaccaagttatctgtctggtagagtttctcagtctggactgggctgattgtatctccatcatgtgatttgacatgtccctctatcttctgtgtttcctttaagaaggatgtaggatctagatgatggtttaatgtatatttcttctaattaacctgggatctaaaccattataatattctgtatatgacatagaatccattgtgagttctaatcaactaattggggt

SEQ ID NO: 109248 - DNA, 1103 bp, Homo sapiens
taagaggactaaagagtccttagttcctcattctgtaccccaaccgtgccttttaccacaactaaagccttaaagtcacatcctgtataactcaatgggagttgtatttactgaattatttccttgagggtagatgtttgtcacagtttggtatacacgccaggaaagtataattttactgagtgtatttatgaagatttgataggctataaattaaaacattaatttacttttttgtacaaaaattataactataataatggaaataaagatggcttatataattctacaaccttagctagtaagtccctgtcactcctttccagtcctcaccaagaactacatttgaaatatctgaaattttgacttctatttttggggagtttattaaggttaaacttcgttcatttggagatttatttttgaagtacaggtcaactcctggctactcccagagaatattcccagaaaatatactcatcaagtacagaaaaaggaggagtaccttctgaggttggccatctcatcaggaagaatttctgtgggttcctttgatacagaacaatccttgatgtcattgactaaacaggatatttagacattttataacacctgaactgtggaagacatgtttcagggttttttttttttttttttttggactgggtctagattagactttctaacctgtataaaccattgggacttgctcacaattgaattgtgtttttattagggagaaaatagcacacaaaaagtagggtacctcttaaacaaaagcatttgtcttactgaaatttattcagtaagacattgatttattgattatatcatcagttgggcttttcatttgaataaacaattaaattttattgattgcccacaaaccctgaaattcagatttcattctactaagaatgtaaattccttaatgattcattcatttattcattgattcgttgattcacagaaagtcaattactacaatagtctgatttaggagtcctagacaatttttaaaagatggttttgtaaatatagttgggttactatttcatagattaactacataaccttgattcacctgcctaatgactaggcag

SEQ ID NO: 109249 - DNA, 1054 bp, Homo sapiens
cacttgagaggctgaagtgggcagatcacttgagcccaggagctggagatcagcctgggcaacatgggaaaaccccatctgtacaaaaaatacaaaagttagccgggcatagtggtgcatccctgtagtcccagctactcagaaggctgaggtgagaggatcatctgagcccgtgggcgttggggctacagtgagctgtgatcatgccgctgcactccagcctgggcaccagagtaagaccctttctcaaaaaaaatcaatcaatacaaattaataaataaataattgtaatacaaaggaatgtgcttaaggtgctgttggtggcaggtgggagtggaccagagggtggagattaatgttctggggagagtgaatgtattgggaagggttcctggcaaatattgcagcatcttttgaactgggctttgaagaatgaagaaatgggaaaggaaatgggcttgttggcattggagtgaagctgttaagaagcttagcatcataagaggcttagagacagaagaccgtgagacctaaaagtcaggtgagtgggagctaactccttgggccagagtgtaggccgtgtgaaggatagtactgccaaggggaccaaaacactgacagtcctggatgttaaaagaaggggtttggcatttattctataagcatacaaaacctttaaaaaattgaccaggaaagtaaagataatgccaatcttttagacagattcccttttcagtaataataaagttaaactagaggaggtagagattaaatagaggtggccagtaagatttcaaattgtctatgctagtaaggcagcgattaaggcttgaatagaggcagtgacaacagtagttggaaaagtggatagttctcagagactgagagggatgtaccctgtaagagtaaagacttcaaagagggataaattaggaaatatatgtggagggatgatggttttggatatgtagaacttgaagctctgtgatggagatctctttggatcaagtagaaatgtgttggagctcagaggtaaaggctaaaatattaattt

SEQ ID NO: 109250 - DNA, 1002 bp, Homo sapiens
agtaatctcttatattttacactgttttgtctttctttgcttggtacctgatgtaccatggtaacactattatttcaagccaagaaatataggaaatactcaagggcttttttttatgttagtgaatctctagaaaggcagttacaagctaaatattttcaaaaaataattgtgaaacgtttgaagcatatcttatatagaattggaggtctagttaagtaaatcatagtacgaaaagatattgagtatctccttacttaaaaatccccgataacttcataatattaacaccctttccaaattaagttgtatgtttgatttctatactgatggaggggaacagacacactaagaatctgaaaccacactatttagaggagcatcttaattttttatgttaatagaaaggagtggccataaagtcaatccaatggtccttcctattggaagttagattacatatgattttttctgtgtaacagattttcttaattagattttacataggaacagtaagcagttttaatgtttacctgagtatgtatcagctgatctttaggttgccaaaaaacttgctgactattcctcagaactatttgataaagtcatattgtgaaacattttcgataactgacttccaaaaatttccaaattttatttttaaaaccatgtttacttttaggataaggttcaaatcacttgcatttctttagctgtatattaactgaatgttagcaaaggtaaccagaaatactaagtagtatttcttttctaagcttaaatgtttgctacagataatctcaaggcagaatatttattcatgagtagaaaattcagagttcatagaagtagccgtgggtaagtttcagttaacagcaaaagtcaacttattgttactttagtaataaatgtacctttagaacataaatcttactttaatctcctagtaggcagatggatttacttttggcttcatagatttttcttttaagactcattatt

SEQ ID NO: 109251 - DNA, 1010 bp, Homo sapiens
gcaaaagaatacatgcttattttaataacttacatgatacagacatatataaagaaaaaagtatagttccctttgctccctacctatcccccaacagttcagtgtagattctttgataccttttgatctactaagtctcttttgtataccttttggctttgtgtatagaatattgtataacacaagttttaaattttcatgtggtcagatcttttctcccccaccttttggcatctggatttctttcttgctttccatttttacaattcttttaatagatgcttattttcttttatatagaaaaaaataccagtcataaaatggaaaatacatttagaatcttgaaaccatttgaccctattttacttataccttataatctgcatctgtgaattattcattaagattaaagacttttgtatgttttatgtctctttaacatggtgacacatcaagaattagtaagctgtgtgggctggactactgctgaagagctgtattcatgtagtgatgatcaccagatagtgaagtggaacttgttaaccagtgaaacaactcaaatagtaaagcttcctgatgatatttaccctattgattttcactggtttccaaaaagtttgggtgtaaagaaacaaacccaggcagaaagctttgtcctcacaagttctgatggtaagttttaaataaacattatatgctcgccattgtatttaaaagacttaatagtatgatttatgctttgagttgttttacaaaactggtatttgtggatctgcatatttttatccacatattgtatttcttttctgaatagtcacttggtttgtgtatgggctatgaaattattgtcatggaagaaagttagtttaactggcatatactaggattgaatatgggtctttggctttaatatatatatatatatatatatatatttagagatggggtctcactctgttgcccaggccagagtgcagtggtgtgatcatagctcactgtagcttcaaact

SEQ ID NO: 109252 - DNA, 1041 bp, Homo sapiens
tcttattttaaaattcttactgacgtttttcttactctacttaagtactatacttaaatacttaaaaagcagtttttgtttactttagtaggatcttaaaaagaagctttttttttttttttttgagacagagtctcactctgtcacccaggctggagtacagtggtgtgatctcaactcactgcaaccctctacctcctgggttcaagtgattctcctgcctcagcctcctgagcagctcagattataggcacccgccaacatgcccggctaatttttgtatttttagtagagacggggtttcaccatgttggccaggctggtctcgaactctcgacctcaggtgatccacccgccccagcctcccaaagtgctgggattacaggcatgagccaccgcgcctggccaaaatgaagcattttttaaaccaaactgtttctttgctagtgtgatctagcatgtattcattccactgtgctctatttctttacattcatgataaagtgaaggacaagttggggaaatctgagcagtcagatcctcattatttcacatgggaaggtggcaattaataatattttctcaaacacatgaccctatattttgtcagcaagagtccccagttatgtgtcaaggagatatgacaggccccactatcatcattcttagacatttagactaattctgctcaaagtatcctttgtagactttattgcaggtctgtgaaagaataggtaaataaattgaaagtaagggctgagaaatttttgtagcaatttgacattgttataatgtccaatttttctaatattttatttttattgtatcttacgaaatatccatatgcaatggattcgaaataaagaaaaatctggtccttcatcagaactaggaaagcactgatttaaacatttggtcagacattttaaattggtaggtgttttcatttatattatcttgtttgcttatttaactattaagtgaagatgtaattatttttattcccccttaaatagtttttactgtcttttcaaaaaaaat
